US008673560B2

(12) United States Patent
Leamon et al.

(10) Patent No.: US 8,673,560 B2
(45) Date of Patent: *Mar. 18, 2014

(54) METHODS AND COMPOSITIONS FOR MULTIPLEX PCR

(75) Inventors: John Leamon, Guilford, CT (US);
Mark Andersen, Carlsbad, CA (US);
Michael Thornton, San Francisco, CA (US)

(73) Assignee: Life Technologies Corporation, Carlsbad, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 13/618,805

(22) Filed: Sep. 14, 2012

(65) Prior Publication Data
US 2013/0011881 A1    Jan. 10, 2013

Related U.S. Application Data

(63) Continuation of application No. 13/458,739, filed on Apr. 27, 2012.

(60) Provisional application No. 61/479,952, filed on Apr. 28, 2011, provisional application No. 61/531,583, filed on Sep. 6, 2011, provisional application No. 61/531,574, filed on Sep. 6, 2011, provisional application No. 61/538,079, filed on Sep. 22, 2011, provisional application No. 61/564,763, filed on Nov. 29, 2011, provisional application No. 61/578,192, filed on Dec. 20, 2011, provisional application No. 61/594,160, filed on Feb. 2, 2012, provisional application No. 61/598,881, filed on Feb. 14, 2012, provisional application No. 61/598,892, filed on Feb. 14, 2012, provisional application No. 61/625,596, filed on Apr. 17, 2012, provisional application No. 61/639,017, filed on Apr. 26, 2012.

(51) Int. Cl.
*C12Q 1/68* (2006.01)
*C12P 19/34* (2006.01)
*C07H 21/02* (2006.01)
*C07H 21/04* (2006.01)

(52) U.S. Cl.
USPC .......... 435/6.1; 435/91.2; 536/23.1; 536/24.3

(58) Field of Classification Search
None
See application file for complete search history.

(56) References Cited

U.S. PATENT DOCUMENTS

| 5,582,989 A | 12/1996 | Caskey et al. |
| 5,814,491 A | 9/1998 | Vijg et al. |
| 5,882,856 A | 3/1999 | Shuber et al. |

(Continued)

OTHER PUBLICATIONS

Stiller, M. et al., Genome Res., vol. 19, pp. 1843-1848 (2009).*

(Continued)

*Primary Examiner* — Teresa E Strzelecka

(57) ABSTRACT

The present invention provides methods, compositions, kits, systems and apparatus that are useful for multiplex PCR of one or more nucleic acids present in a sample. In particular, various target-specific primers are provided that allow for the selective amplification of one or more target sequences. In one aspect, the invention relates to target-specific primers useful for the selective amplification of one or more target sequences associated with cancer or inherited disease. In some aspects, amplified target sequences obtained using the disclosed methods, kits, systems and apparatuses can be used in various downstream processes including nucleic acid sequencing and used to detect the presence of genetic variants.

9 Claims, 53 Drawing Sheets

(56) References Cited

U.S. PATENT DOCUMENTS

| | | | |
|---|---|---|---|
| 6,207,372 B1 | 3/2001 | Shuber | |
| 6,251,588 B1 | 6/2001 | Shannon et al. | |
| 7,101,663 B2 | 9/2006 | Godfrey et al. | |
| 7,118,867 B2 | 10/2006 | Tabiti et al. | |
| 7,217,515 B2 | 5/2007 | Chiu et al. | |
| 7,670,774 B2 | 3/2010 | Moon et al. | |
| 7,687,247 B1 | 3/2010 | Hartley et al. | |
| 2008/0228589 A1 | 9/2008 | Koehler et al. | |
| 2008/0293589 A1 | 11/2008 | Shapero | |
| 2010/0129874 A1 | 5/2010 | Mitra et al. | |
| 2011/0212490 A1 | 9/2011 | Fredriksson et al. | |
| 2011/0319290 A1* | 12/2011 | Raymond et al. | 506/9 |

OTHER PUBLICATIONS

Longo, M.C. et al., Gene, vol. 93, pp. 125-128 (1990).*

Cross, Deanna et al., "Development of a fingerprinting panel using medically relevant polymorphisms", *BMC Medical Genomics*, 2:17, http://www.biomedcentral.com/1755-8794/2/17, 2009.

PCT/US2012/035612, International Search Report and Written Opinion mailed on Jul. 25, 2012.

Varley, Katherine et al., "Nested Patch PCR enables highly multiplexed mutation discovery in candidate genes", *Genome Res.*, 18:, 2008, 1844-1850.

PCT/US2012/062494, International Search Report and Written Opinion mailed on Jan. 17, 2013, 1-11.

PCT/US2012/065650, International Search Report and Written Opinion mailed on Jan. 23, 2013, 1-12.

Stiller, Mathias et al., "Direct multiplex sequencing (DMPS)—a novel method for targeted high-throughput sequencing of ancient and highly degraded DNA", *Genome Research*, Supplemental Material, 2009, 1-15.

Meyer, Matthias et al., "Illumina Sequencing Library Preparation for Highly Multiplexed Target Capture and Sequencing", *Cold Spring Harbor Protocols*, vol. 2010, protocol5448, 2010, 1-10.

Buck, et al., "Design strategies and performance of custom sequencing primers", *BioTechniques, 27*, 1999, 528-536.

Dieffenbach, C. W. et al., "General concepts for PCR primer design", *Genome Res.*, 3:, 1993, S30-S37.

* cited by examiner

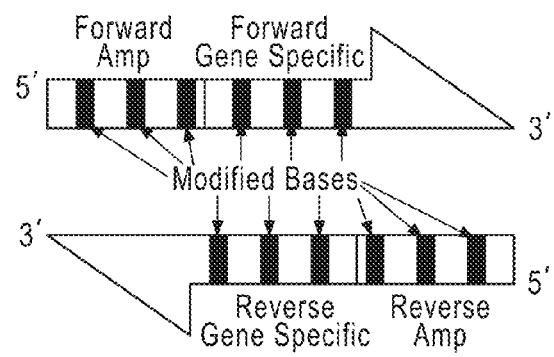
FIG. 1A
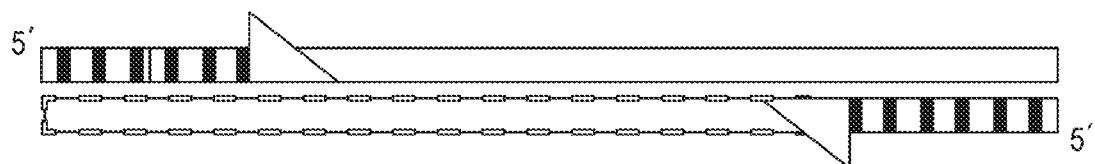
FIG. 1B₁
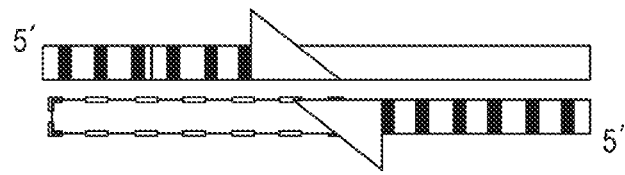
FIG. 1B₂
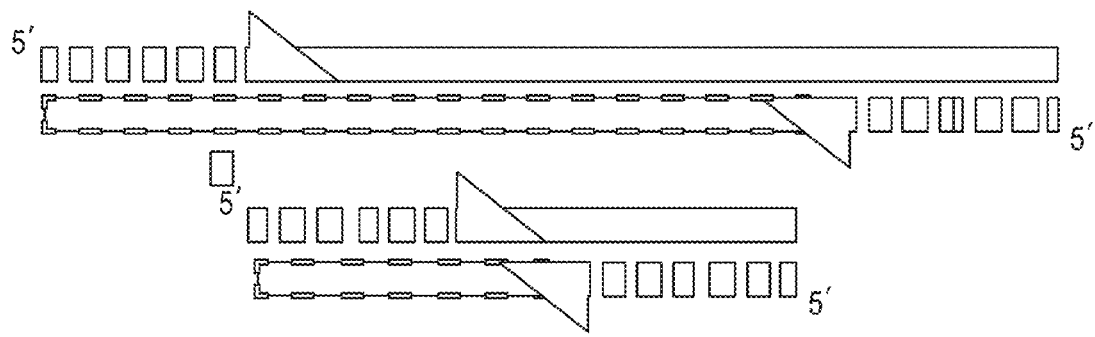
FIG. 1C₁

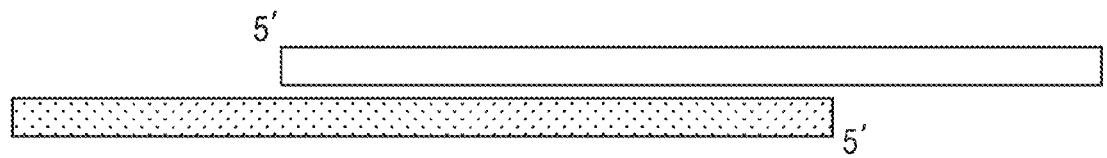
FIG. 1D₁
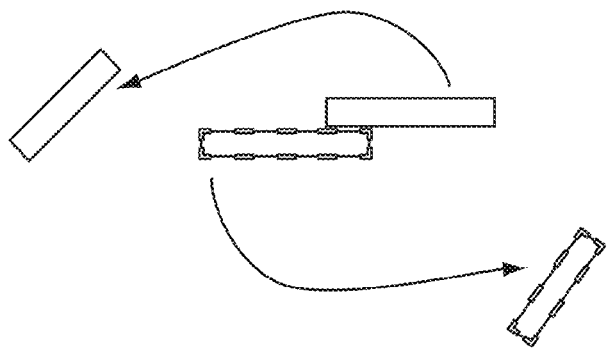
FIG. 1D₂
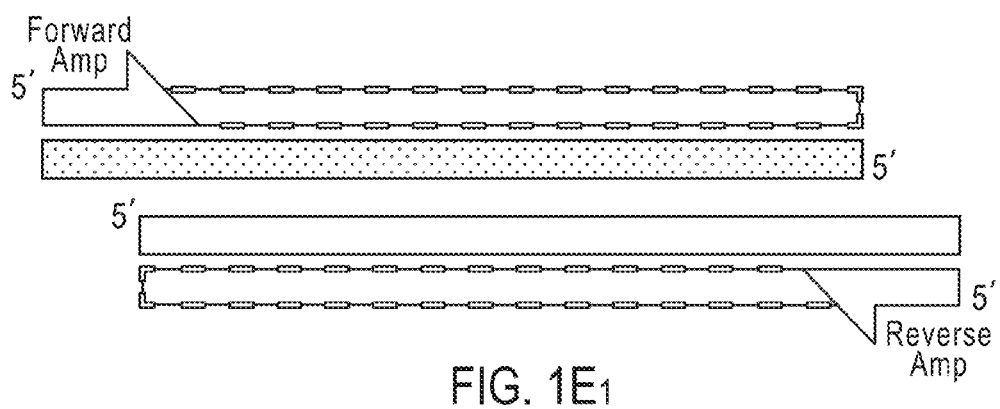
FIG. 1E₁

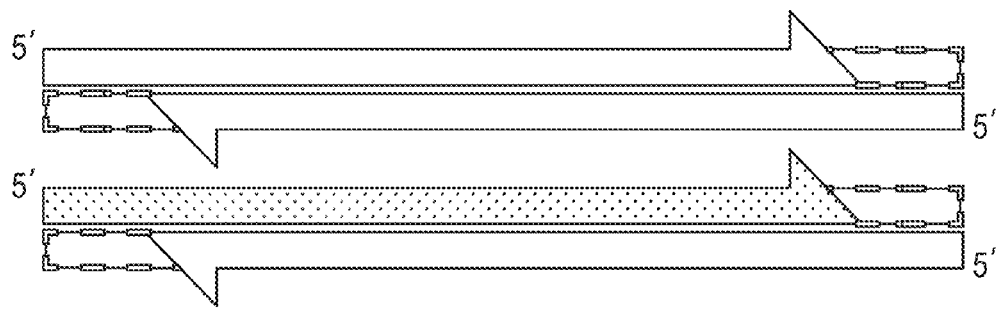
FIG. 1E1i
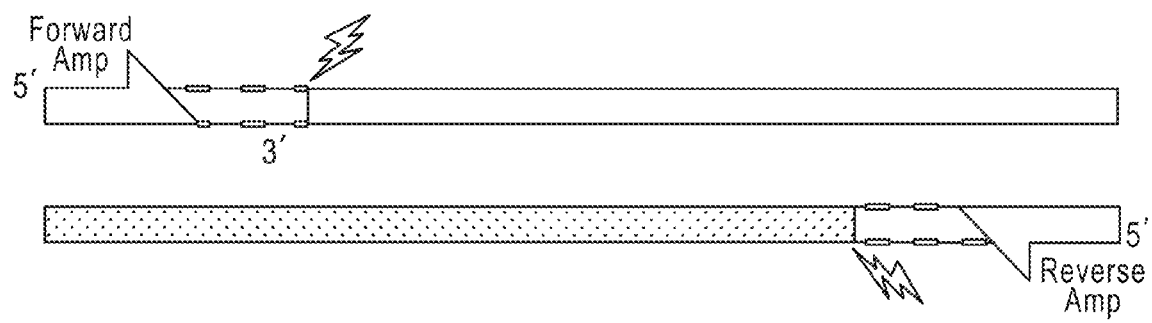
FIG. 1E2

FIG. 13 (Part 1)

| ΔF508 | | c.2562T>G | |
|---|---|---|---|
| CACCATTAAAGAAAAATATCATCTTTGGTGTTTCCTATGATGAAT | | CGATATATTACTGTCCACAAGAGCTTA | |
| CACCATTAAAGAAAAATATCATCTTTGGTGTTTCCTATGATGAAT | | CGATATATTACTGTCCACAAGAGCTTA | |
| | | | |
| CACC▲ | | | |
| CAC▲ | | | |
| CACCATTAAAGAAAAATATI | | | |
| CACCATTAAAGAAAAATATCATI | | c▬ | |
| CACCATTAAAGAAAAATATCATCTTTGGT▬ | | | |
| CACCATTAAAGAAAAATATCAT---TGGTGTTTCCT▬ | | CGATATATTACTGTC▲ | |
| CACCATTAAAGAAAAATATCAT---TG▲ | | | |
| CACCATTAAAGAAAAATATCAT---TGGTGTTTCCTATGAT▬ | | CGATATATTA▬ | |
| CACCATTAAAGAAAAATATCAT---TGGTGTTTCCTATGATGAA▲ | | CGATATATTACTGTCCACAA▲ | |
| ---iCATTAAAGAAAAATATCAT---TGGTGTTTCCTATGATGAA▲ | | CGATATATTACGGTCCACA▲ | |
| ---iTTAAAGAAAAATATCATCTTTGGTGTTTCCTATGATGAAT | | CGATATATTACTGi▬ | |
| ------------AAATATCAT---TGGTGTTTCCTATGATGAAT | | CGATATATTACGGTCCACAAGAG▲ | |
| ------------AAATATCAT---TGGTGTTTCCTATGATGAAT | | CGATATATTACTGTCC▬ | |
| ---------------TATCAT---TGGTGTTTCCTATGATGAAT | | CGATATATTACGGTCi | |
| ---------------TATCAT---TGGTGTTTCCTATGATGAAT | | CGATATATTACTGTCCACAAGAGCT▲ | |
| ---------------TATCAT---TGGTGTTTCCTATGATGAAT | | CGATATATTACGGTCCACAAGAGCi | |
| ------------------TATCAT---TGGTGTTTCCTATGATGAAT | | CGATATATTACTGTCCACAAGAGCi | |
| ------------------▼ATCATCTTTGGTGTTTCCTATGATGAAT | | ------▼TACTGTCCACAAGAGCTTA | |

FIG. 13 (Part 2)

c.1408G>A c.1-8G>C

```
[TCACTTCTAATGGTGATTATGGGAGA
[TCACTTCTAATGGTGATTATGGGAGA

[TC▲
[TCACTTCTAATGATGATGAT▲
[TCACTTCTAATGATGAGATTATGGGAGA
[TCACTTCTAATGATGAT▲
[TCACTTCTAATGATGATTATGGGAGA
[TCACTTCTAATG▲
▼CACTTCTAATGATGATGATTATGGGAGA   GGACCCCAGCGCCCGAGAGACCATGCAGAGGTCC
---▼CTTCTAATGATGATGATTATGGGAGA   GGACCCCAGCGCCCGAGAGACCATGCAGAGGTCC
-----▼TCTAATGATGATTATGGGA▼GA
--------▼GATGATTATGGGAGA           GGACCCCAGCGCCCGAGAGACCAT ̄
-----------▼TGATTATGGGAGA          GGACCCCAGCGCCCGAGA ̄
----------------▼ATTATGGGAGA       GGACCCCAGCGCCCCAGAGACC ̄
------------------▼TATGGGAGA       CCCAGAGACCA ̄ ̄GCAGAGGTCC
------------------▼TATGGGAGA       ATGCAGAGGTCC
------------▼TATGGGAGA             ̄AGAGGTCC
----------------▼AGA
--------------------
--------------------
--------------------
--------------------
--------------------
--------------------
--------------------
--------------------
```

FIG. 13 (Part 3)

FIG. 20 (Part 1)

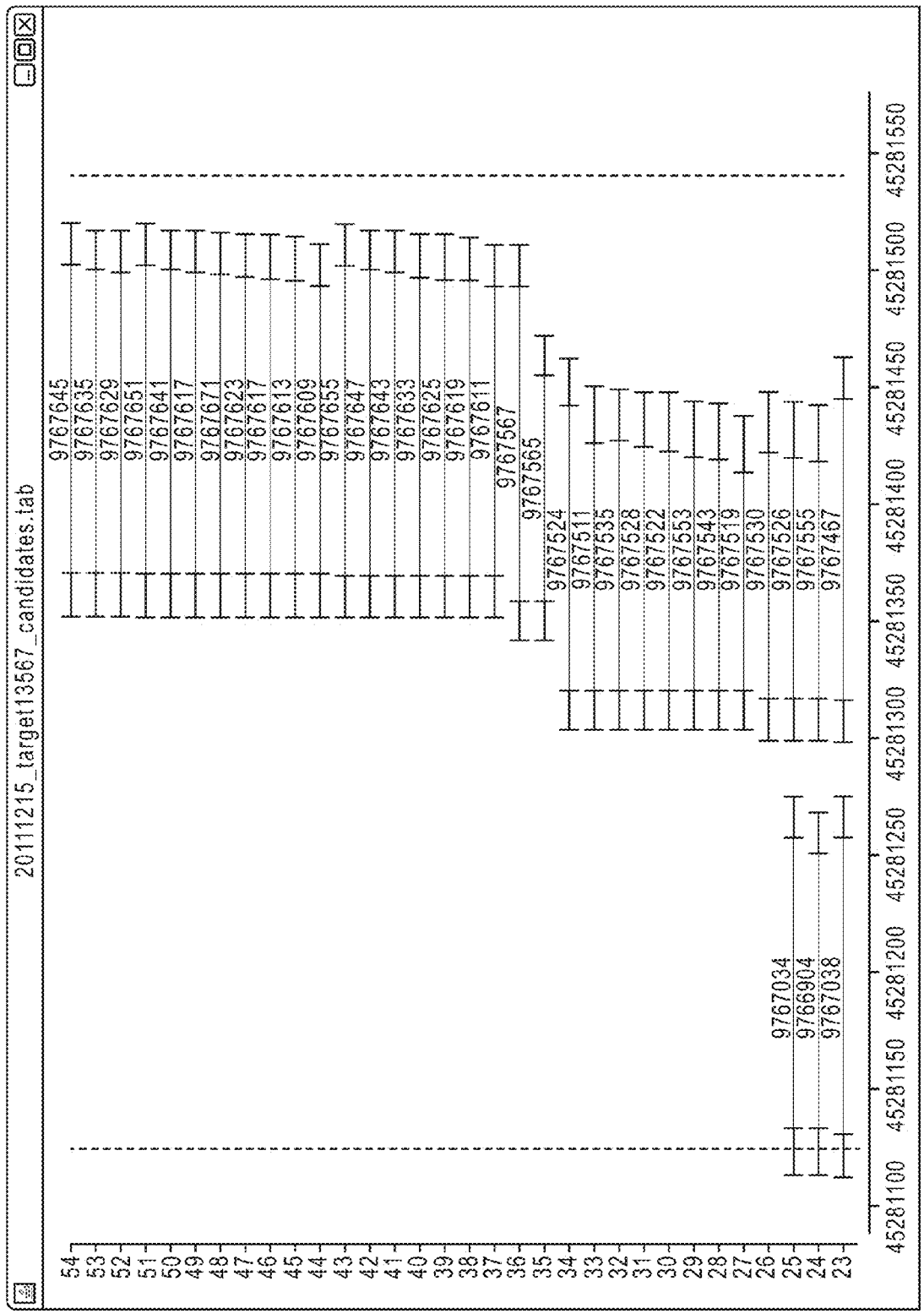
FIG. 20 (Part 2)

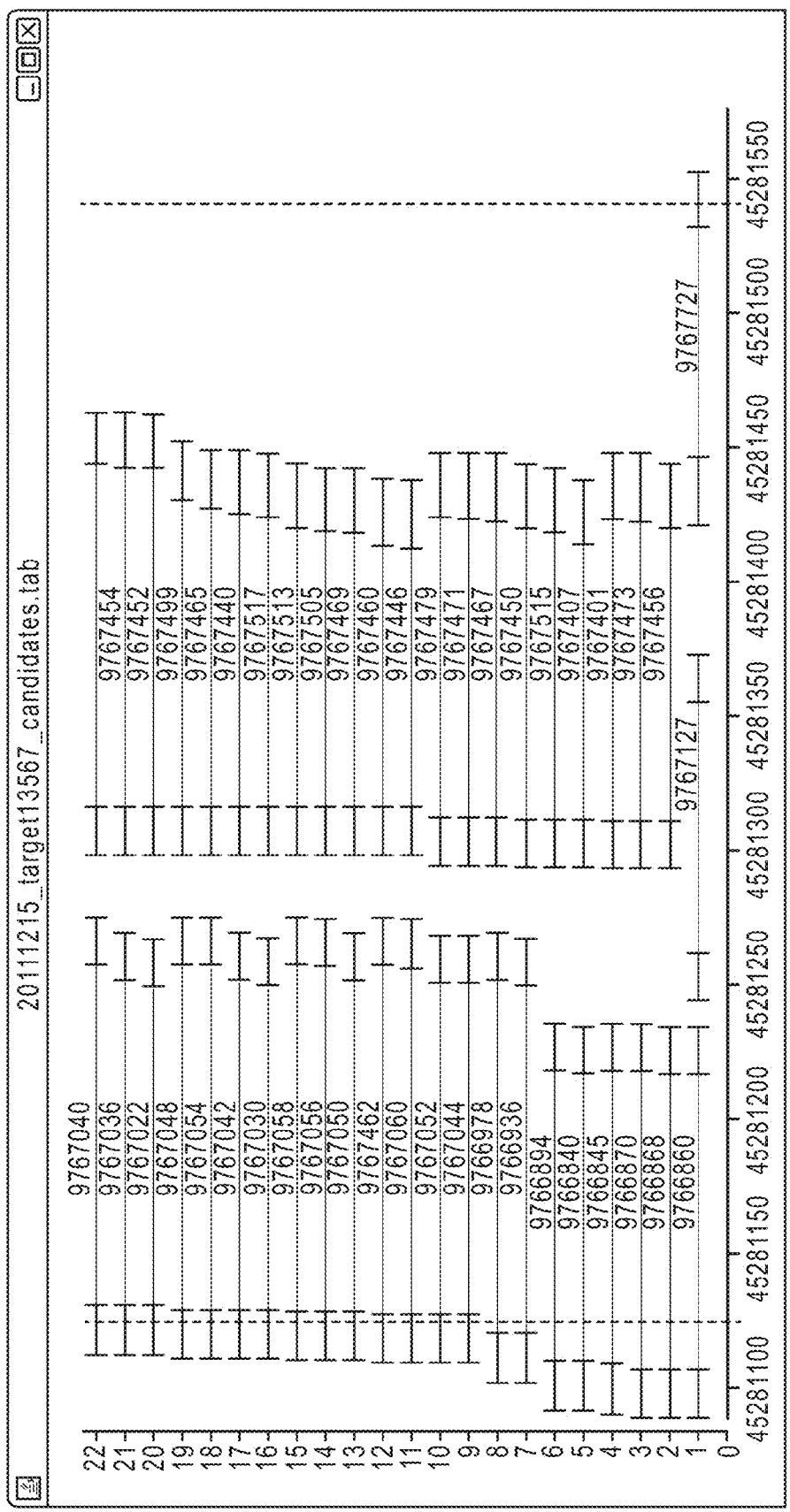
FIG. 20 (Part 3)

METHODS AND COMPOSITIONS FOR MULTIPLEX PCR

CROSS REFERENCE TO RELATED APPLICATIONS

This application is a continuation of U.S. Nonprovisional application Ser. No. 13/458,739, filed Apr. 27, 2012, which claims benefit of priority under 35 U.S.C. §119(e) to U.S. Provisional Application No. 61/479,952, filed Apr. 28, 2011, U.S. Provisional Application No. 61/531,583, filed Sep. 6, 2011, U.S. Provisional Application No. 61/531,574, filed Sep. 6, 2011, U.S. Provisional Application No. 61/538,079, filed Sep. 22, 2011, U.S. Provisional Application No. 61/564,763, filed Nov. 29, 2011, U.S. Provisional Application No. 61/578,192, filed Dec. 20, 2011, U.S. Provisional Application No. 61/594,160 filed Feb. 2, 2012, U.S. Provisional Application No. 61/598,881 filed Feb. 14, 2012, U.S. Provisional Application No. 61/598,892 filed Feb. 14, 2012, U.S. Provisional Application No. 61/625,596 filed Apr. 17, 2012, and U.S. Provisional Application No. 61/639,017 filed Apr. 26, 2012 entitled "METHODS AND COMPOSITIONS FOR MULTIPLEX PCR", the disclosures of which are incorporated herein by reference in their entireties.

SEQUENCE LISTING

This application hereby incorporates by reference the material of the electronic Sequence Listing filed concurrently herewith. The material in the electronic Sequence Listing is submitted as a text (.txt) file entitled "2012_04_25 LT00503 US_ST25.txt" created on Apr. 25, 2012, which has a file size of 18943 KB, and is herein incorporated by reference in its entirety.

TECHNICAL FIELD

In some embodiments, the disclosure relates generally to methods, compositions, systems, apparatuses and kits for amplifying one or more target sequences within a sample containing a plurality of target sequences. Optionally, a plurality of target sequences, for example at least 10, 50, 100, 500, 1000, 2500, 5000, 7500, 10000, 25000, 50000 or 100000, are amplified within a single amplification reaction. In some embodiments, the disclosure relates generally to methods, compositions, systems, apparatuses and kits for amplifying one or more target sequences from a single source, such as genomic DNA or formalin-fixed paraffin-embedded (FFPE) DNA. In particular, methods, kits, systems apparatuses and compositions useful for amplifying one or more target sequences using primers having a cleavable group are disclosed.

BACKGROUND

Several biological applications involve the selective amplification of nucleic acid molecules within a population. For example, next-generation sequencing methods can involve the analysis of selected targets within a large population of nucleic acid molecules. For such applications, it can be useful to increase the total number of targets that can be selectively amplified from a population within a single amplification reaction. Such selective amplification is typically achieved through use of one or more primers that can selectively hybridize to, or selectively promote the amplification of, a particular target nucleic acid molecule. Such selective amplification can be complicated by the formation of amplification artifacts, such as primer-dimers and the like. The formation of such amplification artifacts (also referred to herein as non-specific amplification products) can consume critical amplification reagents, e.g., nucleotides, polymerase, primers, etc. Furthermore, such artifacts can frequently have shorter length relative to the intended product and in such situations can amplify more efficiently than the intended products and dominate the reaction output. Selective amplification can also be complicated by the formation of 'superamplicons', i.e., the formation of a extended amplicon, which can occur when extension of a first primer is extended through an adjacent target nucleic acid sequence, thereby creating a long non-specific amplification product, which can act as a template for extension with a second primer. The formation of such artifacts in amplification reactions, even when only a single pair of primers is employed, can complicate downstream applications such as qPCR, cloning, gene expression analysis and sample preparation for next-generation sequencing. In some downstream applications, including several next-generation sequencing methods, this problem can be compounded by the requirement to practice a secondary amplification step, since the artifacts can be further amplified during the secondary amplification. For example, downstream sequencing applications can involve the generation of clonally amplified nucleic acid populations that are individually attached to separate supports, such as beads, using emulsion PCR ("emPCR") and enrichment for clonal amplicons performed via positive selection. In such applications, the artifacts can be carried all the way through the library generation process to the emPCR stage, producing DNA capture beads that include non-specific amplification products. These artifact-containing beads can be selected for during the enrichment process with the template containing beads but are genetically non-informative.

Nucleic acid molecules amplified in a multiplex PCR reaction can be used in many downstream analysis or assays with, or without, further purification or manipulation. For example, the products of a multiplex PCR reaction (amplicons) when obtained in sufficient yield can be used for single nucleotide polymorphism (SNP) analysis, genotyping, copy number variation analysis, epigenetic analysis, gene expression analysis, hybridization arrays, analysis of gene mutations including but not limited to detection, prognosis and/or diagnosis of disease states, detection and analysis of rare or low frequency allele mutations, nucleic acid sequencing including but not limited to de novo sequencing or targeted resequencing, and the like.

Exemplary next-generation sequencing systems include the Ion Torrent PGM™ sequencer (Life Technologies) and the Ion Torrent Proton™ Sequencer (Life Technologies), which are ion-based sequencing systems that sequence nucleic acid templates by detecting ions produced as a byproduct of nucleotide incorporation. Typically, hydrogen ions are released as byproducts of nucleotide incorporations occurring during template-dependent nucleic acid synthesis by a polymerase. The Ion Torrent PGM™ sequencer and Ion Proton™ Sequencer detect the nucleotide incorporations by detecting the hydrogen ion byproducts of the nucleotide incorporations. The Ion Torrent PGM™ sequencer and Ion Torrent Proton™ sequencer include a plurality of nucleic acid templates to be sequenced, each template disposed within a respective sequencing reaction well in an array. The wells of the array are each coupled to at least one ion sensor that can detect the release of $H^+$ ions or changes in solution pH produced as a byproduct of nucleotide incorporation. The ion sensor comprises a field effect transistor (FET) coupled to an ion-sensitive detection layer that can sense the presence of $H^+$ ions or changes in solution pH. The ion sensor provides output signals indicative of nucleotide incorporation which can be represented as voltage changes whose magnitude correlates with the $H^+$ ion concentration in a respective well or reaction chamber. Different nucleotide types are flowed serially into the reaction chamber, and are incorporated by the polymerase into an extending primer (or polymerization site) in an order determined by the sequence of the template. Each nucleotide incorporation is accompanied by the release of $H^+$ ions in the reaction well, along with a concomitant change in the localized pH. The release of $H^+$ ions is registered by the FET of the sensor, which produces signals indicating the occurrence of the nucleotide incorporation. Nucleotides that are not incorporated during a particular nucleotide flow will not produce signals. The amplitude of the signals from the FET may also be correlated with the number of nucleotides of a particular type incorporated into the extending nucleic acid molecule thereby permitting homopolymer regions to be resolved. Thus, during a run of the sequencer multiple nucleotide flows into the reaction chamber along with incorporation monitoring across a multiplicity of wells or reaction chambers permit the instrument to resolve the sequence of many nucleic acid templates simultaneously. Further details regarding the compositions, design and operation of the Ion Torrent PGM™ sequencer can be found, for example, in U.S. patent application Ser. No. 12/002,781, now published as U.S. Patent Publication No. 2009/0026082; U.S. patent application Ser. No. 12/474,897, now published as U.S. Patent Publication No. 2010/0137143; and U.S. patent application Ser. No. 12/492,844, now published as U.S. Patent Publication No. 2010/0282617, all of which applications are incorporated by reference herein in their entireties. In some embodiments, amplicons can be manipulated or amplified through bridge amplification or emPCR to generate a plurality of clonal templates that are suitable for a variety of downstream processes including nucleic acid sequencing. In one embodiment, nucleic acid templates to be sequenced using the Ion Torrent PGM™ or Ion Torrent Proton™ system can be prepared from a population of nucleic acid molecules using one or more of the target-specific amplification techniques outlined herein. Optionally, following target-specific amplification a secondary and/or tertiary amplification process including, but not limited to a library amplification step and/or a clonal amplification step such as emPCR can be performed.

As the number of nucleic acid targets desired to be amplified within a sample nucleic acid population increases, the challenge of selectively amplifying these targets while avoiding the formation of undesirable amplification artifacts can correspondingly increase. For example, the formation of artifacts including primer-dimers and superamplicons can be a greater issue in multiplex PCR reactions where PCR primer pairs for multiple targets are combined in a single reaction tube and co-amplified. In multiplex PCR, the presence of additional primer pairs at elevated concentrations relative to the template DNA makes primer-primer interactions, and the formation of primer-dimers and other artifacts, more likely.

Current methods for avoiding or reducing the formation of artifacts, such as primer-dimers, during nucleic acid amplification center around the primer design process and often utilize dedicated software packages (e.g., DNAsoftwares's Visual OMP, MuItiPLX, ABI's Primer Express, etc.) to design primer pairs that are predicted to exhibit minimal interaction between the other primers in the pool during amplification. Through the use of such software, primers can be designed to be as target-specific or amplicon-specific as possible, and often are grouped into subsets to minimize primer-primer interactions, primer-dimer formation and superamplicons. Stringent design parameters, however, limit the number of amplicons that can be co-amplified simultaneously and in some cases may prevent the amplification of some amplicons altogether. Other current methods require the use of multiple PCR primer pools to segregate primers into non-overlapping pools to minimize or prevent primer artifacts during the amplification step. Other methods include the use of multiple primer pools or single plex reactions to enhance the overall yield of amplification product per reaction. In a multiplex PCR reaction, each primer pair competes in the amplification reaction with additional primer pairs for a finite amount of dNTPs, polymerase and other reagents. There is therefore a need for improved methods, compositions, systems, apparatuses and kits that allow for the selective amplification of multiple target nucleic acid molecules within a population of nucleic acid molecules while avoiding, or minimizing, the formation of artifacts (also referred to as non-specific amplification products), including primer dimers. There is also a need for improved methods, compositions, systems, apparatuses and kits that allow for the selective amplification of multiple target nucleic acid molecules from a single nucleic acid sample, such as genomic DNA and/or formalin-fixed paraffin embedded (FFPE) DNA while avoiding, or minimizing, the formation of artifacts. There is also a need in the art for improved methods, compositions, systems and kits that allow for the simultaneous amplification of thousands of target-specific nucleic acid molecules in a single reaction, which can be used in any applicable downstream assay or analysis.

The practice of the present subject matter may employ, unless otherwise indicated, conventional techniques and descriptions of organic chemistry, molecular biology (including recombinant techniques), cell biology, and biochemistry, which are within the skill of the art. Such conventional techniques include, but are not limited to, preparation of synthetic polynucleotides, polymerization techniques, chemical and physical analysis of polymer particles, preparation of nucleic acid libraries, nucleic acid sequencing and analysis, and the like. Specific illustrations of suitable techniques can be used by reference to the examples provided herein. Other equivalent conventional procedures can also be used. Such conventional techniques and descriptions can be found in standard laboratory manuals such as *Genome Analysis: A Laboratory Manual Series* (Vols. I-IV), *PCR Primer: A Laboratory Manual, and Molecular Cloning: A Laboratory Manual* (all from Cold Spring Harbor Laboratory Press), Hermanson, Bioconjugate Techniques, Second Edition (Academic Press, 2008); Merkus, Particle Size Measurements (Springer, 2009); Rubinstein and Colby, Polymer Physics (Oxford University Press, 2003); and the like.

Unless defined otherwise, all technical and scientific terms used herein have the same meaning as is commonly understood by one of ordinary skill in the art to which these inventions belong. All patents, patent applications, published applications, treatises and other publications referred to herein, both supra and infra, are incorporated by reference in their entirety. If a definition and/or description is set forth herein that is contrary to or otherwise inconsistent with any definition set forth in the patents, patent applications, published applications, and other publications that are herein incorporated by reference, the definition and/or description set forth herein prevails over the definition that is incorporated by reference.

As used herein, the terms "comprises," "comprising," "includes," "including," "has," "having" or any other variation thereof, are intended to cover a non-exclusive inclusion.

For example, a process, method, article, or apparatus that comprises a list of features is not necessarily limited only to those features but may include other features not expressly listed or inherent to such process, method, article, or apparatus. Further, unless expressly stated to the contrary, "or" refers to an inclusive-or and not to an exclusive-or. For example, a condition A or B is satisfied by any one of the following: A is true (or present) and B is false (or not present), A is false (or not present) and B is true (or present), and both A and B are true (or present).

BRIEF DESCRIPTION OF THE DRAWINGS

The accompanying drawings, which are incorporated into and form a part of the specification, illustrate one or more exemplary embodiments and serve to explain the principles of various exemplary embodiments. The drawings are exemplary and explanatory only and are not to be construed as limiting or restrictive in any way.

FIG. 1A-FIG. 1E2 are schematic outlining an exemplary embodiment of a method utilizing degradable amplification primers according to the disclosure.

FIG. 2 is a schematic outlining an exemplary embodiment of a method obtaining a target-specific amplicon library according to the disclosure.

FIG. 3A shows a significant and predominant production of primer-dimers when using an exemplary set of standard multiplex primers. FIG. 3B shows a decrease in primer-dimers and an overall increase in expected amplicon product (104 bp) when using an exemplary set of modified multiplex primers as exemplified by the application.

FIG. 13 (Part 1)-FIG. 13 (Part 3) show sequencing alignment data identifying 6 mutations of the cystic fibrosis (CFTR) gene in a sample when using exemplary modified multiplex primers and exemplary library amplification process according to the disclosure.

FIG. 20 (Part 1)-FIG. 20 (Part 3) illustrate a set of candidate amplicons for a given target region, each including an insert surrounded by a pair of primers, for tiling and pooling according to an exemplary embodiment.

SUMMARY

Figure 2:
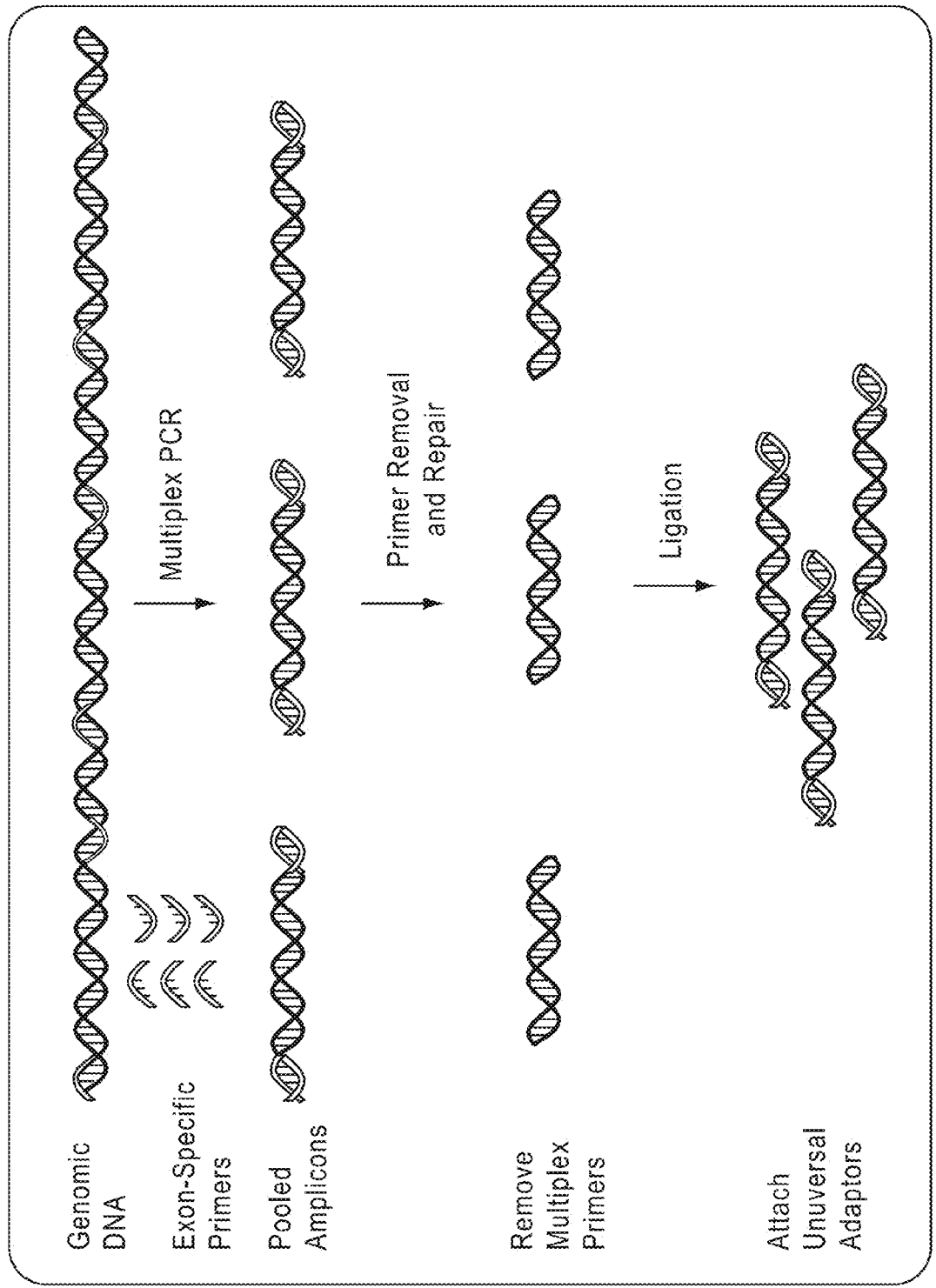

In some embodiments, the disclosure relates generally to methods, compositions, systems, apparatuses and kits for performing multiplex amplification of nucleic acids. In some embodiments, the method includes amplifying a plurality of target sequences within a sample including two or more target sequences. Optionally, multiple target sequences of interest from a sample can be amplified using one or more target-specific primers in the presence of a polymerase under amplification conditions to produce a plurality of amplified target sequences. The amplifying optionally includes contacting a nucleic acid molecule including at least one target sequence with one or more target-specific primers and at least one polymerase under amplification conditions. The contacting can produce one or more amplified target sequences.

In some embodiments, the disclosed methods (and related compositions, systems, apparatuses and kits) can include ligating at least one adapter to at least one of the amplified target sequences to produce one or more adapter-ligated amplified target sequences. The adapter can include at least one sequence that is substantially non-complementary to the target sequence, to the amplified target sequence, and/or to the nucleic acid molecule.

In some embodiments, the amplifying can produce least two amplified target sequences that are less than 50% complementary to each other. In some embodiments, at least one amplified target sequence is substantially non-complementary to another target sequence in the sample. In some embodiments, an amplified target sequence can be substantially noncomplementary to any one or more nucleic acid molecules in the sample that does not include the target sequence.

In some embodiments, the disclosed methods (as well as related compositions, systems, apparatuses and kits) can involve reamplifying at least one of the amplified target sequences c. For example, an adapter-ligated amplified target sequence can be reamplified to produce at least one reamplified adapter-ligated amplified target sequence. In some embodiments, at least one of the adapter-ligated amplified target sequences can be contacted with one or more adapters or their complement, and a polymerase under amplification conditions to produce at least one reamplified adapter-ligated amplified target sequence. In some embodiments, at least one adapter or its complement is substantially non-complementary to at least one amplified target sequence.

In some embodiments, the disclosure relates generally to compositions (as well as related methods, kits, apparatuses and systems using such compositions) comprising one or more target-specific primers useful for hybridizing to, and optionally amplifying, at least one target sequence in a sample. In some embodiments, the composition can include a plurality of target-specific primers useful for amplifying one, two or more target sequences in a sample. The compositions can further include one or more adapters.

In some embodiments, a target sequence includes one or more mutational hotspots, single nucleotide polymorphisms (SNPs), short tandem repeats (STRs), coding regions, exons and genes. In some embodiments, the number of target sequences amplified by one or more of the methods using the compositions (and related kits, apparatuses and systems) disclosed herein can be dozens, hundreds or thousands of target sequences in a single reaction. In some embodiments, the number of different targets amplified in a single multiplex amplification can be at least 100, 300, 500, 750, 1000, 2500, 5000, 7500, 10000, 12500, 15000 or greater.

In some embodiments, a target-specific primer, adapter, amplified target sequence or nucleic acid molecule can include one or more cleavable moieties, also referred to herein as cleavable groups. Optionally, the methods can further include cleaving at least one cleavable group of the target-specific primer, adapter, amplified target sequence or nucleic acid molecule. The cleaving can be performed before or after any of the other steps of the disclosed methods. In some embodiments, the cleavage step occurs after the amplifying and prior to the ligating. In one embodiment, the cleaving includes cleaving at least one amplified target sequence prior to the ligating. The cleavable moiety can be present in a modified nucleotide, nucleoside or nucleobase. In some embodiments, the cleavable moiety can include a nucleobase not naturally occurring in the target sequence of interest. In some embodiments, uracil or uridine can be incorporated into a DNA-based nucleic acid as a cleavable group. In one exemplary embodiment, a uracil DNA glycosylase can be used to cleave the cleavable group from the nucleic acid. In another embodiment, inosine can be incorporated into a DNA-based nucleic acid as a cleavable group. In one exemplary embodiment, EndoV can be used to cleave near the inosine residue and a further enzyme such as Klenow can be used to create blunt-ended fragments capable of blunt-ended ligation. In another exemplary embodiment, the enzyme hAAG can be used to cleave inosine residues from a nucleic acid creating a basic sites that can be further processed by one or more enzymes such as Klenow to create blunt-ended fragments capable of blunt-ended ligation.

In some embodiments, the methods disclosed herein (as well as related kits, compositions, apparatuses and systems) can include amplifying at least two target sequences of the sample (e.g., a first target sequence and a second target sequence) that are different from each other. In some embodiments, the methods disclosed herein (as well as related kits, compositions, apparatuses and systems) include simultaneously amplifying a first target sequence and a second target sequence that are less than 50% complementary to each other. In some embodiments, the first target sequence and a second target sequence are substantially non-complementary to each other.

In some embodiments, the methods disclosed herein (as well as related kits, compositions, apparatuses and systems) can include amplifying using at least two target-specific primers (e.g., a first target-specific primer and a second target-specific primer) that are different from each other. In some embodiments, a first target-specific primer can be at least 50% complementary to at least some portion of a first target sequence. In some embodiments, the first target-specific primer can be substantially noncomplementary to another target sequence in the sample. For example, the first target-specific primer can be substantially noncomplementary to a second target sequence. Optionally, the first target-specific primer can be substantially complementary to a first target sequence within a sample and can be substantially non-complementary to any portion of any other nucleic acid molecule within the sample other than the first target sequence.

Optionally, methods of multiplex amplification disclosed herein include amplifying at least a portion of a target sequence in a sample using at least one target-specific primer that is substantially complementary to at least some portion of a nucleic acid molecule that includes a corresponding target sequence. In some embodiments, the at least one target-specific primer is substantially complementary to at least some portion of the corresponding target sequence. In some embodiments, the amplifying can include using a primer pair including a target-specific forward primer and a target-specific reverse primer. In some embodiments, the target-specific primer can include at least one sequence that is substantially complementary or substantially identical to at least some portion of a nucleic acid molecule that includes the corresponding target sequence or its complement. Optionally, the target-specific primer is not substantially complementary to any other nucleic acid molecule present in the sample. In some embodiments, the target-specific primer can include at least one sequence that is substantially complementary or substantially identical to at least some portion of a corresponding target sequence or its complement. In some embodiments, the target-specific primer can include at least one sequence that is complementary or identical to at least some portion of a corresponding target sequence or its complement. In some embodiments, a target-specific primer does not include any nucleic acid sequence that is at least 5 contiguous nucleotides, 8 nucleotides, 10 contiguous nucleotides, or 15 contiguous nucleotides in length, and that is substantially noncomplementary to at least some portion of its corresponding target sequence. In some embodiments, a target-specific primer can hybridize under stringent conditions to at least some portion of a corresponding target sequence in the sample. In some embodiments, at least one of the target-specific primers is not substantially complementary to any nucleic acid sequence present in the sample other than its corresponding target sequence.

In some embodiments, one or more target-specific primers can be designed to exclude one or more sequence motifs. For example, at least one of the target-specific primers may be designed to not include a triplet nucleotide motif that is repeated 5 or more times in the target-specific primer. Optionally, at least one of the target-specific primers may be designed to not include the nucleotide sequence "ACA", repeated 3 or more times. Further, at least one of the target-specific primers may be designed to not include a homopolymer greater than 8 nucleotides in length. Optionally, at least one of the target-specific primers of the methods disclosed herein may be designed to possess a GC content of less than 85%.

In some embodiments, one or more of the methods of amplifying disclosed herein includes performing a target-specific amplification. Performing the target-specific amplification can include amplifying one or more target sequences using one or more exclusively target-specific primers, i.e., primers that do not include any shared or universal sequence motifs. Typically, one or more of the target-specific primers are substantially complementary to at least some portion of their corresponding target sequence, or to some portion of the nucleic acid molecule including the corresponding target sequence. In some embodiments, one, some or all of the target-specific primers are substantially complementary to at least some portion of their corresponding target sequence, or to some portion of the nucleic acid molecule including the corresponding target sequence, across their (i.e., the primers') entire length.

In some embodiments, a nucleic acid molecule in a sample, an amplified target sequence, an adapter or a target-specific primer includes a 5' end and a 3' end. The 5' end can include a free 5' phosphate group or its equivalent; the 3' end can include a free 3' hydroxyl group or its equivalent. Optionally, the ends of an amplified target sequence can be substantially non-complementary to the ends of another amplified target sequence. In some embodiments, the 3' end can include about 30 nucleotides, or about 15 nucleotides from the 3' hydroxyl group. In some embodiments, the 5' end can include about 30 nucleotides, or about 15 nucleotides, from the 5' phosphate group. In some embodiments, any one amplified target sequence having a 3' end and 5' end can be substantially non-complementary to any portion of any other amplified target sequence.

Optionally, the disclosed methods can further include ligating one or more adapters including a universal priming sequence to the amplified product formed as a result of such target-specific amplification. For example, in some embodiments, one or more adapters can be ligated to an amplified target sequence. Optionally, an adapter that is ligated to an amplified target sequence is susceptible to exonuclease digestion. In some embodiments, an adapter susceptible to exonuclease digestion can be ligated to the 3' end of an amplified target sequence. In some embodiments, an adapter ligated to an amplified target sequence does not include a protecting group. In some embodiments, the adapter does not include a protecting group that can prevent nucleic acid degradation or digestion under degrading or digesting conditions. Subsequent enzymatic digestion of the adapter-ligated amplified target sequence in the presence of nucleic acids that do not include a protecting group, offers a means for selective digestion of the unprotected nucleic acids. In some embodiments, an adapter can include a DNA barcode or tagging sequence.

In some embodiments, the methods disclosed herein (as well as related kits, systems, apparatuses and compositions)

can include contacting an amplified target sequence having a 3' end and a 5' end with a ligation reaction mixture. In some embodiments, a ligation reaction mixture can include one or more adapters and a ligase to produce at least one adapter-ligated amplified target sequence. In some embodiments, none of the adapters in a ligation mixture, prior to the ligating, includes a target-specific sequence. In some embodiments, none of the adapters in the ligation mixture, prior to ligating, includes a sequence that is substantially complementary to a 3' end or a 5' end of an amplified target sequence. Optionally, the 3' end or the 5' end of an amplified target sequence includes about 30 nucleotides, and in some instances refers to about 15 nucleotides from the 3' end or the 5' end of an amplified target sequence. In some embodiments, none of the adapters in a ligation mixture, prior to ligating, can hybridize under high stringency, to some portion of an amplified target sequence. In some embodiments, ligating can include direct ligation of one or more adapters to one or more amplified target sequences. In one embodiment, ligating can include performing a blunt-ended ligation. For example, the process of blunt-ended ligation can include ligating a substantially blunt-end double-stranded amplified target sequence to a substantially blunt-ended double-stranded adapter. In some embodiments, ligating does not include one or more additional oligonucleotide adapters prior to ligating an adapter to an amplified target sequence.

In some embodiments, the disclosure relates generally to methods for performing amplification of a target sequence (as well as related compositions, systems, apparatuses and kits using the disclosed methods) and can include a digestion step. In some embodiments, the methods also include a ligating step, and the digestion step is performed prior to a ligating step. In some embodiments, an amplified target sequence can be partially digested prior to performing a ligation step. For example, an amplified target sequence can be digested by enzymatic, thermal or chemical means. In some embodiments, an amplified target sequence can be digested prior to ligating to produce a blunt-end amplified target sequence. In some embodiments, a blunt-ended amplified target sequence can include a 5' phosphate group at the 5' end of the digested amplified target sequence.

In some embodiments, the disclosure relates generally to methods, compositions, systems, apparatuses and kits for performing multiplex nucleic acid amplification. In some embodiments, the methods (as well as related compositions, kits, apparatuses and systems using such methods) include amplifying one or more target sequences using one or more target-specific primers in the presence of polymerase under amplification conditions to produce an amplified target sequence and, ligating an adapter to the amplified target sequence. Further, the method can include reamplifying an adapter-ligated amplified target sequence to form a reamplified adapter-ligated amplified target sequence. In some embodiments, a reamplified adapter-ligated amplified target sequence can be produced using no more than two rounds of target-specific selection.

In some embodiments, one or more target-specific primers, target sequences or adapters can include a cleavable group. Furthermore, a cleavable group can be located at a nucleotide position at, or near, the terminus of a target-specific primer, target sequence or adapter. In some embodiments, a cleavable group can be located within 15 nucleotides of the 3' end or 5' end of the nucleic acid having the cleavable group. In some embodiments, a cleavable group can be located at or near a central nucleotide in a target-specific primer. In some embodiments, one or more cleavable groups can be present in a target-specific primer or adapter. In some embodiments, cleavage of one or more cleavable groups in a target-specific primer or an adapter can generate a plurality of nucleic acid fragments with differing melting temperatures. In one embodiment, the placement of one or more cleavable groups in a target-specific primer or adapter can be regulated or manipulated by determining a comparable maximal minimum melting temperature for each nucleic acid fragment, after cleavage of the cleavable group. In some embodiments the cleavable group can be a uracil or uridine moiety. In some embodiments the cleavable group can be an inosine moiety. In some embodiments, at least 50% of the target-specific primers can include at least one cleavable group. In some embodiments, each target-specific primer includes at least one cleavable group.

In one embodiment, a multiplex nucleic acid amplification method is disclosed herein that includes a) amplifying one or more target sequences using one or more target-specific primers in the presence of polymerase to produce an amplified target sequence, and b) ligating an adapter to the amplified target sequence to form an adapter-ligated amplified target sequence. In some embodiments, amplifying can be performed in solution such that an amplified target sequence or a target-specific primer is not linked to a solid support or surface. In some embodiments, ligating can be performed in solution such that an amplified target sequence or an adapter is not linked to a solid support or surface. In another embodiment, amplifying and ligating can be performed in solution such that an amplified target sequence, a target-specific primer or an adapter is not linked to a solid support or surface.

In some embodiments, the disclosure relates generally to methods, compositions, systems, apparatuses and kits for synthesizing two or more target sequences within a sample. In one embodiment, the synthesizing method includes a) synthesizing two or more target sequences using a plurality of target-specific primers in the presence of polymerase under polymerizing conditions to produce a plurality of synthesized target sequences. In some embodiments, the method further includes ligating one or more adapters to the synthesized target sequences. In some embodiments, a target sequence of interest includes one or more mutational hotspots, single nucleotide polymorphisms (SNPs), short tandem repeats (STRs), coding regions, exons and genes. In some embodiments, the number of target sequences that can be synthesized in a multiplex reaction using the compositions (and related methods, kits, apparatuses and systems) disclosed herein can be dozens, hundreds or thousands of target sequences in a single sample. Optionally, multiple target sequences of interest from a sample can be synthesized using one or more target-specific primers in the presence of a polymerase under polymerizing conditions to produce a plurality of synthesized target sequences. In some embodiments, a synthesized target sequence can be less than 50% complementary to another synthesized target sequence. In some embodiments, a synthesized target sequence can be substantially non-complementary to another target sequence in the sample. In some embodiments, a synthesized target sequence can be substantially noncomplementary to any one or more nucleic acid molecules in the sample that is not a target sequence of interest. In some embodiments, synthesizing a target sequence can include ligating an adapter to a synthesized target sequence, thereby producing an adapter-ligated synthesized target sequence.

In some embodiments, the disclosure relates generally to synthesizing a target sequence from a plurality of target sequences. For example, a method of synthesizing can include synthesizing a target sequence using a plurality of target-specific primers in the presence of polymerase under polymerizing conditions to produce a plurality of synthesized target sequences. Synthesizing can further include resynthesizing at least one adapter-ligated synthesized target sequence. In some embodiments, resynthesizing can include contacting at least one adapter-ligated synthesized target sequence with at least one adapter or its complement and a polymerase under polymerizing conditions to produce a plurality of resynthesized adapter-ligated synthesized target sequences. In some embodiments, a resynthesized adapter-ligated synthesized target sequence can be produced using no more than two rounds of target-specific selection.

In some embodiments, a method for synthesizing target sequences can include a synthesizing and a ligating step. In some embodiments, ligating does not include an adapter that is substantially complementary to a portion of a synthesized target sequence. In some embodiments, an adapter is not substantially complementary to about 30 contiguous nucleotides, or about 20 contiguous nucleotides, from a 3' end or a 5' end of a synthesized target sequence. In some embodiments, an adapter can include at least one sequence that is substantially complementary, or substantially identical, to at least a portion of a universal primer.

In some embodiments, the disclosure relates generally to methods, compositions, systems, apparatuses and kits for performing multiplex nucleic acid amplification. In one embodiment, the method includes amplifying one or more target sequences using one or more target-specific primers in the presence of polymerase under amplification conditions to produce an amplified target sequence; ligating an adapter to the amplified target sequence; and reamplifying at least one adapter-ligated amplified target sequence. In some embodiments, reamplifying includes contacting an adapter-ligated amplified target sequence with one or more adapters (or their complements) and a polymerase under amplification conditions to produce at least one reamplified adapter-ligated amplified target sequence. In some embodiments, an amplified target sequence can be less than 50% complementary to another amplified target sequence. In some embodiments, an amplified target sequence can be substantially non-complementary to another target sequence in the sample. In some embodiments, an amplified target sequence can be substantially noncomplementary to any one or more nucleic acid molecules in the sample that is not a target sequence of interest. In some embodiments, an amplified target sequence can be ligated to at least one adapter, or their complement, to produce one or more adapter-ligated amplified target sequences. In some embodiments, an adapter-ligated amplified target sequence can be reamplified to produce at least one reamplified adapter-ligated amplified target sequence. In some embodiments, an adapter or their complement is not substantially complementary to any portion of any other nucleic acid molecule within the sample. In some embodiments, an adapter or their complement is not substantially complementary to at least one amplified target sequence. In one embodiment, one or more of the adapters or their complement during the reamplifying step can be a universal primer. In one embodiment, the ligating step can further include ligating a DNA barcode or DNA tagging sequence to an amplified target sequence prior to ligating an adapter to an amplified target sequence.

In some embodiments, amplifying and synthesizing methods of the disclosure can be performed as "addition-only" processes. In some embodiments, an addition-only process excludes the removal of all, or a portion of a first reaction mixture including the amplifying or synthesizing compositions, for further manipulation during the amplification or synthesizing steps. In some embodiments, an addition-only process can be automated for example for use in high-throughput processing.

In some embodiments, the disclosure generally relates to compositions (as well as related kits, methods, systems and apparatuses using the disclosed compositions) for performing nucleic acid amplification and nucleic acid synthesis. In some embodiments, one or more of the compositions disclosed herein (as well as related methods, kits, systems and apparatuses) can include at least one target-specific primer and/or at least one adapter. In some embodiments, the compositions include a plurality of target-specific primers or adapters that are about 15 to about 40 nucleotides in length. In some embodiments, the compositions include one or more target-specific primers or adapters that include one or more cleavable groups. In some embodiments, one or more types of cleavable groups can be incorporated into a target-specific primer or adapter. In some embodiments, a cleavable group can be located at, or near, the 3' end of a target-specific primer or adapter. In some embodiments, a cleavable group can be located at a terminal nucleotide, a penultimate nucleotide, or any location that corresponds to less than 50% of the nucleotide length of the target-specific primer or adapter. In some embodiments, a cleavable group can be incorporated at, or near, the nucleotide that is central to the target-specific primer or the adapter. For example, a target specific primer of 40 bases can include a cleavage group at nucleotide positions 15-25. Accordingly, a target-specific primer or an adapter can include a plurality of cleavable groups within its 3' end, its 5' end or at a central location. In some embodiments, the 5' end of a target-specific primer includes only non-cleavable nucleotides. In some embodiments, the cleavable group can include a modified nucleobase or modified nucleotide. In some embodiments, the cleavable group can include a nucleotide or nucleobase that is not naturally occurring in the corresponding nucleic acid. For example, a DNA nucleic acid can include a RNA nucleotide or nucleobase. In one example, a DNA based nucleic acid can include uracil or uridine. In another example, a DNA based nucleic acid can include inosine. In some embodiments, the cleavable group can include a moiety that can be cleaved from the target-specific primer or adapter by enzymatic, chemical or thermal means. In some embodiments, a uracil or uridine moiety can be cleaved from a target-specific primer or adapter using a uracil DNA glycosylase. In some embodiments, a inosine moiety can be cleaved from a target-specific primer or adapter using hAAG or EndoV.

In some embodiments, the disclosure relates generally to compositions including a target-specific primer of about 15 to about 40 nucleotides in length having a cleavable group located near the terminus of the target-specific primer, hybridized to a first strand of a double-stranded target sequence. In some embodiments, the primer is substantially complementary to the first strand of the double-stranded target sequence. In some embodiments, the disclosure relates generally to compositions including a target-specific primer of about 15 to about 40 nucleotides in length having a cleavable group located near the terminus of the target-specific primer, hybridized to a first strand of a double-stranded target sequence, and a second target-specific primer of about 15 to about 40 nucleotides in length having a cleavable group located near the terminus of the second target-specific primer, hybridized to a second strand of the double-stranded target sequence. In some embodiments, the second target-specific primer is substantially complementary to the second strand of the double-stranded target sequence.

In some embodiments, the disclosure generally relates to compositions (as well as related kits, methods, systems and apparatuses using the disclosed compositions) for performing nucleic acid amplification and nucleic acid synthesis. In some embodiments, the compositions include a target-specific primer of about 15 to about 40 nucleotides in length having a uracil nucleotide located near the terminus of the target-specific primer and a second uracil nucleotide located near the central nucleotide of the target-specific primer. In some embodiments, the disclosure generally relates to compositions (as well as related kits, methods, systems and apparatuses using the disclosed compositions) for performing nucleic acid amplification and nucleic acid synthesis. In some embodiments, the compositions include a target-specific primer of about 15 to about 40 nucleotides in length having an inosine nucleotide located near the 3' terminus of the target-specific primer and at least a second inosine nucleotide located near the central nucleotide of the target-specific primer.

In some embodiments, the disclosure relates generally to a composition comprising at least one target-specific primer or at least one target-specific primer pair. In some embodiments, the disclosure relates generally to a composition comprising a plurality of target-specific primers. Optionally, the composition can include at least 100, 200, 300, 500, 750, 1000, 1250, 1500, 1750, 2000, 2500, 3000, 4000, 5000, 7500 or 10,000 target-specific primers or target-specific primer pairs. In some embodiments, the composition comprising a plurality of target-specific primers includes at least one of the target-specific primers disclosed herein. In some embodiments, the composition comprising a plurality of target-specific primers includes at least one target-specific primer that is at least 90% identical to any one of the nucleic acid sequences provided herein or in the concurrently filed sequencing listing. In some embodiments, the composition comprising a plurality of target-specific primers includes one or more target-specific primer pairs disclosed herein or one or more primer pairs having at least 90% identity to any one of the primer pair nucleic acid sequences provided herein. In some embodiments, the composition comprising a plurality of target-specific primers can include a percentage identity of at least 91%, 92%, 93%, 94%, 95%, 96%, 97%, 98% or 99% identity to any one or more of the nucleic acid sequences disclosed herein or in the concurrently filed sequence listing. In some embodiments, the composition comprising a plurality of target-specific primers can include any one or more target-specific primers selected from Tables 2, 3, 13, 14, 15, 17 and 19 from U.S. Ser. No. 13/458,739, filed Apr. 27, 2012, hereby incorporated by reference in its entirety. In some embodiments, the composition comprising a plurality of target-specific primers can include any one or more target-specific primer pairs selected from Tables 2, 3, 13, 14, 15, 17 and 19 from U.S. Ser. No. 13/458,739, filed Apr. 27, 2012, hereby incorporated by reference in its entirety. In some embodiments, the composition comprising a plurality of target-specific primers generally relates to any one or more nucleic acid sequences selected from SEQ ID NOs: 1-103,143 or includes at least 15 contiguous nucleotides from any one nucleic acid sequence selected from SEQ ID NOs: 1-103,143. In some embodiments, the composition is generally directed to an isolated nucleic acid sequence consisting of any one or more of the nucleic acid sequences set forth in SEQ ID NOs: 1-103,143.

In some embodiments, the disclosure relates generally to a composition comprising a target-specific primer of about 15 nucleotides to about 40 nucleotides in length. In some embodiments, the disclosure relates generally to a composition comprising a plurality of at least 2 target-specific primers of about 15 nucleotides to about 40 nucleotides in length. In some embodiments, the composition comprises a plurality of target-specific primer pairs of about 15 nucleotides to about 40 nucleotides in length designed using the primer selection criteria or primer selection methods outlined herein.

In some embodiments, the composition includes at least one target-specific primer that is substantially complementary across its entire length to at least one target sequence in a sample. In some embodiments, the composition includes a plurality of target-specific primers, where substantially all of the plurality of target-specific primers include a complementary nucleic acid sequence across their entire primer lengths to one or more target sequences in a sample. In some embodiments, the composition includes at least one target-specific primer that is complementary across its entire length to at least one target sequence in a sample. In some embodiments, the composition includes a plurality of target-specific primers, where substantially all of the plurality of target-specific primers include a complementary nucleic acid sequence across their entire primer lengths to one or more target sequences in a sample.

In some embodiments, the disclosure relates generally to a composition comprising a plurality of target-specific primers having a cleavable group located at a 3' end of at least one of the plurality of the target-specific primers. In some embodiments, the composition includes a cleavable group located at a 3' end of substantially all of the plurality of target-specific primers. In some embodiments, the cleavable group can include a uracil nucleobase, an inosine nucleoside or an analog thereof. In some embodiments, the 3' end of one or more target-specific primers can include more than one cleavable group and/or more than one species of cleavable group. For example, a composition having a cleavable group at the 3' end of one target-specific primer can include one uracil moiety and an inosine moiety in the 3' end of the same target-specific primer. In some embodiments, the composition can include at least one target-specific primer that includes a non-cleavable at the 3' terminal nucleotide. For example, a target-specific primer can include a cleavable group at the 3' end of the target-specific primer except for the terminal nucleotide at the 3' end of the target-specific primer. In some embodiments, the composition can include a plurality of target-specific primers where substantially all of the target-specific primers include a cleavable group at the 3' end except for the terminal nucleotide location.

In some embodiments, the disclosure relates generally to a composition comprising a plurality of target-specific primers having a cleavable group located near or about a central nucleotide of at least one of the target-specific primers. In some embodiments, the composition includes a cleavable group located near or about a central nucleotide of substantially all of the plurality of the target-specific primers. For example, in a target-specific primer of 40 nucleotides, a cleavable group can be located near the central nucleotide, for example at the 15th nucleotide through the 25th nucleotide. In some instances, 'near' a central nucleotide can refer to a percentage of the length of the entire target-specific primer. For example in a 40 nucleotide target-specific primer, the location of a central cleavable group can include any location from about 40% to about 60% of the length of the target-specific primer. In some embodiments, a central nucleotide of an odd numbered target-specific primer includes the central nucleotide of the target-specific primer. In an even numbered target-specific primer a central nucleotide can include one nucleotide either side of the central nucleotide location. For example, in a 20 nucleotide target-specific primer, the central nucleotide can include nucleotide position 10, nucleotide position 11, or both.

In some embodiments, the disclosure relates generally to a composition comprising a plurality of target-specific primers having at a 5' end only non-cleavable nucleotides. In some embodiments, the composition can include substantially all of the plurality of target-specific primers having only non-cleavable nucleotides at the 5' end. In some embodiments, the 5' end of the plurality of target-specific primers having only non-cleavable nucleotides can include fewer than 10 nucleotides from the 5' end. In some embodiments, the 5' end can include fewer than 8, 7, 6, 5, 4, 3 or 2 nucleotides from the 5' end. In some embodiments, the 5' end having non-cleavable nucleotides can include less than 50% of the length of the target specific primer, less than 40% of the length of the target specific primer, less than 30% of the length of the target specific primer, less than 20% of the length of the target specific primer, or less than 10% of the length of the target-specific primer from the 5' end.

In some embodiments, the disclosure relates generally to a composition comprising a plurality of target-specific primers where at least one of the target-specific primers includes less than 20% of the nucleotides across the primer's entire length containing a cleavable group. In some embodiments, the composition comprises a plurality of target-specific primers where substantially all of the target-specific primers include less than 20% of the nucleotides across each primer's entire length containing a cleavable group. For example, a target-specific primer of 20 nucleotides in length can include 4 or fewer cleavage groups. In some embodiments, the disclosure relates generally to a composition comprising a plurality of target-specific primers where at least one of the target-specific primers includes less than 10% of the nucleotides across the primer's entire length containing a cleavable group. In some embodiments, the composition comprises a plurality of target-specific primers where substantially all of the target-specific primers include less than 10% of the nucleotides across each primer's entire length containing a cleavable group. For example, a target-specific primer of 20 nucleotides in length can include 2 or fewer cleavage groups.

In some embodiments, the disclosure relates generally to a composition comprising a plurality of target-specific primers having minimal cross-hybridization to at least one of the target-specific primers in the plurality of primers. In some embodiments, the disclosure relates generally to a composition comprising a plurality of target-specific primers having minimal cross-hybridization to substantially all of the target-specific primers in the plurality of primers. In some embodiments, minimal cross-hybridization to one or more target-specific primers in the plurality of primers can be evaluated by the formation of primer-dimers or dimer-dimers. In some embodiments, the composition can include fewer primer-dimers in a multiplex PCR amplification reaction as compared to a multiplex PCR amplification reaction of the prior art under corresponding amplification conditions.

In some embodiments, the disclosure relates generally to a composition comprising a plurality of target-specific primers, where at least one of the target-specific primers includes minimal cross-hybridization to non-specific sequences present in a sample. In some embodiments, the composition comprises a plurality of target-specific primers where substantially all of the target-specific primers include minimal cross-hybridization to non-specific sequences present in a sample. In some embodiments, minimal cross-hybridization to non-specific sequences present in a sample can be evaluated by the presence of 'percent of reads off-target' or a decrease in 'percent of reads on target'. In some embodiments, the compositions as disclosed herein can provide fewer 'percent of reads off-target' or an increase in 'percent of reads on target' in multiplex PCR amplification reactions as compared to multiplex PCR amplification reactions of the prior art under corresponding amplification conditions. The "plex" of a given multiplex amplification refers generally to the number of different target-specific sequences that are amplified during a single multiplex amplification according to the disclosure. In some embodiments, the plex can be about 12-plex, 24-plex, 48-plex, 96-plex, 192-plex, 384-plex, 768-plex, 1536-plex, 3072-plex, 6144-plex or higher. In some embodiments, minimal cross-hybridization to non-specific sequences present in a sample can include less than 15%, less than 12%, or fewer than 10% reads off target. In some embodiments, the percent of reads on target per multiplex amplification can be greater than 85%, 88%, 90%, 92%, 94%, 95%, 96%, 97%, 98%, or more.

In some embodiments, the disclosure relates generally to a composition comprising a plurality of target-specific primers having minimal self-complementarity. In some embodiments, the composition includes at least one target-specific primer that does not form a secondary structure, such as loops or hairpins. In some embodiments, the composition includes a plurality of target-specific primers where a majority (i.e., greater than 50%), or substantially all of the plurality of target-specific primers fail to form a secondary structure. The "plex" of a given multiplex amplification refers generally to the number of different target-specific sequences that are amplified during a single multiplex amplification according to the disclosure. In some embodiments, the plex can be about 12-plex, 24-plex, 48-plex, 96-plex, 192-plex, 384-plex, 768-plex, 1536-plex, 3072-plex, 6144-plex or higher. In some embodiments, minimal self-complementarity can include less than 10%, less than 8%, less than 5% or less than 3% of the plurality of target-specific primers possessing self-complementarity that allows a target-specific primer to form a secondary structure.

In some embodiments, the disclosure relates generally to a composition comprising a plurality of target-specific primers having minimal nucleotide sequence overlap at a 3' end or a 5' end. In some embodiments, the composition can include minimal overlap of nucleotide sequence in the 3' end of at least one target-specific primer. In some embodiments, the composition can include minimal overlap of nucleotide sequence in the 3' end of substantially all of the plurality of target-specific primers. In some embodiments, the composition can include minimal overlap of nucleotide sequence in the 5' end of at least one target-specific primer. In some embodiments, the composition can include minimal overlap of nucleotide sequence in the 5' end of substantially all of the plurality of target-specific primers. In some embodiments, the composition can include minimal overlap of nucleotide sequence in the 3' end and the 5' end of at least one target-specific primer. In some embodiments, the composition can include minimal overlap of nucleotide sequence in the 3' end and the 5' end of substantially all of the plurality of target-specific primers. In some embodiments, the amount of nucleotide sequence overlap between one or more target-specific primers is less than 8 nucleotides. In some embodiments, the amount of nucleotide sequence overlap between one or more target-specific primers is less than 5 nucleotides. In some embodiments, the amount of nucleotide sequence between one or more target-specific primers of the plurality of primers is less than 8, 7, 6, 5, 4, 3, 2 or 1 nucleotide. In some embodiments, the composition can include a plurality of target-specific primers including a nucleotide sequence gap of one or more nucleotides. In some embodiments, the composition can include a nucleotide sequence gap of 1, 2, 3, 4, 5, 10, 15, 20 or more nucleotides between two or more of the plurality of target-specific primers. In some embodiments, the composition can include a nucleotide sequence gap of about 50 nucleotides between two or more target-specific primers in the plurality of target-specific primers. In some embodiments, the composition can include a nucleotide sequence gap of about 10, 20, 30, 40, or 50 nucleotides between substantially all of the target-specific primers in the plurality of target-specific primers.

In some embodiments, the disclosure relates generally to a composition comprising a plurality of target-specific primers of about 15 nucleotides to about 40 nucleotides in length having at least two or more following criteria,: a cleavable group located at a 3' end of substantially all of the plurality of primers, a cleavable group located near or about a central nucleotide of substantially all of the plurality of primers, substantially all of the plurality of primers at a 5' end including only non-cleavable nucleotides, minimal cross-hybridization to substantially all of the primers in the plurality of primers, minimal cross-hybridization to non-specific sequences present in a sample, minimal self-complementarity, and minimal nucleotide sequence overlap at a 3' end or a 5' end of substantially all of the primers in the plurality of primers. In some embodiments, the composition can include any 3, 4, 5, 6 or 7 of the above criteria.

In some embodiments, the disclosure relates generally to a composition comprising a plurality of at least 2 target-specific primers of about 15 nucleotides to about 40 nucleotides in length having two or more of the following criteria, a cleavable group located near or about a central nucleotide of substantially all of the plurality of primers, substantially all of the plurality of primers at a 5' end including only non-cleavable nucleotides, substantially all of the plurality of primers having less than 20% of the nucleotides across the primer's entire length containing a cleavable group, at least one primer having a complementary nucleic acid sequence across its entire length to a target sequence present in a sample, minimal cross-hybridization to substantially all of the primers in the plurality of primers, minimal cross-hybridization to non-specific sequences present in a sample, and minimal nucleotide sequence overlap at a 3' end or a 5' end of substantially all of the primers in the plurality of primers. In some embodiments, the composition can include any 3, 4, 5, 6 or 7 of the above criteria.

In some embodiments, the disclosure relates generally to a composition comprising a plurality of target-specific primers designed according to the criteria disclosed here or including any one or more of the target-specific primers disclosed herein, where at least one of the plurality of target-specific primers is substantially complementary across its entire length to at last a portion of one or more genes selected from ABI1; ABL1; ABL2; ACSL3; ACSL6; AFF1; AFF3; AFF4; AKAP9; AKT1; AKT2; ALK; APC; ARHGAP26; ARHGEF12; ARID1A; ARNT; ASPSCR1; ASXL1; ATF1; ATIC; ATM; AXIN2; BAP1; BARD1; BCAR3; BCL10; BCL11A; BCL11B; BCL2; BCL3; BCL6; BCL7A; BCL9; BCR; BIRC3; BLM; BMPR1A; BRAF; BRCA1; BRCA2; BRD3; BRD4; BRIP1; BUB1B; CARD11; CARS; CASC5; CBFA2T3; CBFB; CBL; CBLB; CBLC; CCDC6; CCNB11P1; CCND1; CCND2; CD74; CD79A; CDC73; CDH1; CDH11; CDK4; CDK6; CDKN2A; CDKN2B; CDKN2C; CDX2; CEBPA; CEP110; CHEK1; CHEK2; CHIC2; CHN1; CIC; CIITA; CLP1; CLTC; CLTCL1; COL1A1; CREB1; CREB3L2; CREBBP; CRTC1; CRTC3; CSF1R; CTNNB1; CXCR7; CYLD; CYTSB; DCLK3; DDB2; DDIT3; DDR2; DDX10; DDX5; DDX6; DEK; DGKG; DICER1; DNMT3A; EGFR; EIF4A2; ELF4; ELL; ELN; EML4; EP300; EPS15; ERBB2; ERBB4; ERC1; ERCC2; ERCC3; ERCC4; ERCC5; ERG; ETV1; ETV4; ETV5; ETV6; EWSR1; EXT1; EXT2; EZH2; FAM123B; FANCA; FANCC; FANCD2; FANCE; FANCF; FANCG; FAS; FBXW7; FCRL4; FGFR1; FGFR10P; FGFR2; FGFR3; FH; FIP1L1; FLCN; Fill; FLT1; FLT3; FNBP1; FOXL2; FOXO1; FOXO3; FOXO4; FOXP1; FUS; GAS7; GATA1; GATA2; GATA3; GMPS; GNAQ; GNAS; GOLGA5; GOPC; GPC3; GPHNGPR124; HIP1; HIST1H4I; HLF; HNF1A; HNRNPA2B1; HOOK3; HOXA11; HOXA13; HOXA9; HOXC11; HOXC13; HOXD13; HRAS; HSP90AA1; HSP90AB1; IDH1; IDH2; IKZF1; IL2; IL21R; IL6ST; IRF4; ITGA10; ITGA9; ITK; JAK1; JAK2; JAK3; KDM5A; KDM5C; KDM6A; KDR; KDSR; KIAA1549; KIT; KLF6; KLK2; KRAS; KTN1; LASP1; LCK; LCP1; LHFP; LIFR; LMO2; LPP; MAF; MALT1; MAML2; MAP2K1; MAP2K4; MDM2; MDM4; MECOM; MEN1; MET; MITF; MKL1; MLH1; MLL; MLLT1; MLLT10; MLLT3; MLLT4; MLLT6; MN1; MPL; MRE11A; MSH2; MSH6; MSI2; MSN; MTCP1; MTOR; MUC1; MYB; MYC; MYCL1; MYCN; MYH11; MYH9; MYST3; MYST4; NACA; NBN; NCOA1; NCOA2; NCOA4; NEK9; NF1; NF2; NFE2L2; NFKB2; NIN; NKX2-1; NLRP1; NONO; NOTCH1; NOTCH2; NPM1; NR4A3; NRAS; NSD1; NTRK1; NTRK3; NUMA1; NUP214; NUP98; OLIG2; OMD; PAFAH1B2; PALB2; PATZ1; PAX3; PAX5; PAX7; PAX8; PBRM1; PBX1; PCM1; PDE4DIP; PDGFB; PDGFRA; PDGFRB; PER1; PHOX2B; PICALM; PIK3CA; PIK3R1; PIM1; PLAG1; PML; PMS1; PMS2; POU2AF1; POU5F1; PPARG; PPP2R1A; PRCC; PRDM16; PRF1; PRKAR1A; PRRX1; PSIP1; PTCH1; PTEN; PTPN11; RABEP1; RAD50; RAD51L1; RAF1; RANBP17; RAP1GDS1; RARA; RB1; RBM15; RECQL4; REL; RET; RHOH; RNF213; ROS1; RPN1; RPS6KA2; RUNX1; RUNX1T1; SBDS; SDHAF2; SDHB; SETD2; SFPQ; SFRS3; SH3GL1; SLC45A3; SMAD4; SMARCA4; SMARCB1; SMO; SOCS1; SRC; SRGAP3; SS18; SS18L1; STIL; STK11; STK36; SUFU; SYK; TAF15; TAF1L; TALI; TAL2; TCF12; TCF3; TCL1A; TET1; TET2; TEX14; TFE3; TFEB; TFG; TFRC; THRAP3; TLX1; TLX3; TMPRSS2; TNFAIP3; TOP1; TP53; TPM3; TPM4; TPR; TRIM27; TRIM33; TRIP11; TSC1; TSC2; TSHR; USP6; VHL; WAS; WHSC1L1; WRN; WT1; XPA; XPC; ZBTB16; ZMYM2; ZNF331; ZNF384; and ZNF521.

In some embodiments, the disclosure relates generally to a composition comprising a plurality of target-specific primers designed according to the criteria disclosed here or including any one or more of the target-specific primers disclosed herein, where at least one of the plurality of target-specific primers is substantially complementary across its entire length to at last a portion of one or more genes selected from ABL1; AKT1; ALK; APC; ATM; BRAF; CDH1; CDKN2A; CSF1R; CTNNB1; EGFR; ERBB2; ERBB4; FBXW7; FGFR1; FGFR2; FGFR3; FLT3; GNAS; HNF1A; HRAS; IDH1; JAK2; JAK3; KDR; KIT; KRAS; MET; MLH1; MPL; NOTCH1; NPM1; NRAS; PDGFRA; PIK3CA; PTEN; PTPN11; RB1; RET; SMAD4; SMARCB1; SMO; SRC; STK11; TP53; and VHL.

In some embodiments, the disclosure relates generally to a composition comprising a plurality of target-specific primers designed according to the criteria disclosed here or including any one or more of the target-specific primers disclosed herein, where at least one of the plurality of target-specific primers is substantially complementary across its entire length to at last a portion of one or more genes selected from ABCA4; ABCC8; ABCD1; ACADVL; ACTA2; ACTC; ACTC1; ACVRL1; ADA; AIPL1; AIRE; ALK1; ALPL; AMT; APC; APP; APTX; AR; ARL6; ARSA; ASL; ASPA; ASS; ASS1; ATL; ATM; ATP2A2; ATP7A; ATP7B; ATXN1; ATXN2; ATXN3; ATXN7; BBS6; BCKDHA; BCKDHB; BEST1; BMPR1A; BRCA1; BRCA2; BRIP1; BTD; BTK; C2orf25; CA4; CALR3; CAPN3; CAV3; CCDC39; CCDC40; CDH23; CEP290; CERKL; CFTR; CHAT; CHD7; CHEK2; CHM; CHRNA1; CHRNB1; CHRND; CHRNE; CLCN1; CNBP; CNGB1; COH1; COL11A1; COL11A2; COL1A1; COL1A2; COL2A1; COL3A1; COL4A5; COL5A1; COL5A2; COL7A1; COL9A1; CRB1; CRX; CTDP1; CTNS; CYP21A2; CYP27A1; DAX1; DBT; DCX; DES; DHCR7; DJ1; DKC1; DLD; DMD; DMPK; DNAAF1; DNAAF2; DNAH11; DNAH5; DNAI1; DNAI2; DNAL1; DNM2; DOK7; DSC2; DSG2; DSP; DYSF; DYT1; EMD; ENG; EYA1; EYS; F8; F9; FANCA; FANCC; FANCF; FANCG; FANCJ; FANDC2; FBN1; FBXO7; FGFR1; FGFR3; FMO3; FMR1; FOXL2; FRG1; FRMD7; FSCN2; FXN; GAA; GALT; GBA; GBE1; GCSH; GDF5; GJB2; GJB3; GJB6; GLA; GLDC; GNE; GNPTAB; GPC3; GPR143; GUCY2D; HBA1; HBA2; HBB; HD; HERG; HEXA; HFE; HHF; HIBCH; HLA-B27; HMBS; HPLH1; HPRP3; HR; HTNB; HTT; IKBKAP; IKBKG; IL2RG; IMPDH1; ITGB4; JAG1; JPH3; KCNE1; KCNE2; KCNH2; KCNQ1; KCNQ4; KIAA0196; KLHL7; KRAS; KRT14; KRT5; L1CAM; LAMB3; LAMP2; LDB3; LMNA; LMX18; LRAT; LRRK2; MAPT; MC1R; MECP2; MED12; MEN1; MERTK; MFN2; MKKS; MLH1; MMAA; MMAB; MMACHC; MMADHC; MPZ; MSH2; MTM1; MTND5; MTTG; MTTI; MTTK; MTTL1; MTTQ; MUT; MYBPC3; MYH11; MYH6; MYH7; MYL2; MYL3; MYLK2; MYO7A; NDS; ND6; NEMO; NF1; NF2; NIPBL; NROB1; NR2E3; NRAS; NSD1; OCA2; OCRL; OPA1; OTC; PABPN1; PAFAH1B1; PAH; PARK2; PARK7; PARKIN; PAX3; PAX6; PCDH15; PEX1; PEX2; PEX10; PEX13; PEX14; PEX19; PEX26; PEX3; PEX5; PINK1; PKD1; PKD2; PKD3; PKHD1; PKP2; PLEC1; PLOD1; PMM2; PMP22; POLG; PPT1; PRCD; PRKAG2; PRNP; PROM1; PRPF3; PRPF8; PRPH2; PRPN; PSEN1; PSEN2; PTCH1; PTPN11; RAB7A; RAF1; RAI1; RAPSN; RB1; RDH12; RDS; RECQL3; RET; RHO; ROR2; RP1; RP2; RP9; RPE65; RPGR; RPGRIP1; RPL11; RPL35A; RPS10; RPS17; RPS19; RPS24; RPS26; RPS6KA3; RPS7; RPSL5; RS1; RSPH4A; RSPH9; RYR1; RYR2; SALL4; SCA3; SCN5A; SCN9A; SEMA4A; SERPINA1; SERPING1; SGCD; SH3BP2; SHOX; SIX1; SIX5; SLC25A13; SLC25A4; SLC26A4; SMAD4; SMN1; SNCA; SNRNP200; SOD1; SOS1; SOX9; SP110; SPAST; SPATA7; SPG3A; SPG4; SPG7; TAF1; TBX5; TCOF1; TGFBR1; TGFBR2; TNFRSC13C; TNNC1; TNNI3; TNNT1; TNNT2; TNXB; TOPORS; TOR1A; TP53; TPM1; TRNG; TRNI; TRNK; TRNL1; TRNQ; TSC1; TSC2; TTN; TTPA; TTR; TULP1; TWIST1; TXNDC3; TYR; USH1C; USH1H; USH2A; VCL; VHL; VPS13B; WAS; WRN; WT1; and ZNF9.

In some embodiments, the disclosure relates generally to a composition comprising a plurality of target-specific primers designed according to the criteria disclosed here or including any one or more of the target-specific primers disclosed herein, where at least one of the plurality of target-specific primers is substantially complementary across its entire length to at last a portion of one or more genes associated with breast cancer selected from AIM1, AR, ATM, BARD1, BCAS1, BRIP1, CCND1, CCND2, CCNE1, CDH1, CDK3, CDK4, CDKN2A, CDKN2B, CAMK1D, CHEK2, DIRAS3, EGFR, ERBB2, EPHA3, ERBB4, ETV6, GNRH1, KCTD9, CDCA2, EBF2, EMSY, BNIP3L, PNMA2, DPYSL2, ADRA1A, STMN4, TRIM35, PAK1, AQP11, CLSN1A, RSF1, KCTD14, THRSP, NDUFC2, ALG8, KCTD21, USP35, GAB2, DNAH9, ZNF18, MYOCD, STK11, TP53, JAK1, JAK2, MET, PDGFRA, PML, PTEN, RET, TMPRSS2, WNK1, FGFR1, IGF1R, PPP1R12B, PTPRT, GSTM1, IP08, MYC, ZNF703, MDM1, MDM2, MDM4, MKK4, P14 KB, NCOR1, NBN, PALB2, RAD50, RAD51, PAK1, RSF1, INTS4, ZMIZ1, SEPHS1, FOXM1, SDC-CAG1, IGF1R, TSHZ2, RPSK6K1, PPP2R2A, MTAP, MAP2K4, AURKB, BCL2, BUB1, CDCA3, CDCA4, CDC20, CDC45, CHEK1, FOXM1, HDAC2, IGF1R, KIF2C, KIFC1, KRAS, RB1, SMAD4, NCOR1, UTX, MTHDFD1L, RAD51AP1, TTK and UBE2C.

In some embodiments, the disclosure is generally related to a combination of polynucleotides, where the combination of polynucleotides includes at least one polynucleotide selected from Tables 2, 3, 13, 14, 15, 17 and 19 (from U.S. Ser. No. 13/458,739, filed Apr. 27, 2012, hereby incorporated by reference in its entirety), and one or more additional polynucleotides independent of the polynucleotides disclosed herein. In some embodiments, the disclosure is generally related to a combination of polynucleotides, where the combination of polynucleotides includes a polynucleotide having at least 90% identity to one or more polynucleotides selected from Tables 2, 3, 13, 14, 15, 17 and 19 (from U.S. Ser. No. 13/458, 739, filed Apr. 27, 2012, hereby incorporated by reference in its entirety). In some embodiments, the disclosure relates to 2, 3, 4, 5, 6, 7, 8, 9, 10, 20, 30, 40, 50, 60, 70, 80, 90, 100, 200, 500, 1000, 2000, 3000, 4000, 5000, 6000, 7000, 8000, 9000, 10,000 or more polynucleotides selected from Tables 2, 3, 13, 14, 15, 17 and 19 from U.S. Ser. No. 13/458,739, filed Apr. 27, 2012, hereby incorporated by reference in its entirety.

In some embodiments, the disclosure is generally related to a combination of polynucleotides, where the combination of polynucleotides includes at least one polynucleotide selected from Tables 2, 3, 13, 14, 15, 17 and 19 (from U.S. Ser. No. 13/458,739, filed Apr. 27, 2012, hereby incorporated by reference in its entirety), and one or more additional polynucleotides independent of the polynucleotides disclosed herein. In some embodiments, the disclosure is generally related to a combination of polynucleotides, where the combination of polynucleotides includes at least one polynucleotide having at least 90% identity to one or more polynucleotides selected from Tables 2, 3, 13, 14, 15, 17 and 19 from U.S. Ser. No. 13/458,739, filed Apr. 27, 2012, hereby incorporated by reference in its entirety. In some embodiments, the disclosure relates to 2, 3, 4, 5, 6, 7, 8, 9, 10, 20, 30, 40, 50, 60, 70, 80, 90, 100, 200, 500, 1000, 2000, 3000, 4000, 5000, 6000, 7000, 8000, 9000, 10,000 or more polynucleotides selected from Tables 2, 3, 13, 14, 15, 17 and 19 (from U.S. Ser. No. 13/458, 739, filed Apr. 27, 2012, hereby incorporated by reference in its entirety) or one or more polynucleotides having at least 90% identity thereto.

In some embodiments, the disclosure is generally related to a pair of polynucleotides that specifically anneal to a portion of at least one gene selected from EGFR, BRAF or KRAS. In one embodiment, a pair of polynucleotides that specifically anneal to a portion of the EGFR gene includes any one or more of the following Amplicon IDs: 229910389, 227801665, 229055506, 230397881, 230175199, 230195609, 228630698, 230632980, 227722022, 232978808, 231616816, 230481741, 231198336, 229919273, 227816834, 228030652, 230679876, 229747025, 228741519, 228636601, 230635054, 230738160, 232984355, 228941652, 230495367, 231212482, 229608278, 230461276, 228035285, 230683371, 230173849, 330137554, 228857751, 230742871, 232237229, 228956984, 228732632, 231222418, 231493149, 229630617, 229052979, 230392156, 230683680, 230187475, 228709018, 230628101, 227716821, 227830783, 232260099, 230075336, 231314233, and 231239581. In one embodiment, a pair of polynucleotides that specifically anneal to a portion of the BRAF gene includes any one or more of the following Amplicon IDs: 222636793, 223460541, 223967627, 326913823, 223739184, 223944056, 224404546, 222922922, 224119138, 223519358, 223465859, 223971374, 222680486, 223741661, 223950351, 224410546, 222935598, 224119999, 222629880, 223175118, 223719489, 225222024, 222684242, 223700378, 222258987, 222895407, 223103332, 222635553, 223177865, 223960162, 326889377, 223588249, 223708886, 222259284, 222903910, and 223104608. In one embodiment, a pair of polynucleotides that specifically anneal to a portion of the KRAS gene includes any one or more of the following Amplicon IDs: 233361228, 234355242, 234355242, 233466735, 233466735, 231132733, 231132733, 234764991, 234764991, 233467720, 233467720, 231133990, 231133990, 233356818, 326772204, and 326772204.

In some embodiments, the disclosure is generally related to kits (as well as related compositions, methods, apparatuses and systems using such kits) for amplifying one or more target sequences in a sample. In some embodiments, the kits for amplifying one or more target sequences in a sample include at least one target-specific primer that can amplify the at least one target sequence in the sample. In some embodiments, the kit can include at least two target-specific primers that can amplify at least one target sequence in the sample. In another embodiment, the kit can include a plurality of target-specific primers for amplifying at least two target sequences in a sample, where the kit includes a) a first target-specific primer having at least 90% identity to a nucleic acid sequence selected from SEQ ID NOs: 1-103,143 being substantially complementary to the first target sequence in a sense direction; b) a second target-specific primer having at least 90% identity to a nucleic acid sequence selected from SEQ ID NOs: 1-103,143 being substantially complementary to the first target sequence in a antisense direction; c) a third target-specific primer having at least 90% identity to a nucleic acid sequence selected from SEQ ID NOs: 1-103,143 being substantially complementary to the second target sequence in a sense direction; and, d) a fourth target-specific primer having at least 90% identity to a nucleic acid sequence selected from SEQ ID NOs: 1-103,143 being substantially complementary to the second target sequence in a antisense direction. In some embodiments, the sample can be an environmental, aquatic, microbiological, entomological, plant, fungi, animal or mammalian nucleic acid containing sample. In some embodiments, the sample can include a clinical, surgical, physician, forensic or laboratory obtained nucleic acid sample.

In some embodiments, the disclosure relates generally to a method for amplifying a plurality of target sequences in a sample comprising contacting at least some portion of the sample with at least one target-specific primer as disclosed herein, or designed using the primer selection criteria disclosed herein, and a polymerase under amplification conditions thereby producing at least one amplified target sequence. In some embodiments, the method further includes ligating at least one adapter to at least one amplified target sequence, thereby producing at least one adapter-ligated amplified target sequence. In some embodiments, the method includes any one or more of the target-specific primers provided in Tables 2, 3, 13, 14, 15, 17 and 19 (from U.S. Ser. No. 13/458,739, filed Apr. 27, 2012, hereby incorporated by reference in its entirety) or any nucleic acid sequence having at least 90% identity to any one or more of the target-specific primers provided in Tables 2, 3, 13, 14, 15, 17 and 19 (from U.S. Ser. No. 13/458,739, filed Apr. 27, 2012, hereby incorporated by reference in its entirety).

In some embodiments, the disclosure is generally related to an amplification product generated by amplifying at least one target sequence present in a sample with one or more target-specific primers disclosed herein or one or more target-specific primers designed using the primer selection criteria disclosed herein. In some embodiments, the disclosure is generally related to an amplification product generated by contacting at least one target sequence in a sample with one or more target-specific primers disclosed herein or one or more target-specific primers designed using the primer selection criteria disclosed herein under amplification conditions. In some embodiments, the amplification product can include one or more mutations associated with cancer or inherited disease. For example, a sample suspected of containing one or more mutations associated with at least one cancer can be subjected to any one of the amplification methods disclosed herein. The amplification products obtained from the selected amplification method can optionally be compared to a normal or matched sample known to be noncancerous with respect to the at least one cancer, and can therefore be used as a reference sample. In some embodiments, the amplification products obtained by the methods disclosed herein can be optionally sequenced using any suitable nucleic acid sequencing platform to determine the nucleic acid sequence of the amplification products, and optionally compared to sequencing information from the normal or non-cancerous sample. In some embodiments, amplification products can include one or more markers associated with antibiotic resistance, pathogenicity or genetic modification. In some embodiments, nucleic acid sequences of one or more amplification products obtained by contacting at least one target sequence with at least one target-specific primer under amplification conditions can be used to determine the presence or absence of a genetic variant within the one or more amplification products.

In some embodiments, the disclosure generally relates to compositions (as well as related kits, methods, systems and apparatuses using the disclosed compositions) for performing nucleic acid amplification and nucleic acid synthesis. In some embodiments, the composition includes a plurality of target-specific primer pairs, at least one target-specific primer pair including a target-specific forward primer and a target-specific reverse primer. In some embodiments, the composition includes at least 100, 200, 500, 750, 1000, 2500, 5000, 7500, 10000, 12000, 15000, 17500, 20000 or 50000 different primer pairs, some or all of which can be target-specific. Optionally at least two of the different target-specific primer pairs are directed to (i.e., are specific for) different target sequences.

In some embodiments, the composition includes at least one target-specific primer pair that can be specific for at least one amplified target sequence. In some embodiments, the composition includes a plurality of target-specific primer pairs, at least two target-specific primer pairs being specific for at different amplified target sequences. In some embodiments, the composition includes a target-specific primer pair, which each member of the primer pair includes a target-specific primer that can hybridize to at least a portion of a first amplified sequence or its complement, and that is substantially non-complementary to the 3' end or the 5' end of any other amplified sequence in the sample. In some embodiments, the composition includes at least one target-specific primer pair that can be substantially non-complementary to a portion of any other nucleic acid molecule in the sample. In some embodiments, the compositions include a plurality of target-specific primer pairs that include one or more cleavable groups at one or more locations within the target-specific primer pair.

In some embodiments, the composition includes one or more target-specific primer pairs that can amplify a short tandem repeat, single nucleotide polymorphism, gene, exon, coding region, exome, or portion thereof. For example, a plurality of target-specific primer pairs can uniformly amplify one gene, exon, coding region, exome or portion thereof. In some embodiments, the compositions include target-specific primer pairs designed to minimize overlap of nucleotide sequences amplified using the one or more target-specific primer pairs. In some embodiments, the nucleotide sequence overlap between one or more target-specific primers can be minimized at the 3' end, the 5' end, or both. In some embodiments, at least one primer in a plurality of target-specific primers includes less than 5 nucleotides of nucleotide sequence overlap at the 3' end, 5' end or both. In some embodiments, at least one target-specific primer of a plurality of target-specific primers includes a nucleotide sequence gap of at least one nucleotide, as compared to the plurality of target-specific primers. In some embodiments, the compositions include one or more target-specific primer pairs designed to comprehensively amplify one or more genes or exons. For example, a plurality of target-specific primer pairs can be designed to uniformly amplify (i.e., provide 100% representation of all nucleotides) in a single gene or exon.

In some embodiments, at least two pairs of target-specific primers are capable of hybridizing to locations on a template nucleic acid and serving as substrates for template-dependent primer extension by a polymerase. In some embodiments, the template-dependent primer extension can include amplification of the region of template located between the sites of hybridization of the primers of the at least two pairs of primers, resulting in formation of an amplified region or "amplicon". Typically, the sequence of the amplicon includes the sequence of the template located between the sites of hybridization of the primers, as well as at least part of the sequence of the primers themselves. In some embodiments, the amplification reaction can include at least about 5, 10, 25, 50, 100, 150, 200, 250, 400, 500, 750, 1000, 1200, 1250, 1500, 1750, 2000, 2250, 2500, 2750, 3000, 5000, 7500 or 10,000 different primer pairs. In some embodiments, the amplification reaction can result in the generation of at least about 5, 10, 25, 50, 100, 150, 200, 250, 400, 500, 750, 1000, 1200, 1250, 1500, 1750, 2000, 2250, 2500, 2750, 3000, 5000, 7500 or 10,000 different amplicons. In some embodiments, at least about 75%, 80%, 90%, 95%, 97% or 99% of the amplicons generated during the amplification reaction are similarly sized, for example, the amplicons differ in size from each other by no more than 5, 10, 25, 50, 75, 100, 500, 1000 or 2000 nucleotides. In some embodiments, the difference in length between any two amplicons is no greater than 1%, 5%, or 10% of average amplicon length in the amplification reaction mixture. Optionally, the average amplicon length is about 50, 60, 70, 80, 90, 100, 110, 120, 130, 140, 150, 200, 250, 500, 1000, 2000, 10,000 nucleotides or greater. In some embodiments, the standard deviation in length among amplicons in a mixture is no greater than 0.1, 0.25, 0.4, 0.5, 0.75, 1, 1.5, 2.0, 2.4 or 3.0

In some embodiments, the compositions include target-specific primer pairs designed to generate amplified target sequences that overlap with an adjacent amplified target sequence by a single nucleotide. In some embodiments, the compositions include target-specific primer pairs designed to generate an amplified target sequence that does not overlap with an adjacent amplified target sequence. For example, target-specific primer pairs can be designed to generate amplified target sequences that are separated by one or more nucleotides. In some embodiments, the composition includes target-specific primer pairs designed to separate amplified target sequences by about 50 nucleotides.

In some embodiments, the composition includes a plurality of exon- or gene-specific, target-specific primer pairs that can be substantially complementary to an individual exon or gene. In some embodiments, the composition includes a plurality of exon- or gene-specific, target-specific primer pairs that can be substantially complementary to one or more exons or genes. In some embodiments, the composition includes a plurality of substantially complementary exon- or gene-specific, target-specific primer pairs and that no two primer pairs amplify greater than 10% of the same target sequence. In some embodiments, no two target-specific primer pairs amplify the same exon or gene. In some embodiments, the target-specific primer pairs amplify about 100 to about 600 nucleotides of a target sequence. In some embodiments, the target-specific primer pairs can be used to amplify about 25% to 100% of an exon, gene or coding region. In some embodiments, the compositions includes a plurality of target-specific primer pairs to generate a plurality of amplified target sequences and that no individual amplified target sequence is overexpressed by more than 50% as compared to the other amplified target sequences. In some embodiments, the compositions includes a plurality of target-specific primer pairs designed to generate a plurality of amplified target sequences that are substantially homogenous (i.e., homogenous with respect to GC content, melting temperature, or amplified target sequence length). In some embodiments, the plurality of target-specific primer pairs overlap in sequence by no more than five nucleotides.

In some embodiments, the disclosure generally relates to a method for preventing or eliminating non-specific amplification products in a multiplex PCR reaction. In some embodiments, the method includes (as well as related compositions, kits, systems and apparatuses used using the disclosed methods) hybridizing one or more target-specific primer pairs to a target sequence in a sample having a plurality of target sequences, extending the hybridized target-specific primers to form a plurality of amplified target sequences, denaturing and annealing the amplified target sequences to form a plurality of double-stranded amplified target sequences and performing a digesting step on the sample containing the double-stranded amplified target sequences to eliminate non-specific amplification products. In some embodiments, the method includes one or more cleavable groups at one or more locations in one or more target-specific primer pairs. In some embodiments, each target-specific primer pair includes at least one cleavable group. In some embodiments, each target-specific primer of the primer pairs includes a cleavable group. In some embodiments, the digestion is an enzymatic or chemical digestion. In some embodiments, the digestion step includes partial digestion of a target-specific primer of an amplified target sequence. In some embodiments, the method includes a thermostable polymerase. In some embodiments, the thermostable polymerase can be optionally reactivated by heat or chemical treatment.

In some embodiments, the composition includes a plurality of target-specific primer pairs directed to one or more diseases or disorders. In some embodiments, a target-specific primer pair can be substantially complementary to a target sequence correlated or associated with one or more cancers.

In some embodiments, a target-specific primer pair can be substantially complementary to a target sequence correlated with or associated with one or more congenital or inherited disorders. In some embodiments, one or more target-specific primer pairs can be associated with one or more neurological, metabolic, neuromuscular, developmental, cardiovascular or autoimmune disorders. In some embodiments, one or more target-specific primer pairs can be associated with one or more genes or exons associated with one or more neurological, metabolic, neuromuscular, developmental, cardiovascular or autoimmune disorders. In some embodiments, the plurality of target-specific primers can include a gene or gene fragment associated with neoplastic development in mammals.

In some embodiments, the disclosure relates generally to compositions (as well as related kits, methods, systems and apparatuses using the disclosed compositions) comprising any, some or all of the primers disclosed herein, including in the Examples and in the related appendices, supplements and sequence listings attached hereto and including all the tables in U.S. Ser. No. 13/458,739, filed Apr. 27, 2012, hereby incorporated by reference in its entirety. In some embodiments, the disclosure relates generally to compositions (as well as related kits, methods, systems and apparatuses using the disclosed compositions) comprising any of the primer pools used in the Examples, or any subset thereof. For example, in some embodiments the disclosure relates generally to compositions including one or more target-specific primers selected from the primers listed in Tables 2, 3, 13, 14, 15, 17 and 19 (from U.S. Ser. No. 13/458,739, filed Apr. 27, 2012, hereby incorporated by reference in its entirety), which include sets of primers designed and selected using the design methods and selection criteria of the disclosure, and which have been used to perform highly multiplex amplification according to the methods disclosed herein. It will be readily appreciated by one of ordinary skill in the art that any subsets of each of the primer sets set forth in Tables 2, 3, 13, 14, 15, 17 and 19 (from U.S. Ser. No. 13/458,739, filed Apr. 27, 2012, hereby incorporated by reference in its entirety) can also be expected to support multiplex amplification, since the entire set of primers of each table (e.g., tables found in U.S. Ser. No. 13/458,739, filed Apr. 27, 2012, hereby incorporated by reference in its entirety) has been demonstrated to support such multiplex amplification and removal of particular primer pairs from the pool will not be expected to significantly alter the performance of the remaining primers for purposes of multiplex amplification. In some embodiments, the disclosure relates generally to compositions including any 1, 2, 5, 10, 25, 50, 100, 250, 500, 750, 1000, 2500, 5000, 7500, 10000, 12500, 50000, 100000 or more different target-specific primer pairs set forth in Tables 2, 3, 13, 14, 15, 17 and 19 (from U.S. Ser. No. 13/458,739, filed Apr. 27, 2012, hereby incorporated by reference in its entirety). In some embodiments, the disclosure relates to a composition including at least 1, 2, 5, 10, 25, 50, 100, 250, 500, 750, 1000, 2500, 5000, 7500, 10000, 12500, 50000, 100000 or more primers selected from Tables 2, 3, 13, 14, 15, 17 and 19 (from U.S. Ser. No. 13/458,739, filed Apr. 27, 2012, hereby incorporated by reference in its entirety), or their complements. In some embodiments, the disclosure relates to a composition including at least 1, 2, 5, 10, 25, 50, 100, 250, 500, 750, 1000, 2500, 5000, 7500, 10000, 12500, 50000, 100000 or more primers that are at least 85% identical or complementary to any primer of Tables 2, 3, 13, 14, 15, 17 and 19 (from U.S. Ser. No. 13/458, 739, filed Apr. 27, 2012, hereby incorporated by reference in its entirety). In some embodiments, the composition includes at least one 1, 2, 5, 10, 25, 50, 100, 250, 500, 750, 1000, 2500, 5000, 7500, 10000, 12500, 50000, 100000 or more primers selected from Tables 2, 3, 13, 14, 15, 17 and 19 (from U.S. Ser. No. 13/458,739, filed Apr. 27, 2012, hereby incorporated by reference in its entirety), or their complements, wherein at least one primer includes at least one nucleotide substitution. A nucleotide substitution includes replacement of any nucleotide residue or nucleobase of any primer with any other nucleotide or nucleobase, and can include, for example, purine to purine substitutions, pyrimidine to pyrimidine substitutions, purine to pyrimidine substitutions, and pyrimidine to purine substitutions. In some embodiments, the at least one primer of the composition can include any one, two, three, four or more nucleotide substitutions. In some embodiments, the at least one primer of the composition includes at least one primer in which any one, some or all of the uracil-containing nucleotide residues or nucleobases of the primer are replaced with a thymine-containing nucleotide residue or nucleobase. In some embodiments, the at least one primer of the composition includes at least one primer in which any one, two, three, four, five or more uracil-containing nucleotide residues or nucleobases of the primer are replaced with a thymine-containing nucleotide residue or nucleobase.

In some embodiments, a target-specific primer pair can include a nucleic acid sequence including a somatic or germline mutation. In some embodiments, the germline or somatic mutation can be found in any one or more of the genes provided in Tables 1, 4, 16 or 18 (from U.S. Ser. No. 13/458, 739, filed Apr. 27, 2012, hereby incorporated by reference in its entirety). In some embodiments, the target-specific primer pairs can be used to amplify a target sequence that can be used to detect the presence of mutations at less than 5% allele frequency. In some embodiments, the plurality of target-specific primers includes at least 500, at least 1000, at least 3000, at least 6000, at least 10000, at least 12000, or more target-specific primer pairs.

In some embodiments, the disclosure relates generally to a kit for performing multiplex nucleic acid amplification or multiplex nucleic acid synthesis. In some embodiments, the kit comprises a plurality of target-specific primers. In some embodiments, the kit can further include a polymerase, at least one adapter and/or a cleaving reagent. In some embodiments, the kit can also include dATP, dCTP, dGTP, dTTP and/or an antibody. In some embodiments, the cleaving reagent is any reagent that can cleave one or more cleaving groups present in one or more target-specific primers. In some embodiments the cleaving reagent can include an enzyme or chemical reagent. In some embodiments, the cleaving reagent can include an enzyme with an affinity for apurinic bases. In some embodiments, the cleaving reagent can include a first enzyme with an affinity for a first cleavable group and can further include a second enzyme with an affinity for a second cleavable group. In some embodiments, the kit can further include an enzyme with an affinity for abasic sites. In some embodiments, the polymerase is a thermostable polymerase. In some embodiments, the kits can include one or more preservatives, adjuvants or nucleic acid sequencing barcodes.

In some embodiments, the disclosure relates generally to methods (as well as related compositions, systems, kits and apparatuses) for determining copy number variation comprising performing any of the amplification methods disclosed herein.

DETAILED DESCRIPTION

The following description of various exemplary embodiments is exemplary and explanatory only and is not to be construed as limiting or restrictive in any way. Other embodiments, features, objects, and advantages of the present teachings will be apparent from the description and accompanying drawings, and from the claims.

As used herein, "amplify", "amplifying" or "amplification reaction" and their derivatives, refer generally to any action or process whereby at least a portion of a nucleic acid molecule (referred to as a template nucleic acid molecule) is replicated or copied into at least one additional nucleic acid molecule. The additional nucleic acid molecule optionally includes sequence that is substantially identical or substantially complementary to at least some portion of the template nucleic acid molecule. The template nucleic acid molecule can be single-stranded or double-stranded and the additional nucleic acid molecule can independently be single-stranded or double-stranded. In some embodiments, amplification includes a template-dependent in vitro enzyme-catalyzed reaction for the production of at least one copy of at least some portion of the nucleic acid molecule or the production of at least one copy of a nucleic acid sequence that is complementary to at least some portion of the nucleic acid molecule. Amplification optionally includes linear or exponential replication of a nucleic acid molecule. In some embodiments, such amplification is performed using isothermal conditions; in other embodiments, such amplification can include thermocycling. In some embodiments, the amplification is a multiplex amplification that includes the simultaneous amplification of a plurality of target sequences in a single amplification reaction. At least some of the target sequences can be situated on the same nucleic acid molecule or on different target nucleic acid molecules included in the single amplification reaction. In some embodiments, "amplification" includes amplification of at least some portion of DNA- and RNA-based nucleic acids alone, or in combination. The amplification reaction can include single or double-stranded nucleic acid substrates and can further including any of the amplification processes known to one of ordinary skill in the art. In some embodiments, the amplification reaction includes polymerase chain reaction (PCR).

As used herein, "amplification conditions" and its derivatives, generally refers to conditions suitable for amplifying one or more nucleic acid sequences. Such amplification can be linear or exponential. In some embodiments, the amplification conditions can include isothermal conditions or alternatively can include thermocyling conditions, or a combination of isothermal and themocycling conditions. In some embodiments, the conditions suitable for amplifying one or more nucleic acid sequences includes polymerase chain reaction (PCR) conditions. Typically, the amplification conditions refer to a reaction mixture that is sufficient to amplify nucleic acids such as one or more target sequences, or to amplify an amplified target sequence ligated to one or more adapters, e.g., an adapter-ligated amplified target sequence. Generally, the amplification conditions include a catalyst for amplification or for nucleic acid synthesis, for example a polymerase; a primer that possesses some degree of complementarity to the nucleic acid to be amplified; and nucleotides, such as deoxyribonucleotide triphosphates (dNTPs) to promote extension of the primer once hybridized to the nucleic acid. The amplification conditions can require hybridization or annealing of a primer to a nucleic acid, extension of the primer and a denaturing step in which the extended primer is separated from the nucleic acid sequence undergoing amplification. Typically, but not necessarily, amplification conditions can include thermocycling; in some embodiments, amplification conditions include a plurality of cycles where the steps of annealing, extending and separating are repeated. Typically, the amplification conditions include cations such as $Mg^{++}$ or $Mn^{++}$ (e.g., $MgCl_2$, etc) and can also include various modifiers of ionic strength.

As used herein, "target sequence" or "target sequence of interest" and its derivatives, refers generally to any single or double-stranded nucleic acid sequence that can be amplified or synthesized according to the disclosure, including any nucleic acid sequence suspected or expected to be present in a sample. In some embodiments, the target sequence is present in double-stranded form and includes at least a portion of the particular nucleotide sequence to be amplified or synthesized, or its complement, prior to the addition of target-specific primers or appended adapters. Target sequences can include the nucleic acids to which primers useful in the amplification or synthesis reaction can hybridize prior to extension by a polymerase. In some embodiments, the term refers to a nucleic acid sequence whose sequence identity, ordering or location of nucleotides is determined by one or more of the methods of the disclosure.

As defined herein, "sample" and its derivatives, is used in its broadest sense and includes any specimen, culture and the like that is suspected of including a target. In some embodiments, the sample comprises DNA, RNA, PNA, LNA, chimeric, hybrid, or multiplex-forms of nucleic acids. The sample can include any biological, clinical, surgical, agricultural, atmospheric or aquatic-based specimen containing one or more nucleic acids. The term also includes any isolated nucleic acid sample such a genomic DNA, fresh-frozen or formalin-fixed paraffin-embedded nucleic acid specimen.

As used herein, "contacting" and its derivatives, when used in reference to two or more components, refers generally to any process whereby the approach, proximity, mixture or commingling of the referenced components is promoted or achieved without necessarily requiring physical contact of such components, and includes mixing of solutions containing any one or more of the referenced components with each other. The referenced components may be contacted in any particular order or combination and the particular order of recitation of components is not limiting. For example, "contacting A with B and C" encompasses embodiments where A is first contacted with B then C, as well as embodiments where C is contacted with A then B, as well as embodiments where a mixture of A and C is contacted with B, and the like. Furthermore, such contacting does not necessarily require that the end result of the contacting process be a mixture including all of the referenced components, as long as at some point during the contacting process all of the referenced components are simultaneously present or simultaneously included in the same mixture or solution. For example, "contacting A with B and C" can include embodiments wherein C is first contacted with A to form a first mixture, which first mixture is then contacted with B to form a second mixture, following which C is removed from the second mixture; optionally A can then also be removed, leaving only B. Where one or more of the referenced components to be contacted includes a plurality (e.g, "contacting a target sequence with a plurality of target-specific primers and a polymerase"), then each member of the plurality can be viewed as an individual component of the contacting process, such that the contacting can include contacting of any one or more members of the plurality with any other member of the plurality and/or with any other referenced component (e.g., some but not all of the plurality of target specific primers can be contacted with a target sequence, then a polymerase, and then with other members of the plurality of target-specific primers) in any order or combination.

As used herein, the term "primer" and its derivatives refer generally to any polynucleotide that can hybridize to a target sequence of interest. In some embodiments, the primer can also serve to prime nucleic acid synthesis. Typically, the primer functions as a substrate onto which nucleotides can be polymerized by a polymerase; in some embodiments, however, the primer can become incorporated into the synthesized nucleic acid strand and provide a site to which another primer can hybridize to prime synthesis of a new strand that is complementary to the synthesized nucleic acid molecule. The primer may be comprised of any combination of nucleotides or analogs thereof, which may be optionally linked to form a linear polymer of any suitable length. In some embodiments, the primer is a single-stranded oligonucleotide or polynucleotide. (For purposes of this disclosure, the terms 'polynucleotide" and "oligonucleotide" are used interchangeably herein and do not necessarily indicate any difference in length between the two). In some embodiments, the primer is single-stranded but it can also be double-stranded. The primer optionally occurs naturally, as in a purified restriction digest, or can be produced synthetically. In some embodiments, the primer acts as a point of initiation for amplification or synthesis when exposed to amplification or synthesis conditions; such amplification or synthesis can occur in a template-dependent fashion and optionally results in formation of a primer extension product that is complementary to at least a portion of the target sequence. Exemplary amplification or synthesis conditions can include contacting the primer with a polynucleotide template (e.g., a template including a target sequence), nucleotides and an inducing agent such as a polymerase at a suitable temperature and pH to induce polymerization of nucleotides onto an end of the target-specific primer. If double-stranded, the primer can optionally be treated to separate its strands before being used to prepare primer extension products. In some embodiments, the primer is an oligodeoxyribonucleotide or an oligoribonucleotide. In some embodiments, the primer can include one or more nucleotide analogs. The exact length and/or composition, including sequence, of the target-specific primer can influence many properties, including melting temperature (Tm), GC content, formation of secondary structures, repeat nucleotide motifs, length of predicted primer extension products, extent of coverage across a nucleic acid molecule of interest, number of primers present in a single amplification or synthesis reaction, presence of nucleotide analogs or modified nucleotides within the primers, and the like. In some embodiments, a primer can be paired with a compatible primer within an amplification or synthesis reaction to form a primer pair consisting or a forward primer and a reverse primer. In some embodiments, the forward primer of the primer pair includes a sequence that is substantially complementary to at least a portion of a strand of a nucleic acid molecule, and the reverse primer of the primer of the primer pair includes a sequence that is substantially identical to at least of portion of the strand. In some embodiments, the forward primer and the reverse primer are capable of hybridizing to opposite strands of a nucleic acid duplex. Optionally, the forward primer primes synthesis of a first nucleic acid strand, and the reverse primer primes synthesis of a second nucleic acid strand, wherein the first and second strands are substantially complementary to each other, or can hybridize to form a double-stranded nucleic acid molecule. In some embodiments, one end of an amplification or synthesis product is defined by the forward primer and the other end of the amplification or synthesis product is defined by the reverse primer. In some embodiments, where the amplification or synthesis of lengthy primer extension products is required, such as amplifying an exon, coding region, or gene, several primer pairs can be created than span the desired length to enable sufficient amplification of the region. In some embodiments, a primer can include one or more cleavable groups. In some embodiments, primer lengths are in the range of about 10 to about 60 nucleotides, about 12 to about 50 nucleotides and about 15 to about 40 nucleotides in length. Typically, a primer is capable of hybridizing to a corresponding target sequence and undergoing primer extension when exposed to amplification conditions in the presence of dNTPS and a polymerase. In some instances, the particular nucleotide sequence or a portion of the primer is known at the outset of the amplification reaction or can be determined by one or more of the methods disclosed herein. In some embodiments, the primer includes one or more cleavable groups at one or more locations within the primer.

As used herein, "target-specific primer" and its derivatives, refers generally to a single stranded or double-stranded polynucleotide, typically an oligonucleotide, that includes at least one sequence that is at least 50% complementary, typically at least 75% complementary or at least 85% complementary, more typically at least 90% complementary, more typically at least 95% complementary, more typically at least 98% or at least 99% complementary, or identical, to at least a portion of a nucleic acid molecule that includes a target sequence. In such instances, the target-specific primer and target sequence are described as "corresponding" to each other. In some embodiments, the target-specific primer is capable of hybridizing to at least a portion of its corresponding target sequence (or to a complement of the target sequence); such hybridization can optionally be performed under standard hybridization conditions or under stringent hybridization conditions. In some embodiments, the target-specific primer is not capable of hybridizing to the target sequence, or to its complement, but is capable of hybridizing to a portion of a nucleic acid strand including the target sequence, or to its complement. In some embodiments, the target-specific primer includes at least one sequence that is at least 75% complementary, typically at least 85% complementary, more typically at least 90% complementary, more typically at least 95% complementary, more typically at least 98% complementary, or more typically at least 99% complementary, to at least a portion of the target sequence itself; in other embodiments, the target-specific primer includes at least one sequence that is at least 75% complementary, typically at least 85% complementary, more typically at least 90% complementary, more typically at least 95% complementary, more typically at least 98% complementary, or more typically at least 99% complementary, to at least a portion of the nucleic acid molecule other than the target sequence. In some embodiments, the target-specific primer is substantially non-complementary to other target sequences present in the sample; optionally, the target-specific primer is substantially non-complementary to other nucleic acid molecules present in the sample. In some embodiments, nucleic acid molecules present in the sample that do not include or correspond to a target sequence (or to a complement of the target sequence) are referred to as "non-specific" sequences or "non-specific nucleic acids". In some embodiments, the target-specific primer is designed to include a nucleotide sequence that is substantially complementary to at least a portion of its corresponding target sequence. In some embodiments, a target-specific primer is at least 95% complementary, or at least 99% complementary, or identical, across its entire length to at least a portion of a nucleic acid molecule that includes its corresponding target sequence. In some embodiments, a target-specific primer can be at least 90%, at least 95% complementary, at least 98% complementary or at least 99% complementary, or identical, across its entire length to at least a portion of its corresponding target sequence. In some embodiments, a forward target-specific primer and a reverse target-specific primer define a target-specific primer pair that can be used to amplify the target sequence via template-dependent primer extension. Typically, each primer of a target-specific primer pair includes at least one sequence that is substantially complementary to at least a portion of a nucleic acid molecule including a corresponding target sequence but that is less than 50% complementary to at least one other target sequence in the sample. In some embodiments, amplification can be performed using multiple target-specific primer pairs in a single amplification reaction, wherein each primer pair includes a forward target-specific primer and a reverse target-specific primer, each including at least one sequence that substantially complementary or substantially identical to a corresponding target sequence in the sample, and each primer pair having a different corresponding target sequence. In some embodiments, the target-specific primer can be substantially non-complementary at its 3' end or its 5' end to any other target-specific primer present in an amplification reaction. In some embodiments, the target-specific primer can include minimal cross hybridization to other target-specific primers in the amplification reaction. In some embodiments, target-specific primers include minimal cross-hybridization to non-specific sequences in the amplification reaction mixture. In some embodiments, the target-specific primers include minimal self-complementarity. In some embodiments, the target-specific primers can include one or more cleavable groups located at the 3' end. In some embodiments, the target-specific primers can include one or more cleavable groups located near or about a central nucleotide of the target-specific primer. In some embodiments, one of more targets-specific primers includes only non-cleavable nucleotides at the 5' end of the target-specific primer. In some embodiments, a target specific primer includes minimal nucleotide sequence overlap at the 3' end or the 5' end of the primer as compared to one or more different target-specific primers, optionally in the same amplification reaction. In some embodiments 1, 2, 3, 4, 5, 6, 7, 8, 9, 10 or more, target-specific primers in a single reaction mixture include one or more of the above embodiments. In some embodiments, substantially all of the plurality of target-specific primers in a single reaction mixture includes one or more of the above embodiments.

As used herein, "polymerase" and its derivatives, generally refers to any enzyme that can catalyze the polymerization of nucleotides (including analogs thereof) into a nucleic acid strand. Typically but not necessarily, such nucleotide polymerization can occur in a template-dependent fashion. Such polymerases can include without limitation naturally occurring polymerases and any subunits and truncations thereof, mutant polymerases, variant polymerases, recombinant, fusion or otherwise engineered polymerases, chemically modified polymerases, synthetic molecules or assemblies, and any analogs, derivatives or fragments thereof that retain the ability to catalyze such polymerization. Optionally, the polymerase can be a mutant polymerase comprising one or more mutations involving the replacement of one or more amino acids with other amino acids, the insertion or deletion of one or more amino acids from the polymerase, or the linkage of parts of two or more polymerases. Typically, the polymerase comprises one or more active sites at which nucleotide binding and/or catalysis of nucleotide polymerization can occur. Some exemplary polymerases include without limitation DNA polymerases and RNA polymerases. The term "polymerase" and its variants, as used herein, also refers to fusion proteins comprising at least two portions linked to each other, where the first portion comprises a peptide that can catalyze the polymerization of nucleotides into a nucleic acid strand and is linked to a second portion that comprises a second polypeptide. In some embodiments, the second polypeptide can include a reporter enzyme or a processivity-enhancing domain. Optionally, the polymerase can possess 5' exonuclease activity or terminal transferase activity. In some embodiments, the polymerase can be optionally reactivated, for example through the use of heat, chemicals or re-addition of new amounts of polymerase into a reaction mixture. In some embodiments, the polymerase can include a hot-start polymerase or an aptamer based polymerase that optionally can be reactivated.

As used herein, the term "nucleotide" and its variants comprises any compound, including without limitation any naturally occurring nucleotide or analog thereof, which can bind selectively to, or can be polymerized by, a polymerase. Typically, but not necessarily, selective binding of the nucleotide to the polymerase is followed by polymerization of the nucleotide into a nucleic acid strand by the polymerase; occasionally however the nucleotide may dissociate from the polymerase without becoming incorporated into the nucleic acid strand, an event referred to herein as a "non-productive" event. Such nucleotides include not only naturally occurring nucleotides but also any analogs, regardless of their structure, that can bind selectively to, or can be polymerized by, a polymerase. While naturally occurring nucleotides typically comprise base, sugar and phosphate moieties, the nucleotides of the present disclosure can include compounds lacking any one, some or all of such moieties. In some embodiments, the nucleotide can optionally include a chain of phosphorus atoms comprising three, four, five, six, seven, eight, nine, ten or more phosphorus atoms. In some embodiments, the phosphorus chain can be attached to any carbon of a sugar ring, such as the 5' carbon. The phosphorus chain can be linked to the sugar with an intervening O or S. In one embodiment, one or more phosphorus atoms in the chain can be part of a phosphate group having P and O. In another embodiment, the phosphorus atoms in the chain can be linked together with intervening O, NH, S, methylene, substituted methylene, ethylene, substituted ethylene, $CNH_2$, $C(O)$, $C(CH_2)$, $CH_2CH_2$, or $C(OH)CH_2R$ (where R can be a 4-pyridine or 1-imidazole). In one embodiment, the phosphorus atoms in the chain can have side groups having O, $BH_3$, or S. In the phosphorus chain, a phosphorus atom with a side group other than O can be a substituted phosphate group. In the phosphorus chain, phosphorus atoms with an intervening atom other than O can be a substituted phosphate group. Some examples of nucleotide analogs are described in Xu, U.S. Pat. No. 7,405,281. In some embodiments, the nucleotide comprises a label and referred to herein as a "labeled nucleotide"; the label of the labeled nucleotide is referred to herein as a "nucleotide label". In some embodiments, the label can be in the form of a fluorescent dye attached to the terminal phosphate group, i.e., the phosphate group most distal from the sugar. Some examples of nucleotides that can be used in the disclosed methods and compositions include, but are not limited to, ribonucleotides, deoxyribonucleotides, modified ribonucleotides, modified deoxyribonucleotides, ribonucleotide polyphosphates, deoxyribonucleotide polyphosphates, modified ribonucleotide polyphosphates, modified deoxyribonucleotide polyphosphates, peptide nucleotides, modified peptide nucleotides, metallonucleosides, phosphonate nucleosides, and modified phosphate-sugar backbone nucleotides, analogs, derivatives, or variants of the foregoing compounds, and the like. In some embodiments, the nucleotide can comprise non-oxygen moieties such as, for example, thio- or borano-moieties, in place of the oxygen moiety bridging the alpha phosphate and the sugar of the nucleotide, or the alpha and beta phosphates of the nucleotide, or the beta and gamma phosphates of the nucleotide, or between any other two phosphates of the nucleotide, or any combination thereof. "Nucleotide 5'-triphosphate" refers to a nucleotide with a triphosphate ester group at the 5' position, and are sometimes denoted as "NTP", or "dNTP" and "ddNTP" to particularly point out the structural features of the ribose sugar. The triphosphate ester group can include sulfur substitutions for the various oxygens, e.g. alpha.-thio-nucleotide 5'-triphosphates. For a review of nucleic acid chemistry, see: Shabarova, Z. and Bogdanov, A. Advanced Organic Chemistry of Nucleic Acids, VCH, New York, 1994.

The term "extension" and its variants, as used herein, when used in reference to a given primer, comprises any in vivo or in vitro enzymatic activity characteristic of a given polymerase that relates to polymerization of one or more nucleotides onto an end of an existing nucleic acid molecule. Typically but not necessarily such primer extension occurs in a template-dependent fashion; during template-dependent extension, the order and selection of bases is driven by established base pairing rules, which can include Watson-Crick type base pairing rules or alternatively (and especially in the case of extension reactions involving nucleotide analogs) by some other type of base pairing paradigm. In one non-limiting example, extension occurs via polymerization of nucleotides on the 3'OH end of the nucleic acid molecule by the polymerase.

The term "portion" and its variants, as used herein, when used in reference to a given nucleic acid molecule, for example a primer or a template nucleic acid molecule, comprises any number of contiguous nucleotides within the length of the nucleic acid molecule, including the partial or entire length of the nucleic acid molecule.

The terms "identity" and "identical" and their variants, as used herein, when used in reference to two or more nucleic acid sequences, refer to similarity in sequence of the two or more sequences (e.g., nucleotide or polypeptide sequences). In the context of two or more homologous sequences, the percent identity or homology of the sequences or subsequences thereof indicates the percentage of all monomeric units (e.g., nucleotides or amino acids) that are the same (i.e., about 70% identity, preferably 75%, 80%, 85%, 90%, 95%, 98% or 99% identity). The percent identity can be over a specified region, when compared and aligned for maximum correspondence over a comparison window, or designated region as measured using a BLAST or BLAST 2.0 sequence comparison algorithms with default parameters described below, or by manual alignment and visual inspection. Sequences are said to be "substantially identical" when there is at least 85% identity at the amino acid level or at the nucleotide level. Preferably, the identity exists over a region that is at least about 25, 50, or 100 residues in length, or across the entire length of at least one compared sequence. A typical algorithm for determining percent sequence identity and sequence similarity are the BLAST and BLAST 2.0 algorithms, which are described in Altschul et al, Nuc. Acids Res. 25:3389-3402 (1977). Other methods include the algorithms of Smith & Waterman, Adv. Appl. Math. 2:482 (1981), and Needleman & Wunsch, J. Mol. Biol. 48:443 (1970), etc. Another indication that two nucleic acid sequences are substantially identical is that the two molecules or their complements hybridize to each other under stringent hybridization conditions.

The terms "complementary" and "complement" and their variants, as used herein, refer to any two or more nucleic acid sequences (e.g., portions or entireties of template nucleic acid molecules, target sequences and/or primers) that can undergo cumulative base pairing at two or more individual corresponding positions in antiparallel orientation, as in a hybridized duplex. Such base pairing can proceed according to any set of established rules, for example according to Watson-Crick base pairing rules or according to some other base pairing paradigm. Optionally there can be "complete" or "total" complementarity between a first and second nucleic acid sequence where each nucleotide in the first nucleic acid sequence can undergo a stabilizing base pairing interaction with a nucleotide in the corresponding antiparallel position on the second nucleic acid sequence. "Partial" complementarity describes nucleic acid sequences in which at least 20%, but less than 100%, of the residues of one nucleic acid sequence are complementary to residues in the other nucleic acid sequence. In some embodiments, at least 50%, but less than 100%, of the residues of one nucleic acid sequence are complementary to residues in the other nucleic acid sequence. In some embodiments, at least 70%, 80%, 90%, 95% or 98%, but less than 100%, of the residues of one nucleic acid sequence are complementary to residues in the other nucleic acid sequence. Sequences are said to be "substantially complementary" when at least 85% of the residues of one nucleic acid sequence are complementary to residues in the other nucleic acid sequence. In some embodiments, two complementary or substantially complementary sequences are capable of hybridizing to each other under standard or stringent hybridization conditions. "Non-complementary" describes nucleic acid sequences in which less than 20% of the residues of one nucleic acid sequence are complementary to residues in the other nucleic acid sequence. Sequences are said to be "substantially non-complementary" when less than 15% of the residues of one nucleic acid sequence are complementary to residues in the other nucleic acid sequence. In some embodiments, two non-complementary or substantially non-complementary sequences cannot hybridize to each other under standard or stringent hybridization conditions. A "mismatch" is present at any position in the two opposed nucleotides are not complementary. Complementary nucleotides include nucleotides that are efficiently incorporated by DNA polymerases opposite each other during DNA replication under physiological conditions. In a typical embodiment, complementary nucleotides can form base pairs with each other, such as the A-T/U and G-C base pairs formed through specific Watson-Crick type hydrogen bonding, or base pairs formed through some other type of base pairing paradigm, between the nucleobases of nucleotides and/or polynucleotides in positions antiparallel to each other. The complementarity of other artificial base pairs can be based on other types of hydrogen bonding and/or hydrophobicity of bases and/or shape complementarity between bases.

As used herein, "amplified target sequences" and its derivatives, refers generally to a nucleic acid sequence produced by the amplification of/amplifying the target sequences using target-specific primers and the methods provided herein. The amplified target sequences may be either of the same sense the positive strand produced in the second round and subsequent even-numbered rounds of amplification) or antisense (i.e., the negative, strand produced during the first and subsequent odd-numbered rounds of amplification) with respect to the target sequences. For the purposes of this disclosure, the amplified target sequences are typically less than 50% complementary to any portion of another amplified target sequence in the reaction.

As used herein, the terms "ligating", "ligation" and their derivatives refer generally to the act or process for covalently linking two or more molecules together, for example, covalently linking two or more nucleic acid molecules to each other. In some embodiments, ligation includes joining nicks between adjacent nucleotides of nucleic acids. In some embodiments, ligation includes forming a covalent bond between an end of a first and an end of a second nucleic acid molecule. In some embodiments, for example embodiments wherein the nucleic acid molecules to be ligated include conventional nucleotide residues, the litgation can include forming a covalent bond between a 5' phosphate group of one nucleic acid and a 3' hydroxyl group of a second nucleic acid thereby forming a ligated nucleic acid molecule. In some embodiments, any means for joining nicks or bonding a 5' phosphate to a 3' hydroxyl between adjacent nucleotides can be employed. In an exemplary embodiment, an enzyme such as a ligase can be used. Generally for the purposes of this disclosure, an amplified target sequence can be ligated to an adapter to generate an adapter-ligated amplified target sequence.

As used herein, "ligase" and its derivatives, refers generally to any agent capable of catalyzing the ligation of two substrate molecules. In some embodiments, the ligase includes an enzyme capable of catalyzing the joining of nicks between adjacent nucleotides of a nucleic acid. In some embodiments, the ligase includes an enzyme capable of catalyzing the formation of a covalent bond between a 5' phosphate of one nucleic acid molecule to a 3' hydroxyl of another nucleic acid molecule thereby forming a ligated nucleic acid molecule. Suitable ligases may include, but not limited to, T4 DNA ligase, T4 RNA ligase, and E. coli DNA ligase.

As used herein, "ligation conditions" and its derivatives, generally refers to conditions suitable for ligating two molecules to each other. In some embodiments, the ligation conditions are suitable for sealing nicks or gaps between nucleic acids. As defined herein, a "nick" or "gap" refers to a nucleic acid molecule that lacks a directly bound 5' phosphate of a mononucleotide pentose ring to a 3' hydroxyl of a neighboring mononucleotide pentose ring within internal nucleotides of a nucleic acid sequence. As used herein, the term nick or gap is consistent with the use of the term in the art. Typically, a nick or gap can be ligated in the presence of an enzyme, such as ligase at an appropriate temperature and pH. In some embodiments, T4 DNA ligase can join a nick between nucleic acids at a temperature of about 70-72° C.

As used herein, "blunt-end ligation" and its derivatives, refers generally to ligation of two blunt-end double-stranded nucleic acid molecules to each other. A "blunt end" refers to an end of a double-stranded nucleic acid molecule wherein substantially all of the nucleotides in the end of one strand of the nucleic acid molecule are base paired with opposing nucleotides in the other strand of the same nucleic acid molecule. A nucleic acid molecule is not blunt ended if it has an end that includes a single-stranded portion greater than two nucleotides in length, referred to herein as an "overhang". In some embodiments, the end of nucleic acid molecule does not include any single stranded portion, such that every nucleotide in one strand of the end is based paired with opposing nucleotides in the other strand of the same nucleic acid molecule. In some embodiments, the ends of the two blunt ended nucleic acid molecules that become ligated to each other do not include any overlapping, shared or complementary sequence. Typically, blunted-end ligation excludes the use of additional oligonucleotide adapters to assist in the ligation of the double-stranded amplified target sequence to the double-stranded adapter, such as patch oligonucleotides as described in Mitra and Varley, US2010/0129874, published May 27, 2010. In some embodiments, blunt-ended ligation includes a nick translation reaction to seal a nick created during the ligation process.

As used herein, the terms "adapter" or "adapter and its complements" and their derivatives, refers generally to any linear oligonucleotide which can be ligated to a nucleic acid molecule of the disclosure. Optionally, the adapter includes a nucleic acid sequence that is not substantially complementary to the 3' end or the 5' end of at least one target sequences within the sample. In some embodiments, the adapter is substantially non-complementary to the 3' end or the 5' end of any target sequence present in the sample. In some embodiments, the adapter includes any single stranded or double-stranded linear oligonucleotide that is not substantially complementary to an amplified target sequence. In some embodiments, the adapter is substantially non-complementary to at least one, some or all of the nucleic acid molecules of the sample. In some embodiments, suitable adapter lengths are in the range of about 10-100 nucleotides, about 12-60 nucleotides and about 15-50 nucleotides in length. Generally, the adapter can include any combination of nucleotides and/or nucleic acids. In some aspects, the adapter can include one or more cleavable groups at one or more locations. In another aspect, the adapter can include a sequence that is substantially identical, or substantially complementary, to at least a portion of a primer, for example a universal primer. In some embodiments, the adapter can include a barcode or tag to assist with downstream cataloguing, identification or sequencing. In some embodiments, a single-stranded adapter can act as a substrate for amplification when ligated to an amplified target sequence, particularly in the presence of a polymerase and dNTPs under suitable temperature and pH.

As used herein, "reamplifying" or "reamplification" and their derivatives refer generally to any process whereby at least a portion of an amplified nucleic acid molecule is further amplified via any suitable amplification process (referred to in some embodiments as a "secondary" amplification or "reamplification", thereby producing a reamplified nucleic acid molecule. The secondary amplification need not be identical to the original amplification process whereby the amplified nucleic acid molecule was produced; nor need the reamplified nucleic acid molecule be completely identical or completely complementary to the amplified nucleic acid molecule; all that is required is that the reamplified nucleic acid molecule include at least a portion of the amplified nucleic acid molecule or its complement. For example, the reamplification can involve the use of different amplification conditions and/or different primers, including different target-specific primers than the primary amplification.

As defined herein, a "cleavable group" generally refers to any moiety that once incorporated into a nucleic acid can be cleaved under appropriate conditions. For example, a cleavable group can be incorporated into a target-specific primer, an amplified sequence, an adapter or a nucleic acid molecule of the sample. In an exemplary embodiment, a target-specific primer can include a cleavable group that becomes incorporated into the amplified product and is subsequently cleaved after amplification, thereby removing a portion, or all, of the target-specific primer from the amplified product. The cleavable group can be cleaved or otherwise removed from a target-specific primer, an amplified sequence, an adapter or a nucleic acid molecule of the sample by any acceptable means. For example, a cleavable group can be removed from a target-specific primer, an amplified sequence, an adapter or a nucleic acid molecule of the sample by enzymatic, thermal, photo-oxidative or chemical treatment. In one aspect, a cleavable group can include a nucleobase that is not naturally occurring.

For example, an oligodeoxyribonucleotide can include one or more RNA nucleobases, such as uracil that can be removed by a uracil glycosylase. In some embodiments, a cleavable group can include one or more modified nucleobases (such as 7-methylguanine, 8-oxo-guanine, xanthine, hypoxanthine, 5,6-dihydrouracil or 5-methylcytosine) or one or more modified nucleosides (i.e., 7-methylguanosine, 8-oxo-deoxyguanosine, xanthosine, inosine, dihydrouridine or 5-methylcytidine). The modified nucleobases or nucleotides can be removed from the nucleic acid by enzymatic, chemical or thermal means. In one embodiment, a cleavable group can include a moiety that can be removed from a primer after amplification (or synthesis) upon exposure to ultraviolet light (i.e., bromodeoxyuridine). In another embodiment, a cleavable group can include methylated cytosine. Typically, methylated cytosine can be cleaved from a primer for example, after induction of amplification (or synthesis), upon sodium bisulfite treatment. In some embodiments, a cleavable moiety can include a restriction site. For example, a primer or target sequence can include a nucleic acid sequence that is specific to one or more restriction enzymes, and following amplification (or synthesis), the primer or target sequence can be treated with the one or more restriction enzymes such that the cleavable group is removed. Typically, one or more cleavable groups can be included at one or more locations with a target-specific primer, an amplified sequence, an adapter or a nucleic acid molecule of the sample.

As used herein, "cleavage step" and its derivatives, generally refers to any process by which a cleavable group is cleaved or otherwise removed from a target-specific primer, an amplified sequence, an adapter or a nucleic acid molecule of the sample. In some embodiments, the cleavage steps involves a chemical, thermal, photo-oxidative or digestive process.

As used herein, the term "hybridization" is consistent with its use in the art, and generally refers to the process whereby two nucleic acid molecules undergo base pairing interactions. Two nucleic acid molecule molecules are said to be hybridized when any portion of one nucleic acid molecule is base paired with any portion of the other nucleic acid molecule; it is not necessarily required that the two nucleic acid molecules be hybridized across their entire respective lengths and in some embodiments, at least one of the nucleic acid molecules can include portions that are not hybridized to the other nucleic acid molecule. The phrase "hybridizing under stringent conditions" and its variants refers generally to conditions under which hybridization of a target-specific primer to a target sequence occurs in the presence of high hybridization temperature and low ionic strength. In one exemplary embodiment, stringent hybridization conditions include an aqueous environment containing about 30 mM magnesium sulfate, about 300 mM Tris-sulfate at pH 8.9, and about 90 mM ammonium sulfate at about 60-68° C., or equivalents thereof. As used herein, the phrase "standard hybridization conditions" and its variants refers generally to conditions under which hybridization of a primer to an oligonucleotide (i.e., a target sequence), occurs in the presence of low hybridization temperature and high ionic strength. In one exemplary embodiment, standard hybridization conditions include an aqueous environment containing about 100 mM magnesium sulfate, about 500 mM Tris-sulfate at pH 8.9, and about 200 mM ammonium sulfate at about 50-55° C., or equivalents thereof.

As used herein, "triple nucleotide motif" and its derivatives, refers generally to any nucleotide sequence that is repeated contiguously over three nucleotides e.g., AAA or CCC. Generally, a triple nucleotide motif is not repeated more than five times in a target-specific primer (or adapter) of the disclosure.

As used herein, "an ACA nucleotide motif" and its derivatives, refers generally to the nucleotide sequence "ACA". Generally, this motif is not repeated three or more times in a target-specific primer (or adapter) of the disclosure.

As used herein, "homopolymer" and its derivatives, refers generally to any repeating nucleotide sequence that is eight nucleotides or greater in length e.g., AAAAAAAA or CCCCCCCC. Generally, a homopolymer as defined herein is not present in a target-specific primer (or adapter) of the disclosure.

As used herein, "GC content" and its derivatives, refers generally to the cytosine and guanine content of a nucleic acid molecule. Generally, the GC content of a target-specific primer (or adapter) of the disclosure is 85% or lower. More typically, the GC content of a target-specific primer or adapter of the disclosure is between 15-85%.

As used herein, the term "end" and its variants, when used in reference to a nucleic acid molecule, for example a target sequence or amplified target sequence, can include the terminal 30 nucleotides, the terminal 20 and even more typically the terminal 15 nucleotides of the nucleic acid molecule. A linear nucleic acid molecule comprised of linked series of contiguous nucleotides typically includes at least two ends. In some embodiments, one end of the nucleic acid molecule can include a 3' hydroxyl group or its equivalent, and can be referred to as the "3' end" and its derivatives. Optionally, the 3' end includes a 3' hydroxyl group that is not linked to a 5' phosphate group of a mononucleotide pentose ring. Typically, the 3' end includes one or more 5' linked nucleotides located adjacent to the nucleotide including the unlinked 3' hydroxyl group, typically the nucleotides located adjacent to the 3' hydroxyl, typically the terminal 20 and even more typically the terminal 15 nucleotides. Generally, the one or more linked nucleotides can be represented as a percentage of the nucleotides present in the oligonucleotide or can be provided as a number of linked nucleotides adjacent to the unlinked 3' hydroxyl. For example, the 3' end can include less than 50% of the nucleotide length of the oligonucleotide. In some embodiments, the 3' end does not include any unlinked 3' hydroxyl group but can include any moiety capable of serving as a site for attachment of nucleotides via primer extension and/or nucleotide polymerization. In some embodiments, the term "3' end" for example when referring to a target-specific primer, can include the terminal 10 nucleotides, the terminal 5 nucleotides, the terminal 4, 3, 2 or fewer nucleotides at the 3' end. In some embodiments, the term "3' end" when referring to a target-specific primer can include nucleotides located at nucleotide positions 10 or fewer from the 3' terminus.

As used herein, "5' end", and its derivatives, generally refers to an end of a nucleic acid molecule, for example a target sequence or amplified target sequence, which includes a free 5' phosphate group or its equivalent. In some embodiments, the 5' end includes a 5' phosphate group that is not linked to a 3' hydroxyl of a neighboring mononucleotide pentose ring. Typically, the 5' end includes to one or more linked nucleotides located adjacent to the 5' phosphate, typically the 30 nucleotides located adjacent to the nucleotide including the 5' phosphate group, typically the terminal 20 and even more typically the terminal 15 nucleotides. Generally, the one or more linked nucleotides can be represented as a percentage of the nucleotides present in the oligonucleotide or can be provided as a number of linked nucleotides adjacent to the 5' phosphate. For example, the 5' end can be less than 50% of the nucleotide length of an oligonucleotide. In another exemplary embodiment, the 5' end can include about 15 nucleotides adjacent to the nucleotide including the terminal 5' phosphate. In some embodiments, the 5' end does not include any unlinked 5' phosphate group but can include any moiety capable of serving as a site of attachment to a 3' hydroxyl group, or to the 3' end of another nucleic acid molecule. In some embodiments, the term "5' end" for example when referring to a target-specific primer, can include the terminal 10 nucleotides, the terminal 5 nucleotides, the terminal 4, 3, 2 or fewer nucleotides at the 5' end. In some embodiments, the term "5' end" when referring to a target-specific primer can include nucleotides located at positions 10 or fewer from the 5' terminus. In some embodiments, the 5' end of a target-specific primer can include only non-cleavable nucleotides, for example nucleotides that do not contain one or more cleavable groups as disclosed herein, or a cleavable nucleotide as would be readily determined by one of ordinary skill in the art.

As used herein, "protecting group" and its derivatives, refers generally to any moiety that can be incorporated into an adapter or target-specific primer that imparts chemical selectivity or protects the target-specific primer or adapter from digestion or chemical degradation. Typically, but not necessarily, a protecting group can include modification of an existing functional group in the target-specific primer r adapter to achieve chemical selectivity. Suitable types of protecting groups include alcohol, amine, phosphate, carbonyl, or carboxylic acid protecting groups. In an exemplary embodiment, the protecting group can include a spacer compound having a chain of carbon atoms.

As used herein, "DNA barcode" or "DNA tagging sequence" and its derivatives, refers generally to a unique short (6-14 nucleotide) nucleic acid sequence within an adapter that can act as a 'key' to distinguish or separate a plurality of amplified target sequences in a sample. For the purposes of this disclosure, a DNA barcode or DNA tagging sequence can be incorporated into the nucleotide sequence of an adapter.

As used herein, the phrases "two rounds of target-specific hybridization" or "two rounds of target-specific selection" and their derivatives refers generally to any process whereby the same target sequence is subjected to two consecutive rounds of hybridization-based target-specific selection, wherein a target sequence is hybridized to a target-specific sequence. Each round of hybridization based target-specific selection can include multiple target-specific hybridizations to at least some portion of a target-specific sequence. In one exemplary embodiment, a round of target-specific selection includes a first target-specific hybridization involving a first region of the target sequence and a second target-specific hybridization involving a second region of the target sequence. The first and second regions can be the same or different. In some embodiments, each round of hybridization-based target-specific selection can include use of two target specific oligonucleotides (e.g., a forward target-specific primer and a reverse target-specific primer), such that each round of selection includes two target-specific hybridizations.

As used herein, "comparable maximal minimum melting temperatures" and its derivatives, refers generally to the melting temperature (Tm) of each nucleic acid fragment for a single adapter or target-specific primer after cleavage of the cleavable groups. The hybridization temperature of each nucleic acid fragment generated by a single adapter or target-specific primer is compared to determine the maximal minimum temperature required preventing hybridization of any nucleic acid fragment from the target-specific primer or adapter to the target sequence. Once the maximal hybridization temperature is known, it is possible to manipulate the adapter or target-specific primer, for example by moving the location of the cleavable group along the length of the primer, to achieve a comparable maximal minimum melting temperature with respect to each nucleic acid fragment.

As used herein, "addition only" and its derivatives, refers generally to a series of steps in which reagents and components are added to a first or single reaction mixture. Typically, the series of steps excludes the removal of the reaction mixture from a first vessel to a second vessel in order to complete the series of steps. Generally, an addition only process excludes the manipulation of the reaction mixture outside the vessel containing the reaction mixture. Typically, an addition-only process is amenable to automation and high-throughput.

As used herein, "synthesizing" and its derivatives, refers generally to a reaction involving nucleotide polymerization by a polymerase, optionally in a template-dependent fashion. Polymerases synthesize an oligonucleotide via transfer of a nucleoside monophosphate from a nucleoside triphosphate (dNTP), deoxynucleoside triphosphate (dNTP) or dideoxynucleoside triphosphate (ddNTP) to the 3' hydroxyl of an extending oligonucleotide chain. For the purposes of this disclosure, synthesizing includes to the serial extension of a hybridized adapter or a target-specific primer via transfer of a nucleoside monophosphate from a deoxynucleoside triphosphate.

As used herein, "polymerizing conditions" and its derivatives, refers generally to conditions suitable for nucleotide polymerization. In typical embodiments, such nucleotide polymerization is catalyzed by a polymerase. In some embodiments, polymerizing conditions include conditions for primer extension, optionally in a template-dependent manner, resulting in the generation of a synthesized nucleic acid sequence. In some embodiments, the polymerizing conditions include polymerase chain reaction (PCR). Typically, the polymerizing conditions include use of a reaction mixture that is sufficient to synthesize nucleic acids and includes a polymerase and nucleotides. The polymerizing conditions can include conditions for annealing of a target-specific primer to a target sequence and extension of the primer in a template dependent manner in the presence of a polymerase. In some embodiments, polymerizing conditions can be practiced using thermocycling. Additionally, polymerizing conditions can include a plurality of cycles where the steps of annealing, extending, and separating the two nucleic strands are repeated. Typically, the polymerizing conditions include a cation such as $MgCl_2$. Generally, polymerization of one or more nucleotides to form a nucleic acid strand includes that the nucleotides be linked to each other via phosphodiester bonds, however, alternative linkages may be possible in the context of particular nucleotide analogs.

As used herein, the term "nucleic acid" refers to natural nucleic acids, artificial nucleic acids, analogs thereof, or combinations thereof, including polynucleotides and oligonucleotides. As used herein, the terms "polynucleotide" and "oligonucleotide" are used interchangeably and mean single-stranded and double-stranded polymers of nucleotides including, but not limited to, 2'-deoxyribonucleotides (nucleic acid) and ribonucleotides (RNA) linked by internucleotide phosphodiester bond linkages, e.g. 3'-5' and 2'-5', inverted linkages, e.g. 3'-3' and 5'-5', branched structures, or analog nucleic acids. Polynucleotides have associated counter ions, such as $H^+$, $NH_4^+$, trialkylammonium, $Mg^{2+}$, $Na^+$ and the like. An oligonucleotide can be composed entirely of deoxyribonucleotides, entirely of ribonucleotides, or chimeric mixtures thereof. Oligonucleotides can be comprised of nucleobase and sugar analogs. Polynucleotides typically range in size from a few monomeric units, e.g. 5-40, when they are more commonly frequently referred to in the art as oligonucleotides, to several thousands of monomeric nucleotide units, when they are more commonly referred to in the art as polynucleotides; for purposes of this disclosure, however, both oligonucleotides and polynucleotides may be of any suitable length. Unless denoted otherwise, whenever a oligonucleotide sequence is represented, it will be understood that the nucleotides are in 5' to 3' order from left to right and that "A" denotes deoxyadenosine, "C" denotes deoxycytidine, "G" denotes deoxyguanosine, "T" denotes thymidine, and "U" denotes deoxyuridine. Oligonucleotides are said to have "5' ends" and "3' ends" because mononucleotides are typically reacted to form oligonucleotides via attachment of the 5' phosphate or equivalent group of one nucleotide to the 3' hydroxyl or equivalent group of its neighboring nucleotide, optionally via a phosphodiester or other suitable linkage.

As defined herein, the term "nick translation" and its variants comprise the translocation of one or more nicks or gaps within a nucleic acid strand to a new position along the nucleic acid strand. In some embodiments, a nick can be formed when a double stranded adapter is ligated to a double stranded amplified target sequence. In one example, the primer can include at its 5' end, a phosphate group that can ligate to the double stranded amplified target sequence, leaving a nick between the adapter and the amplified target sequence in the complementary strand. In some embodiments, nick translation results in the movement of the nick to the 3' end of the nucleic acid strand. In some embodiments, moving the nick can include performing a nick translation reaction on the adapter-ligated amplified target sequence. In some embodiments, the nick translation reaction can be a coupled 5' to 3' DNA polymerization/degradation reaction, or coupled to a 5' to 3' DNA polymerization/strand displacement reaction. In some embodiments, moving the nick can include performing a DNA strand extension reaction at the nick site. In some embodiments, moving the nick can include performing a single strand exonuclease reaction on the nick to form a single stranded portion of the adapter-ligated amplified target sequence and performing a DNA strand extension reaction on the single stranded portion of the adapter-ligated amplified target sequence to a new position. In some embodiments, a nick is formed in the nucleic acid strand opposite the site of ligation.

As used herein, the term "polymerase chain reaction" ("PCR") refers to the method of K. B. Mullis U.S. Pat. Nos. 4,683,195 and 4,683,202, hereby incorporated by reference, which describe a method for increasing the concentration of a segment of a polynucleotide of interest in a mixture of genomic DNA without cloning or purification. This process for amplifying the polynucleotide of interest consists of introducing a large excess of two oligonucleotide primers to the DNA mixture containing the desired polynucleotide of interest, followed by a precise sequence of thermal cycling in the presence of a DNA polymerase. The two primers are complementary to their respective strands of the double stranded polynucleotide of interest. To effect amplification, the mixture is denatured and the primers then annealed to their complementary sequences within the polynucleotide of interest molecule. Following annealing, the primers are extended with a polymerase to form a new pair of complementary strands. The steps of denaturation, primer annealing and polymerase extension can be repeated many times (i.e., denaturation, annealing and extension constitute one "cycle"; there can be numerous "cycles") to obtain a high concentration of an amplified segment of the desired polynucleotide of interest. The length of the amplified segment of the desired polynucleotide of interest (amplicon) is determined by the relative positions of the primers with respect to each other, and therefore, this length is a controllable parameter. By virtue of repeating the process, the method is referred to as the "polymerase chain reaction" (hereinafter "PCR"). Because the desired amplified segments of the polynucleotide of interest become the predominant nucleic acid sequences (in terms of concentration) in the mixture, they are said to be "PCR amplified". As defined herein, target nucleic acid molecules within a sample including a plurality of target nucleic acid molecules are amplified via PCR. In a modification to the method discussed above, the target nucleic acid molecules can be PCR amplified using a plurality of different primer pairs, in some cases, one or more primer pairs per target nucleic acid molecule of interest, thereby forming a multiplex PCR reaction. Using multiplex PCR, it is possible to simultaneously amplify multiple nucleic acid molecules of interest from a sample to form amplified target sequences. It is also possible to detect the amplified target sequences by several different methodologies (e.g., quantitation with a bioanalyzer or qPCR, hybridization with a labeled probe; incorporation of biotinylated primers followed by avidin-enzyme conjugate detection; incorporation of $^{32}$P-labeled deoxynucleotide triphosphates, such as dCTP or dATP, into the amplified target sequence). Any oligonucleotide sequence can be amplified with the appropriate set of primers, thereby allowing for the amplification of target nucleic acid molecules from genomic DNA, cDNA, formalin-fixed paraffin-embedded DNA, fine-needle biopsies and various other sources. In particular, the amplified target sequences created by the multiplex PCR process as disclosed herein, are themselves efficient substrates for subsequent PCR amplification or various downstream assays or manipulations.

As defined herein "multiplex amplification" refers to selective and non-random amplification of two or more target sequences within a sample using at least one target-specific primer. In some embodiments, multiplex amplification is performed such that some or all of the target sequences are amplified within a single reaction vessel. The "plexy" or "plex" of a given multiplex amplification refers generally to the number of different target-specific sequences that are amplified during that single multiplex amplification. In some embodiments, the plexy can be about 12-plex, 24-plex, 48-plex, 96-plex, 192-plex, 384-plex, 768-plex, 1536-plex, 3072-plex, 6144-plex or higher.

In some embodiments, the disclosure relates generally to methods, compositions, systems, apparatuses and kits for avoiding or reducing the formation of amplification artifacts (for example primer-dimers) during selective amplification of one or more target nucleic acid molecules in a population of nucleic acid molecules.

In some embodiments, the disclosure relates generally to the amplification of multiple target-specific sequences from a population of nucleic acid molecules. In some embodiments, the method comprises hybridizing one or more target-specific primer pairs to the target sequence, extending a first primer of the primer pair, denaturing the extended first primer product from the population of nucleic acid molecules, hybridizing to the extended first primer product the second primer of the primer pair, extending the second primer to form a double stranded product, and digesting the target-specific primer pair away from the double stranded product to generate a plurality of amplified target sequences. In some embodiments, the digesting includes partial digesting of one or more of the target-specific primers from the amplified target sequence. In some embodiments, the amplified target sequences can be ligated to one or more adapters. In some embodiments, the adapters can include one or more DNA barcodes or tagging sequences. In some embodiments, the amplified target sequences once ligated to an adapter can undergo a nick translation reaction and/or further amplification to generate a library of adapter-ligated amplified target sequences.

In some embodiments, the disclosure relates generally to the preparation and formation of multiple target-specific amplicons. In some embodiments, the method comprises hybridizing one or more target-specific primer pairs to a nucleic acid molecule, extending a first primer of the primer, pair, denaturing the extended first primer from the nucleic acid molecule, hybridizing to the extended first primer product, a second primer of the primer pair and extending the second primer, digesting the target-specific primer pairs to generate a plurality of target-specific amplicons. In some embodiments, adapters can be ligated to the ends of the target-specific amplicons prior to performing a nick translation reaction to generate a plurality of target-specific amplicons suitable for nucleic acid sequencing. In some embodiments, the one or more target specific amplicons can be amplified using bridge amplification or emPCR to generate a plurality of clonal templates suitable for nucleic acid sequencing. In some embodiments, the disclosure generally relates to methods for preparing a target-specific amplicon library, for use in a variety of downstream processes or assays such as nucleic acid sequencing or clonal amplification. In one embodiment, the disclosure relates to a method of performing target-specific multiplex PCR on a nucleic acid sample having a plurality of target sequences using primers having a cleavable group.

In one embodiment, nucleic acid templates to be sequenced using the Ion Torrent PGM™ or Ion Torrent Proton™ system can be prepared from a population of nucleic acid molecules using the target-specific amplification techniques as outlined herein. Optionally, following target-specific amplification a secondary and/or tertiary amplification process including, but not limited to, a library amplification step and/or a clonal amplification step such as emPCR can be performed.

In some embodiments, the disclosure relates to a composition comprising a plurality of target-specific primer pairs, each containing a forward primer and a reverse primer having at least one cleavable group located at either a) the 3' end or the 5' end, and/or b) at about the central nucleotide position of the target-specific primer, and wherein the target-specific primer pairs can be substantially non-complementary to other primer pairs in the composition. In some embodiments, the composition comprises at least 1000, 2000, 3000, 4000, 6000, 9000, 12000, or more target-specific primer pairs. In some embodiments, the target-specific primer pairs comprise about 15 nucleotides to about 40 nucleotides in length, wherein at least one nucleotide is replaced with a cleavable group. In some embodiments the cleavable group can be a uridine nucleotide. In some embodiments, the target-specific primer sets are designed to amplify an exon, gene, exome or region of the genome associated with a clinical or pathological condition, e.g., the amplification of one or more single nucleotide mutations (SNPs) associated with cancer, such as colon cancer, or the amplification of mutations associated with an inherited disease such as cystic fibrosis. In some embodiments, the target-specific primer pairs when hybridized to a target sequence and amplified as outlined herein can generate a library of adapter-ligated amplified target sequences that are about 100 to about 500 base pairs in length. In some embodiments, no one adapter-ligated amplified target sequence is overexpressed in the library by more than 30% as compared to the remainder of the adapter-ligated amplified target sequences in the library. In some embodiments, the adapter-ligated amplified target sequence library is substantially homogenous with respect to GC content, amplified target sequence length or melting temperature (Tm).

In some embodiments, the disclosure relates generally to a kit for performing multiplex PCR comprising a plurality of target-specific primers having a cleavable group, a DNA polymerase, an adapter, dATP, dCTP, dGTP and dTTP. In some embodiments, the cleavable group can be a uracil nucleotide. The kit can further include one or more antibodies, nucleic acid barcodes, purification solutions or columns.

In some embodiments, the disclosure relates to a kit for generating a target-specific amplicon library comprising a plurality of target-specific primers having a cleavable group, a DNA polymerase, an adapter, dATP, dCTP, dGTP, dTTP, and a cleaving reagent. In some embodiments, the kit further comprises one or more antibodies, nucleic acid barcodes, purification solutions or columns.

In one embodiment, the disclosure generally relates to the amplification of multiple target-specific sequences from a single nucleic acid source or sample. In another embodiment, the disclosure relates generally to the target-specific amplification of two or more target sequences from two or more nucleic acid sources, samples or species. For example, it is envisioned by the disclosure that a single nucleic acid sample can include genomic DNA or fixed-formalin paraffin-embedded (FFPE) DNA. It is also envisioned that the sample can be from a single individual, a collection of nucleic acid samples from genetically related members, multiple nucleic acid samples from genetically unrelated members, multiple nucleic acid samples (matched) from a single individual such as a tumor sample and normal tissue sample, or genetic material from a single source that contains two distinct forms of genetic material such as maternal and fetal DNA obtained from a maternal subject, or the presence of contaminating bacteria DNA in a sample that contains plant or animal DNA. In some embodiments, the source of nucleic acid material can include nucleic acids obtained from a newborn, for example as typically procured as a blood sample for newborn screening.

The nucleic acid sample can include high molecular weight material such as genomic DNA or cDNA. The sample can include low molecular weight material such as nucleic acid molecules obtained from FFPE or archived DNA samples. In another embodiment, low molecular weight material includes enzymatically or mechanically sheared DNA. The sample can include cell-free circulating DNA such as material obtained from a maternal subject. In some embodiments, the sample can include nucleic acid molecules obtained from biopsies, tumors, scrapings, swabs, blood, mucus, urine, plasma, semen, hair, laser capture micro-dissections, surgical resections, and other clinical or laboratory obtained samples. In some embodiments, the sample can be an epidemiological, agricultural, forensic or pathogenic sample.

In some embodiments, the sample can include nucleic acid molecules obtained from an animal such as a human or mammalian source. In another embodiment, the sample can include nucleic acid molecules obtained from a non-mammalian source such as a plant, bacteria, virus or fungus. In some embodiments, the source of the nucleic acid molecules may be an archived or extinct sample or species.

In some embodiments, the disclosure relates generally to the selective amplification of at least one target sequence in a normal or diseased containing tissue, biopsy, core, tumor or other sample. In some embodiments, the disclosure generally relates to the selective amplification of at least one target sequence and the detection and/or identification of mutations in the diseased tissue, core, biopsy or tumor sample. In some embodiments, the diseased or normal sample can include whole genomic DNA, formalin-fixed paraffin-embedded tissue (FFPE), sheared or enzymatically treated DNA. In some embodiments, the disclosure is directed to the selective amplification of at least one target sequence and detection and/or identification of clinically actionable mutations. In some embodiments, the disclosure is directed to the detection and/or identification of mutations associated with drug resistance or drug susceptibility. In some embodiments, the disclosure is generally directed to the identification and/or quantitation of genetic markers associated with organ transplantation or organ rejection.

In some embodiments, the disclosure relates generally to the selective amplification of at least one target sequence in cell-free circulating DNA. In some embodiments, the selective amplification of at least one target sequence in a sample includes a mixture of different nucleic acid molecules. The selective amplification can optionally be accompanied by detection and/or identification of mutations observed in circulating DNA. In some embodiments, the selective amplification can optionally be accompanied by detection and/or identification of mutations associated with cancer or an inherited disease such as metabolic, neuromuscular, developmental, cardiovascular, autoimmune or other inherited disorder.

In some embodiments, the target-specific primers and primer pairs are target-specific sequences that can amplify specific regions of a nucleic acid molecule. In some embodiments, the target-specific primers can amplify genomic DNA or cDNA. In some embodiments, the target-specific primers can amplify mammalian DNA, such as human DNA. In some embodiments, the amount of DNA required for selective amplification can be from about 1 ng to 1 microgram. In some embodiments, the amount of DNA required for selective amplification of one or more target sequences can be about 1 ng, about 5 ng or about 10 ng. In some embodiments, the amount of DNA required for selective amplification of target sequence is about 10 ng to about 200 ng.

In some embodiments, selective amplification of at least one target sequence further includes nucleic acid sequencing of the amplified target sequence. Optionally, the method further includes detecting and/or identifying mutations present in the sample identified through nucleic acid sequencing of the amplified target sequence.

In some embodiments, target sequences or amplified target sequences are directed to mutations associated with cancer. In some embodiments, the target sequences or amplified target sequences are directed to mutations associated with one or more cancers selected from the group consisting of head and neck cancers, brain cancer, breast cancer, ovarian cancer, cervical cancer, colorectal cancer, endometrial cancer, gallbladder cancer, gastric cancer, bladder cancer, prostate cancer, testicular cancer, liver cancer, lung cancer, kidney (renal cell) cancer, esophageal cancer, pancreatic cancer, thyroid cancer, bile duct cancer, pituitary tumor, wilms tumor, kaposi sarcoma, osteosarcoma, thymus cancer, skin cancer, heart cancer, oral and larynx cancer, leukemia, neuroblastoma and non-hodgkin lymphoma. In one embodiment, the mutations can include substitutions, insertions, inversions, point mutations, deletions, mismatches and translocations. In one embodiment, the mutations can include variation in copy number. In one embodiment, the mutations can include germline or somatic mutations. In one embodiment, the mutations associated with cancer are located in at least one of the genes provided in Tables 1 or 4 (see U.S. Ser. No. 13/458,739, filed Apr. 27, 2012, hereby incorporated by reference in its entirety), or provided in Table 7 of U.S. Application No. 61/598,881 hereby incorporated by reference in its entirety. In some embodiments, the mutations can be any of the genomic coordinates provided in Table 18 (from U.S. Ser. No. 13/458,739, filed Apr. 27, 2012, hereby incorporated by reference in its entirety), or provided in Table 7 of U.S. Application 61/598,881 hereby incorporated by reference in its entirety. In some embodiments, the target sequences directed to mutations associated with cancer can include any one or more of the mutations provided in Table 10 (from U.S. Ser. No. 13/458,739, filed Apr. 27, 2012, hereby incorporated by reference in its entirety). In some embodiments, the mutations can be found within any one or more of the genomic coordinates provided in Table 16 or Table 18 (both found in U.S. Ser. No. 13/458,739, filed Apr. 27, 2012, hereby incorporated by reference in its entirety).

In some embodiments, the mutations associated with cancer are located in at least one of the genes selected from ABI1; ABL1; ABL2; ACSL3; ACSL6; AFF1; AFF3; AFF4; AKAP9; AKT1; AKT2; ALK; APC; ARHGAP26; ARHGEF12; ARID1A; ARNT; ASPSCR1; ASXL1; ATF1; ATIC; ATM; AXIN2; BAP1; BARD1; BCAR3; BCL10; BCL11A; BCL11B; BCL2; BCL3; BCL6; BCL7A; BCL9; BCR; BIRC3; BLM; BMPR1A; BRAF; BRCA1; BRCA2; BRD3; BRD4; BRIP1; BUB1B; CARD11; CARS; CASC5; CBFA2T3; CBFB; CBL; CBLB; CBLC; CCDC6; CCNB11P1; CCND1; CCND2; CD74; CD79A; CDC73; CDH1; CDH11; CDK4; CDK6; CDKN2A; CDKN2B; CDKN2C; CDX2; CEBPA; CEP110; CHEK1; CHEK2; CHIC2; CHN1; CIC; CIITA; CLP1; CLTC; CLTCL1; COL1A1; CREB1; CREB3L2; CREBBP; CRTC1; CRTC3; CSF1R; CTNNB1; CXCR7; CYLD; CYTSB; DCLK3; DDB2; DDIT3; DDR2; DDX10; DDX5; DDX6; DEK; DGKG; DICER1; DNMT3A; EGFR; EIF4A2; ELF4; ELL; ELN; EML4; EP300; EPS15; ERBB2; ERBB4; ERC1; ERCC2; ERCC3; ERCC4; ERCC5; ERG; ETV1; ETV4; ETV5; ETV6; EWSR1; EXT1; EXT2; EZH2; FAM123B; FANCA; FANCC; FANCD2; FANCE; FANCF; FANCG; FAS; FBXW7; FCRL4; FGFR1; FGFR10P; FGFR2; FGFR3; FH; FIP1L1; FLCN; FLI1; FLT1; FLT3; FNBP1; FOXL2; FOXO1; FOXO3; FOXO4; FOXP1; FUS; GAS7; GATA1; GATA2; GATA3; GMPS; GNAQ; GNAS; GOLGA5; GOPC; GPC3; GPHNGPR124; HIP1; HIST1H4I; HLF; HNF1A; HNRNPA2B1; HOOKS; HOXA11; HOXA13; HOXA9; HOXC11; HOXC13; HOXD13; HRAS; HSP90AA1; HSP90AB1; IDH1; IDH2; IKZF1; IL2; IL21R; IL6ST; IRF4; ITGA10; ITGA9; ITK; JAK1; JAK2; JAK3; KDM5A; KDM5C; KDM6A; KDR; KDSR; KIAA1549; KIT; KLF6; KLK2; KRAS; KTN1; LASP1; LCK; LCP1; LHFP; LIFR; LMO2; LPP; MAF; MALT1; MAML2; MAP2K1; MAP2K4; MDM2; MDM4; MECOM; MEN1; MET; MITF; MKL1; MLH1; MLL; MLLT1; MLLT10; MLLT3; MLLT4; MLLT6; MN1; MPL; MRE11A; MSH2; MSH6; MSI2; MSN; MTCP1; MTOR; MUC1; MYB; MYC; MYCL1; MYCN; MYH11; MYH9; MYST3; MYST4; NACA; NBN; NCOA1; NCOA2; NCOA4; NEK9; NF1; NF2; NFE2L2; NFKB2; NIN; NKX2-1; NLRP1; NONO; NOTCH1; NOTCH2; NPM1; NR4A3; NRAS; NSD1; NTRK1; NTRK3; NUMA1; NUP214; NUP98; OLIG2; OMD; PAFAH1B2; PALB2; PATZ1; PAX3; PAX5; PAX7; PAX8; PBRM1; PBX1; PCM1; PDE4DIP; PDGFB; PDGFRA; PDGFRB; PER1; PHOX2B; PICALM; PIK3CA; PIK3R1; PIM1; PLAG1; PML; PMS1; PMS2; POU2AF1; POU5F1; PPARG; PPP2R1A; PRCC; PRDM16; PRF1; PRKAR1A; PRRX1; PSIP1; PTCH1; PTEN; PTPN11; RABEP1; RAD50; RADS1L1; RAF1; RANBP17; RAP1GDS1; RARA; RB1; RBM15; RECQL4; REL; RET; RHOH; RNF213; ROS1; RPN1; RPS6KA2;

RUNX1; RUNX1T1; SBDS; SDHAF2; SDHB; SETD2; SFPQ; SFRS3; SH3GL1; SLC45A3; SMAD4; SMARCA4; SMARCB1; SMO; SOCS1; SRC; SRGAP3; SS18; SS18L1; STIL; STK11; STK36; SUFU; SYK; TAF15; TAF1L; TAL1; TAL2; TCF12; TCF3; TCL1A; TET1; TET2; TEX14; TFE3; TFEB; TFG; TFRC; THRAP3; TLX1; TLX3; TMPRSS2; TNFAIP3; TOP1; TP53; TPM3; TPM4; TPR; TRIM27; TRIM33; TRIP11; TSC1; TSC2; TSHR; USP6; VHL; WAS; WHSC1L1; WRN; WT1; XPA; XPC; ZBTB16; ZMYM2; ZNF331; ZNF384; and ZNF521.

In some embodiments, the mutations associated with cancer are located in at least one of the genes selected from ABL1; AKT1; ALK; APC; ATM; BRAF; CDH1; CDKN2A; CSF1R; CTNNB1; EGFR; ERBB2; ERBB4; FBXW7; FGFR1; FGFR2; FGFR3; FLT3; GNAS; HNF1A; HRAS; IDH1; JAK2; JAK3; KDR; KIT; KRAS; MET; MLH1; MPL; NOTCH1; NPM1; NRAS; PDGFRA; PIK3CA; PTEN; PTPN11; RB1; RET; SMAD4; SMARCB1; SMO; SRC; STK11; TP53; and VHL.

In some embodiments, the amplified target sequences are directed to any one of more of the genomic coordinates provided in Table 18 (from U.S. Ser. No. 13/458,739, filed Apr. 27, 2012, hereby incorporated by reference in its entirety). In some embodiments, any one or more of the cancer target-specific primers provided in Tables 2, 3 or 17 (all from U.S. Ser. No. 13/458,739, filed Apr. 27, 2012, hereby incorporated by reference in its entirety) can be used to amplify a target sequence present in a sample as disclosed by the methods described herein.

In some embodiments, the cancer target-specific primers from Tables 2, 3 or 17 (from U.S. Ser. No. 13/458,739, filed Apr. 27, 2012, hereby incorporated by reference in its entirety) can include 2, 3, 4, 5, 6, 7, 8, 9, 10, 20, 40, 60, 80, 100, 150, 200, 400, 500, 800, 1000, 2000, 3000, 4000, 5000, 6000, 7000, 8000, 9000, 10,000, 11,000, 12,000, 13,000 or more, target-specific primers. In some embodiments, the amplified target sequences can include any one or more of the amplified target sequences generated at the genomic coordinates (using amplicon ID target-specific primers) provided in Tables 10 or 18 (both found in U.S. Ser. No. 13/458,739, filed Apr. 27, 2012, hereby incorporated by reference in its entirety). In some embodiments, at least one of the target-specific primers associated with cancer is at least 90% identical to at least one nucleic acid sequence selected from SEQ ID NOs: 1-103,143. In some embodiments, at least one of the target-specific primers associated with cancer is complementary across its entire length to at least one target sequence in a sample. In some embodiments, at least one of the target-specific primers associated with cancer includes a non-cleavable nucleotide at the 3' end. In some embodiments, the non-cleavable nucleotide at the 3' end includes the terminal 3' nucleotide. In one embodiment, the amplified target sequences are directed to individual exons having a mutation associated with cancer. In some embodiments, the disclosure relates generally to the selective amplification of more than one target sequences in a sample and the detection and/or identification of mutations associated with cancer. In some embodiments, the amplified target sequences include two or more nucleotide sequences provided in Table 2 (from U.S. Ser. No. 13/458,739, filed Apr. 27, 2012, hereby incorporated by reference in its entirety). In some embodiments, the amplified target sequences can include any one or more the amplified target sequences generated at the genomic coordinates using the amplicon ID target-specific primers provided in Table 18 (found in U.S. Ser. No. 13/458,739, filed Apr. 27, 2012, hereby incorporated by reference in its entirety), or provided in Table 7 of U.S. Application 61/598,881 hereby incorporated by reference in its entirety. In one embodiment, the amplified target sequences include 100, 200, 500, 1000, 2000, 3000, 6000, 8000, 10,000, 12,000, or more amplicons from Tables 1-5, or Tables 6 and 7 of U.S. Application 61/598,881 hereby incorporated by reference in their entireties (also Tables 1-5, 6 and 7 found in U.S. Ser. No. 13/458,739, filed Apr. 27, 2012, hereby incorporated by reference in its entirety. In some embodiments, the disclosure relates generally to the detection and optionally, the identification of clinically actionable mutations. As defined herein, the term "clinically actionable mutations" includes mutations that are known or can be associated by one of ordinary skill in the art with, but not limited to, prognosis for the treatment of cancer. In one embodiment, prognosis for the treatment of cancer includes the identification of mutations associated with responsiveness or non-responsiveness of a cancer to a drug, drug combination, or treatment regime. In one embodiment, the disclosure relates generally to the amplification of a plurality of target sequences from a population of nucleic acid molecules linked to, or correlated with, the onset, progression or remission of cancer.

In some embodiments, target-specific primers are designed using the primer criteria disclosed herein. In some embodiments, target-specific primers are designed using the primer criteria disclosed herein and directed to one or more genes associated with breast cancer. In some embodiments, target-specific primers associated with breast cancer include at least one target-specific primer selected from one or more genes selected from the group consisting of AIM1, AR, ATM, BARD1, BCAS1, BRIP1, CCND1, CCND2, CCNE1, CDH1, CDK3, CDK4, CDKN2A, CDKN2B, CAMK1D, CHEK2, DIRAS3, EGFR, ERBB2, EPHA3, ERBB4, ETV6, GNRH1, KCTD9, CDCA2, EBF2, EMSY, BNIP3L, PNMA2, DPYSL2, ADRA1A, STMN4, TRIM35, PAK1, AQP11, CLSN1A, RSF1, KCTD14, THRSP, NDUFC2, ALG8, KCTD21, USP35, GAB2, DNAH9, ZNF18, MYOCD, STK11, TP53, JAKE JAK2, MET, PDGFRA, PML, PTEN, RET, TMPRSS2, WNK1, FGFR1, IGF1R, PPP1R12B, PTPRT, GSTM1, IP08, MYC, ZNF703, MDM1, MDM2, MDM4, MKK4, P14 KB, NCOR1, NBN, PALB2, RAD50, RAD51, PAK1, RSF1, INTS4, ZMIZ1, SEPHS1, FOXM1, SDCCAG1, IGF1R, TSHZ2, RPSK6K1, PPP2R2A, MTAP, MAP2K4, AURKB, BCL2, BUB1, CDCA3, CDCA4, CDC20, CDC45, CHEK1, FOXM1, HDAC2, IGF1R, KIF2C, KIFC1, KRAS, RB1, SMAD4, NCOR1, UTX, MTHDFD1L, RAD51AP1, TTK and UBE2C.

In some embodiments, the disclosure relates generally to the amplification of target sequences directed to mutations associated with a congenital or inherited disease. In some embodiments, the disclosure can include the amplification of target sequences directed to somatic or germline mutations. In some embodiments, the mutations can be autosomal dominant or autosomal recessive. In one embodiment, the mutations associated with a congenital or inherited disease are located in at least one of the genes or diseases provided in Table 4 (from U.S. Ser. No. 13/458,739, filed Apr. 27, 2012, hereby incorporated by reference in its entirety). In some embodiments, the disclosure relates to the amplification of target sequences in a sample associated with one or more inherited diseases selected from the group consisting of Adenosine Aminohydrolase Deficiency (ADA); Agammaglobulinemia, X-linked, Type 1; Alagille Syndrome; All Hypertrophic and Dilated Cardiomyopathy; Alopecia Universalis Congenita (ALUNC); Alpers Syndrome; Alpha-1-Antitrypsin Deficiency; Alpha-Thalassemia—Southeast Asia; Amyotrophic Lateral Sclerosis—Lou Gehrig's Disease; Androgen Insensitivity Syndrome; Aniridia; Ankylosing spondylitis; APC-Associated Polyposis Conditions; Argininosuccinate Lyase Deficiency; Arrhythmogenic Right Ventricular Dysplasia/Cardiomyopathy; Ataxia with Oculomotor Apraxia Type 2; Ataxia with Vitamin E Deficiency; Ataxia-Telangiectasia; Autoimmune Polyendocrine Syndrome; Beta-Hydroxyisobutyryl CoA Deacylase deficiency (HIBCH deficiency); Biotimidase Deficiency; Blepharophimosis-ptosis-epicanthus inversus; Bloom Syndrome; Brachydactyly; Brachydactyly—Hypertension Syndrome; Brachydactyly Type B1; Branchiootorenal Spectrum Disorders; BRCA1; Campomelic Dysplasia; Canavan; Cerebrotendinous Xanthomatosis; Ceroid-lipofuscinoses-Batton; Charcot-Marie-Tooth Disease Type 2B; Charcot-Marie-Tooth Neuropathy Type 1B; Charcot-Marie-Tooth Neuropathy Type 2A2; Charge Syndrome; Cherubism; Choroideremia; Citrin Deficiency; Citrullinemia Type I; Coffin-Lowry Syndrome; Cohen Syndrome; Collagen 4A5; Common Variable Immune Deficiency; Congenital Adrenal Hyperplasia; Congenital Cataracts, Facial Dysmorphism, and Neuropathy; Congenital Disorder of Glycosylation Type 1a; Congenital Myasthenic Syndromes; Cornelia de Lange Syndrome; Cystic fibrosis; Cystinosis; Darier Disease; Desmin Storage Myopathy; DFNA2 Nonsyndromic Hearing Loss; Diamond-Blackfan Anemia; Double Cortex Syndrome; Duane Syndrome; Duchenne/Becker muscular dystrophy; Dysferlinopathy; Dyskeratosis Congenita; Early-Onset Familial Alzheimer Disease; Early-Onset Primary Dystonia (DYT1); Ehlers Danlos; Ehlers-Danlos Syndrome, Classic Type; Ehlers-Danlos Syndrome, Hypermobility Type; Ehlers-Danlos Syndrome, Kyphoscoliotic Form; Emery-Dreifuss Muscular Dystrophy X linked; Epidermolysis Bullosa Simplex; Fabry Disease; Facioscapulohumeral Muscular Dystrophy; Familial Dysautonomia (HSAN III); Familial Hyperinsulinism (FHI); Familial Hypertrophic Cardiomyopathy; Familial Transthyretin Amyloidosis; Fanconi Anemia; Fragile X; Friedreich Ataxia; FRMD7-Related Infantile Nystagmus; Fryns Syndrome; Galactosemia; Gaucher Disease; Glycine Encephalopathy; Glycogen Storage Disease Type VI; Hemophagocytic Lymphohistiocytosis; Hemophilia A; Hemophilia B; Hepatic Veno-Occlusive Disease with Immunodeficiency; Hereditary Hemorrhagic Telangiectasia; Hereditary Neuropathy with Liability to Pressure Palsies; Hereditary Nonpolyposis Colon Cancer; Hexosaminidase A Deficiency; HFE-Associated Hereditary Hemochromatosis; Holt-Oram Syndrome; Huntington Disease; Hydroxymethylbilane Synthase (HMBS) Deficiency; Hypophosphatasia; Inclusion Body Myopathy 2; Incontinentia Pigmenti; Juvenile Polyposis Syndrome; Kallmann Syndrome; Leber Congenital Amaurosis; Leber congenital amaurosis 10; L1-Fraumeni Syndrome; Limb-Girdle Muscular Dystrophy Type 2A Calpainopathy; LIS1-Associated Lissencephaly; Long QT Syndrome; Lowe Syndrome; Malignant Hyperthermia Susceptibility; Maple Syrup Urine Disease; MAPT-Related Disorders; McKusick-Kaufman Syndrome; MECP2-Rett Syndrome; Menkes; Metachromatic Leukodystrophy; Methylmalonic Acidemia; Mucolipidosis II; Multiple Endocrine Neoplasia Type 1; Multiple Endocrine Neoplasia Type 2; Myotonia Congenita; Myotonic Dystrophy Type 1; Myotonic Dystrophy Type 2; Nail-Patella Syndrome; Nemaline Myopathy; Neurofibromatosis 1; Neurofibromatosis 2; Noonan Syndrome; Ocular Albinism, X-Linked; Oculocutaneous Albinism Type 1; Oculocutaneous Albinism Type 2; Oculopharyngeal Muscular Dystrophy; Optic Atrophy Type 1; Ornithine Transcarbamylase Deficiency; Osteogenesis Imperfecta; Parkinson Disease; Pendred Syndrome; Peroxisome Biogenesis, Zellweger; Phenylketonuria; Polycystic Kidney Disease; Pompe Disease-GSD II; Primary Ciliary Dyskinesia; Retinitis Pigmentosa; Retinoblastoma; Saethre-Chotzen Syndrome; SCN9A-Related Inherited Erythromelalgia; SHOX-Related Haploinsufficiency; Sickle Cell Disease; Smith-Lemli-Opitz Syndrome; Smith-Magenis Syndrome; Sotos Syndrome; Spastic Paraplegia 3A; Spastic Paraplegia 7; Spastic Paraplegia 8; Spastic Paraplegia Type 1; Spastic Paraplegia Type 4; Spinal Muscular Atrophy; Spinocerebellar Ataxia 2; Spinocerebellar Ataxia 3; Spinocerebellar Ataxia 7; Spinocerebellar Ataxia Type 1; Stickler Syndrome; Thanatophoric Dysplasia; Thoracic Aortic Aneurysms and Aortic Dissections; Treacher Collins Syndrome; Trimethylaminuria; Tuberous Sclerosis Complex; Udd Distal Myopathy; Usher Syndrome type 1; Very Long Chain Acyl-Coenzyme A Dehydrogenase Deficiency; von Hippel-Lindau; Waardenburg Syndrome, Type 1; Werner Syndrome; Wilms Tumor; Wilson Disease; Wiskott-Aldrich; X-Linked Adrenal Hypoplasia Congenita; X-Linked Adrenoleukodystrophy; X-Linked Dystonia-Parkinsonism; X-linked Juvenile Retinoschisis; X-linked myotubular Myopathy; X-Linked SCIDS; and Zellweger Syndrome.

In one embodiment, the mutations associated with a congenital or inherited disease can include substitutions, insertions, inversions, point mutations, deletions, mismatches and translocations. In some embodiments, the mutations associated with an inherited or congenital disease includes copy number variation. In some embodiments, the disclosure relates generally to the selective amplification of at least one target sequence and the detection and/or identification of mutations associated with an inherited disease. In some embodiments, the mutations associated with a congenital or inherited disease can be located in one or more of the genes selected from the group consisting of ABCA4; ABCC8; ABCD1; ACADVL; ACTA2; ACTC; ACTC1; ACVRL1; ADA; AIPL1; AIRE; ALK1; ALPL; AMT; APC; APP; APTX; AR; ARL6; ARSA; ASL; ASPA; ASS; ASS1; ATL; ATM; ATP2A2; ATP7A; ATP7B; ATXN1; ATXN2; ATXN3; ATXN7; BBS6; BCKDHA; BCKDHB; BEST1; BMPR1A; BRCA1; BRCA2; BRIP1; BTD; BTK; C2orf25; CA4; CALR3; CAPN3; CAV3; CCDC39; CCDC40; CDH23; CEP290; CERKL; CFTR; CHAT; CHD7; CHEK2; CHM; CHRNA1; CHRNB1; CHRND; CHRNE; CLCN1; CNBP; CNGB1; COH1; COL11A1; COL11A2; COL1A1; COL1A2; COL2A1; COL3A1; COL4A5; COL5A1; COL5A2; COL7A1; COL9A1; CRB1; CRX; CTDP1; CTNS; CYP21A2; CYP27A1; DAX1; DBT; DCX; DES; DHCR7; DJ1; DKCl; DLD; DMD; DMPK; DNAAF1; DNAAF2; DNAH11; DNAH5; DNA11; DNAI2; DNAL1; DNM2; DOK7; DSC2; DSG2; DSP; DYSF; DYT1; EMD; ENG; EYA1; EYS; F8; F9; FANCA; FANCC; FANCF; FANCG; FANCJ; FANDC2; FBN1; FBXO7; FGFR1; FGFR3; FMO3; FMR1; FOXL2; FRG1; FRMD7; FSCN2; FXN; GAA; GALT; GBA; GBE1; GCSH; GDF5; GJB2; GJB3; GJB6; GLA; GLDC; GNE; GNPTAB; GPC3; GPR143; GUCY2D; HBA1; HBA2; HBB; HD; HERG; HEXA; HFE; HHF; HIBCH; HLA-B27; HMBS; HPLH1; HPRP3; HR; HTNB; HTT; IKBKAP; IKBKG; IL2RG; IMPDH1; ITGB4; JAG1; JPH3; KCNE1; KCNE2; KCNH2; KCNQ1; KCNQ4; KIAA0196; KLHL7; KRAS; KRT14; KRT5; L1CAM; LAMBS; LAMP2; LDB3; LMNA; LMX18; LRAT; LRRK2; MAPT; MC1R; MECP2; MED12; MEN1; MERTK; MFN2; MKKS; MLH1; MMAA; MMAB; MMACHC; MMADHC; MPZ; MSH2; MTM1; MTND5; MTTG; MTTI; MTTK; MTTL1; MTTQ; MUT; MYBPC3; MYH11; MYH6; MYH7; MYL2; MYL3; MYLK2; MYO7A; NDS; ND6; NEMO; NF1; NF2; NIPBL; NROB1; NR2E3; NRAS; NSD1; OCA2; OCRL; OPA1; OTC;

PABPN1; PAFAH1B1; PAH; PARK2; PARK7; PARKIN; PAX3; PAX6; PCDH15; PEX1; PEX2; PEX10; PEX13; PEX14; PEX19; PEX26; PEX3; PEX5; PINK1; PKD1; PKD2; PKD3; PKHD1; PKP2; PLEC1; PLOD1; PMM2; PMP22; POLG; PPT1; PRCD; PRKAG2; PRNP; PROM1; PRPF3; PRPF8; PRPH2; PRPN; PSEN1; PSEN2; PTCH1; PTPN11; RAB7A; RAF1; RAI1; RAPSN; RB1; RDH12; RDS; RECQL3; RET; RHO; ROR2; RP1; RP2; RP9; RPE65; RPGR; RPGRIP1; RPL11; RPL35A; RPS10; RPS17; RPS19; RPS24; RPS26; RPS6KA3; RPS7; RPSL5; RS1; RSPH4A; RSPH9; RYR1; RYR2; SALL4; SCA3; SCN5A; SCN9A; SEMA4A; SERPINA1; SERPING1; SGCD; SH3BP2; SHOX; SIX1; SIX5; SLC25A13; SLC25A4; SLC26A4; SMAD4; SMN1; SNCA; SNRNP200; SOD1; SOS1; SOX9; SP110; SPAST; SPATA7; SPG3A; SPG4; SPG7; TAF1; TBX5; TCOF1; TGFBR1; TGFBR2; TNFRSC13C; TNNC1; TNNI3; TNNT1; TNNT2; TNXB; TOPORS; TOR1A; TP53; TPM1; TRNG; TRNI; TRNK; TRNL1; TRNQ; TSC1; TSC2; TTN; TTPA; TTR; TULP1; TWIST1; TXNDC3; TYR; USH1C; USH1H; USH2A; VCL; VHL; VPS13B; WAS; WRN; WT1; and ZNF9.

In some embodiments, target-specific primers directed to one or more inherited diseases or congenital disorders can be selected from any one or more of the target-specific primers provided in Table 15 (see U.S. Ser. No. 13/458,739, filed Apr. 27, 2012, hereby incorporated by reference in its entirety). In some embodiments, the target-specific primers from Table 15 (found in U.S. Ser. No. 13/458,739, filed Apr. 27, 2012, hereby incorporated by reference in its entirety) can include 2, 3, 4, 5, 6, 7, 8, 9, 10, 20, 40, 60, 80, 100, 150, 200, 400, 500, 800, 1000, 2000, 3000, 4000, 5000, 6000, 7000, 8000, 9000, 10,000, 11,000, 12,000, 13,000 or more target-specific primers. In some embodiments, the amplified target sequences can include any one or more of the amplified target sequences generated at the genomic coordinates (using amplicon ID target-specific primers) provided in Table 16 (see U.S. Ser. No. 13/458,739, filed Apr. 27, 2012, hereby incorporated by reference in its entirety). In some embodiments, at least one of the target-specific primers associated with a congenital disease or disorder is at least 90% identical to at least one nucleic acid sequence selected from SEQ ID NOs: 1-103,143. In some embodiments, at least one of the target-specific primers associated with a congenital disease or disorder is complementary across its entire length to at least one target sequence in a sample. In some embodiments, at least one of the target-specific primers associated with a congenital disease or disorder includes a non-cleavable nucleotide at the 3' end. In some embodiments, the non-cleavable nucleotide at the 3' end includes the terminal 3' nucleotide. In one embodiment, target sequences or resulting amplified target sequences are directed to individual exons having a mutation associated with an inherited disease. In some embodiments, congenital or inherited disease amplified target sequences can include two or more target-specific primers provided in Table 15 (from U.S. Ser. No. 13/458,739, filed Apr. 27, 2012, hereby incorporated by reference in its entirety) or Table 8 of U.S. Application 61/598,881 hereby incorporated by reference in its entirety. In some embodiments, the amplified target sequences can include any one or more of the amplified target sequences generated at the genomic coordinates using the amplicon ID target-specific primers provided in Table 16 (from U.S. Ser. No. 13/458,739, filed Apr. 27, 2012, hereby incorporated by reference in its entirety) or Table 9 of U.S. Application 61/598,881 hereby incorporated by reference in its entirety. In some embodiments, congenital or inherited disease amplified target sequences can include two or more target-specific primers provided in Table 15 (found in U.S. Ser. No. 13/458, 739, filed Apr. 27, 2012, hereby incorporated by reference in its entirety). In some embodiments, the amplified target sequences can include any one or more of the amplified target sequences generated at the genomic coordinates using the amplicon ID target-specific primers provided in Table 16 (found in U.S. Ser. No. 13/458,739, filed Apr. 27, 2012, hereby incorporated by reference in its entirety). In one embodiment, the congenital or inherited disease target-specific primers can include any one or more of the target-specific primers provided in Table 8 of U.S. Application 61/598,881 hereby incorporated by reference in its entirety. In some embodiments, any one or more target-specific primers can be designed using the target-specific primer selection criteria outlined herein. In some embodiments, the disclosure relates generally to the selective amplification of more than one target sequence in a sample and the detection and/or identification of mutations associated with a congenital or inherited disease. In one embodiment, the disclosure relates generally to the amplification of a plurality of target sequences linked to, or correlated with a congenital or inherited disease.

In some embodiments, the target-specific primers are prepared to amplify regions or fragments of the human genome associated with a congenital or inherited disease. In some embodiments, the target-specific primers can be prepared to amplify regions of the human genome associated with heredity disorders, such as cystic fibrosis, Alagille syndrome, Alpers syndrome, Alpha-Thalassemia, Amyotrophic Lateral Sclerosis, Anklosing spondylitis, Ataxia-Telangiectasia, congential Myasthenic syndromes, Darier disease, Diamond-Blackfan anemia, early onset familial Alzheimer disease, Ehlers-Danlos syndrome, Epidermolysis Bullosa Simplex, familial Hypertrophic Cardiomyopathy, Fanconi anemia, Glycine Encephalopathy, Hereditary Hemorrhagic Telangiectasia, Huntington Disease, Juvenile Polyposis syndrome, Leber Congential Amaurosis, Long QT syndrome, Maple Syrup Urine Disease, Marfan syndrome, Mitochondrial Encephalomyopathy, Methylmalonic Acidemia, Multiple Endocrine Neoplasia Type 2, Noonan syndrome, Parkinson disease, Peroxisome Biogenesis, Primary Cilary Dyskineasia, Retinitis Pigmentosa, Stickler syndrome, Thoracic Aortic Aneurysms and Aortic Dissections, Tuberous Sclerosis Complex, Usher syndrome, Werner syndromw, Wilson disease and Zellweger syndrome. In some embodiments, the target-specific primers can be prepared from any one or more of the genes provided in Table 4 (found in U.S. Ser. No. 13/458,739, filed Apr. 27, 2012, hereby incorporated by reference in its entirety).

In some embodiments, the disclosure relates generally to detecting the presence of a target sequence or amplified target sequence associated with one or more newborn disorders. In some embodiments, the disclosure relates generally to detecting the presence of an amplified target sequence obtained by amplifying a sample containing at least one target sequence associated with a newborn disorder with one or more target-specific primers disclosed herein. In some embodiments, the disclosure relates generally to detecting the presence of an amplified target sequence obtained by amplifying a sample containing at least one target sequence associated with a newborn disorder and a target-specific primer designed according to the primer criteria provided herein.

In some embodiments, the one or more newborn disorders can include 2-methyl-3-hydroxybutyric aciduria (2M3HBA); 2-methylbutyryl-CoA dehydrogenase (2 MBG); 3-methyl-glutaconic aciduria (3MGA); argininemia (ARG); defects of biopterin cofactor biosynthesis (BIOPT-BS); defects of biopterin cofactor regeneration (BIOPT-REG); carnitine acylcarnitine translocase (CACT); methylmalonic acidemia (CBL-C,D); citruilinemia type II (CIT-II); carnitine palmitoyltransferase I (CPT-Ia); carnitine palmitoyltransferase II (CPT-II); Dienoyl-CoA reductase (De-Red); Glutaric acidemia type H (GA-II); galactose epimerase (GALE); galactokinase (GALK); benign hyperphenylalaninemia (H-PHE); isobutyryl-CoA dehydrogenase (IBG); medium/short chain L-3-hydroxy acyl-CoA dehydrogenase (M/SCHAD); malonic acidemia (MAL); medium chain ketoacyl-CoA thiolase (MCKAT); hypermethioninemia (MET); short chain acyl-CoA dehydrogenase (SCAD); Tyrosinemia type II (TYR-II); tyrosinemia type III (TYR-III); Biotimidase (BIO); Cystic fibrosis (CF); Transferase deficient galactosemia (GALT); Sickle-C disease (HB S/C); Congenital adrenal hyperplasia (CAH); Congenital hypothyroidism (CH); Sickle cell anemia (HB S/S); S-βeta thalassemia(HB S/A); (SCID) Severe Combined Immunodeficiency; 5-oxoprolinuria (pyroglutamic aciduria) (5-OXO); Glucose 6 phosphate dehydrogenase (G6PD); Nonketotic hyperglycinemia (NKH); Carbamoylphosphate synthetase (CPS); Hyperammonemia/ornithinemia/citrullinemia (Ornithine transporter defect) (HHH); Prolinemia (PRO); Ethylmalonic encephalopathy (EMA); Human immunodeficiency virus (HIV); Toxoplasmosis (TOXO); 3-Methylcrotonyl-CoA carboxylase (3-MCC); Carnitine uptake defect (CUD); Long-chain L-3-hydroxyacyl-CoA dehydrogenase (LCHAD); Phenylketonuria/Hyperphenylalaninemia (PKU); Argininosuccinate aciduria (ASA); Glutaric acidemia type 1 (GA-1); Medium-chain acyl-CoA dehydrogenase (MCAD); Propionic acidemia (Propionyl-CoA carboxylase) (PROP); Beta ketothiolase (mitochondrial acetoacetyl-CoA thiolase; short-chain ketoacyl thiolase; T2) (BKT); Homocystinuria (cystathionine beta synthase) (HCY); Multiple carboxylase (Holocarboxylase synthetase) (MCD); Trifunctional protein deficiency (TFP); Methylmalonic academia (Vitamin B12 Disorders) (CBL A,B); 3-Hydroxy 3-methylglutaric aciduria (3-Hydroxy 3-methylglutaryl-CoA lyase) (HMG); Maple syrup urine disease (branched-chain ketoacid dehydrogenase) (MSUD); Tyrosinemia Type 1 (TYR-1); Citrullinemia type I (Argininosuccinate synthetase) (CIT I); Isovaleric acidemia (Isovaleryl-CoA dehydrogenase) (IVA); Methylmalonic Acidemia (methylmalonyl-CoA mutase) (MUT); and very long-chain acyl-CoA dehydrogenase (VLCAD).

In some embodiments, the disclosure relates generally to target-specific primers for the detection of newborn screening disorders. In some embodiments, target-specific primers for newborn disorders including the disorders provided above can be prepared using the primer criteria disclosed herein. In some embodiments, the disclosure relates generally to detecting a newborn disorder by contacting a sample that may contain one or more target sequences for one or more newborn disorders and amplifying the one or more target sequences in the sample, thereby obtaining at least one amplified target sequence associated with at least one newborn disorder. In some embodiments, a plurality of target-specific primers can be designed to amplify a plurality of target sequences from a sample, thereby providing a means to detect a plurality of newborn disorders optionally, in a single method or procedure. In some embodiments, target-specific primers designed to amplify a plurality of amplified target sequences associated with one or more newborn disorders can be pooled and provided as a newborn screening panel.

In some embodiments, target sequences or amplified target sequences are directed to nucleic acids obtained from a forensic sample. In one embodiment, forensic samples can include nucleic acids obtained from a crime scene, nucleic acids obtained from a missing persons DNA database, nucleic acids obtained from a laboratory associated with a forensic investigation or include forensic samples obtained by law enforcement agencies, one or more military services or any such personnel. In some embodiments, target sequences can be present in one or more bodily fluids including but not limited to, blood, sputum, plasma, semen, urine and serum. In some embodiments, target sequences can be obtained from hair, skin, tissue samples, autopsy or remains of a victim. In some embodiments, nucleic acids including one or more target sequences can be obtained from a deceased animal or human. In some embodiments, target sequences can include nucleic acids obtained from non-human DNA such a microbial, plant or entomological DNA. In some embodiments, target sequences or amplified target sequences are directed to purposes of human identification. In some embodiments, the disclosure relates generally to methods for identifying a nucleic acid sample from an animal, including a human. In some embodiments, the disclosure relates generally to methods for identifying characteristics of a forensic sample. In some embodiments, the disclosure relates generally to human identification methods using one or more target-specific primers disclosed herein or one or more target-specific primers prepared using the primer criteria outlined herein.

In one embodiment, a forensic or human identification sample containing at least one target sequence can be amplified using any one or more of the target-specific primers discloser herein or using the primer criteria outlined herein. In some embodiments, a forensic or human identification sample containing one or more target sequences can be identified by amplifying the at least one or more target sequences with any one or more target-specific primers provided in Tables 13 and 14 (both found in U.S. Ser. No. 13/458,739, filed Apr. 27, 2012, hereby incorporated by reference in its entirety). Table 13 (from U.S. Ser. No. 13/458,739, filed Apr. 27, 2012, hereby incorporated by reference in its entirety) provides a plurality of target-specific primers, provided as primer pairs, directed to single nucleotide polymorphisms (SNPs) associated with human identification. Table 14 (from U.S. Ser. No. 13/458,739, filed Apr. 27, 2012, hereby incorporated by reference in its entirety) provides a plurality of target-specific primers, provided as primer pairs, directed to short tandem repeats (STRs) associated with human identification. An individual inherits one copy of an STR from each parent, which may or may not have similar repeat sizes. The number of repeats in STR markers can be highly variable among individuals, which makes STRs effective for human identification purposes. In some embodiments, targets-specific primers such as those provided in Table 14 (from U.S. Ser. No. 13/458,739, filed Apr. 27, 2012, hereby incorporated by reference in its entirety), or target-specific primers prepared as disclosed herein, that are directed to the gene amelogenin (AMG) can be used to determine the sex of the individual providing the sample. For example, primers to the amelogenin gene can be prepared using the criteria disclosed herein that are specific, for example, to intron 1. Once a sample is amplified using such target-specific primers, the amplification product from a male sample versus a female sample will generally result in amplification products (amplified target sequences) that differ by in length by several nucleotides and therefore provides a simple method by which to determine the sex of the individual providing the sample.

In one embodiment, a sample containing one or more target sequences can be amplified using any one or more of the target-specific primers disclosed herein. In another embodiment, amplified target sequences obtained using the methods (and associated compositions, systems, apparatuses and kits)

disclosed herein, can be coupled to a downstream process, such as but not limited to, nucleic acid sequencing. For example, once the nucleic acid sequence of an amplified target sequence is known, the nucleic acid sequence can be compared to one or more reference samples such as Hg19 genome. The Hg19 genome is commonly used in the genomics field as a reference genome sample for humans. In some embodiments, a sample suspected of containing one or more SNPs and/or STRs can be identified by amplifying the sample suspected of containing the SNP or STR with any one or more of the target-specific primers provided in Tables 13 and 14 (both tables found in U.S. Ser. No. 13/458,739, filed Apr. 27, 2012, hereby incorporated by reference in its entirety). Consequently, the output from the amplification procedure can be optionally analyzed for example by nucleic acid sequencing to determine if the expected amplification product based on the target-specific primers is present in the amplification output. The identification of an appropriate SNP or STR amplification product can in some instances provide additional information regarding the source of the sample or it characteristics (e.g., a male or female sample or a sample of particular ancestral origin).

It is envisaged that one of ordinary skill in the art can readily prepare one or more target-specific primers using the primer criteria disclosed herein without undue experimentation. It is also envisaged that one of ordinary skill in the art can readily prepare one or more target-specific primers using the criteria disclosed herein, to identify at least one medically relevant polymorphism. In some instances, a medically relevant polymorphism can be used in forensic or human identification purposes. Generally, a medically relevant polymorphism includes a polymorphism that is associated with at least one disease state in multiple populations (e.g., a European Caucasian population). In some embodiments, a medically relevant polymorphism includes any one or more of the polymorphisms outlined below.

| Polymorphism | Caucasian MAF | Chromosome | Gene | Disease Associated with Polymorphism |
| --- | --- | --- | --- | --- |
| rs1137101 | 0.449 | 1p31 | LEPR | Obesity, Insulin Resistance, Non-Hodgkin's lymphoma |
| rs486907 | 0.408 | 1q25 | RNASEL | Prostate cancer |
| rs1042031 | 0.208 | 2p24 | APOB | Cardiovascular disease, Dislipidemia |
| rs231775 | 0.379 | 2q33 | CTLA4 | Multiple Sclerosis, Autoimmune Disease |
| rs5186 | 0.348 | 3q21 | AGTR1 | Metabolic syndrome, Aortic aneurism, Left-ventricular hypertrophy |
| rs6280 | 0.35 | 3q13.3 | DRD3 | Schizophrenia |
| rs1693482 | 0.477 | 4q21 | ADH1C | Alcohol dependence, Coronary heart disease |
| rs1799883 | 0.373 | 4q28 | FABP2 | Metabolic syndrome, Type 2 diabetes |
| rs4444903 | 0.392 | 4q25 | EGF | Cancer |
| rs4961 | 0.208 | 4p16.3 | ADD1 | Hypertension, Coronary artery disease |
| rs1042714 | 0.467 | 5q31 | ADRB2 | Obesity, COPD |
| rs351855 | 0.283 | 5q35.1 | FGFR4 | Cancer |
| rs5370 | 0.242 | 6p24 | EDN1 | Asthma, sleep apnea |
| rs6296 | 0.322 | 6q13 | HTR1B | Substance abuse |
| rs2227983 | 0.25 | 7p12.3 | EGFR | Cancer |
| rs213950 | 0.492 | 7q31.2 | CFTR | Cystic fibrosis |
| rs7493 | 0.237 | 7q21.3 | PON2 | Myocardial infarction |
| rs328 | 0.273 | 8p22 | LPL | Left ventricular hypertrophy |
| rs2383206 | 0.475 | 9p21 | | Coronary artery disease |
| rs1800861 | 0.25 | 10q11.2 | RET | Hirschsprung disease, Thyroid cancer |

-continued

| Polymorphism | Caucasian MAF | Chromosome | Gene | Disease Associated with Polymorphism |
| --- | --- | --- | --- | --- |
| rs1801253 | 0.283 | 10q24 | ADRB1 | Insulin Resistance |
| rs2227564 | 0.341 | 10q24 | PLAU | Alzheimer's disease, Asthma |
| rs1799750 | 0.433 | 11q22.3 | MMP1 | Endometriosis, Osteolysis, Rheumatoid arthritis |
| rs1063856 | 0.342 | 12p13.3 | VWF | Hypertension |
| rs6313 | 0.438 | 13q14 | HTR2A | Psychiatric disorders |
| rs2236225 | 0.396 | 14q24 | MTHFD1 | Neural tube defects |
| rs1800588 | 0.333 | 15q21 | LIPC | Coronary artery disease |
| rs243865 | 0.198 | 16q13 | MMP2 | Cancer |
| rs4673 | 0.342 | 16q24 | CYBA | Coronary artery disease |
| rs708272 | 0.478 | 16q21 | CETP | Coronary artery disease |
| rs1800012 | 0.188 | 17q21.3 | COL1A1 | Osteoporosis |
| rs4291 | 0.354 | 17q23 | ACE | Depression, Alzheimer's disease |
| rs4792311 | 0.331 | 17p11 | ELAC2 | Prostate cancer |
| rs16430 | 0.37 | 18p11.3 | ENOSF1/TYMS | Cancer |
| rs601338 | 0.391 | 19q13.3 | FUT2 | Infection susceptibility |
| rs688 | 0.45 | 19p13.2 | LDLR | Alzheimer's disease, Coronary artery disease |
| rs7121 | 0.458 | 20q13.3 | GNAS | Obesity, Cancer |
| rs234706 | 0.333 | 21q22 | CBS | Oral cleft defects |
| rs4680 | 0.483 | 22q11.21 | COMT | Schizophrenia, ADHD |
| AMG | 0.5 | Xp22.3 | AMG | Sex Marker |

In some embodiments, a medically relevant polymorphism can be present within a single exon of the corresponding disease associated gene. In some embodiments, the disclosure relates generally to the selective amplification of at least one target sequence in a sample and the detection and/or identification of a medically relevant polymorphism. In some embodiments, the disclosure relates generally to the selective amplification of at least one target sequence in a sample and the detection and/or identification of a SNP or STR. In some embodiments, amplified target sequences can be generated by amplifying a sample with one or more target-specific primers of Tables 13 or 14 (both tables found in U.S. Ser. No. 13/458,739, filed Apr. 27, 2012, hereby incorporated by reference in its entirety). In some embodiments, the amplified target sequences can include any one or more of the amplified target sequences generated at the genomic coordinates provided in the polymorphism table above. In one embodiment, an amplified target sequence can be prepared using one or more of the target-specific primers from Tables 13 or 14 (both from U.S. Ser. No. 13/458,739, filed Apr. 27, 2012, hereby incorporated by reference in its entirety). In some embodiments, any one or more target-specific primers corresponding to SEQ ID NOs: 50354-50451 can be used to selectively amplify at least one target sequence present in a sample. In some embodiments, at least one target-specific primer selected from SEQ ID NOs: 50354-50451 can be used to amplify a target sequence from a sample for the purposes of forensic or human identification.

In some embodiments, target-specific primers directed to human identification can be selected from any one or more of the target-specific primers provided in Tables 13 or 14 (from U.S. Ser. No. 13/458,739, filed Apr. 27, 2012, hereby incorporated by reference in its entirety). In some embodiments, the target-specific primers from Tables 13 or 14 (found in U.S. Ser. No. 13/458,739, filed Apr. 27, 2012, hereby incorporated by reference in its entirety) can include 1, 2, 3, 4, 5, 6, 7, 8, 9, 10, 15, 20, 22, 25, 27, 30, 35, 38, 40, 42, 45 or more target-specific primers. In some embodiments, at least one of the target-specific primers associated with human identification is at least 90% identical to at least one of the target-specific primers provided in Tables 13 or 14 (from U.S. Ser. No.

13/458,739, filed Apr. 27, 2012, hereby incorporated by reference in its entirety). In some embodiments, at least one of the target-specific primers associated with human identification is complementary across its entire length to at least one target sequence in a sample. In some embodiments, at least one of the target-specific primers associated with human identification includes a non-cleavable nucleotide at the 3' end. In some embodiments, the non-cleavable nucleotide at the 3' end includes the terminal 3' nucleotide.

In some embodiments, the disclosure relates generally to methods (and associated compositions, systems, apparatuses and kits) for reducing the formation of amplification artifacts in a multiplex PCR. In some embodiments, primer-dimers or non-specific amplification products are obtained in lower number or yield as compared to standard multiplex PCR of the prior art. In some embodiments, the reduction in amplification artifacts is in part, governed by the use of target-specific primer pairs in the multiplex PCR reaction. In one embodiment, the number of target-specific primer pairs in the multiplex PCR reaction can be greater than 1000, 3000, 5000, 10000, 12000, or more. In some embodiments, the disclosure relates generally to methods (and associated compositions, systems, apparatuses and kits) for performing multiplex PCR using target-specific primers that contain a cleavable group. In one embodiment, target-specific primers containing a cleavable group can include one or more cleavable moieties per primer of each primer pair. In some embodiments, a target-specific primer containing a cleavable group includes an nucleotide neither normally present in a non-diseased sample nor native to the population of nucleic acids undergoing multiplex PCR. For example, a target-specific primer can include one or more non-native nucleic acid molecules such as, but not limited to thymine dimers, 8-oxo-2'-deoxyguanosine, inosine, deoxyuridine, bromodeoxyuridine, apurinic nucleotides, and the like.

In some embodiments, the disclosed methods (and associated compositions, systems, etc.,) involve performing a primary amplification of target sequences from a population of nucleic acids, optionally using target-specific primers. In some embodiments, the disclosed methods involve amplifying target sequences using target-specific forward and reverse primer pairs. The target-specific forward and reverse primer pairs can optionally include one or more intron-specific and/or exon specific forward and reverse primer pairs. In some embodiments, each primer pair is directed to a single or discrete exon. In some embodiments, the disclosed methods involve amplifying target sequences using exon-specific forward and reverse primer pairs containing at least one cleavable group. In some embodiments, the target-specific forward and reverse primer pairs contain a uracil nucleotide as the one or more cleavable groups. In one embodiment, a target-specific primer pair can include a uracil nucleotide in each of the forward and reverse primers of each primer pair. In one embodiment, a target-specific forward or reverse primer contains one, two, three or more uracil nucleotides. In some embodiments, the disclosed methods involve amplifying at least 10, 50, 100, 200, 500, 1000, 2000, 3000, 5000, 6000, 8000, 10000, 12000 or more, target sequences from a population of nucleic acids having a plurality of target sequences using target-specific forward and reverse primer pairs containing at least two uracil nucleotides.

In some embodiments, target-specific primers (including but not limited to intron-specific and exon-specific primers, which can be forward and/or reverse primers) can be designed de novo using algorithms that generate oligonucleotide sequences according to specified design criteria. For example, the primers may be selected according to any one or more of criteria specified herein. In some embodiments, one or more of the target-specific primers are selected or designed to satisfy any one or more of the following criteria: (1) inclusion of two or more modified nucleotides within the primer sequence, at least one of which is included near or at the termini of the primer and at least one of which is included at, or about the center nucleotide position of the primer sequence; (2) primer length of about 15 to about 40 bases in length; (3) $T_m$ of from about 60° C. to about 70° C.; (4) low cross-reactivity with non-target sequences present in the target genome or sample of interest; (5) for each primer in a given reaction, the sequence of at least the first four nucleotides (going from 3' to 5' direction) are not complementary to any sequence within any other primer present in the same reaction; and (6) no amplicon includes any consecutive stretch of at least 5 nucleotides that is complementary to any sequence within any other amplicon.

In some embodiments, the target-specific primers include one or more primer pairs designed to amplify target sequences from the sample that are about 100 base pairs to about 500 base pairs in length. In some embodiments, the target-specific primers include a plurality of primer pairs designed to amplify target sequences, where the amplified target sequences are predicted to vary in length from each other by no more than 50%, typically no more than 25%, even more typically by no more than 10%, or 5%. For example, if one target-specific primer pair is selected or predicted to amplify a product that is 100 nucleotides in length, then other primer pairs are selected or predicted to amplify products that are between 50-150 nucleotides in length, typically between 75-125 nucleotides in length, even more typically between 90-110 nucleotides, or 95-105 nucleotides, or 99-101 nucleotides in length.

In some embodiments, at least one primer pair in the amplification reaction is not designed de novo according to any predetermined selection criteria. For example, at least one primer pair can be an oligonucleotide sequence selected or generated at random, or previously selected or generated for other applications. In one exemplary embodiment, the amplification reaction can include at least one primer pair selected from the TaqMan® probe reagents (Roche Molecular Systems). The TaqMan® reagents include labeled probes and can be useful, inter alia, for measuring the amount of target sequence present in the sample, optionally in real time. Some examples of TaqMan technology are disclosed in U.S. Pat. Nos. 5,210,015, 5,487,972, 5,804,375, 6,214,979, 7,141,377 and 7,445,900, hereby incorporated by reference in their entireties.

In some embodiments, at least one primer within the amplification reaction can be labeled, for example with an optically detectable label, to facilitate a particular application of interest. For example, labeling may facilitate quantification of target template and/or amplification product, isolation of the target template and/or amplification, product, and the like.

In some embodiments, one or more of the primers within the amplification reaction can be useful in genotyping of a nucleic acid sample.

In some embodiments, the target-specific primers can be provided as a set of target-specific primer pairs in a single amplification vessel. In some embodiments, the target-specific primers can be provided in one or more aliquots of target-specific primer pairs that can be pooled prior to performing the multiplex PCR reaction in a single amplification vessel or reaction chamber. In one embodiment, the target-specific primers can be provided as a pool of target-specific forward primers and a separate pool of target-specific reverse primers. In another embodiment, target-specific primer pairs can be pooled into subsets such as non-overlapping target-specific primer pairs. In some embodiments, the pool of target-specific primer pairs can be provided in a single reaction chamber or microwell, for example on a PCR plate to perform multiplex PCR using a thermocycler. In some embodiments, the target-specific forward and reverse primer pairs can be substantially complementary to the target sequences.

In some embodiments, the method of performing multiplex PCR amplification includes contacting a plurality of target-specific primer pairs having a forward and reverse primer, with a population of target sequences to form a plurality of template/primer duplexes; adding a DNA polymerase and a mixture of dNTPs to the plurality of template/primer duplexes for sufficient time and at sufficient temperature to extend either (or both) the forward or reverse primer in each target-specific primer pair via template-dependent synthesis thereby generating a plurality of extended primer product/template duplexes; denaturing the extended primer product/template duplexes; annealing to the extended primer product the complementary primer from the target-specific primer pair; and extending the annealed primer in the presence of a DNA polymerase and dNTPs to form a plurality of target-specific double-stranded nucleic acid molecules. In some embodiments, the steps of the amplification PCR method can be performed in any order. In some instances, the methods disclosed herein can be further optimized to remove one or more steps and still obtain sufficient amplified target sequences to be used in a variety of downstream processes. For example, the number of purification or clean-up steps can be modified to include more or less steps than disclose herein, providing the amplified target sequences are generated in sufficient yield.

In some embodiments, the target-specific primer pairs do not contain a common extension (tail) at the 3' or 5' end of the primer. In another embodiment, the target-specific primers do not contain a Tag or universal sequence. In some embodiments, the target-specific primer pairs are designed to eliminate or reduce interactions that promote the formation of non-specific amplification.

In one embodiment, the target-specific primer pairs comprise at least one cleavable group per forward and reverse target-specific primer. In one embodiment, the cleavable group can be a uracil nucleotide. In one embodiment, the target-specific primer pairs are partially or substantially removed after generation of the amplified target sequence. In one embodiment, the removal can include enzymatic, heat or alkali treatment of the target-specific primer pairs as part of the amplified target sequence. In some embodiments, the amplified target sequences are further treated to form blunt-ended amplification products, referred to herein as, blunt-ended amplified target sequences.

In some embodiments, any one or more of the target-specific primers disclosed in the methods, compositions, kits, systems and apparatuses may be designed using the following primer selection criteria.

There is a need for new methods, computer readable media, and systems for identifying or designing products or kits that use PCR to enrich one or more genomic regions of interest (which may be, for example, cumulative regions of 1 kb to 1 Mb) for subsequent sequencing.

There is a need for new methods, computer readable media, and systems for identifying or designing products or kits including primers or assays that maximize coverage of one or more genomic regions or targets of interest while minimizing one or more of off-target hybridization, a number of primers, and a number of primer pools.

In accordance with the teachings and principles embodied in this application, new methods, computer readable media, and systems are provided that identify or design products or kits that use PCR to enrich one or more genomic regions or targets of interest for subsequent sequencing and/or that include primers or assays that maximize coverage of one or more genomic regions or targets of interest while minimizing one or more of off-target hybridization, a number of primers, and a number of primer pools.

Figure 16:
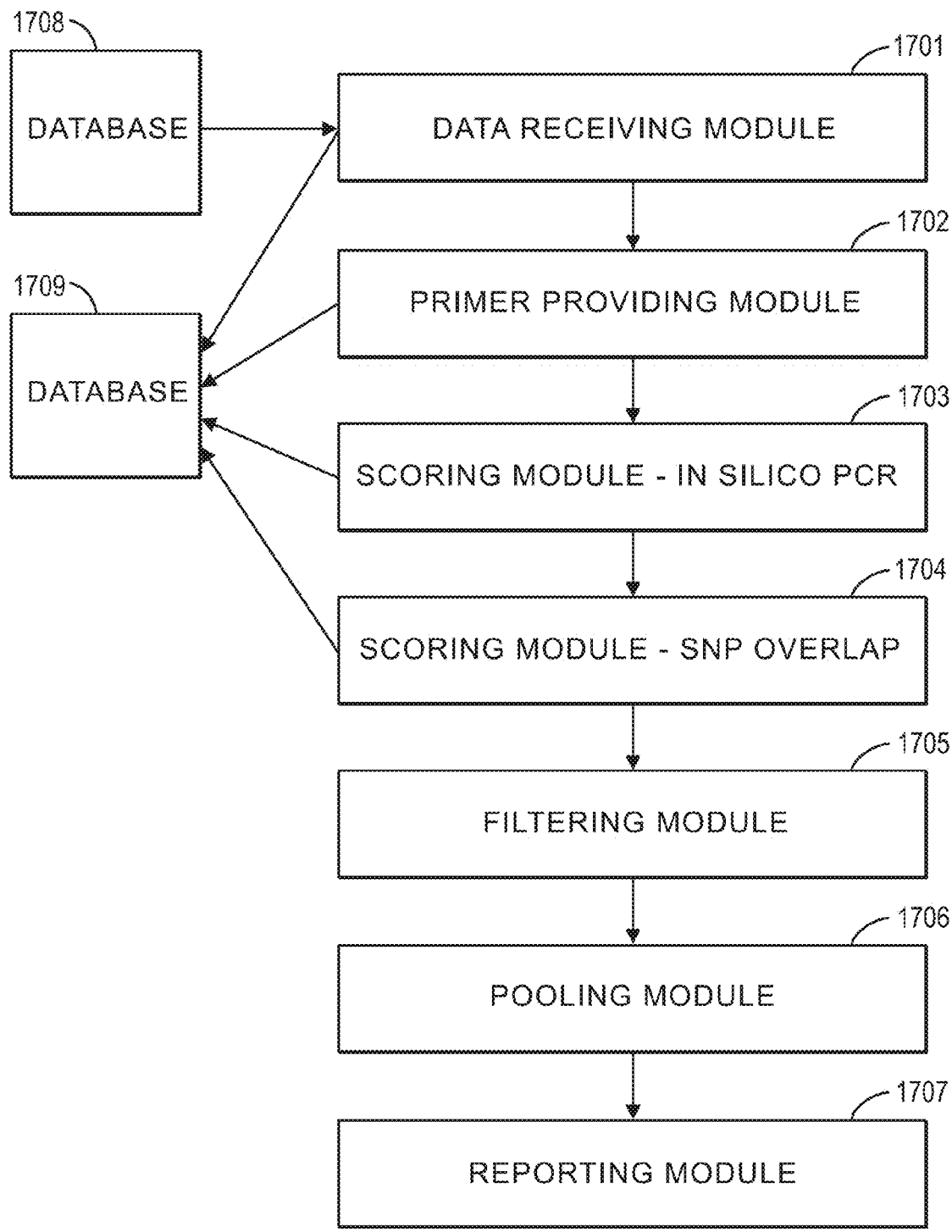
FIG. 16 illustrates a system for designing primers or assays according to an exemplary embodiment.

FIG. 16 illustrates a system for designing primers or assays according to an exemplary embodiment. The system includes a data receiving module 1701, a primer providing module 1702, a scoring (in silico PCR) module 1703, a scoring (SNP overlap) module 1704, a filtering module 1705, a pooling module 1706, and a reporting module 1707. The system also includes a database 1708, which may include data regarding genetic annotations, SNP-related data, or other genetic data such as identification of a repeat, chromosome, position, direction, etc., for example, or any other type of information that could be related to a genomic region or target of interest, and a database 1709, which may include primer-related data such as a melting temperature (Tm), a chromosome, a position, a direction, and SNP overlap information, etc., for example, or any other type of information that could be related to primers. The system may be implemented in or using one or more computers and/or servers using one or more software components, which may not be accessible or released to customers who may be ordering custom primers or assays that may be designed using such a system. Customers may order custom primers or assays at least in part through a web-accessible data portal by providing one or more genomic regions or targets of interest in any suitable format. In an exemplary embodiment, there is provided a method performing steps including the general steps associated with modules 1701-1707 and databases 1708 and 1709 (e.g., receiving data, providing primers, scoring primers and/or amplicons, filtering primers and/or amplicons, pooling primers and/or amplicons, reporting results, and querying databases).

Figure 17:
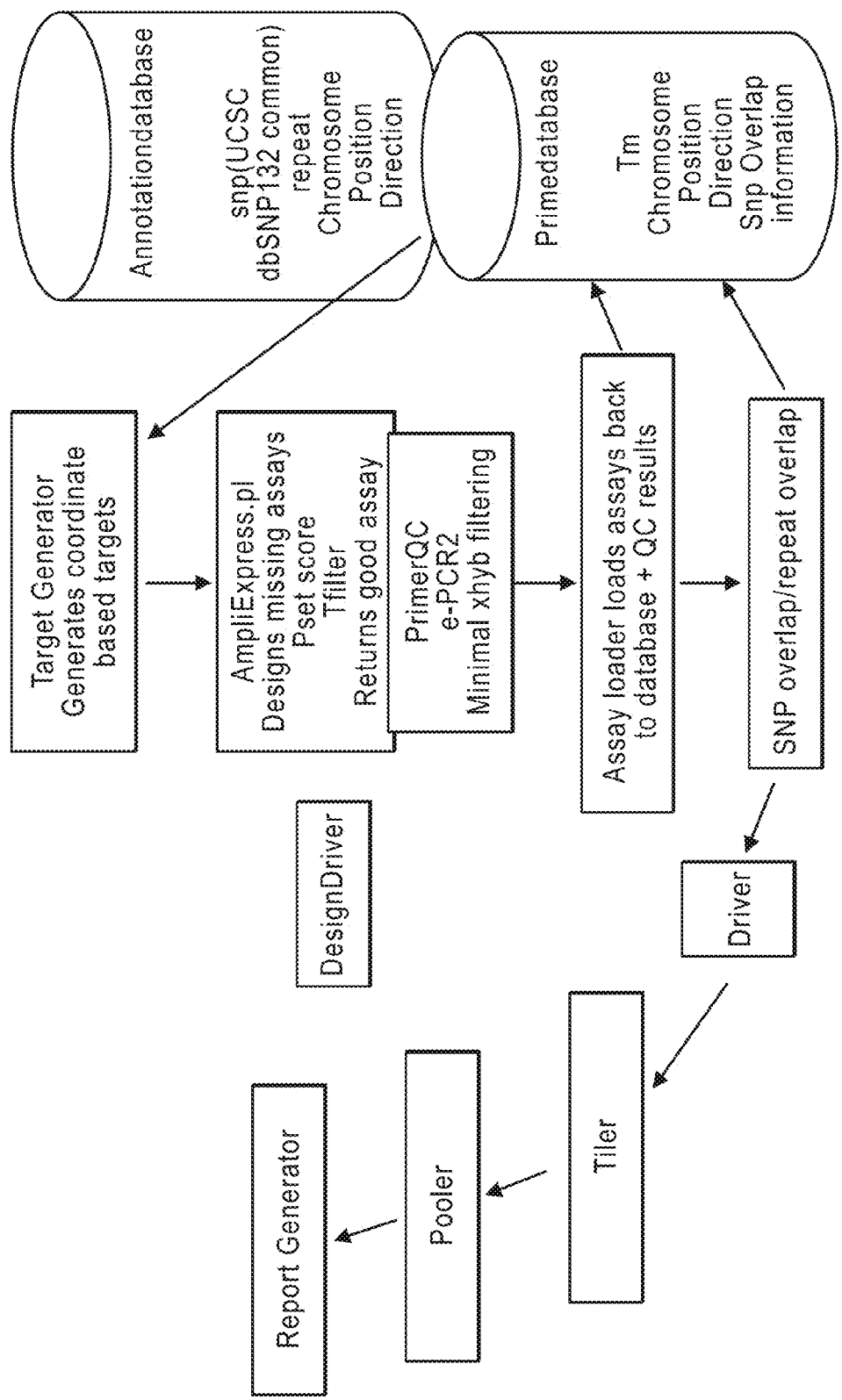
FIG. 17 illustrates a system for designing primers or assays according to an exemplary embodiment.

FIG. 17 illustrates a system for designing primers or assays according to an exemplary embodiment. The system includes a target generator module, which may generate one or more coordinate-based genomic regions or targets of interest and which may query and/or receive information from an annotation database (which may include data regarding genetic annotations, SNP-related data, or other genetic data such as identification of a repeat, chromosome, position, direction, etc., for example, as well as information regarding primers or any other type of information that could be related to a genomic region or target of interest); a designing module, which may design one or more primers or assays and determine and/or apply various scoring and filtering procedures for the primers or assays and which may perform various quality control procedures; a loader module, which may load the primers or assays and/or related information (such as quality control results, for example) to a primer database (which may be in communication with or comprised within the annotation database and which may include primer-related data such as a melting temperature (Tm), a chromosome, a position, a direction, and SNP overlap information, etc., for example, or any other type of information that could be related to primers); a SNP overlap/repeat overlap module; a driver module; a tiler module, which may determine a subset of amplicons or tiles maximizing a coverage of a genomic region or target of interest; a pooler module, which may determine a pooling of the amplicons or tiles into one or more pools of amplicons; and a report generator module. The system may be implemented in or using one or more computers and/or servers using one or more software components, which may not be accessible or released to customers who may be ordering custom primers or assays that may be designed using such a system. Customers may order custom primers or assays at least in part through a web-accessible data portal by providing one or more genomic regions or targets of interest in any suitable format. In an exemplary embodiment, there is provided a method performing steps including the general steps associated with these modules and databases.

Figure 18:
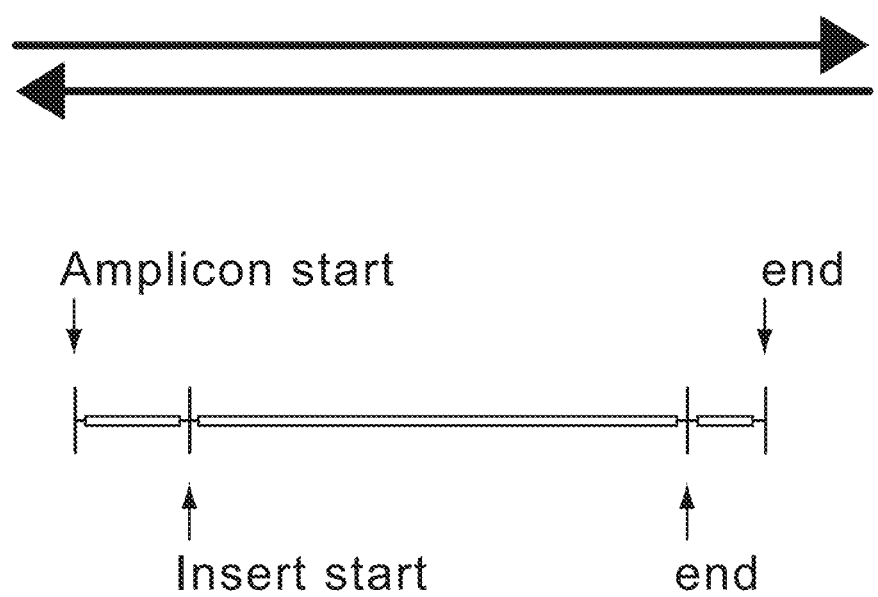
FIG. 18 illustrates an amplicon sequence including an insert sequence surrounded by a pair of primers designed according to an exemplary embodiment.

FIG. 18 illustrates an amplicon sequence including an insert sequence surrounded by a pair of primers designed according to an exemplary embodiment. The amplicon may include a forward primer and a reverse primer surrounding the insert sequence. The two primers may together form an assay, which may be customized and ordered. The primer component of an amplicon may be a copy of a spiked-in primer, rather than the underlying sample, and one or more inserts may be selected to cover the target.

Figure 19:
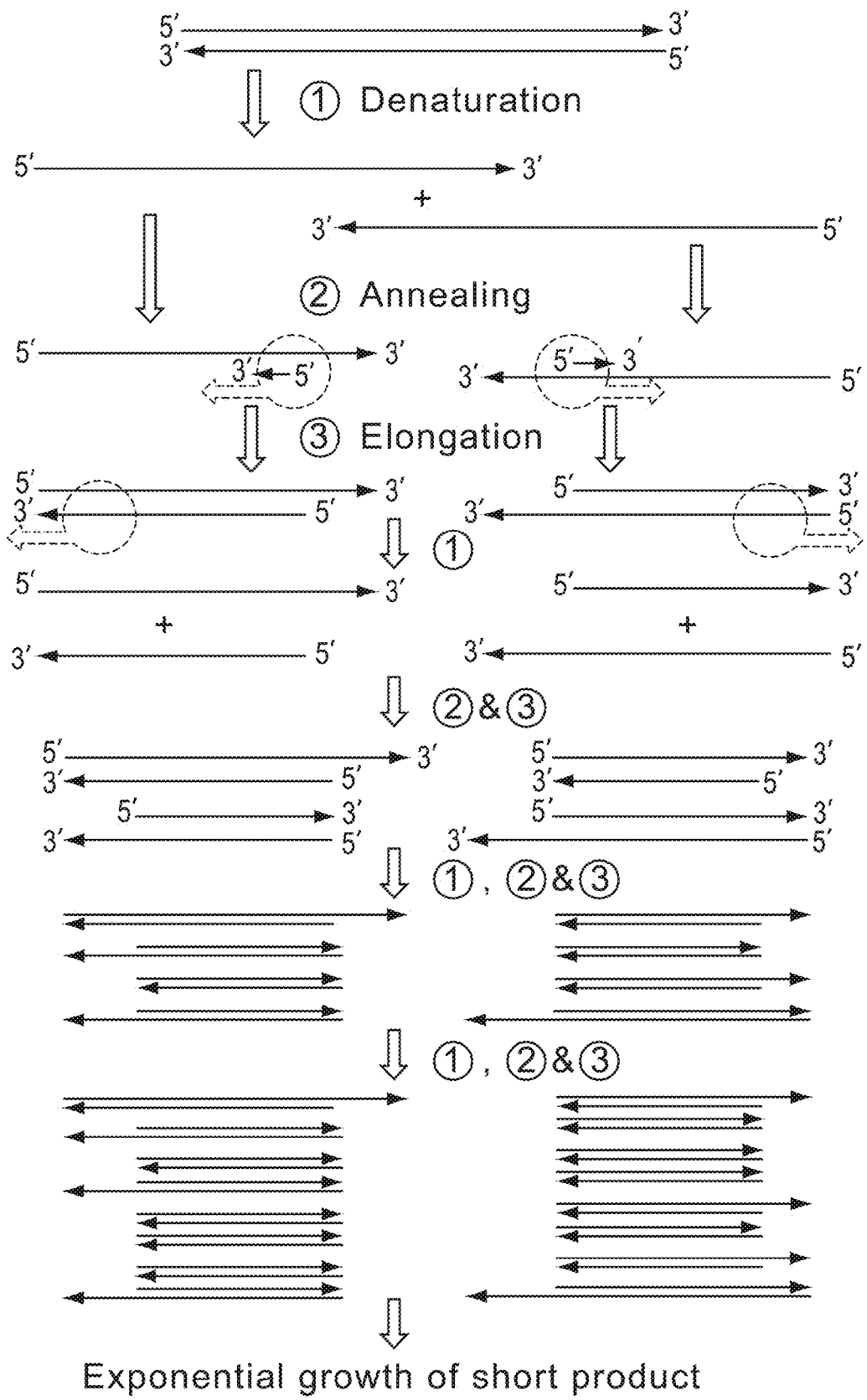
FIG. 19 illustrates PCR amplification of an amplicon sequence (which may be referred to as "tile" herein) including an insert surrounded by a pair of primers designed according to an exemplary embodiment.

FIG. 19 illustrates PCR amplification of an amplicon sequence (which may be referred to as "tile" herein) including an insert surrounded by a pair of primers designed according to an exemplary embodiment. Shown are denaturation, annealing, and elongation steps ultimately leading to exponential growth of the amplicon.

Figure 20:
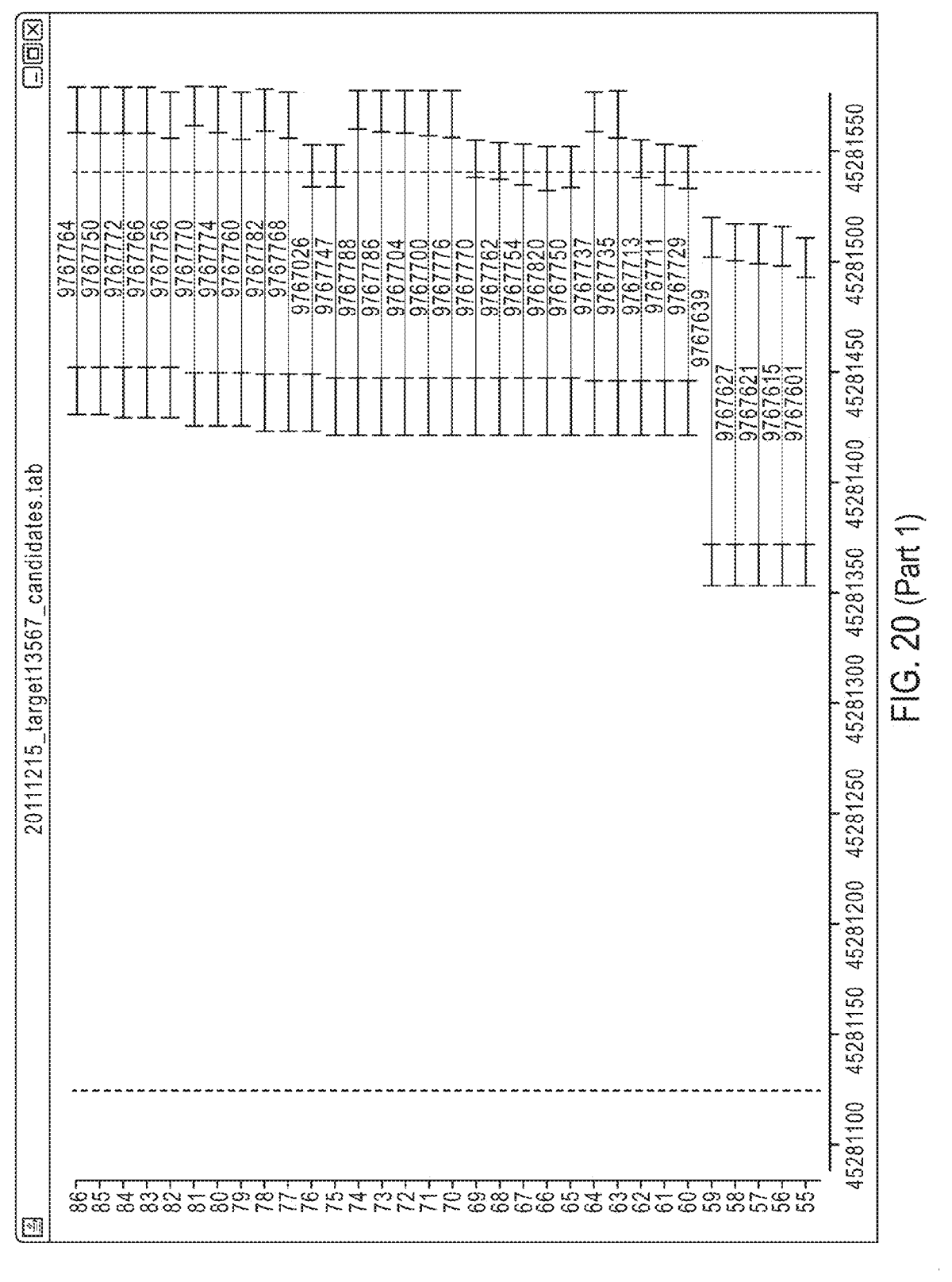

FIG. 20(Part 1-Part III) illustrates a set of candidate amplicons for a given target region, each including an insert surrounded by a pair of primers, for tiling and pooling according to an exemplary embodiment. The dotted lines indicate the boundaries of a target region (on chromosome 19 in this example). There are 112 candidate amplicons for covering the target region in this example, but the number of candidate amplicons could of course be different, including much lower or much higher, and may be selected by taking into account computational resources, the length of the target region, and any other relevant factor.

According to various exemplary embodiments, there are provided methods for designing primers using a design pipeline that allows design of oligonucleotide primers across genomic areas of interest while incorporating various design criteria and considerations including amplicon size, primer composition, potential off-target hybridization, and SNP overlap of the primers. In an embodiment, the design pipeline includes several functional modules that may be sequentially executed as discussed next.

First, in an embodiment, a sequence retrieval module may be configured to retrieve sequences based on instructions of an operator regarding a final product desired by a customer. The operator may request a design of primer pairs for genomic regions which may be specified by chromosome and genome coordinates or by a gene symbol designator. In the latter case, the sequence retrieval module may retrieve the sequence based on the exon coordinates. The operator may also specify whether to include a 5' UTR sequence (untranslated sequence).

Second, in an embodiment, an assay design module may be configured to design primer pairs using a design engine, which may be a public tool such as Primer3 or another primer design software that can generate primer pairs across the entire sequence regions retrieved by the sequence retrieval module, for example. The primers pairs may be selected to tile densely across the nucleotide sequence. The primer design may be based on various parameters, including: (1) the melting temperature of the primer (which may be calculated using the nearest neighbor algorithm set forth in John Santa-Lucia, Jr., "A unified view of polymer, dumbbell, and oligonucleotide DNA nearest-neighbor thermodynamics," Proc. Natl. Acad. Sci. USA, vol. 95, 1460-1465 (1998), the contents of which is incorporated by reference herein in its entirety), (2) the primer composition (e.g., nucleotide composition such as GC content may be determined and filtered and penalized by the software, as may be primer hairpin formation, composition of the GC content in the 3' end of primer, and specific parameters that may be evaluated are stretches of homopolymeric nucleotides, hairpin formation, GC content, and amplicon size), (3) scores of forward primer, reverse primer and amplicon (the scores may be added up to obtain a probe set score, and the score may reflect how close the amplicon confirms with the intended parameters), and (4) conversion of some of the T's to U's (T's may be placed such that the predicted Tm of the T delimited fragments of a primer have a minimum average Tm.)

Third, in an embodiment, a primer mapping module may be configured to use a mapping software (e.g., e-PCR (NCBI), see Rotmistrovsky et al., "A web server for performing electronic PCR," Nucleic Acids Research, vol. 32, W108-W112 (2004), and Schuler, "Sequence Mapping by Electronic PCR," Genome Research, vol. 7, 541-550 (1997), which are both incorporated by reference herein in their entirety, or other similar software) to map primers to a genome. The primers mapping may be scored using a mismatch matrix. In an embodiment, a perfect match may receive a score of 0, and mismatched primers may receive a score of greater than 0. The mismatch matrix takes the position of the mismatch and the nature of the mismatch into account. For example, the mismatch matrix may assign a mismatch score to every combination of a particular motif (e.g., AA, AC, AG, CA, CC, CT, GA, GG, GT, TC, TG, TT, A-, C-, G-, T-, -A, -C, -G, and -T, where '-' denotes an ambiguous base or gap) with a particular position (e.g., base at 3' end, second base from 3' end, third base from 3' end, third base from 5' end, second base from 5' end, base at 5' end, and positions therebetween), which may be derived empirically and may be selected to reflect that mismatches closer to the 3' end tend to weaker PCR reactions more than mismatches closer to the 5' end and may therefore be generally larger. The mismatch scores for motifs with an ambiguous base or gap may be assigned an average of scores of other motifs consistent therewith (e.g., A-may be assigned an average of the scores of AA, AC, and AG). Based on the number of hits with a certain score threshold, an amplicon cost may be calculated.

Fourth, in an embodiment, a SNP module may be configured to determine underlying SNPs and repeat regions: SNPs may be mapped to the primers and based on the distance of a SNP from the 3' end, primers may be filtered as potential candidates. Similarly, if a primer overlaps to a certain percentage with a repeat region, the primer might be filtered.

Fifth, in an embodiment, a tiler module may be configured to use a function based on the amplicon cost (see primer mapping) and the number of primers necessary to select a set of primers covering the target while ensuring that selection of tiling primers for a target is independent of other targets that may be in a customer's request so that the same set of primers for a target will be selected whether the customer requested only that target or additional targets and whether amplicons are to help cover on that target or additional targets.

Sixth, in an embodiment, a pooler module may be configured to use a pooling algorithm that prevents amplicon overlaps, and ensures that the average number of primers in a pool does not deviate by more than a preset value.

Figure 21:
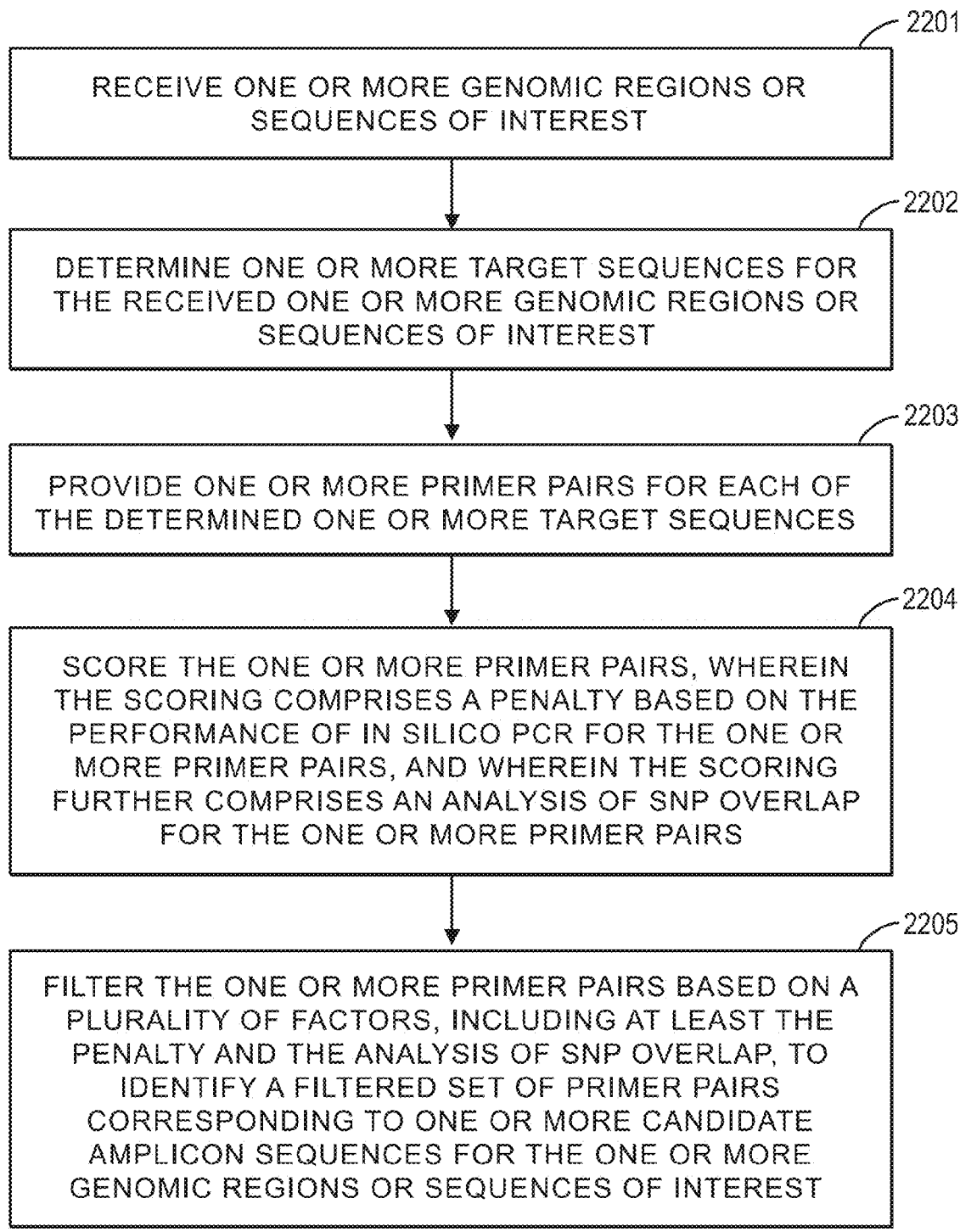
FIG. 21 illustrates a method according to an exemplary embodiment.

FIG. 21 illustrates a method according to an exemplary embodiment. In step 2201, a module or other hardware and/or software component receives one or more genomic regions or sequences of interest. In step 2202, a module or other hardware and/or software component determines one or more target sequences for the received one or more genomic regions or sequences of interest. In step 2203, a module or other hardware and/or software component provides one or more primer pairs for each of the determined one or more target sequences. In step 2204, a module or other hardware and/or software component scores the one or more primer pairs, wherein the scoring comprises a penalty based on the performance of in silico PCR for the one or more primer pairs, and wherein the scoring further comprises an analysis of SNP overlap for the one or more primer pairs. In step 2205, a module or other hardware and/or software component filters the one or more primer pairs based on a plurality of factors, including at least the penalty and the analysis of SNP overlap, to identify a filtered set of primer pairs corresponding to one or more candidate amplicon sequences for the one or more genomic regions or sequences of interest.

According to an exemplary embodiment, there is provided a method, comprising: (1) receiving one or more genomic regions or sequences of interest; (2) determining one or more target sequences for the received one or more genomic regions or sequences of interest; (3) providing one or more primer pairs for each of the determined one or more target sequences; (4) scoring the one or more primer pairs, wherein the scoring comprises a penalty based on the performance of in silico PCR for the one or more primer pairs, and wherein the scoring further comprises an analysis of SNP overlap for the one or more primer pairs; and (5) filtering the one or more primer pairs based on a plurality of factors, including at least the penalty and the analysis of SNP overlap, to identify a filtered set of primer pairs corresponding to one or more candidate amplicon sequences for the one or more genomic regions or sequences of interest.

In various embodiments, receiving one or more genomic regions or sequences of interest may comprise receiving a list of one or more gene symbols or identifiers. Receiving one or more genomic regions or sequences of interest may comprise receiving a list of one or more genomic coordinates or other genomic location identifiers. Receiving one or more genomic regions or sequences of interest may comprise receiving a list of one or more BED coordinates.

In various embodiments, determining one or more target sequences may comprise determining one or more exons or coding regions that correspond to each of the one or more genomic regions or sequences of interest. Determining one or more target sequences may comprise querying an amplicon or other genomic sequence database for a presence therein of the one or more genomic regions or sequences of interest and information related thereto.

In various embodiments, providing one or more primer pairs may comprise designing one or more primer pairs. Providing one or more primer pairs may comprise querying an amplicon or other genomic sequence database for a presence therein of the one or more genomic regions or sequences of interest or of the one or more primer pairs and information related thereto.

In various embodiments, the performance of in silico PCR may comprise performing in silico PCR against a reference or previously sequenced genome of any species. The performance of in silico PCR may comprise performing in silico PCR against an hg19 reference genome. The performance of in silico PCR against a reference genome may comprise determining a number of off-target hybridizations for each of the one or more primer pairs. The performance of in silico PCR against a reference genome may comprise determining a worst case attribute or score for each of the one or more primer pairs. The performance of in silico PCR may comprise determining one or more genomic coordinates for each of the one or more primer pairs. The performance of in silico PCR may comprise determining one or more predicted amplicon sequences for each of the one or more primer pairs. The performance of in silico PCR may comprise querying an amplicon or other genomic sequence database for a presence therein of the one or more genomic regions or sequences of interest or of in silico PCR results for the one or more primer pairs and information related thereto.

In various embodiments, the analysis of SNP overlap may comprise determining a SNP class for each of the one or more primer pairs. The analysis of SNP overlap may comprise querying an amplicon or other genomic sequence database for a presence therein of the one or more genomic regions or sequences of interest or of SNP overlap results for the one or more primer pairs and information related thereto.

In various embodiments, the plurality of factors may include one or more of an indication of forward SNP overlap, an indication of a reverse SNP overlap, an indication of a frequency of forward repeats, an indication of a frequency of reverse repeats, an indication of an off-target hybridization of each of the one or more primer pairs, and a composition of each of the one or more primer pairs. The plurality of factors may include one or more of a forward triplet factor, a reverse triplet factor, a forward A run factor, a reverse A run factor, a forward C run factor, a reverse C run factor, a forward G run factor, a reverse G run factor, a forward T run factor, and a reverse T run factor. The plurality of factors may include one or more of an indication of an extent to which each of the one or more primer pairs includes one or more homopolymers. The plurality of factors may include an indication of an extent to which each of the one or more primer pairs includes one or more repeating sequences. The plurality of factors may include a length of the one or more primer pairs, wherein a score for the one or more primer pairs decreases as the length gets shorter than a minimal length threshold and decreases as the length gets longer than a maximal length threshold. The plurality of factors may include a maximal number of a given base in the one or more primer pairs, wherein a score for the one or more primer pairs decreases as the number of instances of the given base exceeds a maximal base inclusion threshold. The plurality of factors may include a maximal number of contiguous instances of a given base, wherein a score for the one or more primer pairs decreases as the number of contiguous instances of the given base exceeds a maximal contiguous base inclusion threshold.

The plurality of factors may include a maximal percentage of a set of two given bases, wherein a score for the one or more primer pairs decreases as the percentage of the two given bases increases. The plurality of factors may include a maximal percentage of G and C bases, wherein a score for the one or more primer pairs decreases as the percentage of G and C bases increases. The plurality of factors may include a deviation of a predicted melting temperature for the one or more primer pairs relative to minimal and maximal melting temperature thresholds. The plurality of factors may include a number of primer-dimer inclusions for the one or more primer pairs. The plurality of factors may include a level of local complementarity for the one or more primer pairs. The plurality of factors may include an indication of a complexity level of each of the one or more primer pairs. The plurality of factors may include an indication of SNP overlap of each of the one or more primer In various embodiments, the method may comprise selecting a subset of the one or more candidate amplicon sequences that substantially covers the one or more genomic regions or sequences of interest while minimizing a cost function associated with the candidate amplicon sequences. Minimizing the cost function may include generating an overlap graph comprising a source vertex, one or more amplicon vertices, and a sink vertex.

In various embodiments, the method may comprise assembling the primer pairs in the filtered set of primer pairs that correspond with the selected subset of the one or more candidate amplicon sequences into a plurality of separate pools of primer pairs. Assembling the primer pairs may include limiting an inclusion of one or more primer pairs in the filtered set of primer pairs that correspond with the selected subset of the one or more candidate amplicon sequences into a given pool based at least on a minimal threshold distance between amplicon sequences in the given pool. The minimal threshold distance may be between about 5 base pairs and about 100 base pairs, or between about 15 base pairs and about 90 base pairs, or between about 25 base pairs and about 75 base pairs, or between about 40 base pairs and about 60 base pairs, for example. In some embodiments, the minimum threshold distance between amplicons may include any integer, including a negative one. For example, a value of 0 can mean that any two amplicons are allowed to "touch," and a value of −8 can mean that any two amplicons can overlap by up to 8 bases.

In various embodiments, assembling the filtered set of primer pairs into a plurality of separate pools of primer pairs may comprise splitting the primer pairs between tubes so as to prevent amplicon overlap within any given tube. Assembling the primer pairs may include limiting an inclusion of one or more primer pairs in the filtered set of primer pairs that correspond with the selected subset of the one or more candidate amplicon sequences into a given pool based at least on a pre-determined amplicon capacity of the given pool. Assembling the primer pairs may include limiting an inclusion of one or more primer pairs in the filtered set of primer pairs that correspond with the selected subset of the one or more candidate amplicon sequences into a given pool based at least on an inequality relating a size of the given pool with a product between a balance factor and a maximum value of the sizes of the separate pools.

In various embodiments, the method may comprise providing a report reporting on any one or more element of information of data used or generated by any one or more of the receiving, providing, scoring, filtering, selecting, and assembling steps.

According to an exemplary embodiment, there is provided a non-transitory machine-readable storage medium comprising instructions which, when executed by a processor, cause the processor to perform a method comprising: (1) receiving one or more genomic regions or sequences of interest; (2) determining one or more target sequences for the received one or more genomic regions or sequences of interest; (3) providing one or more primer pairs for each of the determined one or more target sequences; (4) scoring the one or more primer pairs, wherein the scoring comprises a penalty based on the performance of in silico PCR for the one or more primer pairs, and wherein the scoring further comprises an analysis of SNP overlap for the one or more primer pairs; and (5) filtering the one or more primer pairs based on a plurality of factors, including at least the penalty and the analysis of SNP overlap, to identify a filtered set of primer pairs corresponding to one or more candidate amplicon sequences for the one or more genomic regions or sequences of interest.

In various embodiments, such a non-transitory machine-readable storage medium may comprise instructions which, when executed by a processor, cause the processor to perform a method further comprising: (6) selecting a subset of the one or more candidate amplicon sequences that substantially covers the one or more genomic regions or sequences of interest while minimizing a cost function associated with the candidate amplicon sequences; and (7) assembling the primer pairs in the filtered set of primer pairs that correspond with the selected subset of the one or more candidate amplicon sequences into a plurality of separate pools of primer pairs.

According to an exemplary embodiment, there is provided a system, comprising: (1) a machine-readable memory; and (2) a processor configured to execute machine-readable instructions, which, when executed by the processor, cause the system to perform steps including: (a) receiving one or more genomic regions or sequences of interest; (b) determining one or more target sequences for the received one or more genomic regions or sequences of interest; (c) providing one or more primer pairs for each of the determined one or more target sequences; (d) scoring the one or more primer pairs, wherein the scoring comprises a penalty based on the performance of in silico PCR for the one or more primer pairs, and wherein the scoring further comprises an analysis of SNP overlap for the one or more primer pairs; and (e) filtering the one or more primer pairs based on a plurality of factors, including at least the penalty and the analysis of SNP overlap, to identify a filtered set of primer pairs corresponding to one or more candidate amplicon sequences for the one or more genomic regions or sequences of interest.

In various embodiments, the processor of such a system may further be configured to execute machine-readable instructions, which, when executed by the processor, cause the system to perform steps including: (f) selecting a subset of the one or more candidate amplicon sequences that substantially covers the one or more genomic regions or sequences of interest while minimizing a cost function associated with the candidate amplicon sequences; and (g) assembling the primer pairs in the filtered set of primer pairs that correspond with the selected subset of the one or more candidate amplicon sequences into a plurality of separate pools of primer pairs.

According to various exemplary embodiment, various parameters or criteria may be used to select primers and/or amplicons.

In an embodiment, a forward SNP score may be used and may be given a numerical attribute/score of 1 if there is no SNP within a given length of base pairs of the forward primer (such as 4, for example) or a numerical attribute of 0 if there is one or more SNPs within a length of 4 base pairs. In one embodiment, the forward SNP score may be given a numerical attribute/score of 1 if there is no SNP within a given length of base pairs from the 3' end of the forward primer. In some embodiments, a SNP can include one or more SNPs found on UCSC's Genome Browser Web Page including but not limited to, the SNP reference table referred to as "dbSNP132 common". An attribute/score of 1 may be a minimal attribute/score such that failure to achieve that attribute/score would result in disqualification. The base length threshold for the attribute/score determination could be lower or higher than 4, and could be 5, 6, 7, 8, 9, 10, 15, 20, for example, or more generally any positive integer larger than 4. The attribute/score could be other than binary and could be a more complex linear or non-linear function of the number of SNPs within the given length of base pairs.

In an embodiment, a reverse SNP score may be used and may be given a numerical attribute/score of 1 if there is no SNP within a given length of base pairs of the reverse primer (such as 4, for example) or a numerical attribute of 0 if there is one or more SNPs within a length of 4 base pairs. In one embodiment, the reverse SNP score may be given a numerical attribute/score of 1 if there is no SNP within a given length of base pairs from the 3' end of the reverse primer. In some embodiments, a SNP can include one or more SNPs found on UCSC's Genome Browser Web Page including but not limited to, the SNP reference table referred to as "dbSNP132 common". An attribute/score of 1 may be a minimal attribute/score such that failure to achieve that attribute/score would result in disqualification. The base length threshold for the attribute/score determination could be lower or higher than 4, and could be 5, 6, 7, 8, 9, 10, 15, 20, for example, or more generally any positive integer larger than 4. The attribute/score could be other than binary and could be a more complex linear or non-linear function of the number of SNPs within the given length of base pairs.

In an embodiment, a forward repeat score may be used and may be given a numerical attribute/score of 1 if there is no repeat within a given length of base pairs of the forward primer (such as 4, for example) or a numerical attribute of 0 if there is one or more repeats within a length of 4 base pairs. In one embodiment, the forward repeat score may be given a numerical attribute/score of 1 if there is less than 30% overlap of the forward primer with known repeats. In some embodiments, known repeats may include one or more repeats reported by UCSC's Genome Browser, for example repeat regions as provided by the repeat masked hg19 genome from UCSC. An attribute/score of 1 may be a minimal attribute/score such that failure to achieve that attribute/score would result in disqualification. The base length threshold for the attribute/score determination could be lower or higher than 4, and could be 5, 6, 7, 8, 9, 10, 15, 20, for example, or more generally any positive integer larger than 4. The attribute/score could be other than binary and could be a more complex linear or non-linear function of the number of repeats within the given length of base pairs.

In an embodiment, a reverse repeat score may be used and may be given a numerical attribute/score of 1 if there is no repeat within a given length of base pairs of the reverse primer (such as 4, for example) or a numerical attribute of 0 if there is one or more repeats within a length of 4 base pairs. In one embodiment, the reverse repeat score may be given a numerical attribute/score of 1 if there is less than 30% overlap of the reverse primer with known repeats. In some embodiments, known repeats may include one or more repeats reported by UCSC's Genome Browser, for example repeat regions as provided by the repeat masked hg19 genome from UCSC. An attribute/score of 1 may be a minimal attribute/score such that failure to achieve that attribute/score would result in disqualification. The base length threshold for the attribute/score determination could be lower or higher than 4, and could be 5, 6, 7, 8, 9, 10, 15, 20, for example, or more generally any positive integer larger than 4. The attribute/score could be other than binary and could be a more complex linear or non-linear function of the number of repeats within the given length of base pairs.

In various embodiments, one or more of a forward triplet score, a reverse triplet score, a forward A run score, a reverse A run score, a forward C run score, a reverse C run score, a forward G run score, a reverse G run score, a forward T run score, and a reverse T run score, may be used and may be given a numerical attribute/score equal to the number of forward triplets, reverse triplets, forward A runs, reverse A runs, forward C runs, reverse C runs, forward G runs, reverse G runs, forward T runs, and reverse T runs within the entire primer. An attribute/score of 3 may be a maximal attribute/score for the triplets such that failure to remain at or below that attribute/score would result in disqualification. An attribute/score of 5 may be a maximal attribute/score for the runs such that failure to remain at or below that attribute/score would result in disqualification. The attribute/score could be other than binary and could be a more complex linear or non-linear function of the number of triplets/runs.

In an embodiment, a length of the primers may be limited by a minimum primer length threshold and a maximum primer length, and a length score for the primers may be set so as to decrease as the length gets shorter than the minimum primer length threshold and to decrease as the length gets longer than the maximum primer length threshold. In an embodiment, the minimum primer length threshold may be 16. In other embodiments, the minimum primer length threshold may be 15, 14, 13, 12, 11, 10, 9, 8, 7, 6, or 5, for example, and may also be 17, 18, 19, 20, 21, 22, 23, and 24, for example. In an embodiment, the maximum primer length threshold may be 28. In other embodiments, the maximum primer length threshold may be 29, 30, 31, 32, 33, 34, 35, 36, 37, 38, 39, and 40, for example, and may also be 27, 26, 25, 24, 23, 22, 21, and 20, for example. In an embodiment, the primer length criterion may be given a score of 1.0 if the length thresholds are satisfied, for example, and that score may go down to 0.0 as the primer length diverges from the minimum or maximum length threshold. For example, if the maximum primer length threshold were set to 28, then the score could be set to 1.0 if the length does not exceed 28, to 0.7 if the length is 29, to 0.6 if the length is 30, to 0.5 if the length is 31, to 0.3 if the length is 32, to 0.1 if the length is 33, and to 0.0 if the length is 34 or more. The attribute/score could be scaled between values other than 0.0 and 1.0, of course, and the function defining how the score varies with an increase difference relative to the threshold could be any other or more complex linear or non-linear function that does not lead to increases in score for primer that further diverge from length thresholds.

In an embodiment, a number of G bases (or of A, C, or T bases) in the primers may be limited by a maximum threshold, and corresponding score for the primers may be set so as to decrease as the number of G bases (or of A, C, or T bases) exceeds the maximum threshold. In an embodiment, the maximum threshold may be 3. In other embodiments, the maximum threshold may be 2, 4, 5, 6, 7, 8, 9, and 10, for example. In an embodiment, the number of G bases (or of A, C, or T bases) criterion may be given a score of 1.0 if the maximum threshold is satisfied, for example, and that score may go down to 0.0 as the number of G bases (or of A, C, or T bases) diverges from the maximum threshold. For example, if the maximum threshold were set to 4, then the score could be set to 1.0 if the number of G bases (or of A, C, or T bases) does not exceed 4, to 0.9 if the number is 5, to 0.8 if the number is 6, to 0.6 if the number is 7, to 0.4 if the number is 8, to 0.2 if the number is 9, and to 0.0 if the number is 10 or more. The score could be scaled between values other than 0.0 and 1.0, of course, and the function defining how the score varies with an increased difference between the number of G bases (or of A, C, or T bases) and the maximum threshold could be any other or more complex linear or non-linear function that does not lead to increases in score for primer that further diverge from the maximum threshold.

In an embodiment, the numbers of contiguous and total matches in a loop (e.g., hairpin) in the primers may be limited by a maximum threshold, and corresponding scores for the primers may be set so as to decrease as the numbers of contiguous and total matches in a loop exceed the maximum threshold. In an embodiment, the maximum threshold for contiguous matches may be 3 and the maximum threshold for total matches may be 5. In other embodiments, the maximum threshold for contiguous matches may be 2, 4, 5, 6, 7, 8, 9, and 10, for example, and the maximum threshold for total matches may be 3, 4, 6, 7, 8, 9, 10, 11, 12, 13, 14, and 15, for example. In an embodiment, the numbers of contiguous and total matches in a loop criteria may be given a score of 1.0 if the maximum threshold is satisfied, for example, and that score may go down to 0.0 as the number of the numbers of contiguous and total matches in a loop diverge from the corresponding maximum threshold. For example, if the maximum threshold for contiguous matches were set to 3, then the score could be set to 1.0 if the number of contiguous matches does not exceed 3, to 0.9 if the number is 4, to 0.7 if the number is 5, to 0.4 if the number is 6, to 0.2 if the number is 7, to 0.1 if the number is 8, and to 0.0 if the number is 9 or more. For example, if the maximum threshold for total matches were set to 5, then the score could be set to 1.0 if the number of total matches does not exceed 5, to 0.9 if the number is 6, to 0.8 if the number is 7, to 0.6 if the number is 8, to 0.4 if the number is 9, to 0.2 if the number is 10, to 0.1 if the number is 11, and to 0.0 if the number is 12 or more. The scores could be scaled between values other than 0.0 and 1.0, of course, and the function defining how the scores vary with an increased difference between the number of contiguous/total matches and the corresponding maximum thresholds could be any other or more complex linear or non-linear function that does not lead to increases in score for primer that further diverge from the maximum threshold.

In an embodiment, a number of G and C bases (or any two of the A, C, G, and T bases) in the last five bases of the primers may be limited by a maximum threshold, and corresponding score for the primers may be set so as to decrease as the number of G and C bases (or any two of the A, C, G, and T bases) exceeds the maximum threshold. In an embodiment, the maximum threshold may be 2. In other embodiments, the maximum threshold may be 3, 4, and 5, for example. In an embodiment, the number of G and C bases (or any two of the A, C, G, and T bases) criterion may be given a score of 1.0 if the maximum threshold is satisfied, for example, and that score may go down to 0.0 as the number of G and C bases (or any two of the A, C, G, and T bases) diverges from the maximum threshold. For example, if the maximum threshold were set to 2, then the score could be set to 1.0 if the number of G and C bases (or any two of the A, C, G, and T bases) does not exceed 2, to 0.8 if the number is 3, to 0.4 if the number is 4, and to 0.1 if the number is 5. The score could be scaled between values other than 0.0 and 1.0, of course, and the function defining how the score varies with an increased difference between the number of G and C bases (or any two of the A, C, G, and T bases) and the maximum threshold could be any other or more complex linear or non-linear function that does not lead to increases in score for primer that further diverge from the maximum threshold. In other embodiments, this criterion could consider the number of G and C bases (or any two of the A, C, G, and T bases) in a larger window of bases, such as in the last six bases, the last seven bases, the last eight bases, etc., for example.

In an embodiment, a percentage of G and C bases (or any two of the A, C, G, and T bases) in the primers may be limited by minimum and maximum thresholds, and corresponding score for the primers may be set so as to decrease as the percentage of G and C bases (or any two of the A, C, G, and T bases) diverges from the minimum or maximum threshold. In an embodiment, the minimum threshold may be 0.2 (20%) and the maximum threshold may be 0.8 (80%). In other embodiments, the minimum threshold may be any percentage between about 0.2 (20%) and about 0.5 (50%) and the maximum threshold may be any percentage between about 0.8 (80%) and 0.5 (50%), for example. In an embodiment, the percentage of G and C bases (or any two of the A, C, G, and T bases) criterion may be given a score of 1.0 if the minimum and maximum thresholds are satisfied, for example, and that score may go down to 0.0 if either of the thresholds is not satisfied. The score could be scaled between values other than 0.0 and 1.0, of course, and the function defining how the score varies with an increased difference between the percentage of G and C bases (or any two of the A, C, G, and T bases) and the minimum or maximum threshold could be any other or more complex linear or non-linear function that does not lead to increases in score for primer that further diverge from the minimum or maximum threshold.

In an embodiment, a melting temperature (Tm) of the primers may be limited by minimum and maximum thresholds, and corresponding score for the primers may be set so as to decrease as the melting temperature diverges from the minimum or maximum threshold. In an embodiment, the minimum threshold may be 60 and the maximum threshold may be 67 with a target melting temperature of 62. In other embodiments, the minimum threshold may be a value between about 55 and about 65 and the maximum threshold may be a value between about 62 and about 72, for example. In an embodiment, the melting temperature criterion may be given a score of 1.0 if the minimum and maximum thresholds are satisfied, for example, and that score may go down to 0.0 if either of the thresholds is not satisfied. The score could be scaled between values other than 0.0 and 1.0, of course, and the function defining how the score varies with an increased difference between the melting temperature and the minimum or maximum threshold could be any other or more complex linear or non-linear function that does not lead to increases in score for primer that further diverge from the minimum or maximum threshold. The melting temperature of a primer may be calculated using the teachings set forth in John SantaLucia, Jr., "A unified view of polymer, dumbbell, and oligonucleotide DNA nearest-neighbor thermodynamics," Proc. Natl. Acad. Sci. USA, vol. 95, 1460-1465 (1998), the contents of which is incorporated by reference herein in its entirety.

In an embodiment, a primer-dimer propensity in the primers may be limited by a maximum threshold of contiguous primer-dimers at the 3' end and a maximum threshold of total contiguous matches over the full length, and corresponding score for the primers may be set so as to decrease as the primer-dimer propensity diverges from the maximum thresholds. In an embodiment, the maximum threshold of contiguous primer-dimers at the 3' end may be 4 and the maximum threshold of total contiguous matches over the full length may be 8. In other embodiments, the maximum threshold of contiguous primer-dimers at the 3' end may be a value between about 2 and about 6 and the maximum threshold of total contiguous matches over the full length may be a value between about 4 and 10, for example. In an embodiment, the primer-dimer propensity criteria may be given a score of 1.0 if the threshold is satisfied, for example, and that score may go down to 0.0 if the threshold is not satisfied. The score could be scaled between values other than 0.0 and 1.0, of course, and the function defining how the score varies with an increased difference between the primer-dimer propensity and the maximum threshold could be any other or more complex linear or non-linear function that does not lead to increases in score for primer that further diverge from the maximum threshold.

In an embodiment, a percentage of G and C bases (or any two of the A, C, G, and T bases) in an amplicon sequence may be limited by minimum and maximum thresholds, and corresponding score for the amplicons may be set so as to decrease as the percentage of G and C bases (or any two of the A, C, G, and T bases) diverges from the minimum or maximum threshold. In an embodiment, the minimum threshold may be 0.0 (0%) and the maximum threshold may be 1.0 (100%). In other embodiments, the minimum threshold may be any percentage between about 0.1 (10%) and about 0.25 (25%) and the maximum threshold may be any percentage between about 0.75 (75%) and 0.9 (90%), for example. In an embodiment, the percentage of G and C bases (or any two of the A, C, G, and T bases) criterion may be given a score of 1.0 if the minimum and maximum thresholds are satisfied, for example, and that score may go down to 0.0 if either of the thresholds is not satisfied. The score could be scaled between values other than 0.0 and 1.0, of course, and the function defining how the score varies with an increased difference between the percentage of G and C bases (or any two of the A, C, G, and T bases) and the minimum or maximum threshold could be any other or more complex linear or non-linear function that does not lead to increases in score for amplicons that further diverge from the minimum or maximum threshold.

In an embodiment, a length of the amplicons may be limited by a minimum amplicon length threshold and a maximum amplicon length, and a length score for the amplicons may be set so as to decrease as the length gets shorter than the minimum amplicon length threshold and to decrease as the length gets longer than the maximum amplicon length threshold. In an embodiment, the minimum amplicon length threshold may be 110. In other embodiments, the minimum primer length threshold may be a value between about 80 and about 140, for example. In an embodiment, the maximum amplicon length threshold may be 240. In other embodiments, the maximum amplicon length threshold may be a value between about 200 and about 280, for example. In an embodiment, the amplicon length criterion may be given a score of 1.0 if the length thresholds are satisfied and of 0.0 if either is not satisfied. In another embodiment, that score may go down to 0.0 as the amplicon length diverges from the minimum or maximum length threshold. For example, if the maximum amplicon length threshold were set to 240, then the score could be set to 1.0 if the length does not exceed 240, to 0.8 if the length is at least 250, to 0.6 if the length is at least 260, to 0.4 if the length is at least 270, to 0.1 if the length is at least 280, and to 0.0 if the length is at least 290. The attribute/score could be scaled between values other than 0.0 and 1.0, of course, and the function defining how the score varies with an increase difference relative to the threshold could be any other or more complex linear or non-linear function that does not lead to increases in score for amplicons that further diverge from length thresholds.

According to an exemplary embodiment, there is provided a method for selecting a subset (which may be referred to as "tiling" herein) of amplicons (which may be referred to as "tiles" herein) from a plurality of candidate amplicons for covering one or more specific desired (e.g., customized) genomic regions or targets using one or more pools of amplicons. The method may include receiving as input a set of one or more targets and a set of candidate amplicons, and may include outputting as output a subset of the candidate amplicons and an assignment of each of the amplicons in the subset to a pool in which that amplicon can be multiplexed. Amplicons of any suitable sizes may be used. In an embodiment, an assay or primer design may accommodate 200 bp amplicons and 150 bp amplicons, for example, which may be especially useful for certain challenging samples such as FFPE, for example. In an embodiment, an assay or primer design may be adapted to be compatible with one or more specific library kits, such as, for example, the Ion AmpliSeq™ Library Kit 2.0.

According to an exemplary embodiment, there is provided a method for tiling and pooling, comprising (1) selecting a subset of amplicons (which may be referred to as "tiling" herein) from a set of input amplicons such that the subset of amplicons (i) covers as much of each target as do the amplicons in the set of input amplicons, (ii) has many fewer amplicons than the set of input amplicons, and (iii) maximizes a quality of the amplicons; and (2) assigns each amplicon or tile in the subset of amplicons or tiling to a pool so as to allow each pool to be multiplexed.

Figure 22:
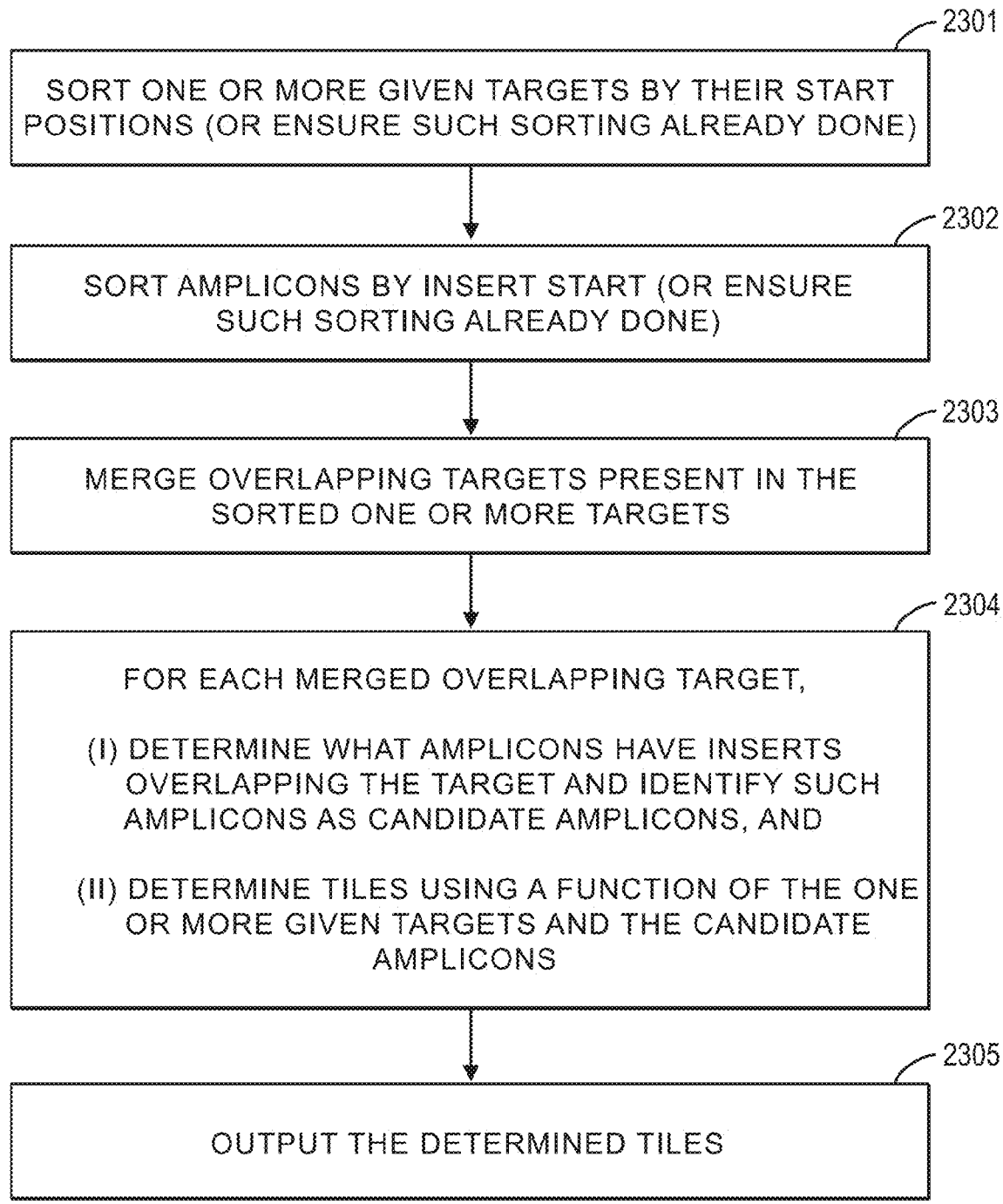
FIG. 22 illustrates a method for tiling a plurality of amplicons for one or more given targets according to an exemplary embodiment.

FIG. 22 illustrates a method for tiling a plurality of amplicons for one or more given targets according to an exemplary embodiment. In step 2301, a module or other hardware and/or software component sorts the one or more given targets by their start positions (or ensures that the given targets were already pre-sorted in such a manner when provided as input). In step 2302, a module or other hardware and/or software component sorts the amplicons by insert start (or ensures that the amplicons were already pre-sorted in such a manner when provided as input). In step 2303, a module or other hardware and/or software component merges overlapping targets present in the sorted one or more targets. In step 2304, for each merged overlapping target, a module or other hardware and/or software component (i) determines what amplicons have inserts overlapping the target and identifies such amplicons as candidate amplicons, and (ii) determines tiles using a function of the one or more given targets and the candidate amplicons. In step 2305, a module or other hardware and/or software component outputs the determined tiles. In some embodiments, targets may or may not be merged ahead of gathering any target amplicons, amplicons may be gathered for unmerged targets, and, if two targets share at least one amplicon, such two targets may be merged together (and one of the two targets may already represent a set of merged input amplicons).

According to an exemplary embodiment, there is provided a method for tiling a plurality of amplicons for one or more given targets, comprising: (1) sorting the one or more given targets by their start positions or ensuring that the given targets were already pre-sorted in such a manner when provided as input; (2) sorting the amplicons by insert start or ensuring that the amplicons were already pre-sorted in such a manner when provided as input; (3) merging overlapping targets present in the sorted one or more targets; (4) for each merged overlapping target, (i) determining what amplicons have inserts overlapping the target and identifying such amplicons as candidate amplicons and (ii) determining the tiles using a function of the one or more given targets and the candidate amplicons; and (5) outputting the tiles.

Figure 23:
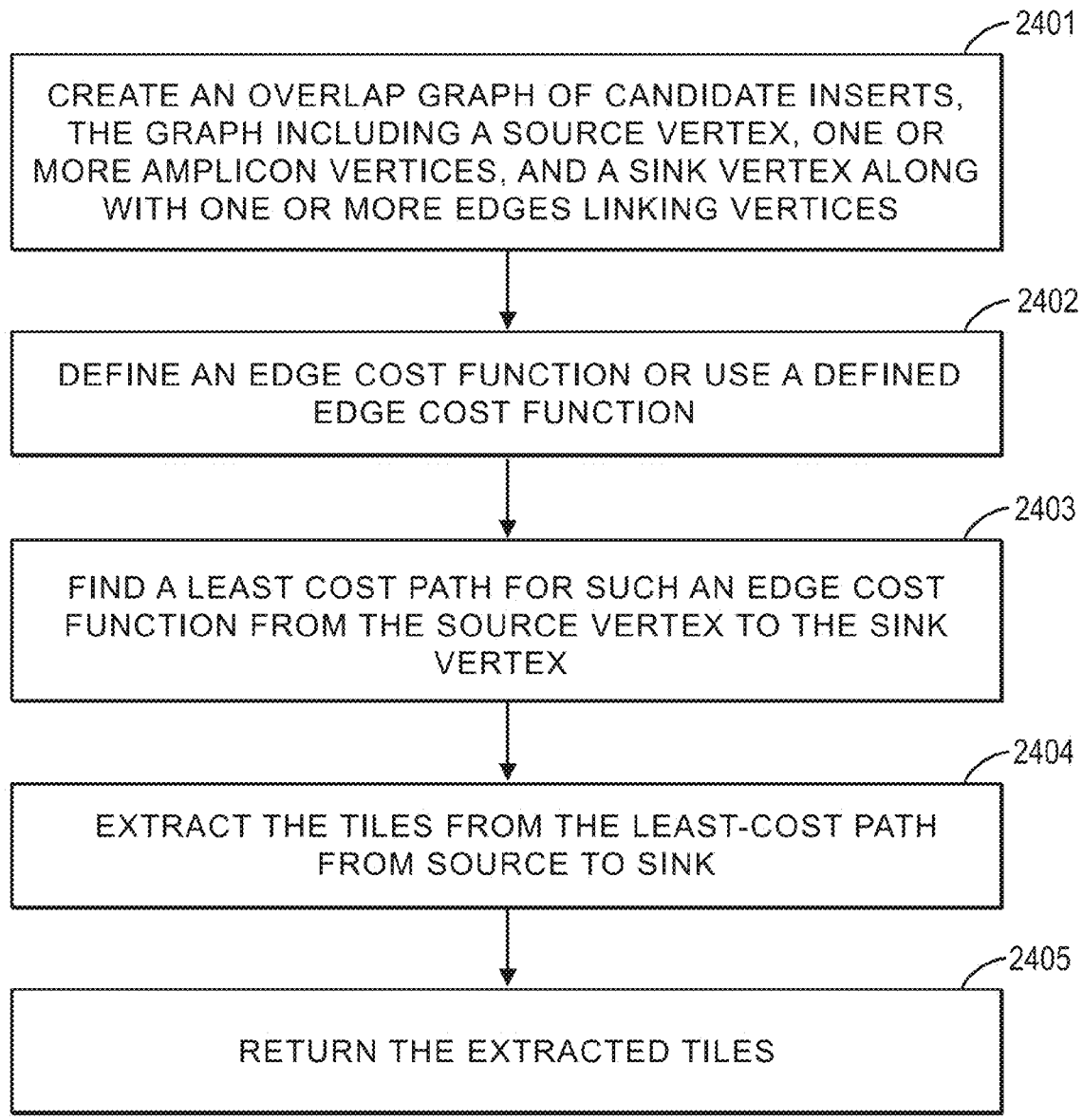
FIG. 23 illustrates a method for determining tiles for one or more given targets and candidate amplicons according to an exemplary embodiment.

FIG. 23 illustrates a method for determining tiles for one or more given targets and candidate amplicons according to an exemplary embodiment. In step 2401, a module or other hardware and/or software component creates an overlap graph of candidate inserts, the graph including a source vertex, one or more amplicon vertices, and a sink vertex along with one or more edges linking vertices. In step 2402, a module or other hardware and/or software component defines an edge cost function or uses a defined edge cost function. In step 2403, a module or other hardware and/or software component finds a least cost path for such an edge cost function from the source vertex to the sink vertex. In step 2404, a module or other hardware and/or software component extracts the tiles from the least-cost path from source to sink. In step 2405, a module or other hardware and/or software component returns the extracted tiles.

According to an exemplary embodiment, there is provided a method for determining tiles for one or more given targets and candidate amplicons, comprising: (1) creating an overlap graph of candidate inserts, the overlap graph comprising a set of vertices V and a set of edges E (e.g., a graph G=(V,E)), such creating including (i) letting V equal the union of the set of candidate amplicons (each of which being assigned a corresponding vertex) and the set consisting of a source element and a sink element (e.g., V={amplicons} ∪{source,sink}), (ii) connecting the source vertex to all initial vertices and the sink vertex to all terminal vertices, (iii) connecting each amplicon vertex to all subsequent, proper, overlaps, and (iv) connecting rightmost vertices on the left of a gap to leftmost vertices on the right of that gap; (2) defining an edge cost function or using a defined edge cost function; (3) finding a least cost path for such an edge cost function from the source vertex to each vertex; (4) extracting the tiles from the least-cost path from source to sink; and (5) returning the extracted tiles.

Figure 24A:
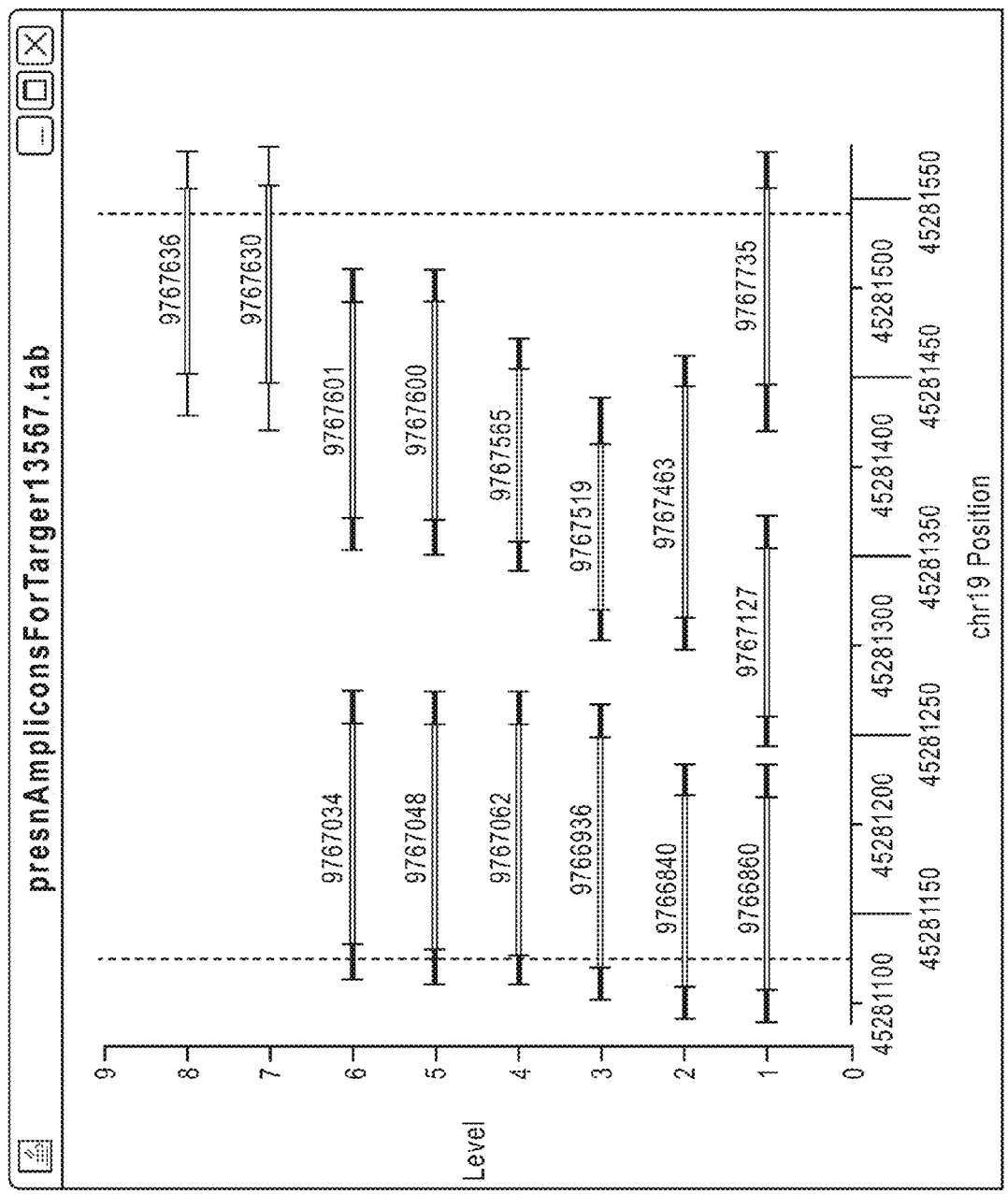
FIG. 24A illustrates a set of candidate amplicons for covering a given target region, each including an insert surrounded by a pair of primers, for tiling and pooling according to an exemplary embodiment.

FIG. 24A illustrates a set of candidate amplicons for covering a given target region, each including an insert surrounded by a pair of primers, for tiling and pooling according to an exemplary embodiment. The dotted lines indicate the boundaries of the target region (on chromosome 19 in this example).

Figure 24B:
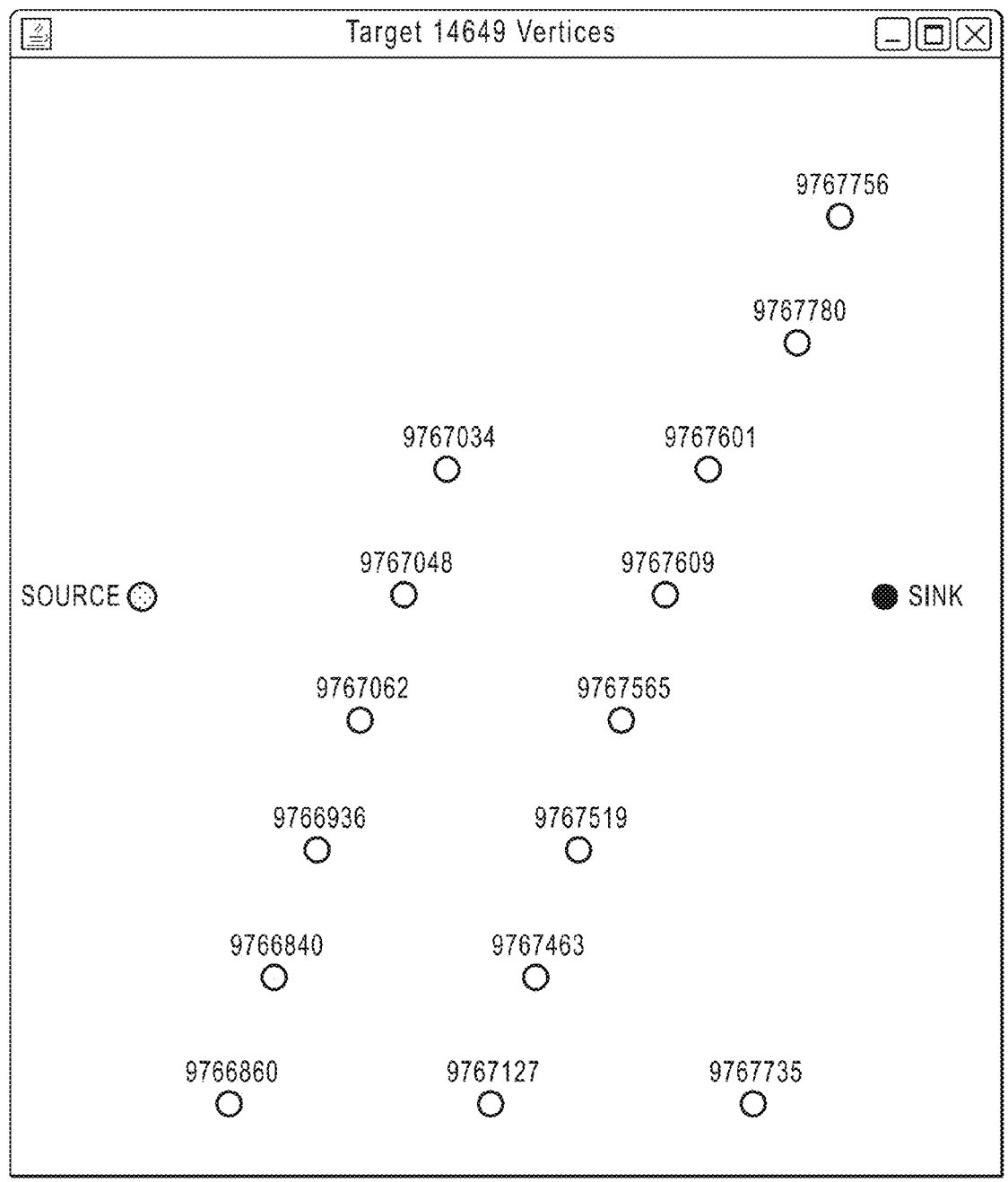
FIG. 24B illustrates a set of vertices for generating a graph according to an exemplary embodiment.
Figure 25A:
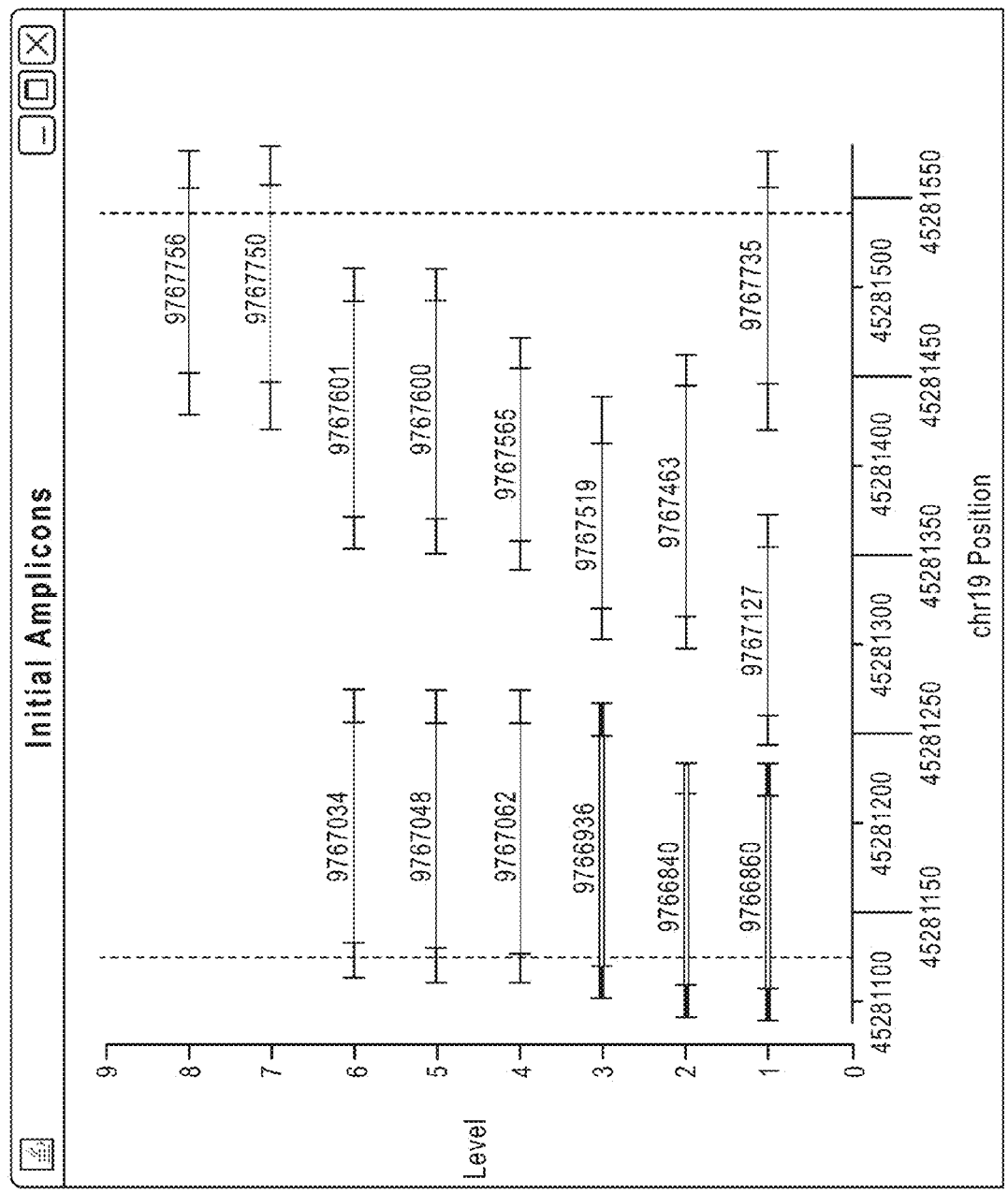
FIG. 25A illustrates the 15 candidate amplicons of FIG. 24A, except that three "initial" amplicons having at least some overlap between their insert and the beginning of the target region are highlighted.

FIG. 24B illustrates a set of vertices for generating a graph. The vertices V includes 15 amplicon vertices (white) corresponding to the 15 candidate amplicons illustrated in FIG. 24A together with a source vertex (light gray or green, left) and a sink vertex (dark grey or red, right). FIG. 25A illustrates the 15 candidate amplicons of FIG. 24A, except that three "initial" amplicons having at least some overlap between their insert and the beginning of the target region are highlighted.

Figure 25B:
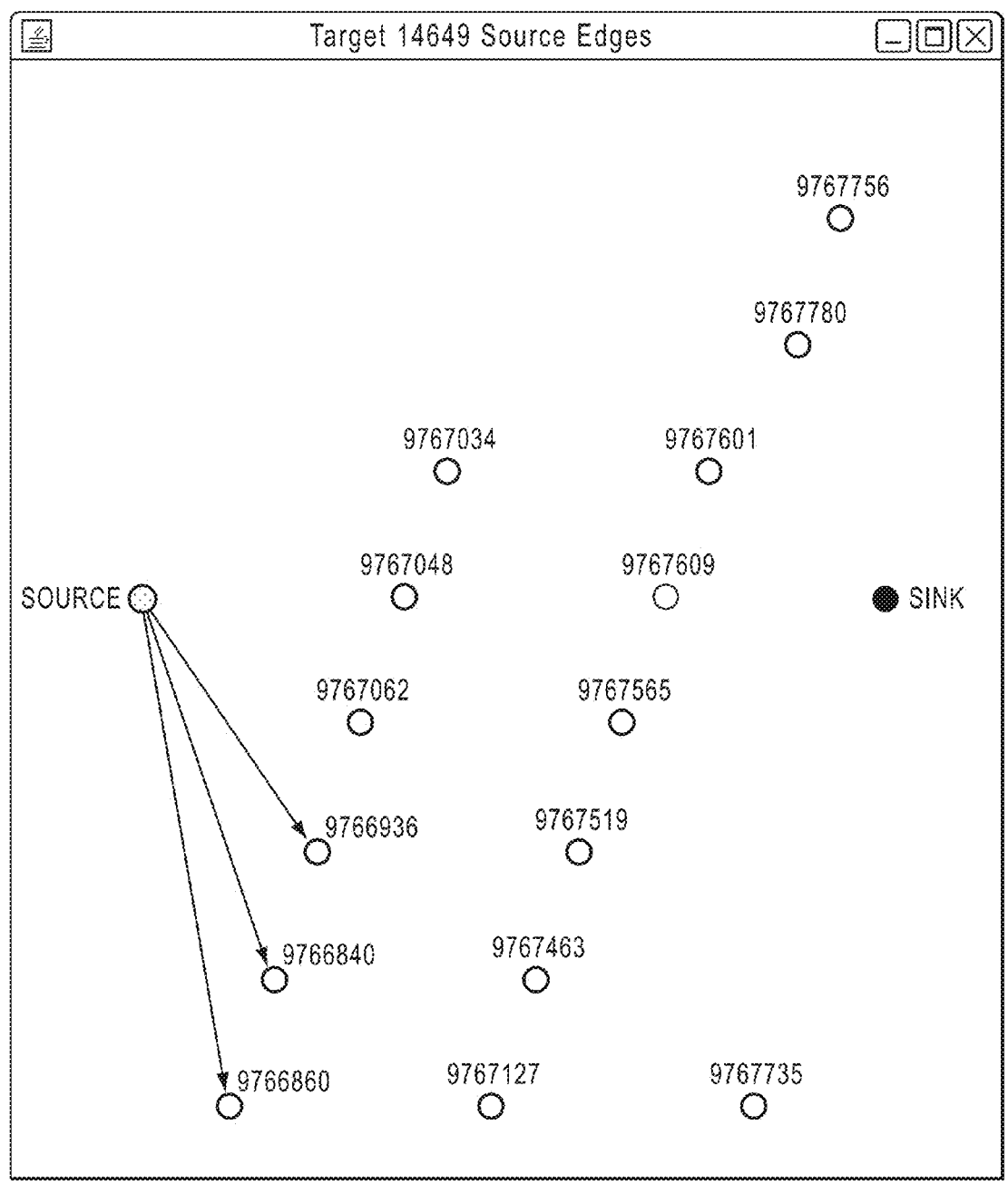
FIG. 25B illustrates the connection of a source vertex to three vertices corresponding to the initial amplicons of FIG. 25A with edges.

FIG. 25B illustrates the connection of a source vertex to three vertices corresponding to the initial amplicons of FIG. 25A with edges.

Figure 26A:
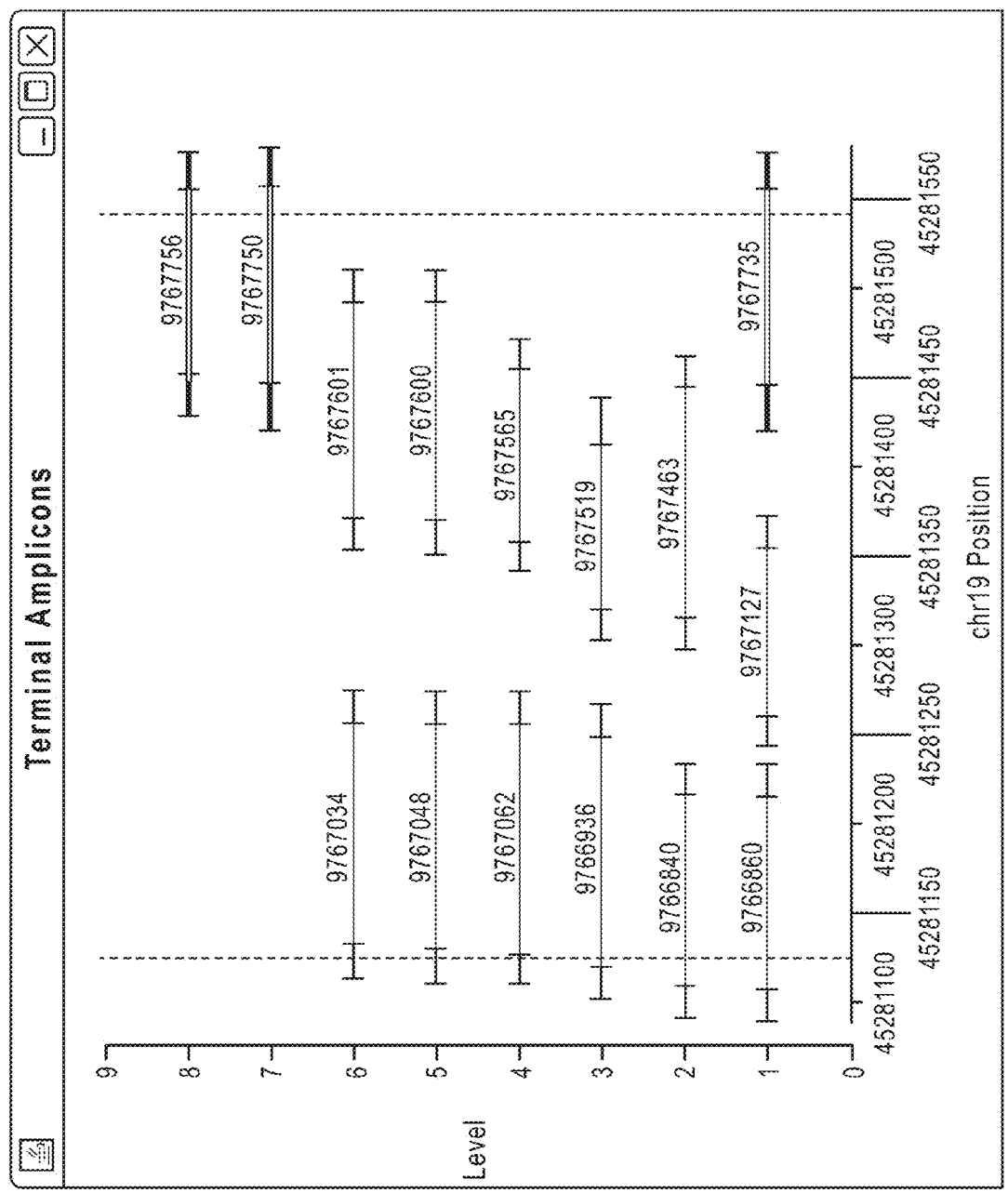
FIG. 26A illustrates the 15 candidate amplicons of FIG. 24A, except that three "terminal" amplicons having at least some overlap between their insert and the end of the target region are highlighted.

FIG. 26A illustrates the 15 candidate amplicons of FIG. 24A, except that three "terminal" amplicons having at least some overlap between their insert and the end of the target region are highlighted.

Figure 26B:
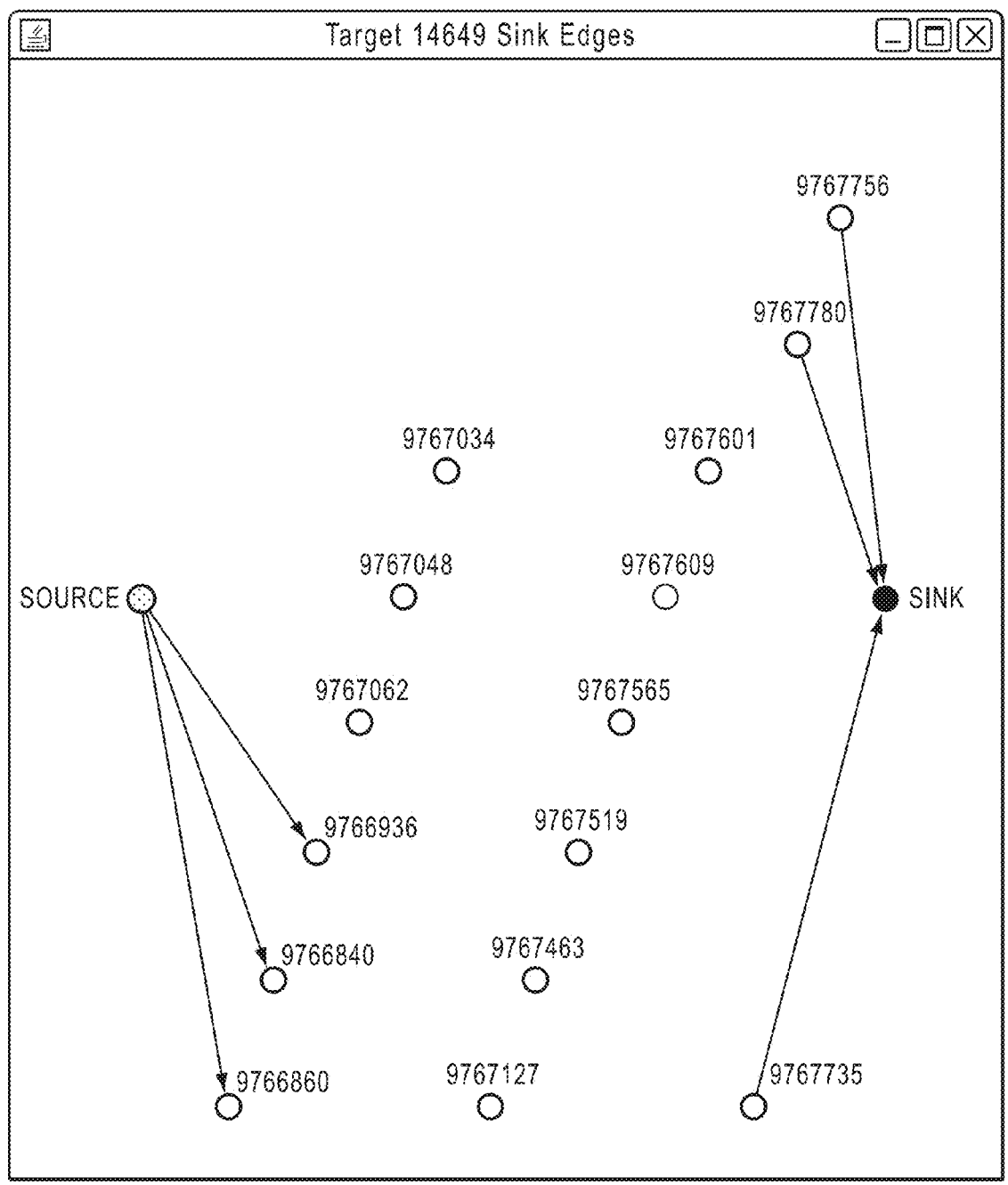
FIG. 26B illustrates the connection of a sink vertex to three vertices corresponding to the terminal amplicons of FIG. 26A with edges.

FIG. 26B illustrates the connection of a sink vertex to three vertices corresponding to the terminal amplicons of FIG. 26A with edges.

Figure 27A:
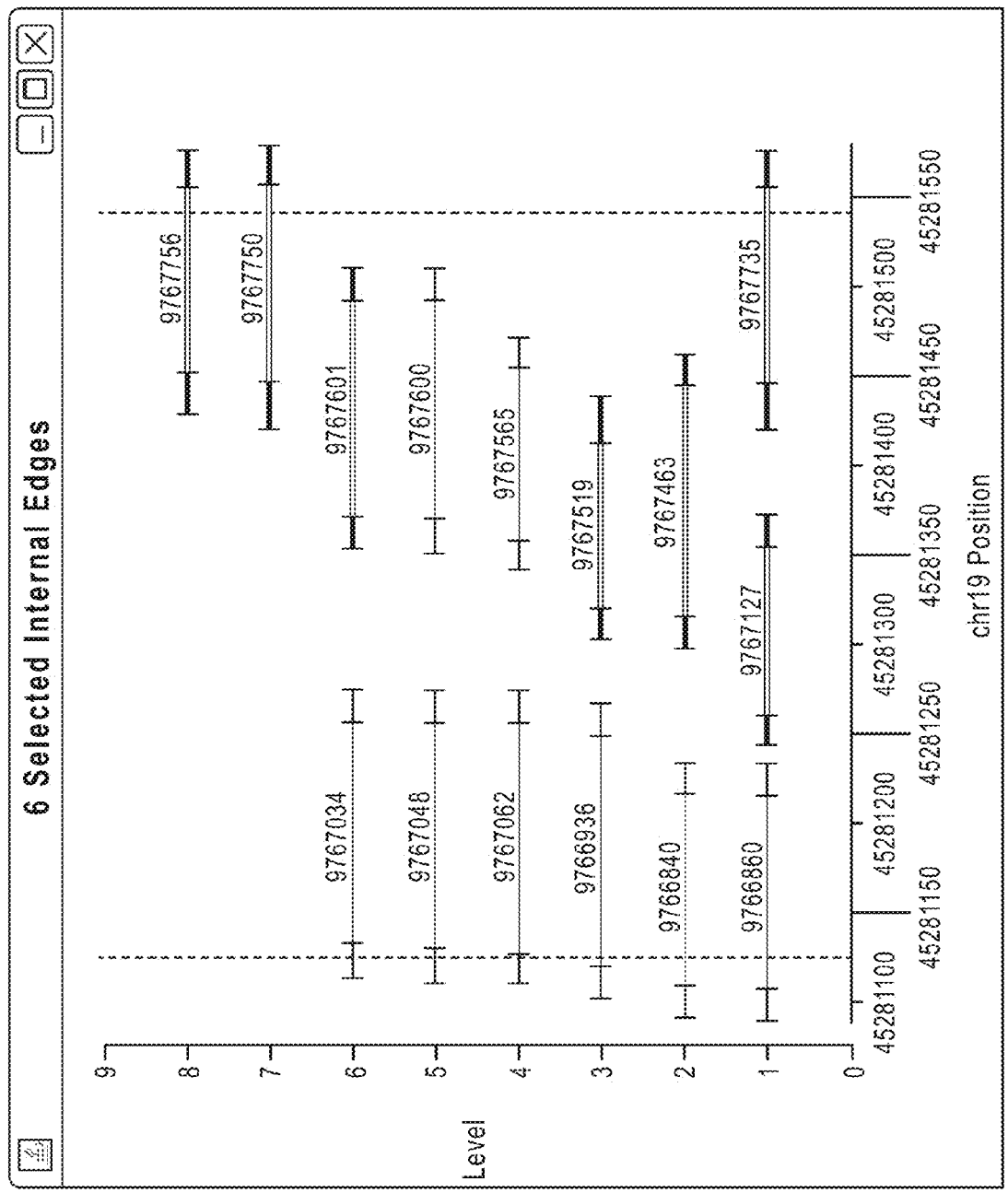
FIG. 27A illustrates the 15 candidate amplicons of FIG. 24A, except that various amplicons for building internal edges are highlighted.

FIG. 27A illustrates the 15 candidate amplicons of FIG. 24A, except that various amplicons for building internal edges are highlighted.

Figure 27B:
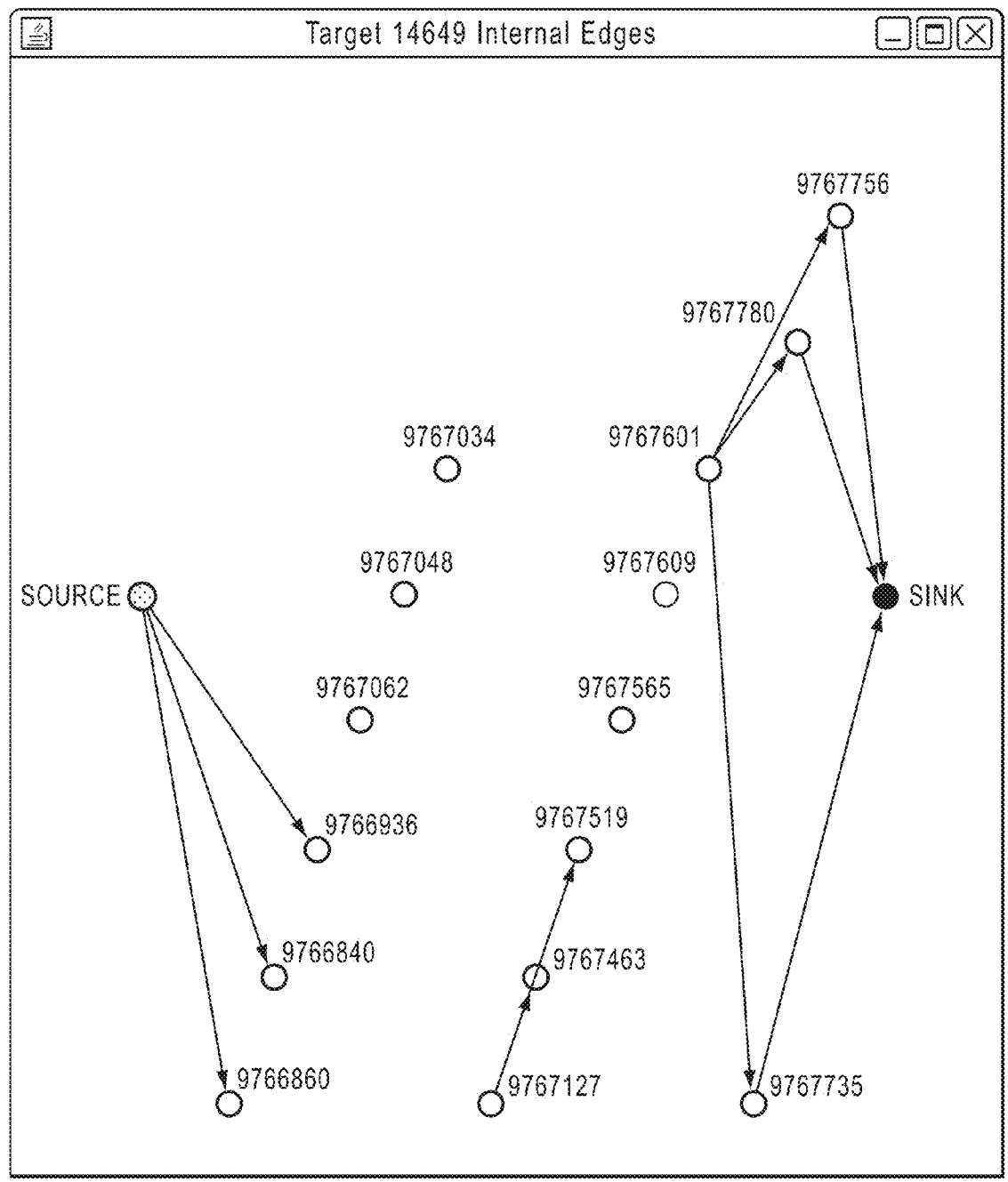
FIG. 27B illustrates the connection of some amplicon insert vertices to subsequent, proper, overlaps according to an exemplary embodiment.

FIG. 27B illustrates the connection of some amplicon insert vertices to subsequent, proper, overlaps according to an exemplary embodiment. Shown are arrows linking the 9767127 amplicon vertex to the 9767463 and 9767519 amplicon vertices (whose inserts overlap the insert of the 9767127 amplicon vertex) and arrows linking the 9767610 amplicon vertex to the 9767780 and 9767756 amplicon vertices (whose inserts overlap the insert of the 9767610 amplicon vertex).

Figure 28A:
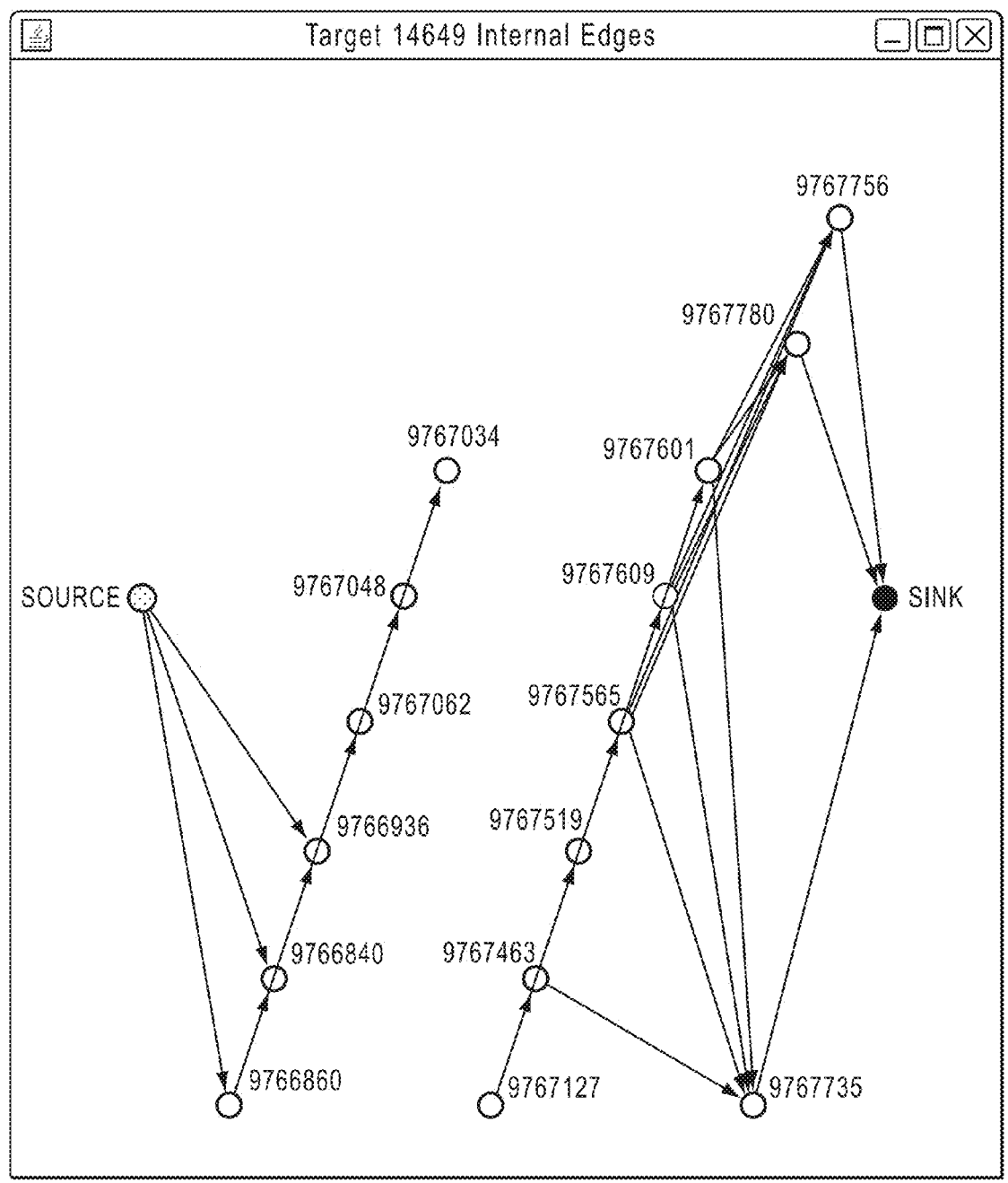
FIG. 28A illustrates the connection of additional amplicon insert vertices to subsequent, proper, overlaps according to an exemplary embodiment.

FIG. 28A illustrates the connection of additional amplicon insert vertices to subsequent, proper, overlaps according to an exemplary embodiment. Also shown is a disconnect or gap that may arise if the candidate amplicons do not fully cover the target.

Figure 28B:
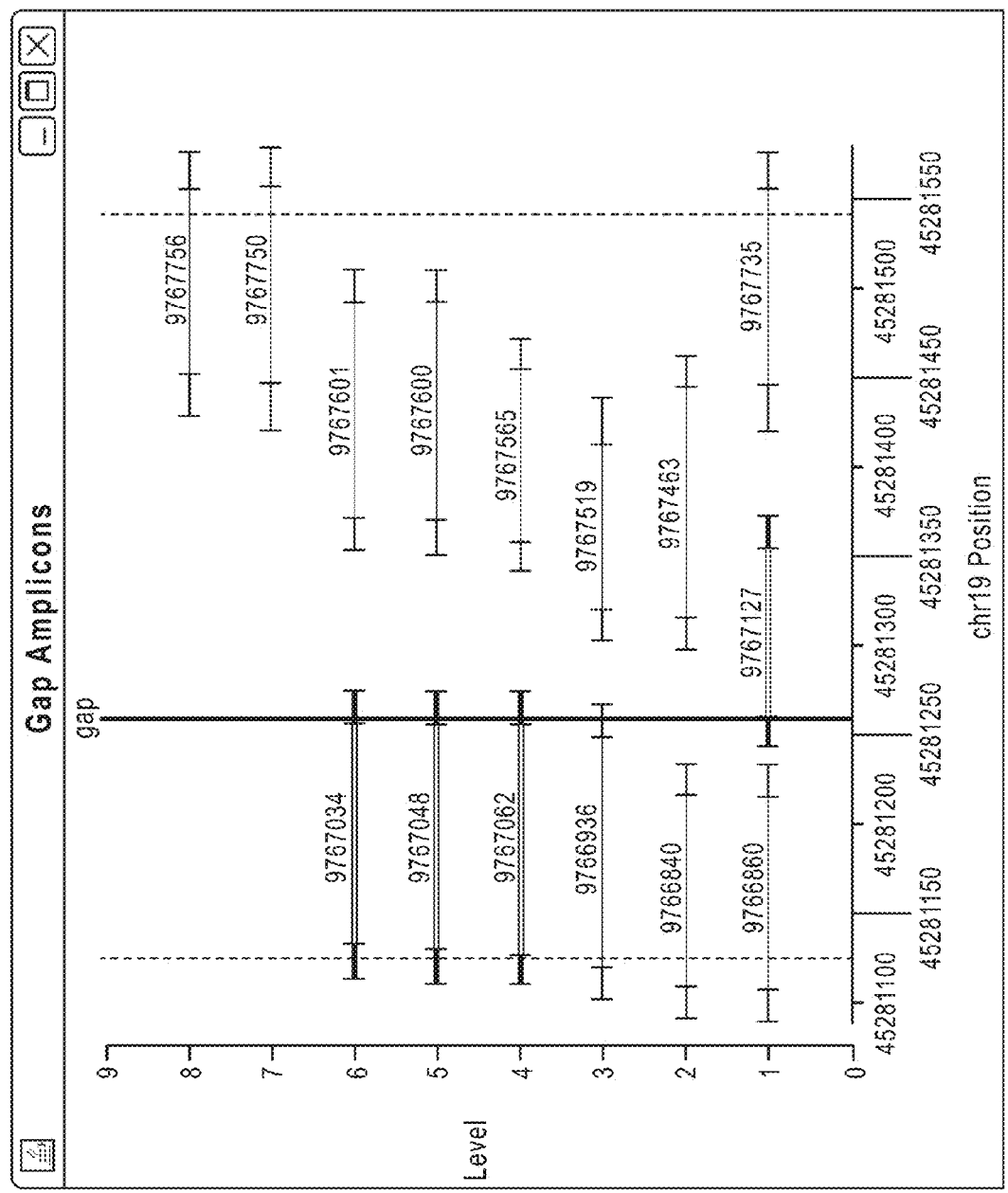
FIG. 28B illustrates the 15 candidate amplicons of FIG. 24A, along with the basis for the gap shown in FIG. 28A according to an exemplary embodiment.

FIG. 28B illustrates the 15 candidate amplicons of FIG. 24A, along with the basis for the gap shown in FIG. 28A according to an exemplary embodiment.

Figure 29A:
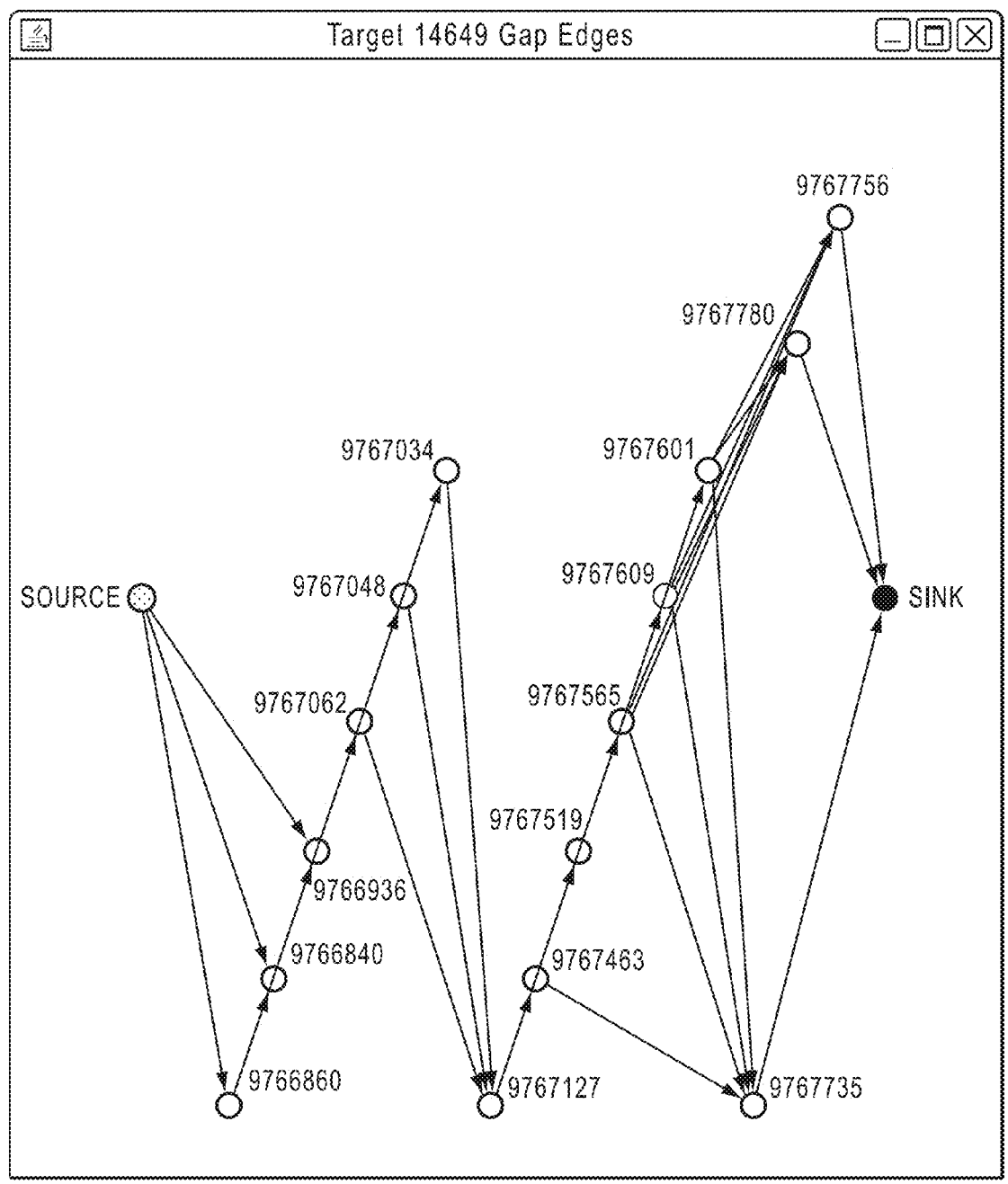
FIG. 29A illustrates three possible additional edges that could be used from source to sink to tile the target in this example according to an exemplary embodiment.

FIG. 29A illustrates three possible additional edges that could be used from source to ink to tile the target in this example according to an exemplary embodiment. In an embodiment, of the possible paths the one with a least cost may be selected.

Figure 29B:
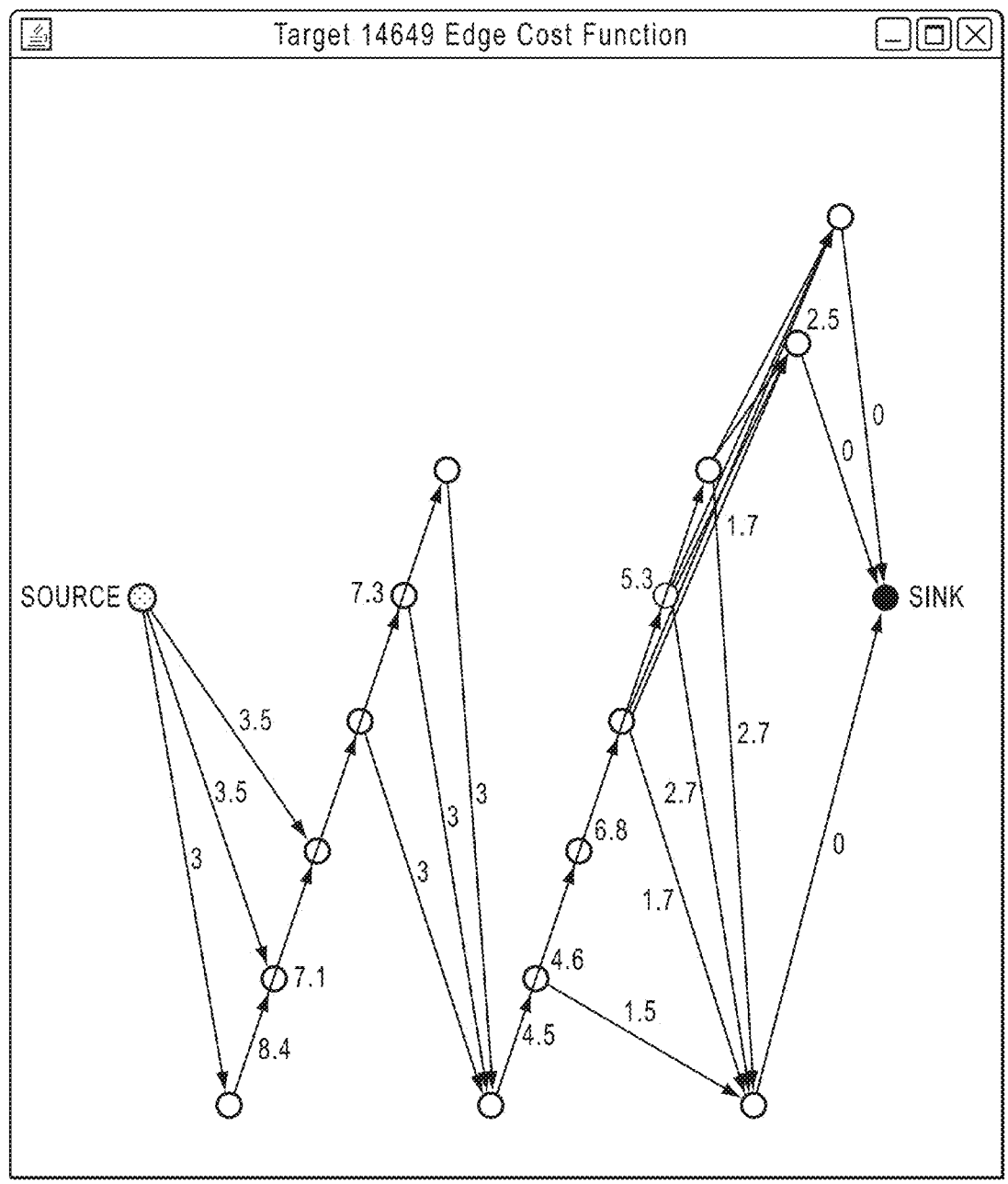
FIG. 29B illustrates an exemplary definition of an edge cost function assigning a cost to each one of the graph's edges linking amplicon vertices according to an exemplary embodiment.

FIG. 29B illustrates an exemplary definition of an edge cost function assigning a cost to each one of the graph's edges linking amplicon vertices according to an exemplary embodiment.

Figure 29C:
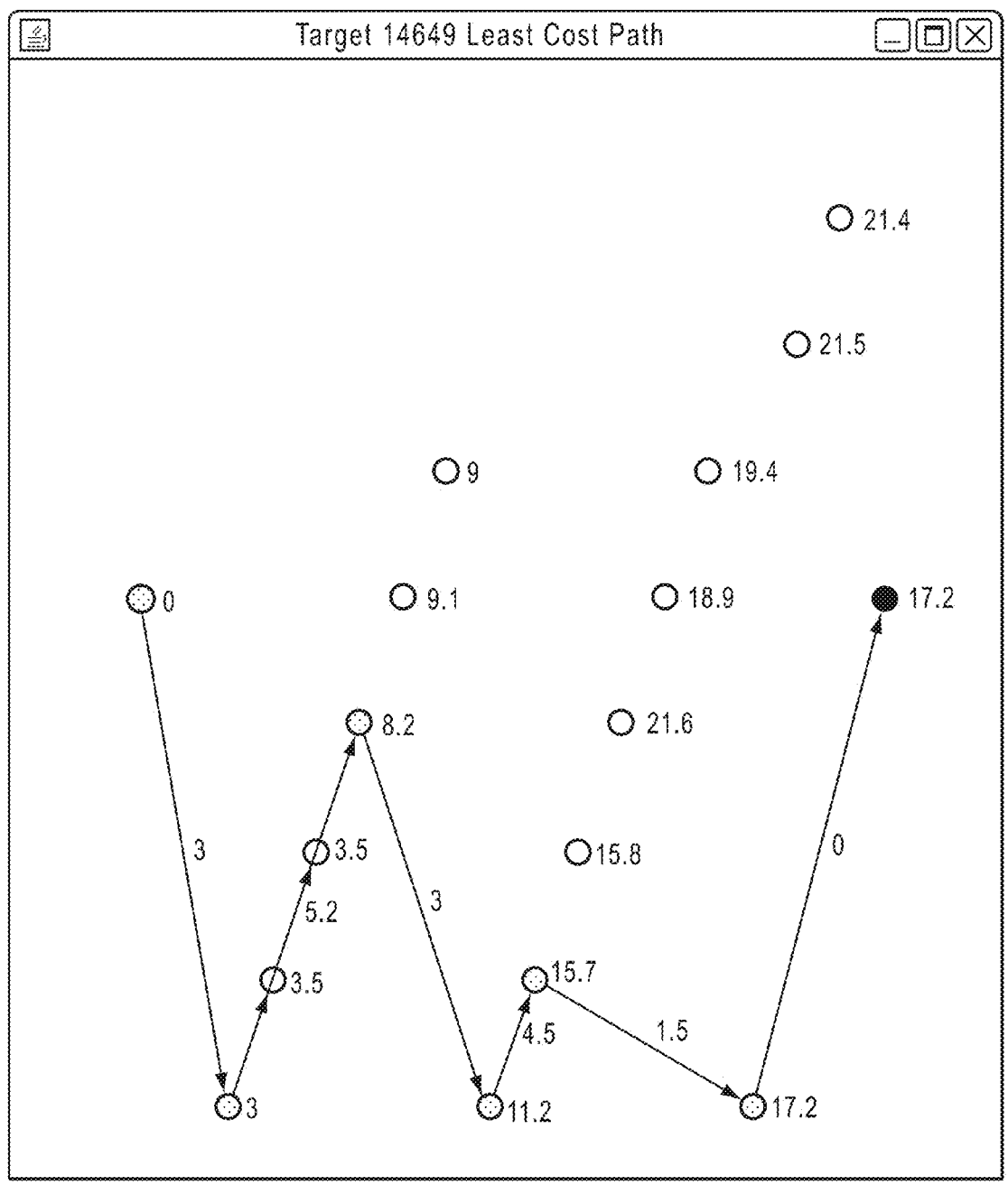
FIG. 29C illustrates the least-cost path from source to sink in the example of FIG. 29B according to an exemplary embodiment.

FIG. 29C illustrates the least-cost path from source to ink in the example of FIG. 29B according to an exemplary embodiment.

Figure 30:
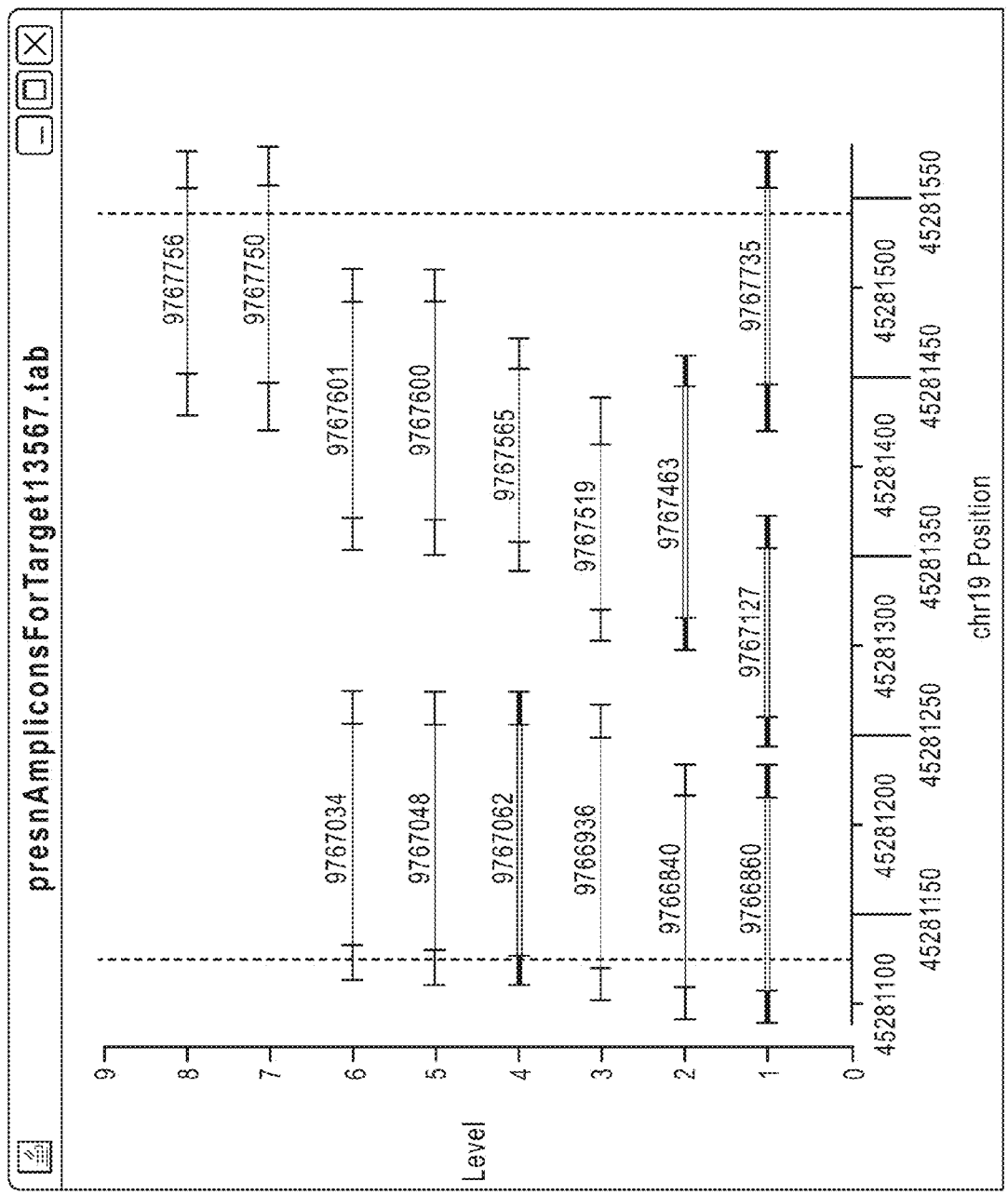
FIG. 30 illustrates the 15 candidate amplicons of FIG. 24A, except that the five amplicons corresponding to the vertices forming the least-cost path shown in FIG. 29C are highlighted.

FIG. 30 illustrates the 15 candidate amplicons of FIG. 24A, except that the five amplicons corresponding to the vertices forming the least-cost path shown in FIG. 29C are highlighted.

According to an exemplary embodiment, the least-cost path may be determined using an $O(|V|+|E|)$ algorithm. The least-cost path may be determined as follows: (1) for each vertex v, (i) initialize D[v] to infinity (the least cost so far in the process) from the source vertex to v and initialize D[source] to zero, and (ii) initialize Predlyl to null (the predecessor of v in the least-cost path from the source vertex to v); and (2) for each vertex u in topological order, for each vertex v in adj[u], if D[u]+cost(u,v)<D[v], then let DM=D[u]+cost(u,v) and Pred[v]=u. More information regarding algorithms for constructing paths on graphs may be found in Dijkstra, "A Note on Two Problems in Connexion with Graphs," Numerische Mathematik, vol. 1, 269-271 (1959), and Sniedovich, "Dijkstra's algorithm revisited: the dynamic programming connexion," Control and Cybernetics, vol. 35, 599-620 (2006), which are both incorporated by reference herein in their entirety.

According to an exemplary embodiment, the cost of a path (e.g., amplicon plus "union" redundancy) may be the sum of the edges forming the path. In an embodiment, the cost of a path may be determined using Equation 1 below:

$$\text{cost}(path) = \sum_{(u,v) \in path} \text{cost}(u, v) \quad \text{Equation 1}$$

According to an exemplary embodiment, the cost of an edge forming a path may be a sum of an amplicon cost and an overlap cost weighed using a factor α selected to blend the two costs, e.g., $0 \leq \alpha \leq 1$. In an embodiment, the cost of an edge forming the path may be determined using Equation 2 below:

$$\text{cost}(u,v) = \alpha \text{cost}(v \cdot \text{amplicon}) + (1-\alpha)\text{cost}(\text{overlap}(u,v)) \quad \text{Equation 2}$$

According to an exemplary embodiment, there is provided a method for determining a cost associated with a tiling or subset of amplicons. In an embodiment, the cost of a tiling may be the sum of a cost of each amplicon in the tiling plus a cost of any one or more insert overlaps. The cost of an amplicon may be assigned any suitable value in any suitable predetermined range of values such that a low value imparts a low cost and a high value imparts a high cost so as to penalize various undesirable characteristics such as, for example, off-target amplification, primer-dimer propensity, etc. For example, the cost of an amplicon may be assigned a value from 1 to 10 such that a higher/lower cost is associated with a higher/lower level of undesirable characteristics (using any appropriate relationships, which may be linear/proportional or non-linear, for example). The cost of an insert overlap may also similarly be assigned any suitable value in any suitable predetermined range of values, for example, such that a low value imparts a low cost and a high value imparts a high cost so as to penalize various undesirable characteristics such as, for example, the redundancy introduced by overlapping inserts. For example, the cost of an insert overlap may also be assigned a value from 1 to 10. In an embodiment, one may opt to select a least-cost tiling from a set of candidate amplicons. In an embodiment, the cost of an insert overlap may be determined based on the redundancy introduced by overlapping inserts using Equation 3 below:

$$\text{redundancy}(\text{overlap}(u, v)) = \frac{numBP(\text{overlap}(u, v))}{numBP(\text{union}(u, v))} \quad \text{Equation 3}$$

According to an exemplary embodiment, the costs for amplicon and specificity may be used by a tiling hardware or software component of tiler to calculate the cost of an edge. In an embodiment, a cost system may be used that allows a scaled cost calculation for a vertex in the tiler. The cost of an amplicon may be a composite of the amplicon cost and the specificity cost. The amplicon cost may reflect the quality of PCR amplification and the specificity cost may reflect the propensity of the amplicon to amplify off-target nucleotides.

In an embodiment, the cost of an amplicon may be determined as follows: Initially, a threshold may be used to filter primers that allow potential off-target amplification. The filter may be based on a program such as e-PCR2 (NCBI), see Rotmistrovsky et al., "A web server for performing electronic PCR," Nucleic Acids Research, vol. 32, W108-W112 (2004), and Schuler, "Sequence Mapping by Electronic PCR," Genome Research, vol. 7, 541-550 (1997), which are both incorporated by reference herein in their entirety, or other similar programs capable of being used for filtering primers. Various scoring strategies may be used for filtering. In various embodiments, the assays may be filtered that have a sum of score of forward and reverve primer less than a certain minimal score threshold (e.g., 150) or show more than 50 hits with a score less than some threshold (e.g., 200). Of course, numerical cut-offs may differ and will vary according to software used. In various embodiments, scores used for filtering may be converted to a cost using a conversion table such as illustrated below:

| 0-19 | 170+ | 10 |
|---|---|---|
| 20-39 | 150-169 | 9 |
| 40-59 | 130-149 | 8 |
| 60-79 | 110-129 | 7 |
| 80-99 | 90-109 | 6 |
| 100-119 | 70-89 | 5 |
| 120-149 | 50-69 | 4 |
| 150-179 | 30-49 | 3 |
| 180-210 | 10-29 | 2 |
| 210+ | 0-9 | 1 |

In this exemplary table, the first column represents sp_score, which is a specificity score; the second column represents sp_hits, which is the number of matches for the forward and reverse primers facing each other; and the third column is a corresponding cost. The first perfect match is free, since it is the self match. In an embodiment, Acost is the cost based on binning the sp_score values, Bcost is the cost based on sp_hits values, and the amplicon cost may be calculated using the formula: AmpliconCost=0.9*Acost+0.1*Bcost.

Figure 31:
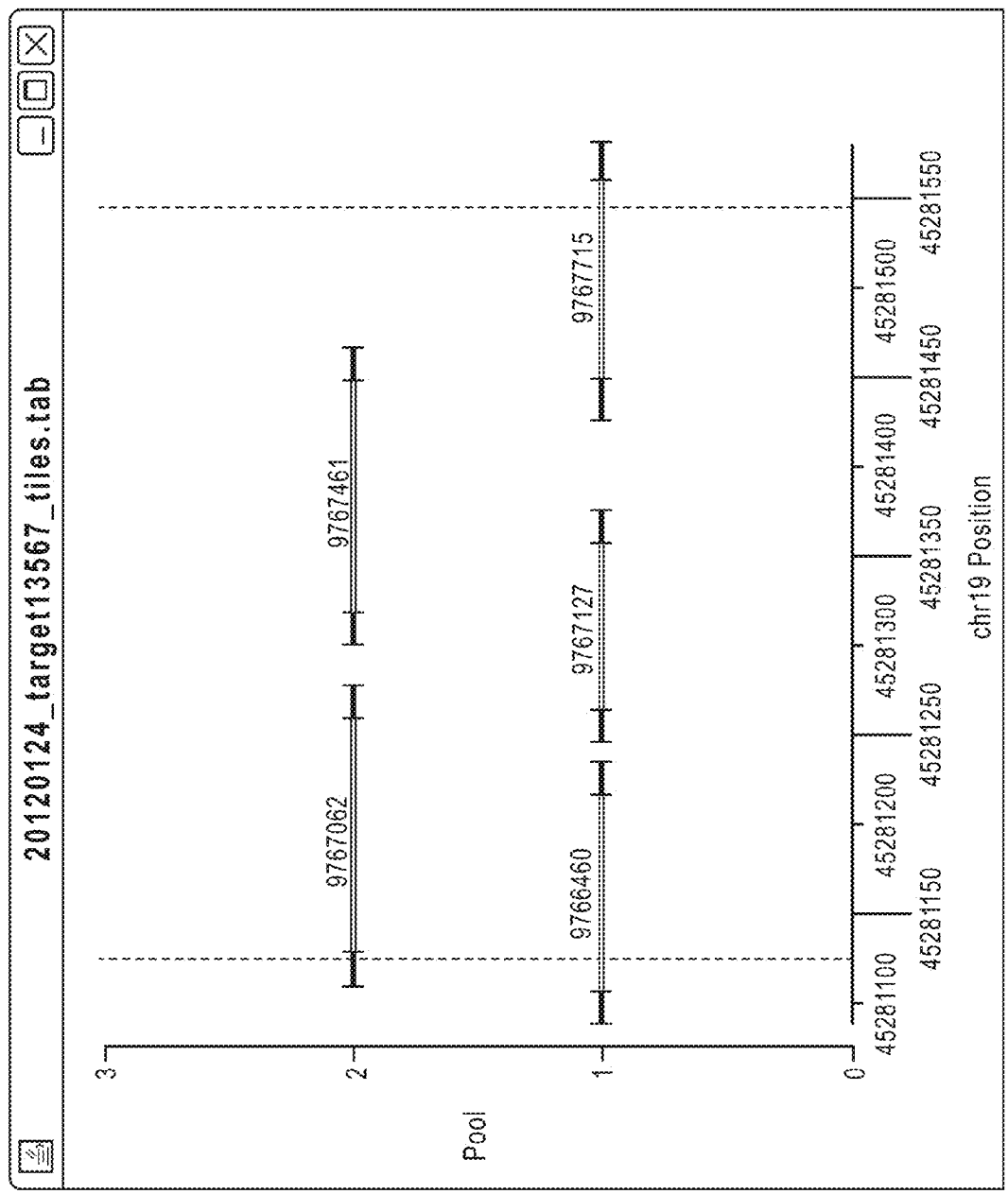
FIG. 31 illustrates three amplicons assigned to a first pool and two amplicons assigned to a second pool according to an exemplary embodiment.

FIG. 31 illustrates three amplicons assigned to a first pool and two amplicons assigned to a second pool according to an exemplary embodiment. The dotted lines indicate the boundaries of a target region (on chromosome 19 in this example). As illustrated, the amplicons in the first and second pools substantially cover the target regions, with the exception of the gaps.

According to an exemplary embodiment, there is provided a method for pooling amplicons into one or more pools of amplicons. In an embodiment, the method may pool the amplicons using one or more pooling criteria, which may related at least in part to pool sizes. In an embodiment, a number of pools may be limited to a pre-determined maximum number of pools, which may be 10 pools, for example, or which may be 50, 40, 30, 20, 9, 8, 7, 6, 5, 4, 3, 2, or 1, for example, or any other positive integer. In an embodiment, a capacity of each pool (e.g., a maximal size of a pool) may also be limited to a pre-determined maximal value, which may be any fixed number of amplicons, and which may be about 10,000, about 7,500, about 5,000, about 2,500, about 2,000, about 1,500, about 1,000, and about 500, or any value between those examples, for example, and which may be a maximum of 768 or 1,536 amplicons, for example. In an embodiment, a balance factor may be used, which may be a percentage between about 60% and 100%, or between about 65% and 95%, or between about 70% and 90%, or about 90%, for example. In an embodiment, the size of a pool p may be constrained by the inequality set forth in Equation 4 below:

$$\text{size}(p) \geq \lfloor balanceFactor \times \max_{q \in pools} \{\text{size}(q)\} \rfloor \quad \text{Equation 4}$$

According to an exemplary embodiment, an intra pool distance may be limited by a minimal threshold distance, which may be, for example, an integer number of base pairs (e.g., 50 base pairs, or 5, 10, 15, 20, etc., or any predetermined number of base pairs).

Figure 32A:
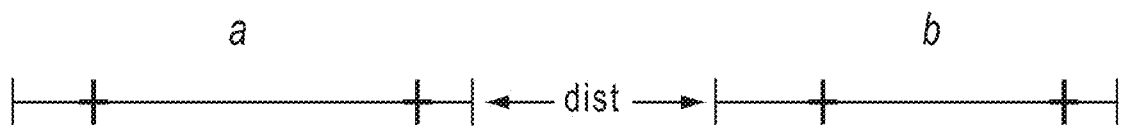
FIG. 32A illustrates a minimal distance between amplicons according to an exemplary embodiment.
Figure 32B:
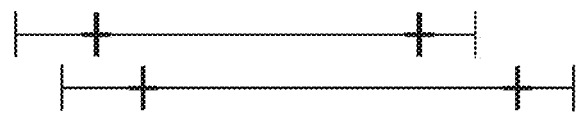
FIG. 32B-D illustrate several problems, including primer "race condition," preferential amplification of sub amplicons, and super amplicons that may be ameliorated by using a minimal distance as illustrated in FIG. 32A.
Figure 32C:
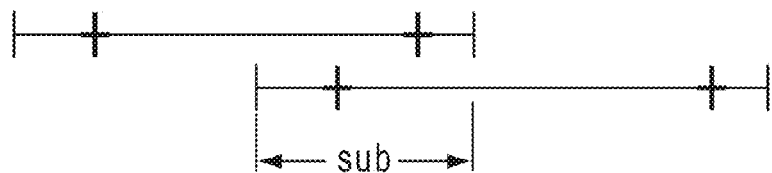
Figure 32D:
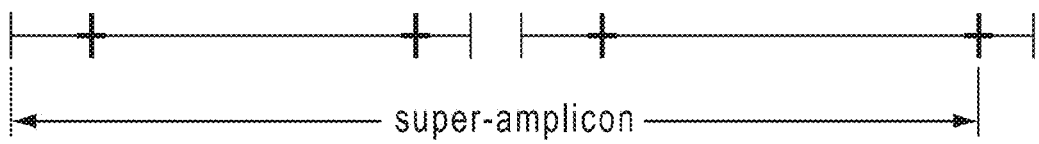

FIG. 32A illustrates a minimal distance between amplicons according to an exemplary embodiment. FIGS. 32B-D illustrate several problems, including primer "race condition" (see FIG. 32B), preferential amplification of sub amplicons (see FIG. 32C), and super amplicons (see FIG. 32D) that may be ameliorated by using a minimal distance as illustrated in FIG. 32A. In an embodiment, the distance may be determined using equation 5, for example. Such an approach may prevent or reduces "race condition," preferential amplification of sub amplicons, and super amplicons.

$$\text{dist}(a,b) = \max(a\cdot\text{start}, b\cdot\text{start}) - \min(a\cdot\text{end}, b\cdot\text{end}) - 1 \quad \text{Equation 5}$$

According to an exemplary embodiment, amplicons may be disqualified from being added to a pool in certain circumstances. For example, an amplicon amp may not be added to a pool p if one or more of the following criteria are met: (1) the size of the pool p equals or exceeds the pool capacity limit; (2) the size of the pool p equals the size of the largest pool (e.g., size(p)=size(largest pool)) and the size of the smallest pool is less than a floor (rounded down) value of the product of (i) the size of the pool p plus 1 and (ii) a balance factor (e.g., size (smallest pool)<floor((size(p)+1) balanceFactor)); and (3) the distance between amp and any other amplicon already in the pool is less than a minimum amplicon separation threshold (e.g., which distance may be determined using Equation 5, for example).

Figure 33:
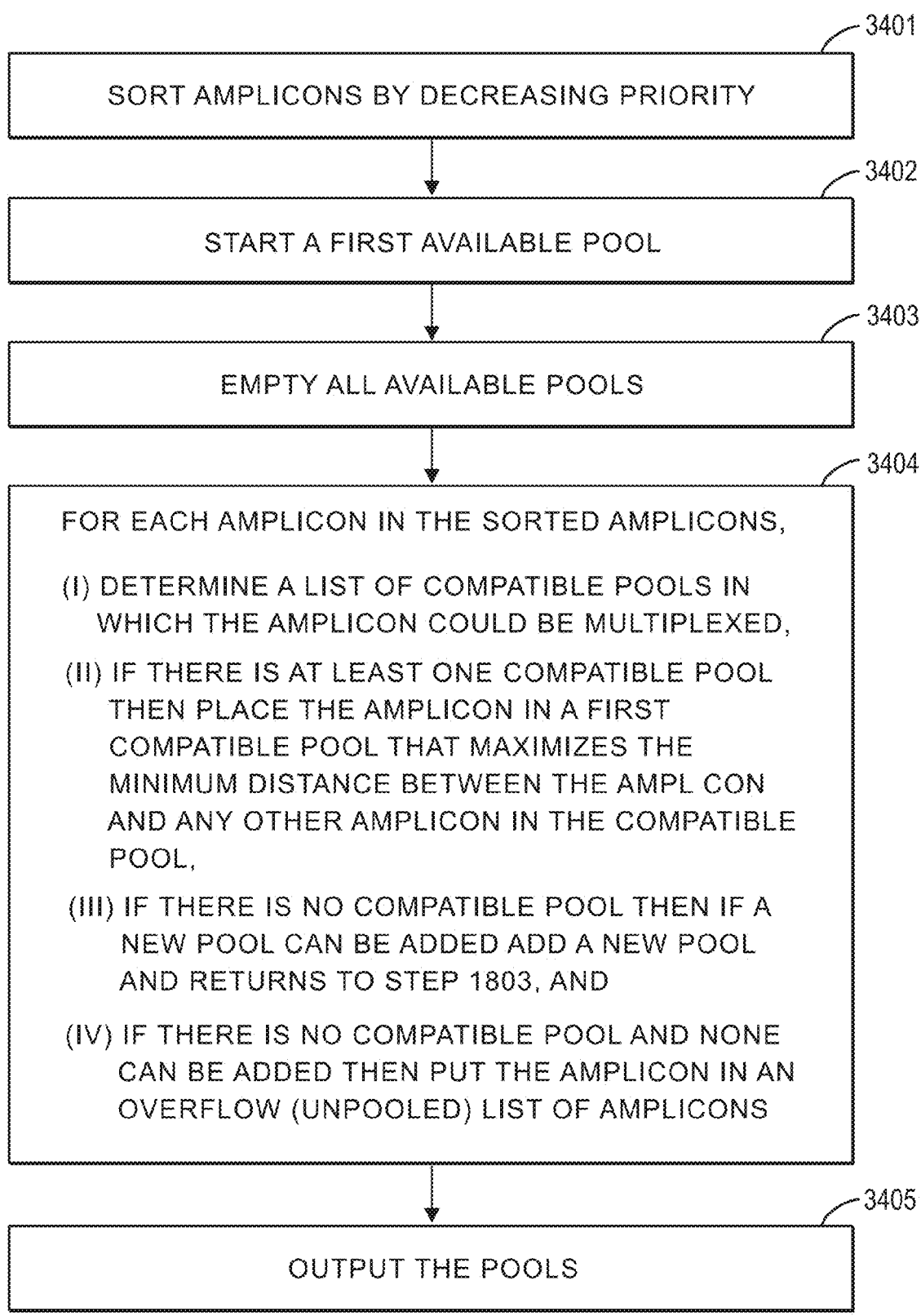
FIG. 33 illustrates a method for pooling amplicons across a plurality of pools according to an exemplary embodiment.

FIG. 33 illustrates a method for pooling amplicons across a plurality of pools according to an exemplary embodiment. In step 3401, a module or other hardware and/or software component sorts the amplicons by decreasing priority. In step 3402, a module or other hardware and/or software component starts a first available pool. In step 3403, a module or other hardware and/or software component empties all available pools. In step 3404, for each amplicon in the sorted amplicons, a module or other hardware and/or software component, (i) determines a list of compatible pools in which the amplicon could be multiplexed, (ii) if there is at least one compatible pool then places the amplicon in a first compatible pool that maximizes the minimum distance between the amplicon and any other amplicon in the compatible pool, (iii) if there is no compatible pool then if a new pool can be added adds a new pool and returns to step 3403, and (iv) if there is no compatible pool and none can be added then puts the amplicon in an overflow (unpooled) list of amplicons. In step 3405, a module or other hardware and/or software component outputs the pools.

According to an exemplary embodiment, a method for pooling amplicons across a plurality of pools comprises: (1) sorting the amplicons by decreasing priority; (2) starting a first available pool; (3) emptying all available pools; (4) for each amplicon in the sorted amplicons, (i) determining a list of compatible pools in which the amplicon could be multiplexed, (ii) if there is at least one compatible pool then placing the amplicon in a first compatible pool that maximizes the minimum distance between the amplicon and any other amplicon in the compatible pool, (iii) if there is no compatible pool then if a new pool can be added add a new pool and return to step (3), and (iv) if there is no compatible pool and none can be added then put the amplicon in an overflow (unpooled) list of amplicons. The method may further comprise outputting the amplicon pools.

Such a method may help ensure that the PCR pools cover as much of the targets as do the candidate amplicons supplied as input. It may generate a small number of PCR pools (e.g., 2, 4, etc.). The primers in a pool will not interact, which may help avoid undesired preferential amplification, "race condition" competition for primer hybridization, and super-amplicons. Further, such a method may run very quickly and using only a reasonable amount of memory.

Figure 34:
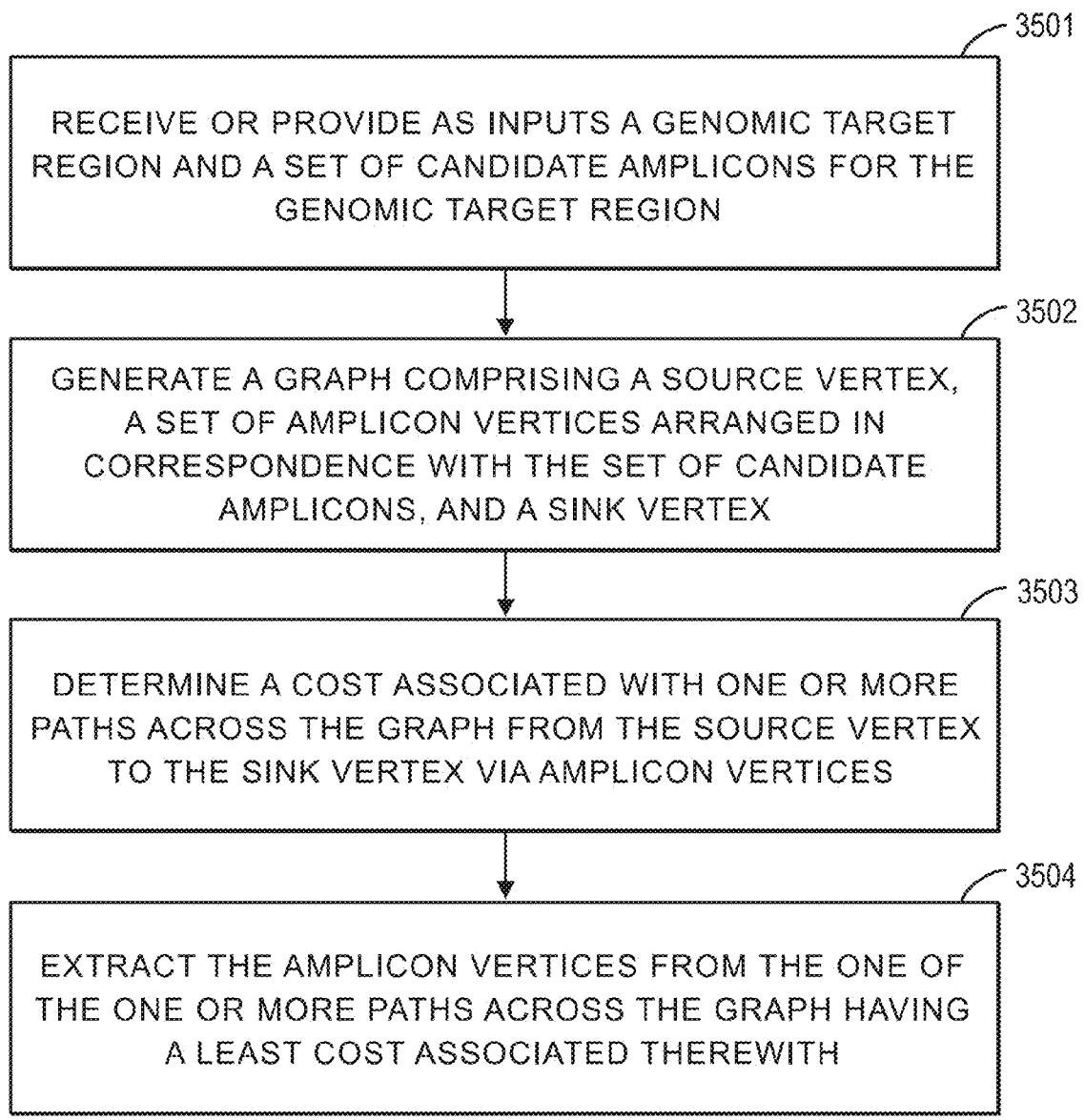
FIG. 34 illustrates a method according to an exemplary embodiment.

FIG. 34 illustrates a method for tiling according to an exemplary embodiment. In step 3501, a module or other hardware and/or software component receives or provides as inputs a genomic target region and a set of candidate amplicons for the genomic target region. In step 3502, a module or other hardware and/or software component generates a graph comprising a source vertex, a set of amplicon vertices arranged in correspondence with the set of candidate amplicons, and a sink vertex. In step 3503, a module or other hardware and/or software component determines a cost associated with one or more paths across the graph from the source vertex to the sink vertex via amplicon vertices. In step 3504, a module or other hardware and/or software component extracts the amplicon vertices from the one of the one or more paths across the graph having a least cost associated therewith. In some embodiments, such a method may be extended to a method for pooling amplicons across a plurality of pools by using as input the amplicons corresponding to the extracted vertices. For example, various steps such as described in FIG. 33 may be performed on amplicons corresponding to the extracted vertices to pool the amplicons.

According to an exemplary embodiment, there is provided a method comprising: (1) receiving or providing as inputs a genomic target region and a set of candidate amplicons for the genomic target region; (2) generating a graph comprising a source vertex, a set of amplicon vertices arranged in correspondence with the set of candidate amplicons, and a sink vertex; (3) determining a cost associated with one or more paths across the graph from the source vertex to the sink vertex via amplicon vertices; and (4) extracting the amplicon vertices from the one of the one or more paths across the graph having a least cost associated therewith.

In various embodiments, the one or more paths may comprise a sequence of amplicons wherein an ending portion of an insert of a first amplicon in the sequence of amplicons overlaps a beginning portion of an insert of a second amplicon in the sequence of amplicons. An ending portion of an insert of the second amplicon in the sequence of amplicons may overlap a beginning portion of an insert of a third amplicon in the sequence of amplicons. An ending portion of an insert of the third amplicon in the sequence of amplicons may overlap a beginning portion of an insert of a fourth amplicon in the sequence of amplicons.

In various embodiments, the one or more paths may comprise a sequence of N amplicons, N being a positive integer, wherein an ending portion of an insert of an amplicon amp in the sequence of amplicons overlaps a beginning portion of an insert of an amplicon amp+1 in the sequence of amplicons, wherein amp is an integer taking values $1, \ldots, N-1$. The one or more paths may comprise a sequence of $L=N+M$ amplicons, N and M being positive integers, wherein an ending portion of an insert of an amplicon amp in the sequence of amplicons overlaps (which may include merely touching) a beginning portion of an insert of an amplicon amp+1 in the sequence of amplicons where amp is an integer taking values $1, \ldots, N-1$; wherein an ending portion of an insert of an amplicon amp in the sequence of amplicons overlaps (which may include merely touching) a beginning portion of an insert of an amplicon amp+1 in the sequence of amplicons where amp is an integer taking values $N+1, \ldots, N+M-1$; and wherein there is a gap between an ending portion of an insert of amplicon amp=N and a beginning portion of an insert of amplicon amp=N+1.

In various embodiments, the cost associated with each of the one or more paths may be a sum of the cost of every edge of the path linking two amplicon vertices. The cost associated with every edge of the path linking two amplicon vertices may be a sum of a first term related to the cost of the edge's destination amplicon vertex and a second term related to the cost of an overlap between an insert of the edge's destination amplicon and an insert of the edge's origin amplicon. The first term and the second term may be weighed by a blending factor such that the first term is multiplied by the blending factor or a function thereof and the second term is multiplied by one minus the blending factor or a function thereof. The cost of an amplicon vertex may be a numerical value along a scale between a first value representing a lower level of one or more undesirable characteristics selected from a group comprising at least a level of off-target amplification and a level of primer-dimer propensity and a second value representing a higher level of the one or more undesirable characteristics. The cost of an overlap between an insert of the edge's destination amplicon and an insert of the edge's origin amplicon may be determined based on a redundancy introduced by overlapping inserts. The cost of an overlap between an insert of the edge's destination amplicon and an insert of the edge's origin amplicon may be a function of a quotient between a number of base pairs in an overlap between the insert of the edge's destination amplicon and the insert of the edge's origin amplicon and a number of base pairs in a union of the insert of the edge's destination amplicon and the insert of the edge's origin amplicon.

In various embodiments, such a method may further comprise determining a pooling of amplicons corresponding to the extracted amplicons into one or more pools of amplicons. Determining a pooling of amplicons may comprise limiting a number of amplicon pools and a capacity of each amplicon pool. Determining a pooling of amplicons may comprise limiting the number of amplicon pools to a threshold number between about 2 and about 5 and limiting the capacity of each amplicon pool to a threshold capacity between about 500 amplicons and about 2,500 amplicons, for example. Determining a pooling of amplicons may comprise limiting a size of any of the one or more pools based on a maximum size of other pools.

In various embodiments, determining a pooling of amplicons may comprise limiting an inclusion of one or more into a given pool based at least on a minimal threshold distance between amplicon sequences in the given pool. The minimal threshold distance may be between about 5 base pairs and about 100 base pairs, for example.

According to an exemplary embodiment, there is provided a non-transitory machine-readable storage medium comprising instructions which, when executed by a processor, cause the processor to perform a method comprising: (1) receiving or providing as inputs a genomic target region and a set of candidate amplicons for the genomic target region; (2) generating a graph comprising a source vertex, a set of amplicon vertices arranged in correspondence with the set of candidate amplicons, and a sink vertex; (3) determining a cost associated with one or more paths across the graph from the source vertex to the sink vertex via amplicon vertices; and (4) extracting the amplicon vertices from the one of the one or more paths across the graph having a least cost associated therewith. In some embodiments, such a method may be extended to a method for pooling amplicons across a plurality of pools by using as input the amplicons corresponding to the extracted vertices. For example, various steps such as described in FIG. 33 may be performed on amplicons corresponding to the extracted vertices to pool the amplicons.

In various embodiments, such a non-transitory machine-readable storage medium may comprise instructions which, when executed by a processor, cause the processor to perform a method further comprising determining a pooling of amplicons corresponding to the extracted amplicons into one or more pools of amplicons.

According to an exemplary embodiment, there is provided a system, comprising: (1) a machine-readable memory; and (2) a processor configured to execute machine-readable instructions, which, when executed by the processor, cause the system to perform steps including: (a) receiving or providing as inputs a genomic target region and a set of candidate amplicons for the genomic target region; (b) generating a graph comprising a source vertex, a set of amplicon vertices arranged in correspondence with the set of candidate amplicons, and a sink vertex; (c) determining a cost associated with one or more paths across the graph from the source vertex to the sink vertex via amplicon vertices; and (d) extracting the amplicon vertices from the one of the one or more paths across the graph having a least cost associated therewith. In some embodiments, such a system may be extended to a system for pooling amplicons across a plurality of pools by using as input the amplicons corresponding to the extracted vertices. For example, various steps such as described in FIG. 33 may be performed on amplicons corresponding to the extracted vertices to pool the amplicons.

In various embodiments, the processor of such a system may further be configured to execute machine-readable instructions, which, when executed by the processor, cause the system to perform steps including determining a pooling of amplicons corresponding to the extracted amplicons into one or more pools of amplicons.

According to various exemplary embodiments, one or more features of any one or more of the above-discussed teachings and/or exemplary embodiments may be performed or implemented using appropriately configured and/or programmed hardware and/or software elements. Determining whether an embodiment is implemented using hardware and/or software elements may be based on any number of factors, such as desired computational rate, power levels, heat tolerances, processing cycle budget, input data rates, output data rates, memory resources, data bus speeds, etc., and other design or performance constraints.

Examples of hardware elements may include processors, microprocessors, input(s) and/or output(s) (I/O) device(s) (or peripherals) that are communicatively coupled via a local interface circuit, circuit elements (e.g., transistors, resistors, capacitors, inductors, and so forth), integrated circuits, application specific integrated circuits (ASIC), programmable logic devices (PLD), digital signal processors (DSP), field programmable gate array (FPGA), logic gates, registers, semiconductor device, chips, microchips, chip sets, and so forth. The local interface may include, for example, one or more buses or other wired or wireless connections, controllers, buffers (caches), drivers, repeaters and receivers, etc., to allow appropriate communications between hardware components. A processor is a hardware device for executing software, particularly software stored in memory. The processor can be any custom made or commercially available processor, a central processing unit (CPU), an auxiliary processor among several processors associated with the computer, a semiconductor based microprocessor (e.g., in the form of a microchip or chip set), a macroprocessor, or generally any device for executing software instructions. A processor can also represent a distributed processing architecture. The I/O devices can include input devices, for example, a keyboard, a mouse, a scanner, a microphone, a touch screen, an interface for various medical devices and/or laboratory instruments, a bar code reader, a stylus, a laser reader, a radio-frequency device reader, etc. Furthermore, the I/O devices also can include output devices, for example, a printer, a bar code printer, a display, etc. Finally, the I/O devices further can include devices that communicate as both inputs and outputs, for example, a modulator/demodulator (modem; for accessing another device, system, or network), a radio frequency (RF) or other transceiver, a telephonic interface, a bridge, a router, etc.

Examples of software may include software components, programs, applications, computer programs, application programs, system programs, machine programs, operating system software, middleware, firmware, software modules, routines, subroutines, functions, methods, procedures, software interfaces, application program interfaces (API), instruction sets, computing code, computer code, code segments, computer code segments, words, values, symbols, or any combination thereof. A software in memory may include one or more separate programs, which may include ordered listings of executable instructions for implementing logical functions. The software in memory may include a system for identifying data streams in accordance with the present teachings and any suitable custom made or commercially available operating system (O/S), which may control the execution of other computer programs such as the system, and provides scheduling, input-output control, file and data management, memory management, communication control, etc.

According to various exemplary embodiments, one or more features of any one or more of the above-discussed teachings and/or exemplary embodiments may be performed or implemented using appropriately configured and/or programmed non-transitory machine-readable medium or article that may store an instruction or a set of instructions that, if executed by a machine, may cause the machine to perform a method and/or operations in accordance with the exemplary embodiments. Such a machine may include, for example, any suitable processing platform, computing platform, computing device, processing device, computing system, processing system, computer, processor, scientific or laboratory instrument, etc., and may be implemented using any suitable combination of hardware and/or software. The machine-readable medium or article may include, for example, any suitable type of memory unit, memory device, memory article, memory medium, storage device, storage article, storage medium and/or storage unit, for example, memory, removable or non-removable media, erasable or non-erasable media, writeable or re-writeable media, digital or analog media, hard disk, floppy disk, read-only memory compact disc (CD-ROM), recordable compact disc (CD-R), rewriteable compact disc (CD-RW), optical disk, magnetic media, magneto-optical media, removable memory cards or disks, various types of Digital Versatile Disc (DVD), a tape, a cassette, etc., including any medium suitable for use in a computer. Memory can include any one or a combination of volatile memory elements (e.g., random access memory (RAM, such as DRAM, SRAM, SDRAM, etc.)) and nonvolatile memory elements (e.g., ROM, EPROM, EEROM, Flash memory, hard drive, tape, CDROM, etc.). Moreover, memory can incorporate electronic, magnetic, optical, and/or other types of storage media. Memory can have a distributed architecture where various components are situated remote from one another, but are still accessed by the processor. The instructions may include any suitable type of code, such as source code, compiled code, interpreted code, executable code, static code, dynamic code, encrypted code, etc., implemented using any suitable high-level, low-level, object-oriented, visual, compiled and/or interpreted programming language.

According to various exemplary embodiments, one or more features of any one or more of the above-discussed teachings and/or exemplary embodiments may be performed or implemented at least partly using a distributed, clustered, remote, or cloud computing resource.

According to various exemplary embodiments, one or more features of any one or more of the above-discussed teachings and/or exemplary embodiments may be performed or implemented using a source program, executable program (object code), script, or any other entity comprising a set of instructions to be performed. When a source program, the program can be translated via a compiler, assembler, interpreter, etc., which may or may not be included within the memory, so as to operate properly in connection with the O/S. The instructions may be written using (a) an object oriented programming language, which has classes of data and methods, or (b) a procedural programming language, which has routines, subroutines, and/or functions, which may include, for example, C, C++, Pascal, Basic, Fortran, Cobol, Pert, Java, and Ada.

According to various exemplary embodiments, one or more of the above-discussed exemplary embodiments may include transmitting, displaying, storing, printing or outputting to a user interface device, a computer readable storage medium, a local computer system or a remote computer system, information related to any information, signal, data, and/or intermediate or final results that may have been generated, accessed, or used by such exemplary embodiments. Such transmitted, displayed, stored, printed or outputted information can take the form of searchable and/or filterable lists of runs and reports, pictures, tables, charts, graphs, spreadsheets, correlations, sequences, and combinations thereof, for example.

Various additional exemplary embodiments may be derived by repeating, adding, or substituting any generically or specifically described features and/or components and/or substances and/or steps and/or operating conditions set forth in one or more of the above-described exemplary embodiments. Further, it should be understood that an order of steps or order for performing certain actions is immaterial so long as the objective of the steps or action remains achievable, unless specifically stated otherwise. Furthermore, two or more steps or actions can be conducted simultaneously so long as the objective of the steps or action remains achievable, unless specifically stated otherwise. Moreover, any one or more feature, component, aspect, step, or other characteristic mentioned in one of the above-discussed exemplary embodiments may be considered to be a potential optional feature, component, aspect, step, or other characteristic of any other of the above-discussed exemplary embodiments so long as the objective of such any other of the above-discussed exemplary embodiments remains achievable, unless specifically stated otherwise.

Various additional exemplary embodiments may be derived by incorporating in the above described exemplary embodiments one or more of the features described in U.S. Pat. Appl. Publ. No. 2008/0228589 A1, published Sep. 18, 2008, and U.S. Pat. Appl. Publ. No. 2004/0175733 A1, published Sep. 9, 2004, the contents of both of which are incorporated by reference herein in their entireties.

In some embodiments, the amplified target sequences generated by the methods disclosed herein represent at least 60%, 70%, 80%, 90%, or more, of one or more exons amplified from the plurality of target sequences. In one embodiment, amplified target sequences of the present invention are about 90 to about 140 base pairs in length, about 100 to about 200 base pairs in length, about 100 to about 300 base pairs in length, or about 100 to about 400 base pairs in length. In one embodiment, the amplified target sequence includes the length of the forward primer and the length of the complementary reverse primer for each primer pair. In another embodiment, the amplified target sequence length includes the length of the reverse primer and the length of the complementary forward primer. In some embodiments, the length of the amplified target sequence minus the forward and reverse primer lengths is about 40 base pairs to about 350 base pairs. In some embodiments, the length of the amplified target sequences generated in the multiplex PCR reaction is substantially the same. As defined herein, "substantially the same" with respect to length of amplified target sequences generated via the methods disclosed herein refers to no more than 30% deviation in nucleotide length across the total number of amplified target sequences. In one embodiment, the percent GC content of an amplicon is less than 85%, less than 75%, less than 65%, less than 60%, or less than 50%. In one embodiment, substantially all amplified target sequences within a reaction contain between 30% and less than 85% GC content. In one embodiment, where the nucleic acid molecules are obtained from an archived or FFPE DNA sample, the length of the amplified target sequence is typically about 100 to about 200 base pairs in length. In one embodiment, if the nucleic acid sample is derived or obtained from genomic DNA, the length of the amplified target sequence can be about 100 to about 500 base pairs in length.

In some embodiments, the amplified target sequences of the disclosed methods can be used in various downstream analysis or assays with, or without, further purification or manipulation. For example, the amplified target sequences can be clonally amplified by techniques known in the art, such a bridge amplification or emPCR to generate a template library that can be used in next generation sequencing. In some embodiments, the amplified target sequences of the disclosed methods or the resulting template libraries can be used for single nucleotide polymorphism (SNP) analysis, genotyping or epigenetic analysis, copy number variation analysis, gene expression analysis, analysis of gene mutations including but not limited to detection, prognosis and/or diagnosis, detection and analysis of rare or low frequency allele mutations, nucleic acid sequencing including but not limited to de novo sequencing, targeted resequencing and synthetic assembly analysis. In one embodiment, amplified target sequences can be used to detect mutations at less than 5% allele frequency. In some embodiments, the methods disclosed herein can be used to detect mutations in a population of nucleic acids at less than 4%, 3%, 2% or at about 1% allele frequency. In another embodiment, amplified target sequences prepared as described herein can be sequenced to detect and/or identify germline or somatic mutations from a population of nucleic acid molecules.

In some embodiments, the forward and/or reverse target-specific primers in the target-specific primer pairs can be "complementary" or "substantially complementary" to the population of nucleic acid molecules. As termed herein "substantially complementary to the population of nucleic acid molecules" refers to percentage complementarity between the primer and the nucleic acid molecule to which the primer will hybridize. Generally, the term "substantially complementary" as used herein refers to at least 70% complementarity. Therefore, substantially complementary refers to a range of complementarity of at least 70% but less than 100% complementarity between the primer and the nucleic acid molecule. A complementary primer is one that possesses 100% complementarity to the nucleic acid molecule. In one embodiment, each target-specific primer pair is designed to minimize cross-hybridization to another primer (or primer pair) in the same multiple PCR reaction (i.e., reduce the prevalence of primer-dimers). In another embodiment, each target-specific primer pair is designed to minimize cross-hybridization to non-specific nucleic acid sequences in the population of nucleic acid molecules (i.e., minimize off-target hybridization). In one embodiment, each target-specific primer is designed to minimize self-complementarity, formation of hairpin structures or other secondary structures.

In some embodiments, the amplified target sequences are formed via polymerase chain reaction. Extension of target-specific primers can be accomplished using one or more DNA polymerases. In one embodiment, the polymerase can be any Family A DNA polymerase (also known as pol I family) or any Family B DNA polymerase. In some embodiments, the DNA polymerase can be a recombinant form capable of extending target-specific primers with superior accuracy and yield as compared to a non-recombinant DNA polymerase. For example, the polymerase can include a high-fidelity polymerase or thermostable polymerase. In some embodiments, conditions for extension of target-specific primers can include 'Hot Start' conditions, for example Hot Start polymerases, such as Amplitaq Gold® DNA polymerase (Applied Biosciences), Platinum® Taq DNA Polymerase High Fidelity (Invitrogen) or KOD Hot Start DNA polymerase (EMD Biosciences). Generally, a 'Hot Start' polymerase includes a thermostable polymerase and one or more antibodies that inhibit DNA polymerase and 3'-5' exonuclease activities at ambient temperature. In some instances, 'Hot Start' conditions can include an aptamer.

In some embodiments, the polymerase can be an enzyme such as Taq polymerase (from *Thermus aquaticus*), Tfi polymerase (from *Thermus filiformis*), Bst polymerase (from *Bacillus stearothermophilus*), Pfu polymerase (from *Pyrococcus furiosus*), Tth polymerase (from *Thermus thermophilus*), Pow polymerase (from *Pyrococcus woesei*), Tli polymerase (from *Thermococcus litoralis*), Ultima polymerase (from *Thermotoga maritima*), KOD polymerase (from *Thermococcus kodakaraensis*), Pol I and II polymerases (from *Pyrococcus abyssi*) and Pab (from *Pyrococcus abyssi*). In some embodiments, the DNA polymerase can include at least one polymerase such as Amplitaq Gold® DNA polymerase (Applied Biosciences), Stoffel fragment of Amplitaq® DNA Polymerase (Roche), KOD polymerase (EMD Biosciences), KOD Hot Start polymerase (EMD Biosciences), Deep Vent™ DNA polymerase (New England Biolabs), Phusion polymerase (New England Biolabs), Klentaq1 polymerase (DNA Polymerase Technology, Inc), Klentaq Long Accuracy polymerase (DNA Polymerase Technology, Inc), Omni Klen-Taq™ DNA polymerase (DNA Polymerase Technology, Inc), Omni KlenTaq™ LA DNA polymerase (DNA Polymerase Technology, Inc), Platinum® Taq DNA Polymerase (Invitrogen), Hemo Klentag™ (New England Biolabs), Platinum® Taq DNA Polymerase High Fidelity (Invitrogen), Platinum® Pfx (Invitrogen), Accuprime™ Pfx (Invitrogen), or Accuprime™ Taq DNA Polymerase High Fidelity (Invitrogen).

In some embodiments, the DNA polymerase can be a thermostable DNA polymerase. In some embodiments, the mixture of dNTPs can be applied concurrently, or sequentially, in a random or defined order. In some embodiments, the amount of DNA polymerase present in the multiplex reaction is significantly higher than the amount of DNA polymerase used in a corresponding single plex PCR reaction. As defined herein, the term "significantly higher" refers to an at least 3-fold greater concentration of DNA polymerase present in the multiplex PCR reaction as compared to a corresponding single plex PCR reaction.

In some embodiments, the amplification reaction does not include a circularization of amplification product, for example as disclosed by rolling circle amplification.

In some embodiments, the methods of the disclosure include selectively amplifying target sequences in a sample containing a plurality of nucleic acid molecules and ligating the amplified target sequences to at least one Adaptersadapters and/or barcode. Adapters and barcodes for use in molecular biology library preparation techniques are well known to those of skill in the art. The definitions of adapters and barcodes as used herein are consistent with the terms used in the art. For example, the use of barcodes allows for the detection and analysis of multiple samples, sources, tissues or populations of nucleic acid molecules per multiplex reaction. A barcoded and amplified target sequence contains a unique nucleic acid sequence, typically a short 6-15 nucleotide sequence, that identifies and distinguishes one amplified nucleic acid molecule from another amplified nucleic acid molecule, even when both nucleic acid molecules minus the barcode contain the same nucleic acid sequence. The use of adapters allows for the amplification of each amplified nucleic acid molecule in a uniformed manner and helps reduce strand bias. Adapters can include universal adapters or propriety adapters both of which can be used downstream to perform one or more distinct functions. For example, amplified target sequences prepared by the methods disclosed herein can be ligated to an adapter that may be used downstream as a platform for clonal amplification. The adapter can function as a template strand for subsequent amplification using a second set of primers and therefore allows universal amplification of the adapter-ligated amplified target sequence. In some embodiments, selective amplification of target nucleic acids to generate a pool of amplicons can further comprise ligating one or more barcodes and/or adapters to an amplified target sequence. The ability to incorporate barcodes enhances sample throughput and allows for analysis of multiple samples or sources of material concurrently. In one example, amplified target nucleic acid molecules prepared by the disclosed methods can be ligated to Ion Torrent™ Sequencing AdaptersAdapters (A and P1 Adaptersadapters, sold as a component of the Ion Fragment Library Kit, Life Technologies, Part No. 4466464) or Ion Torrent™ DNA Barcodes (Life Technologies, Part No. 4468654).

The methods disclosed herein are directed to the amplification of multiple target sequences via polymerase chain reaction (PCR). In some embodiments the multiplex PCR comprises hybridizing one or more target-specific primer pairs to a nucleic acid molecule, extending the primers of the target-specific primer pairs via template dependent synthesis in the presence of a DNA polymerase and dNTPs; repeating the hybridization and extension steps for sufficient time and sufficient temperature there generating a plurality of amplified target sequences. In some embodiments, the steps of the multiplex amplification reaction method can be performed in any order.

The amount of nucleic acid material required for successful multiplex amplification can be about 1 ng. In some embodiments, the amount of nucleic acid material can be about 10 ng to about 50 ng, about 10 ng to about 100 ng, or about 1 ng to about 200 ng of nucleic acid material. Higher amounts of input material can be used, however one aspect of the disclosure is to selectively amplify a plurality of target sequence from a low (ng) about of starting material.

The multiplex PCR amplification reactions disclosed herein can include a plurality of "cycles" typically performed on a thermocycler. Generally, each cycle includes at least one annealing step and at least one extension step. In one embodiment, a mutliplex PCR amplification reaction is performed wherein target-specific primer pairs are hybridized to a target sequence; the hybridized primers are extended generating an extended primer product/nucleic acid duplex; the extended primer product/nucleic acid duplex is denatured allowing the complementary primer to hybridize to the extended primer product, wherein the complementary primer is extended to generate a plurality of amplified target sequences. In one embodiment, the methods disclosed herein have about 5 to about 18 cycles per preamplification reaction. The annealing temperature and/or annealing duration per cycle can be identical; can include incremental increases or decreases, or a combination of both. The extension temperature and/or extension duration per cycle can be identical; can include incremental increases or decreases, or a combination of both. For example, the annealing temperature or extension temperature can remain constant per cycle. In some embodiments, the annealing temperature can remain constant each cycle and the extension duration can incrementally increase per cycle. In some embodiments, increases or decreases in duration can occur in 15 second, 30 second, 1 minute, 2 minute or 4 minute increments. In some embodiments, increases or decrease in temperature can occur as 0.5, 1, 2, 3, or 4 Celsius deviations. In some embodiments, the amplification reaction can be conducted using hot-start PCR techniques. These techniques include the use of a heating step (>60° C.) before polymerization begins to reduce the formation of undesired PCR products. Other techniques such as the reversible inactivation or physical separation of one or more critical reagents of the reaction, for example the magnesium or DNA polymerase can be sequestered in a wax bead, which melts as the reaction is heated during the denaturation step, releasing the reagent only at higher temperatures. The DNA polymerase can also be kept in an active state by binding to an aptamer or an antibody. This binding is disrupted at higher temperatures, releasing the functional DNA polymerase that can proceed with the PCR unhindered.

In some embodiments, the disclosed methods can optionally include destroying one or more primer-containing amplification artifacts, e.g., primer-dimers, dimer-dimers or super-amplicons. In some embodiments, the destroying can optionally include treating the primer and/or amplification product so as to cleave specific cleavable groups present in the primer and/or amplification product. In some embodiments, the treating can include partial or complete digestion of one or more target-specific primers. In one embodiment, the treating can include removing at least 40% of the target specific primer from the amplification product. The cleavable treatment can include enzymatic, acid, alkali, thermal, photo or chemical activity. The cleavable treatment can result in the cleavage or other destruction of the linkages between one or more nucleotides of the primer, or between one or more nucleotides of the amplification product. The primer and/or the amplification product can optionally include one or more modified nucleotides or nucleobases. In some embodiments, the cleavage can selectively occur at these sites, or adjacent to the modified nucleotides or nucleobases. In some embodiments, the cleavage or treatment of the amplified target sequence can result in the formation of a phosphorylated amplified target sequence. In some embodiments, the amplified target sequence is phosphorylated at the 5' terminus.

In some embodiments, the template, primer and/or amplification product includes nucleotides or nucleobases that can be recognized by specific enzymes. In some embodiments, the nucleotides or nucleobases can be bound by specific enzymes. Optionally, the specific enzymes can also cleave the template, primer and/or amplification product at one or more sites. In some embodiments, such cleavage can occur at specific nucleotides within the template, primer and/or amplification product. For example, the template, primer and/or amplification product can include one or more nucleotides or nucleobases including uracil, which can be recognized and/or cleaved by enzymes such as uracil DNA glycosylase (UDG, also referred to as UNG) or formamidopyrimidine DNA glycosylase (Fpg). The template, primer and/or amplification product can include one or more nucleotides or nucleobases including RNA-specific bases, which can be recognized and/or cleaved by enzymes such as RNAseH. In some embodiments, the template, primer and/or amplification product can include one or more abasic sites, which can be recognized and/or cleaved using various proofreading polymerases or apyrase treatments. In some embodiments, the template, primer and/or amplification product can include 7,8-dihydro-8-oxoguanine (8-oxoG) nucleobases, which can be recognized or cleaved by enzymes such as Fpg. In some embodiments, one or more amplified target sequences can be partially digested by a FuPa reagent.

In some embodiments, the primer and/or amplification product includes one or more modified nucleotides including bases that bind, e.g., base pair, with other nucleotides, for example nucleotides in a complementary nucleic acid strand, via chemical linkages. In some embodiments, the chemical linkages are subject to specific chemical attack that selectively cleaves the modified nucleotides (or selectively cleaves one or more covalent linkages between the modified nucleotides and adjacent nucleotides within the primer and/or amplification product) but leaves the other nucleotides unaffected. For example, in some embodiments modified nucleotides can form disulfite linkages with other nucleotides in a complementary strand. Such disulfite linkages can be oxidized via suitable treatments. Similarly, certain modified nucleotides can base pair with other nucleotides in a complementary nucleic acid strand through linkages that can be selectively disrupted via alkali treatment. In some embodiments, the primer and/or amplification product includes one or more modified nucleotides that bind, e.g., base pair, with other nucleotides in a complementary nucleic acid strand through linkages exhibiting decreased thermal stability relative to typical base pairing linkages formed between natural bases. Such reduced-thermal stability linkages can be selectively disrupted through exposure of the primer and/or amplification product to elevated temperatures following amplification.

An exemplary embodiment is depicted in FIG. 1, which depicts a schematic of degradable amplification primers. The amplification primers are bisulfite in design, with either a 5' universal forward amplification sequence linked to a 3' target-specific forward primer, or a 5' universal reverse amplification sequence linked to a 3' target-specific reverse primer. Both primers contain modified nucleotides.

In some embodiments, primers are synthesized that are complementary to, and can hybridize with, discrete segments of a nucleic acid template strand, including: a primer that can hybridize to the 5' region of the template, which encompasses a sequence that is complementary to either the forward or reverse amplification primer. In some embodiments, the forward primers, reverse primers, or both, share no common nucleic acid sequence, such that they hybridize to distinct nucleic acid sequences. For example, target-specific forward and reverse primers can be prepared that do not compete with other primer pairs within the primer pool to amplify the same nucleic acid sequence. In this example, primer pairs that do not compete with other primer pairs in the primer pool assist in the reduction of non-specific or spurious amplification products. In some embodiments, the forward and reverse primers of each primer pair are unique, in that the nucleotide sequence for each primer is non-complementary and non-identical to the other primer in the primer pair. In some embodiments, the primer pair can differ by at least 10%, at least 20%, at least 30%, at least 40%, at least 50%, at least 60%, at least 70%, at least 75%, at least 80%, at least 85%, or at least 90% nucleotide identity. In some embodiments, the forward and reverse primers in each primer pair are non-complementary or non-identical to other primer pairs in the primer pool or multiplex reaction. For example, the primer pairs within a primer pool or multiplex reaction can differ by at least 5%, at least 10%, at least 20%, at least 30%, at least 40%, at least 50%, at least 60%, or at least 70% nucleotide identity to other primer pairs within the primer pool or multiplex reaction. Generally, primers are designed to minimize the formation of primer-dimers, dimer-dimers or other non-specific amplification products. Typically, primers are optimized to reduce GC bias and low melting temperatures ($T_m$) during the amplification reaction. In some embodiments, the primers are designed to possess a $T_m$ of about 55° C. to about 72° C. In some embodiments, the primers of a primer pool can possess a $T_m$ of about 59° C. to about 70° C., 60° C. to about 68° C., or 60° C. to about 65° C. In some embodiments, the primer pool can possess a $T_m$ that does not deviate by more than 5° C.

In some embodiments, the target-specific primers do not contain a carbon-spacer or terminal linker In some embodiments, the target-specific primers or amplified target sequences do not contain an enzymatic, magnetic, optical or fluorescent label.

The template can include a 3' region that contains the sequence for either the upstream or downstream regions surrounding a particular gene or region of interest, such that the region of interest is bracketed by a forward amplification/ upstream gene-specific fusion, and a reverse amplification/ downstream region of interest fusion primer. In some embodiments, an internal separator sequence can separate the template regions that can hybridize to the amplification and gene-specific primers, and this may act as a key or barcode for subsequent downstream applications such as sequencing, etc. In some embodiments, a barcode or key can be incorporated into each of the amplification products to assist with data analysis and for example, cataloging. In some embodiments, the barcodes can be Ion Torrent™ DNA barcodes (Life Technologies).

In some embodiments, the primer includes a sufficient number of modified nucleotides to allow functionally complete degradation of the primer by the cleavage treatment, but not so many as to interfere with the primer's specificity or functionality prior to such cleavage treatment, for example in the amplification reaction. In some embodiments, the primer includes at least one modified nucleotide, but no greater than 75% of nucleotides of the primer are modified.

In some embodiments, multiple different primers including at least one modified nucleotide can be used in a single amplification reaction. For example, multiplexed primers including modified nucleotides can be added to the amplification reaction mixture, where each primer (or set of primers) selectively hybridizes to, and promotes amplification of different target nucleic acid molecules within the nucleic acid population. In some embodiments, different primer combinations can be added to the amplification reaction at plexy of at least about 24, 96, 384, 768, 1000, 2000, 3000, 6000 or 10000, or more (where "plexy" indicates the total number of different targets that can theoretically be amplified in a sequence-specific manner in the amplification reaction). In some embodiments, the modified primers contain at least one modified nucleotide near or at the termini of the primer. In some embodiments, the modified primers contain two or more modified nucleotides within the primer sequence. In an exemplary embodiment, the primer sequence contains a uracil near, or at, the termini of the primer sequence. For the purposes of this disclosure "near" or "at the termini" of the primer sequences refers up to 10 nucleotides from the termini of the primer sequence. In some embodiments, the primer sequence contains a uracil located at, or about, the center nucleotide position of the primer sequence. For the purposes of this disclosure "at, or about the center nucleotide position of the primer sequence" refers to the incorporation of a uracil moiety at the center nucleotide of the primer sequence or within eight nucleotides, in either a 3' or 5' direction flanking the center nucleotide. In one embodiment, the target-specific primer sequence can contain a modified nucleobase at or about the center nucleotide position and contain a modified nucleobase at the 3' and/or 5' terminus. In some embodiments, the length of the forward or reverse primer sequence can be about 15 to about 40 bases in length. In some embodiments, the $T_m$ of the primer sequence used in the multiplex reaction can be about 55° C. to about 72° C. In some embodiments, the primer pairs are designed to amplify sequences from the target nucleic acid molecules or amplicons that are about 100 base pairs to about 500 base pairs in length.

In some embodiments, the amplification reactions are conducted in parallel within a single reaction phase (for example, within the same amplification reaction mixture within a single tube). In some instances, an amplification reaction can generate a mixture of products including both the intended amplicon product as well as unintended, unwanted, nonspecific amplification artifacts such as primer-dimers. Post amplification, the reactions are then treated with any suitable agent that will selectively cleave or otherwise selectively destroy the nucleotide linkages of the modified nucleotides within the excess unincorporated primers and the amplification artifacts without cleaving or destroying the specification amplification products. For example, the primers can include uracil-containing nucleobases that can be selectively cleaved using UNG/UDG (optionally with heat and/or alkali). In some embodiments, the primers can include uracil-containing nucleotides that can be selectively cleaved using UNG and Fpg. In some embodiments, the cleavage treatment includes exposure to oxidizing conditions for selective cleavage of dithiols, treatment with RNAseH for selective cleavage of modified nucleotides including RNA-specific moieties (e.g., ribose sugars, etc.), and the like. This cleavage treatment can effectively fragment the original amplification primers and non-specific amplification products into small nucleic acid fragments that include relatively few nucleotides each. Such fragments are typically incapable of promoting further amplification at elevated temperatures. Such fragments can also be removed relatively easily from the reaction pool through the various post-amplification cleanup procedures known in the art (e.g., spin columns, NaEtOH precipitation, etc).

In some embodiments, amplification products following cleavage or other selective destruction of the nucleotide linkages of the modified nucleotides are optionally treated to generate amplification products that possess a phosphate at the 5' termini. In some embodiments, the phosphorylation treatment includes enzymatic manipulation to produce 5' phosphorylated amplification products. In one embodiment, enzymes such as polymerases can be used to generate 5' phosphorylated amplification products. For example, T4 polymerase can be used to prepare 5' phosphorylated amplicon products. Klenow can be used in conjunction with one or more other enzymes to produce amplification products with a 5' phosphate. In some embodiments, other enzymes known in the art can be used to prepare amplification products with a 5' phosphate group. For example, incubation of uracil nucleotide containing amplification products with the enzyme UDG, Fpg and T4 polymerase can be used to generate amplification products with a phosphate at the 5' termini. It will be apparent to one of skill in the art that other techniques, other than those specifically described herein, can be applied to generate phosphorylated amplicons. It is understood that such variations and modifications that are applied to practice the methods, systems, kits, compositions and apparatuses disclosed herein, without resorting to undue experimentation are considered within the scope of the disclosure.

In some embodiments, primers that are incorporated in the intended (specific) amplification products, these primers are similarly cleaved or destroyed, resulting in the formation of "sticky ends" (e.g., 5' or 3' overhangs) within the specific amplification products. Such "sticky ends" can be addressed in several ways. For example, if the specific amplification products are to be cloned, the overhang regions can be designed to complement overhangs introduced into the cloning vector, thereby enabling sticky ended ligations that are more rapid and efficient than blunt ended ligations. Alternatively, the overhangs may need to be repaired (as with several next-generation sequencing methods). Such repair can be accomplished either through secondary amplification reactions using only forward and reverse amplification primers (in the embodiment shown in FIG. 1, this corresponds to A and P1 primers) comprised of only natural bases. In this manner, subsequent rounds of amplification rebuild the double-stranded templates, with nascent copies of the amplicon possessing the complete sequence of the original strands prior to primer destruction. Alternatively, the sticky ends can be removed using some forms of fill-in and ligation processing, wherein the forward and reverse primers are annealed to the templates. A polymerase can then be employed to extend the primers, and then a ligase, optionally a thermostable ligase, can be utilized to connect the resulting nucleic acid strands. This could obviously be also accomplished through various other reaction pathways, such as cyclical extend-ligation, etc. In some embodiments, the ligation step can be performed using one or more DNA ligases.

The amplification reaction can include any reaction that increases the copy number of a nucleic acid molecule, optionally in a cyclical fashion, and can include without limitation isothermal amplification (for example, rolling circle amplification or isothermal amplification as described in U.S. Provisional Application Nos. 61/424,599, 61/445,324 and 61/451,919, hereby incorporated by reference in their entireties), amplification using thermocycling, and the like.

In some embodiments, the disclosure generally relates to methods for single-tube multiplex PCR. In some embodiments, the method for single-tube multiplex PCR can include target-specific or exon-specific primers. In some embodiments, the exon-specific or target-specific primers can include at least one uracil nucleotide. In some embodiments, single-tube multiplex PCR can include selective amplification of at least 1000, 2000, 3000, 4000, 5000, 6000 or more target nucleic acid molecules using target-specific or exon-specific uracil based primers.

In some embodiments, the disclosure relates generally to methods for generating a target-specific or exon-specific amplicon library. In some embodiments, the amplicon library generated using target-specific or exon-specific primers can be associated with mutations of human cancers. In some embodiments, the mutations can be in the KRAS, BRAF and/or EGFR genes. In some embodiments, the amplicon library can be generated from genomic DNA or formalin-fixed, paraffin-embedded (FFPE) tissue. In some embodiments, the amplicons of the amplicon library prepared using the methods disclosed herein can be about 100 to about 300 base pairs in length, about 100 to about 250 base pairs in length, about 120 to about 220 base pairs in length or about 135 to about 205 base pairs in length. In some embodiments, the amplicon library can be prepared using primer pairs that are targeted to cancer specific mutations. In some embodiments, the primer pairs can be directed to non-cancer related mutations, such as inherited diseases, e.g., cystic fibrosis and the like. In some embodiments, the primer pairs can be used to generate amplicons that once sequenced by any sequencing platform, including semi-conductor sequencing technology can be used to detect genetic mutations such as inversion, deletions, point mutations and variations in copy number.

In some embodiments, the primer pairs used to produce an amplicon library can result in the amplification of target-specific nucleic acid molecules possessing one or more of the following metrics: greater than 97% target coverage at 20× if normalized to 100× average coverage depth; greater than 97% of bases with greater than 0.2× mean; greater than 90% base without strand bias; greater than 95% of all reads on target; greater than 99% of bases with greater than 0.01× mean; and greater than 99.5% per base accuracy.

In some embodiments, the amplicon library can be used to detect and/or identify known mutations or de novo mutations in a sample.

In some embodiments, the amplicon library prepared using target-specific primer pairs can be used in downstream enrichment applications such as emulsion PCR or bridge PCR. In some embodiments, the amplicon library can be used in an enrichment application and a sequencing application.

For example, an amplicon library can be sequenced using any suitable DNA sequencing platform. In some embodiments, an amplicon library can be sequenced using an Ion Torrent PGM Sequencer (Life Technologies). In some embodiments, a PGM sequencer can be coupled to server that applies parameters or software to determine the sequence of the amplified target nucleic acid molecules. In some embodiments, the amplicon library can be prepared, enriched and sequenced in less than 24 hours. In some embodiments, the amplicon library can be prepared, enriched and sequenced in approximately 9 hours. In some embodiments, an amplicon library can be a paired library, that is, a library that contains amplicons from a tumor sample and amplicons from a non-diseased sample. Each pair can be aligned, to detect and/or identify mutations present in the target nucleic acid molecules.

In some embodiments, methods for generating an amplicon library can include: amplifying genomic DNA targets using exon-specific or target-specific primers to generate amplicons; purifying the amplicons from the input DNA and primers; phosphorylating the amplicons; ligating Adaptersadapters to the phosphorylated amplicons; purifying the ligated amplicons; nick-translating the amplified amplicons; and purifying the nick-translated amplicons to generate the amplicon library. In some embodiments, additional amplicon library manipulations can be conducted following the step of amplification of genomic DNA targets to generate the amplicons. In some embodiments, any combination of additional reactions can be conducted in any order, and can include: purifying; phosphorylating; ligating Adaptersadapters; nick-translating; amplification and/or sequencing. In some embodiments, any of these reactions can be omitted or can be repeated. It will be readily apparent to one of skill in the art that the method can repeat or omit any one or more of the above steps. It will also be apparent to one of skill in the art that the order and combination of steps may be modified to generate the required amplicon library, and is not therefore limited to the exemplary methods provided.

A phosphorylated amplicon can be joined to an adapter to conduct a nick translation reaction, subsequent downstream amplification (e.g., template preparation), or for attachment to particles (e.g., beads), or both. For example, an adapter that is joined to a phosphorylated amplicon can anneal to an oligonucleotide capture primer which is attached to a particle, and a primer extension reaction can be conducted to generate a complementary copy of the amplicon attached to the particle or surface, thereby attaching an amplicon to a surface or particle. AdaptersAdapters can have one or more amplification primer hybridization sites, sequencing primer hybridization sites, barcode sequences, and combinations thereof. In some embodiments, amplicons prepared by the methods disclosed herein can be joined to one or more Ion Torrent™ compatible Adaptersadapters to construct an amplicon library. Amplicons generated by such methods can be joined to one or more Adaptersadapters for library construction to be compatible with a next generation sequencing platform. For example, the amplicons produced by the teachings of the present disclosure can be attached to Adaptersadapters provided in the Ion Fragment Library Kit (Life Technologies, Catalog No. 4466464).

In some embodiments, amplification of genomic DNA targets (such as high molecular weight DNA) or FFPE samples can be conducted using a 2×AmpliSeq Hi Fi Master Mix. In some embodiments, the AmpliSeq Hi Fi Master Mix can include glycerol, dNTPs, and a DNA polymerase, such as Platinum® Taq DNA polymerase High Fidelity. In some embodiments, the 2×AmpliSeq Hi Fi Master Mix can further include at least one of the following: a preservative, magnesium sulfate, tris-sulfate and/or ammonium sulfate.

In some embodiments, amplification of genomic DNA targets (such as high molecular weight DNA) or FFPE samples can be conducted using a 5× Ion AmpliSeq Hi Fi Master Mix. In some embodiments, the 5× Ion AmpliSeq Hi Fi Master Mix can include glycerol, dNTPs, and a DNA polymerase such as Platinum® Taq DNA polymerase High Fidelity. In some embodiments, the 5× Ion AmpliSeq Hi Fi Master Mix can further include at least one of the following: a preservative, magnesium chloride, magnesium sulfate, tris-sulfate and/or ammonium sulfate.

In some embodiments, phosphorylation of the amplicons can be conducted using a FuP reagent. In some embodiments, the FuP reagent can include a DNA polymerase, a DNA ligase, at least one uracil cleaving or modifying enzyme, and/or a storage buffer. In some embodiments, the FuP reagent can further include at least one of the following: a preservative and/or a detergent.

In some embodiments, phosphorylation of the amplicons can be conducted using a FuPa reagent. In some embodiments, the FuPa reagent can include a DNA polymerase, at least one uracil cleaving or modifying enzyme, an antibody and/or a storage buffer. In some embodiments, the FuPa reagent can further include at least one of the following: a preservative and/or a detergent. In some embodiments, the antibody is provided to inhibit the DNA polymerase and 3'-5' exonuclease activities at ambient temperature.

In some embodiments, the amplicon library produced by the teachings of the present disclosure are sufficient in yield to be used in a variety of downstream applications including the Ion Xpress™ Template Kit using an Ion Torrent™ PGM system (e.g., PCR-mediated addition of the nucleic acid fragment library onto Ion Sphere™ Particles) (Life Technologies, Part No. 4467389). For example, instructions to prepare a template library from the amplicon library can be found in the Ion Xpress Template Kit User Guide (Life Technologies, Part No. 4465884). Instructions for loading the subsequent template library onto the Ion Torrent™ Chip for nucleic acid sequencing are described in the Ion Sequencing User Guide (Part No. 4467391). In some embodiments, the amplicon library produced by the teachings of the present disclosure can be used in paired end sequencing (e.g., paired-end sequencing on the Ion Torrent™ PGM system (Life Technologies, Part No. MAN0006191).

It will be apparent to one of ordinary skill in the art that numerous other techniques, platforms or methods for clonal amplification such as wildfire PCR and bridge amplification can be used in conjunction with the amplified target sequences of the present disclosure. It is also envisaged that one of ordinary skill in art upon further refinement or optimization of the conditions provided herein can proceed directly to nucleic acid sequencing (for example using the Ion Torrent PGM™ or Proton™ sequencers, Life Technologies) without performing a clonal amplification step.

In some embodiments, at least one of the amplified targets sequences to be clonally amplified can be attached to a support or particle. The support can be comprised of any suitable material and have any suitable shape, including, for example, planar, spheroid or particulate. In some embodiments, the support is a scaffolded polymer particle as described in U.S. Published App. No. 20100304982, hereby incorporated by reference in its entirety.

In some embodiments, nucleic acid sequencing of the amplified target sequences produced by the teachings of this disclosure include de novo sequencing or targeted resequencing. In some embodiments, nucleic acid sequencing further includes comparing the nucleic acid sequencing results of the amplified target sequences against a reference nucleic acid sample. In some embodiments, the reference sample can be normal tissue or well documented tumor sample. In some embodiments, nucleic acid sequencing of the amplified target sequences further includes determining the presence or absence of a mutation within the nucleic acid sequence. In some embodiments, the method further includes correlating the presence of a mutation with drug susceptibly, prognosis of treatment and/or organ rejection. In some embodiments, nucleic acid sequencing includes the identification of genetic markers associated with cancer and/or inherited diseases. In some embodiments, nucleic acid sequencing includes the identification of copy number variation in a sample under investigation.

In some embodiments, a kit is provided for amplifying multiple target sequences from a population of nucleic acid molecules in a single reaction. In some embodiments, the kit includes a plurality of target-specific primer pairs containing one or more cleavable groups, one or more DNA polymerases, a mixture of dNTPs and at least one cleaving reagent. In one embodiment, the cleavable group can be 8-oxo-deoxyguanosine, deoxyuridine or bromodeoxyuridine. In some embodiments, the at least one cleaving reagent includes RNaseH, uracil DNA glycosylase, Fpg or alkali. In one embodiment, the cleaving reagent can be uracil DNA glycosylase. In some embodiments, the kit is provided to perform multiplex PCR in a single reaction chamber or vessel. In some embodiments, the kit includes at least one DNA polymerase, which can be a thermostable DNA polymerase. In some embodiments, the concentration of the one or more DNA polymerases is present in a 3-fold excess as compared to a single PCR reaction. In some embodiments, the final concentration of each target-specific primer pair is present at about 25 nM to about 50 nM. In one embodiment, the final concentration of each target-specific primer pair can be present at a concentration that is 50% lower than conventional single plex PCR reactions. In some embodiments, the kit provides amplification of at least 100, 500, 1000, 3000, 6000, 10000, 12000, or more, target sequences from a population of nucleic acid molecules in a single reaction chamber.

In some embodiments, the kit further comprises one or more adapters, barcodes, and/or antibodies.

The following description of various exemplary embodiments is exemplary and explanatory only and is not to be construed as limiting or restrictive in any way. Other embodiments, features, objects, and advantages of the present teachings will be apparent from the description and accompanying drawings, and from the claims.

Although the present description described in detail certain exemplary embodiments, other embodiments are also possible and within the scope of the present invention. Variations and modifications will be apparent to those skilled in the art from consideration of the specification and figures and practice of the teachings described in the specification and figures, and the claims.

EXAMPLES

Example 1

Library Preparation

PCR Amplify Genomic DNA Targets

Figure 5:
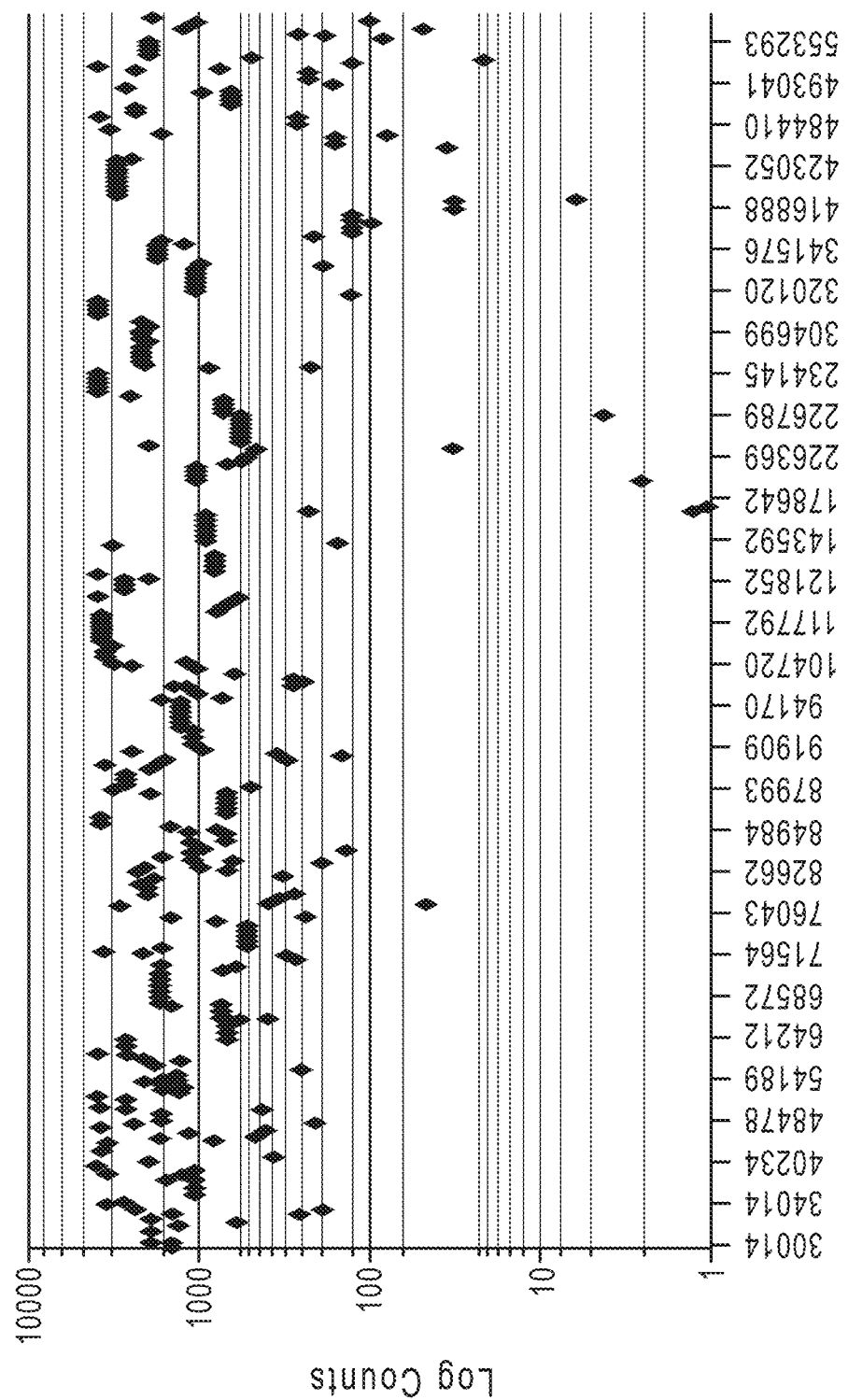
FIG. 5 shows quantification of the abundance and reproducibility of an exemplary multiplex reaction on genomic DNA using primer set HSMv12. The data is averaged across individual 3 runs performed on an Ion Torrent PGM™ Sequencer (Life Technologies). The level of coverage per amplicon is provided as Log of Counts.

A multiplex polymerase chain reaction was performed to amplify 384 individual amplicons across a genomic DNA sample. A pool of greater than 32,000 primers was originally developed covering more than 300 genes. A representative list of genes that were incorporated for investigation while synthesizing the initial primer pool is provided in Table 1 (found in U.S. Ser. No. 13/458,739, filed Apr. 27, 2012, hereby incorporated by reference in its entirety). A sub-set of the primer pool known as "HSMv12" was used to generate the data presented in FIG. 5 (primers from HSMv12 are presented in Table 2 (found in U.S. Ser. No. 13/458,739, filed Apr. 27, 2012, hereby incorporated by reference in its entirety)). Each primer pair in the primer pool was designed to contain at least one uracil nucleotide near the terminus of each forward and reverse primer. Each primer pair was also designed to selectively hybridize to, and promote amplification of a specific gene or gene fragment of the genomic DNA sample.

To a single well of a 96-well PCR plate was added 5 microliters of HSMv12 Primer Pool containing 384 primer pairs at a concentration of 15 μM in TE, 10-50 ng genomic DNA and 10 microliters of an amplification reaction mixture (2×AmpliSeq HiFi Master Mix) that can include glycerol, dNTPs, and Platinum® Taq High Fidelity DNA Polymerase (Invitrogen, Catalog No. 11304) to a final volume of 20 microliters with DNase/RNase Free Water (Life Technologies, CA, Part No. 600004).

The PCR plate was sealed and loaded into a thermal cycler (GeneAmp® PCR system 9700 Dual 96-well thermal cycler (Life Technologies, CA, Part No. N8050200 and 4314445)) and run on the following temperate profile to generate the preamplified amplicon library.

An initial holding stage was performed at 98° C. for 2 minutes, followed by 16 cycles of denaturing at 98° C. for 15 seconds and an annealing and extending stage at 60° C. for 4 minutes. After cycling, the preamplified amplicon library was held at 4° C. until proceeding to the purification step outlined below. A schematic of an exemplary library amplification process is shown in FIG. 2.

Purify the Amplicons from input DNA and Primers

Two rounds of Agencourt® AMPure® XP Reagent (Beckman Coulter, CA) binding, wash, and elution at 0.6× and 1.2× volume ratios were found to remove genomic DNA and unbound or excess primers. The amplification and purification step outlined herein produces amplicons of about 100 bp to about 600 bp in length.

In a 1.5 ml LoBind tube (Eppendorf, Part No. 022431021), the preamplified amplicon library (20 microliters) was combined with 12 microliters (0.6× volumes) of Agencourt® AMPure® XP reagent (Beckman Coulter, CA). The bead suspension was pipetted up and down to thoroughly mix the bead suspension with the preamplified amplicon library. The sample was then pulse-spin and incubated for 5 minutes at room temperature.

The tube containing the sample was placed on a magnetic rack such as a DynaMag™-2 spin magnet (Life Technologies, CA, Part No. 123-21D) for 2 minutes to capture the beads. Once the solution cleared, the supernatant was transferred to a new tube, where 24 microliters (1.2× volume) of Agencourt® AMPure® XP beads (Beckman Coulter, CA) were added to the supernatant. The mixture was pipetted to ensure the bead suspension mixed with the preamplified amplicon library. The sample was then pulse-spin and incubated at room temperature for 5 minutes. The tube containing the sample was placed on the magnetic rack for 2 minutes to capture the beads. Once the solution cleared, the supernatant was carefully discarded without disturbing the bead pellet. The desired preamplified amplicon library was now bound to the beads. Without removing the tube from the magnetic rack, 200 microliters of freshly prepared 70% ethanol was introduced into the sample. The sample was incubated for 30 seconds while gently rotating the tube on the magnetic rack. After the solution cleared, the supernatant was discarded without disturbing the pellet. A second ethanol wash was performed and the supernatant discarded. Any remaining ethanol was removed by pulse-spinning the tube and carefully removing residual ethanol while not disturbing the pellet. The pellet was air-dried for about 5 minutes at room temperature.

Once the tube was dry, the tube was removed from the magnetic rack and 20 microliters of DNase/RNase Free Water was added (Life Technologies, CA, Part No. 600004). The tube was vortexed and pipetted to ensure the sample was mixed thoroughly. The sample was pulse-spin and placed on the magnetic rack for two minutes. After the solution cleared, the supernatant containing the eluted DNA was transferred to a new tube.

Phosphorylate the Amplicons

To the eluted DNA (~20 microliters), 3 microliters of DNA ligase buffer (Invitrogen, Catalog No. 15224041), 2 microliters dNTP mix, and 2 microliters of FuP reagent were added. The reaction mixture was mixed thoroughly to ensure uniformity and incubated at 37° C. for 10 minutes.

Ligate Adpaters to the Amplicons and Purify the Ligated Amplicons

After incubation, the reaction mixture proceeded directly to a ligation step. Here, the reaction mixture now containing the phosphorylated amplicon library was combined with 1 microliter of A/P1 Adaptersadapters (20 um each) (sold as a component of the Ion Fragment Library Kit, Life Technologies, Part No. 4466464) and 1 microliter of DNA ligase (sold as a component of the Ion Fragment Library Kit, Life Technologies, Part No. 4466464), and incubated at room temperature for 30 minutes.

After the incubation step, 52 microliters (1.8× sample volume) of AgenCourt® AMPure® Reagent (Beckman Coulter, CA) was added to the ligated DNA. The mixture was pipetted thoroughly to mix the bead suspension with the ligated DNA. The mixture was pulse-spin and incubated at room temperature for 5 minutes. The samples underwent another pulse-spin and were placed on a magnetic rack such as a DynaMag™-2 spin magnet (Life Technologies, CA, Part No. 123-21D) for two minutes. After the solution had cleared, the supernatant was discarded. Without removing the tube from the magnetic rack, 200 microliters of freshly prepared 70% ethanol was introduced into the sample. The sample was incubated for 30 seconds while gently rotating the tube on the magnetic rack. After the solution cleared, the supernatant was discarded without disturbing the pellet. A second ethanol wash was performed and the supernatant discarded. Any remaining ethanol was removed by pulse-spinning the tube and carefully removing residual ethanol while not disturbing the pellet. The pellet was air-dried for about 5 minutes at room temperature.

The pellet was resuspended in 20 microliters of DNase/RNase Free Water (Life Technologies, CA, Part No. 600004) and vortexed to ensure the sample was mixed thoroughly. The sample was pulse-spin and placed on the magnetic rack for two minutes. After the solution cleared, the supernatant containing the ligated DNA was transferred to a new Lobind tube (Eppendorf, Part No. 022431021).

Nick Translate and Amplify the Amplicon Library and Purify the Library

The ligated DNA (~20 microliters) was combined with 76 microliters of Platinum® PCR SuperMix High Fidelity (Life Technologies, CA, Part No. 12532-016, sold as a component of the Ion Fragment Library Kit, Life Technologies, Part No. 4466464) and 4 microliters of Library Amplification Primer Mix (5 μM each) (Life Technologies, CA, Part No. 602-1068-01, sold as a component of the Ion Fragment Library Kit, Life Technologies, Part No. 4466464), the mixture was pipetted thoroughly to ensure a uniformed solution. The solution was applied to a single well of a 96-well PCR plate and sealed. The plate was loaded into a thermal cycler (GeneAmp® PCR system 9700 Dual 96-well thermal cycler (Life Technologies, CA, Part No. N8050200 and 4314445)) and run on the following temperate profile to generate the final amplicon library.

A nick-translation was performed at 72° C. for 1 minute, followed by an enzyme activation stage at 98° C. for 2 minutes, followed by 5-10 cycles of denaturing at 98° C. for 15 seconds and an annealing and extending stage at 60° C. for 1 minute. After cycling, the final amplicon library was held at 4° C. until proceeding to the final purification step outlined below.

In a 1.5 ml LoBind tube (Eppendorf, Part No. 022431021), the final amplicon library (~100 microliters) was combined with 180 microliters (1.8× sample volume) of Agencourt® AMPure® XP reagent (Beckman Coulter, CA). The bead suspension was pipetted up and down to thoroughly mix the bead suspension with the final amplicon library. The sample was then pulse-spin and incubated for 5 minutes at room temperature.

The tube containing the final amplicon library was placed on a magnetic rack such as a DynaMag™-2 spin magnet (Life Technologies, CA, Part No. 123-21D) for 2 minutes to capture the beads. Once the solution cleared, the supernatant was carefully discarded without disturbing the bead pellet. Without removing the tube from the magnetic rack, 400 microliters of freshly prepared 70% ethanol was introduced into the sample. The sample was incubated for 30 seconds while gently rotating the tube on the magnetic rack. After the solution cleared, the supernatant was discarded without disturbing the pellet. A second ethanol wash was performed and the supernatant discarded. Any remaining ethanol was removed by pulse-spinning the tube and carefully removing residual ethanol while not disturbing the pellet. The pellet was air-dried for about 5 minutes at room temperature.

Once the tube was dry, the tube was removed from the magnetic rack and 20 microliters of Low TE was added (Life Technologies, CA, Part No. 602-1066-01). The tube was pipetted and vortexed to ensure the sample was mixed thoroughly. The sample was pulse-spin and placed on the magnetic rack for two minutes. After the solution cleared, the supernatant containing the final amplicon library was transferred to a new Lobind tube (Eppendorf, Part No. 022431021).

Assess the Library Size Distribution and Determine the Template Dilution Factor

The final amplicon library was quantitated to determine the library dilution (Template Dilution Factor) that results in a concentration within the optimized target range for Template Preparation (e.g., PCR-mediated addition of library molecules onto Ion Sphere™ Particles). The final amplicon library is typically quantitated for downstream Template Preparation procedure using an Ion Library Quantitation Kit (qPCR) (Life Technologies, Part No. 4468802) and/or a Bioanalyzer™ (Agilent Technologies, Agilent 2100 Bioanalyzer) to determine the molar concentration of the amplicon library, from which the Template Dilution Factor is calculated. For example, instructions to determine the Template Dilution Factor by quantitative real-time PCR (qPCR) can be found in the Ion Library Quantitation Kit User Guide (Life Technologies, Part No. 4468986).

In this example, 1 microliter of the final amplicon library preparation was analyzed on the 2100 Bioanalyzer™ with an Agilent High Sensitivity DNA Kit (Agilent Technologies, Part No. 5067-4626) to generate peaks in the 135-205 bp size range and at a concentration of about $5 \times 10^9$ copies per microliter.

Proceed to Template Preparation

An aliquot of the final library was used to prepare DNA templates that were clonally amplified on Ion Sphere™ Particles using emulsion PCR (emPCR). The preparation of template in the instant example was prepared according to the manufacturer's instructions using an Ion Xpress Template Kit (Life Technologies, Part No. 4466457). Once template-positive Ion Sphere Particles were enriched, an aliquot of the Ion Spheres were loaded onto an Ion 314TH Chip (Life Technologies, Part No. 4462923) as described in the Ion Sequencing User Guide (Part No. 4467391), and subjected to analysis and sequencing as described in the Ion Torrent PGM Sequencer User Guide (Life Technologies, Part No. 4462917). The data obtained from this example is provided in FIG. 5.

Example 2

Optimizing Multiplex Reactions to Minimize GC Bias

This example demonstrates that optimizing multiplex PCR reactions performed under the guidance of the exemplary library amplification process described in Example 1 help to minimize GC bias.

In this example, a low-plex sample containing 94 primer pairs of target-specific primers and a high-plex sample containing 380 primer pairs of target-specific primers were prepared from across the human genome. Each low-plex and high plex sample was subjected to library amplification as described in Example 1. The melting temperature of amplicon products was observed to correlate with GC content of the amplicon assay (FIG. 4A-4H). The high multiplex (384-plex) sample with high GC content (i.e., 80%) was observed to have a higher melting temperature than the corresponding 94-plex sample (FIG. 4A-4H). Additionally, high-plex samples with highest GC content (75% and 80%) were observed to possess a single predominant peak, the amplicon product (connected to X-axis via dotted line), in contrast to other non-specific amplification products (observed as additional peaks and noise across the X-axis). The low-plex samples containing highest GC content (75% and 80%) were found to form multiple peaks along the X-axis suggesting the formation of a substantial amount of non-specific amplification products in addition to the desired amplicons. This example demonstrates that high-multiplex PCR reactions (394-plex) can be successfully optimized, for example through primer design, to increase the melting temperature of the desired amplicon product, increase the amount of amplicon specific product generated, and decrease the formation of amplification artifacts.

Example 3

Optimizing Primer Design to Reduce Non-Specific Amplification

Figure 3A:
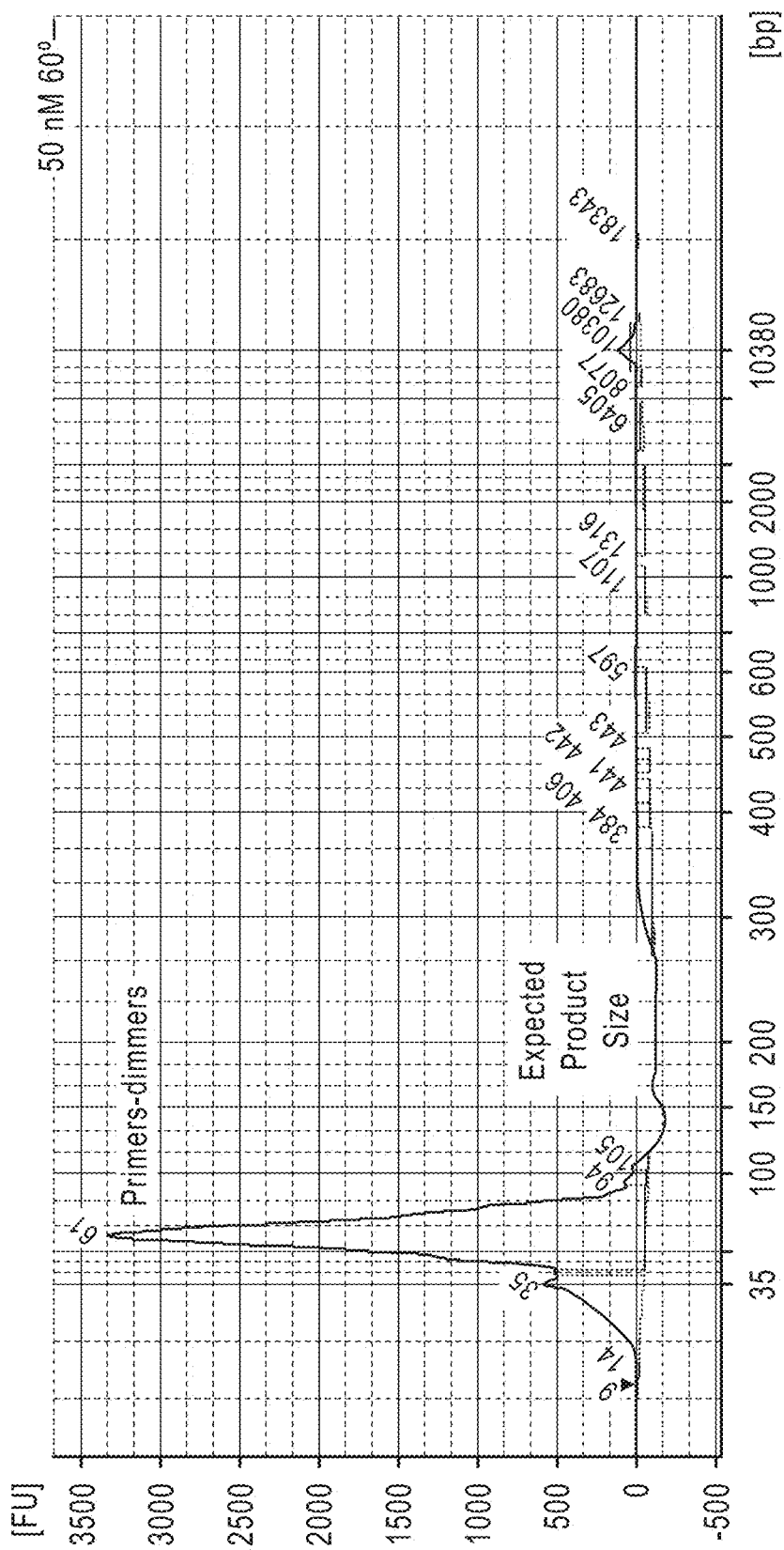
FIG. 3A-FIG. 3B show examples of elution profiles for exemplary unmodified and modified primer pools.
Figure 3B:
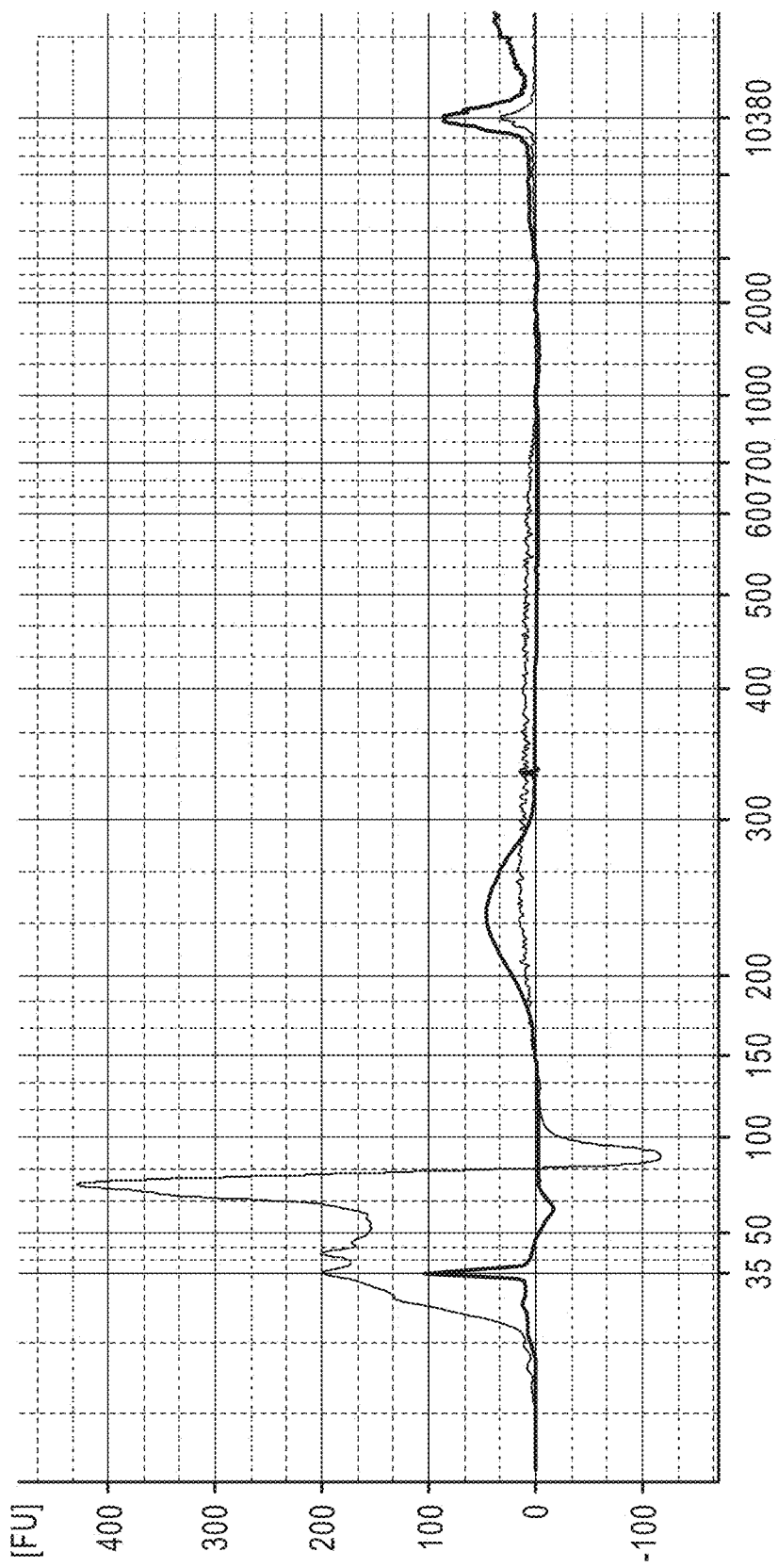
Figure 4B:
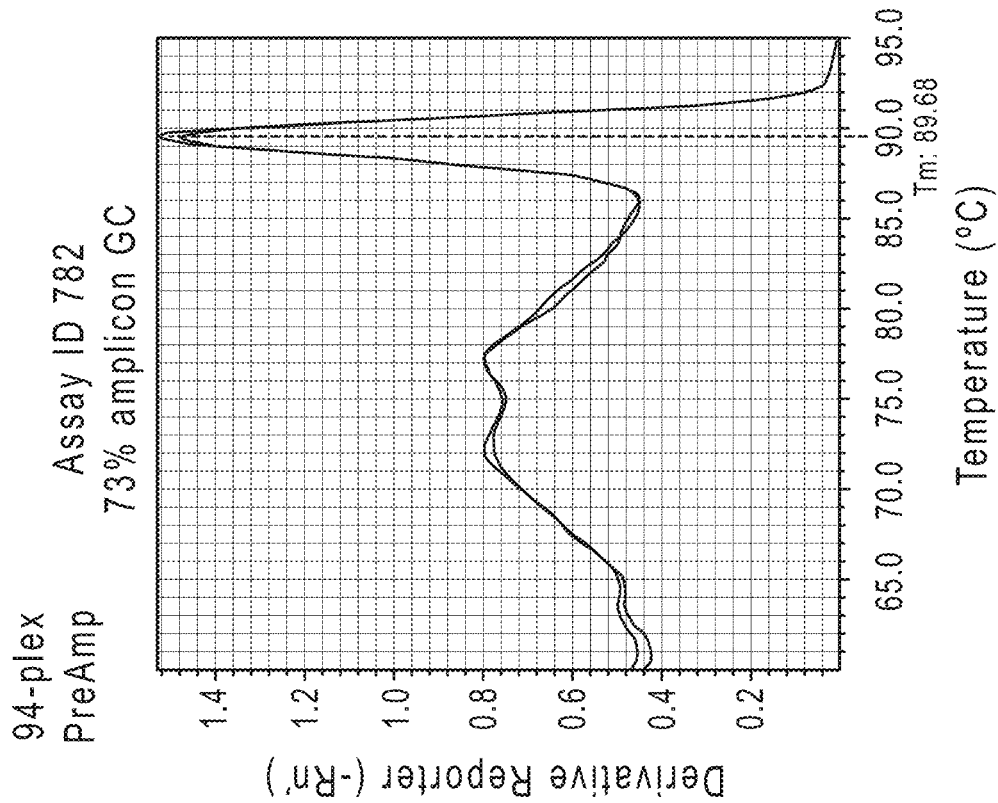
FIG. 4A-FIG. 4H show the effect of increasing amplicon GC content in both an exemplary 94-plex and an exemplary 380-plex reaction.
Figure 4A:
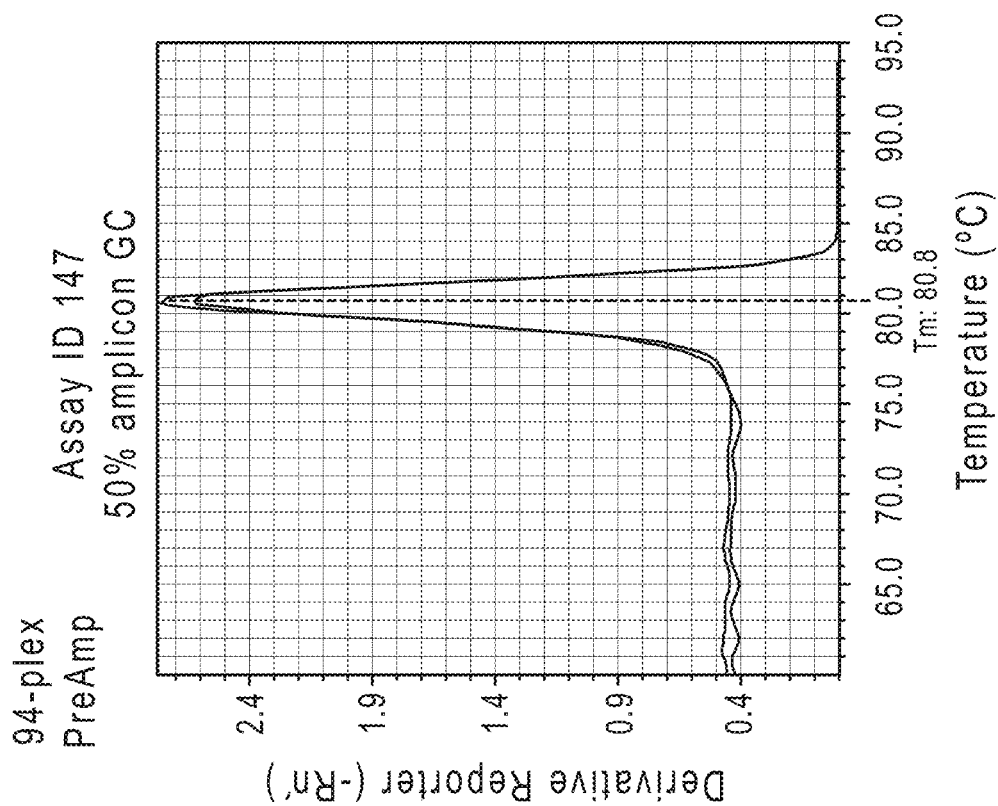
Figure 4D:
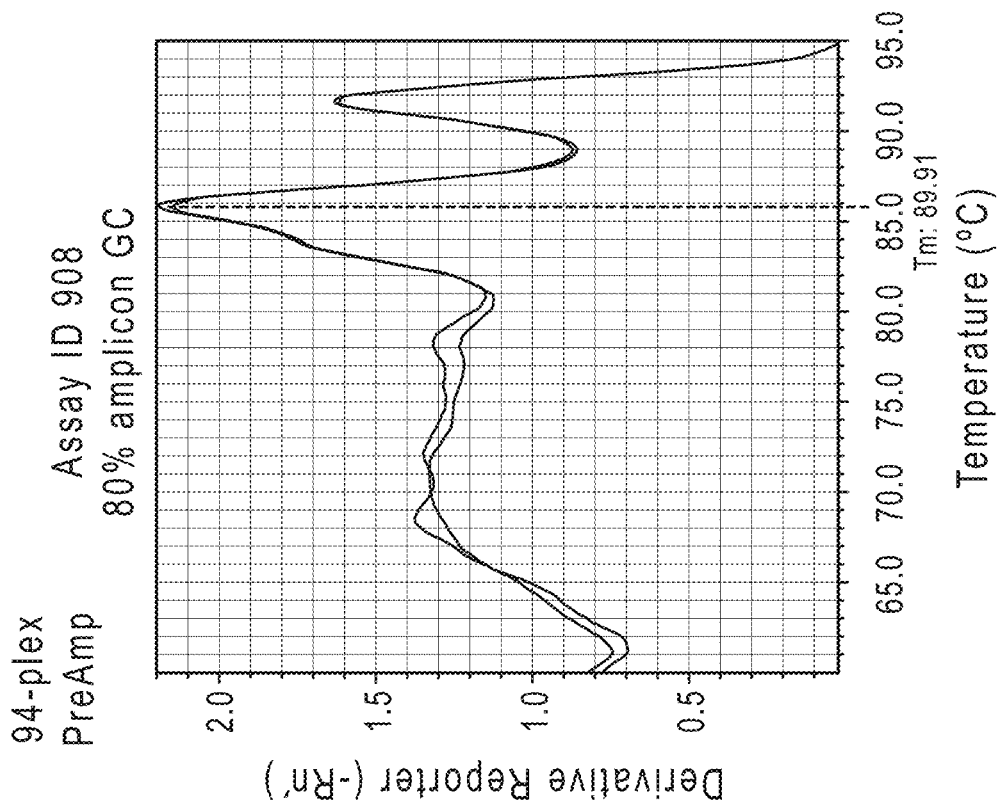
Figure 4C:
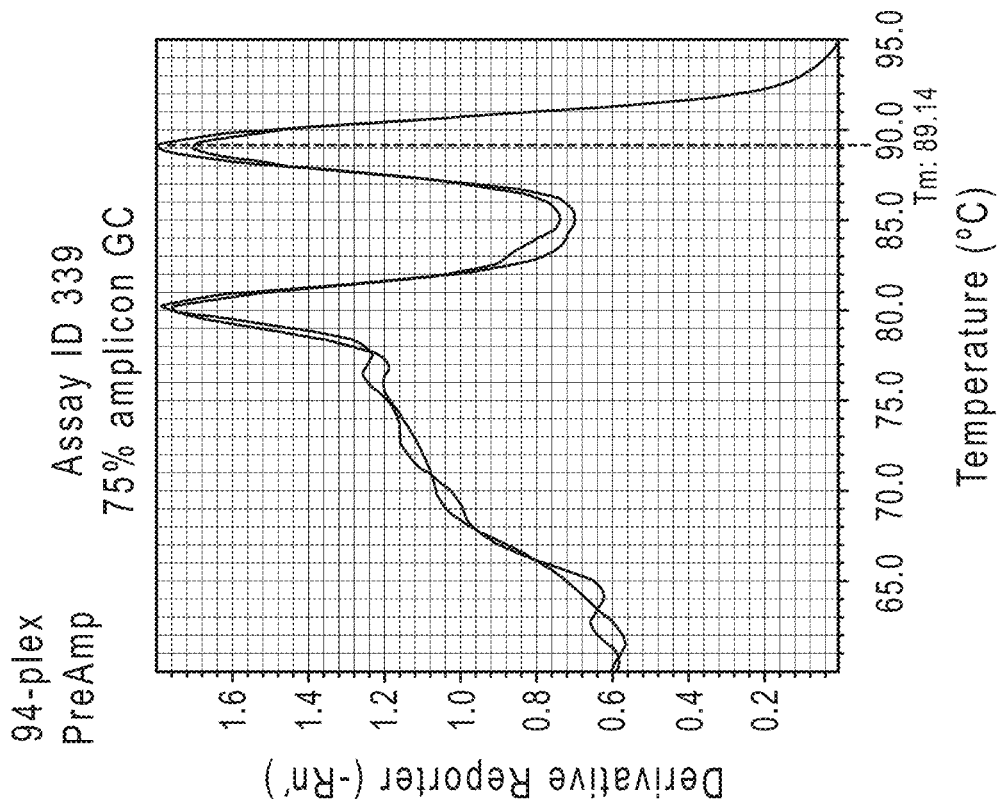
Figures 4E, 4F:
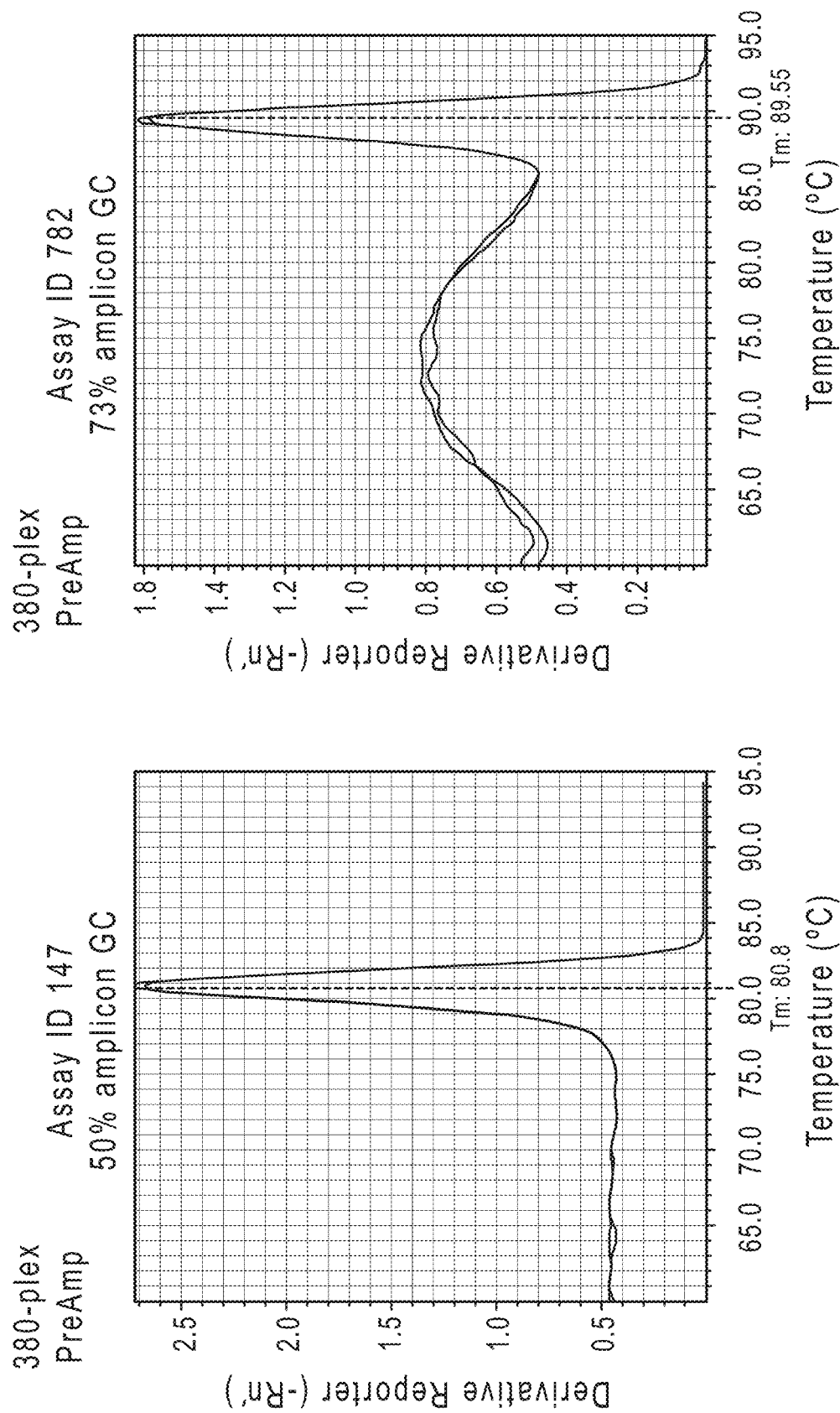
Figure 4H:
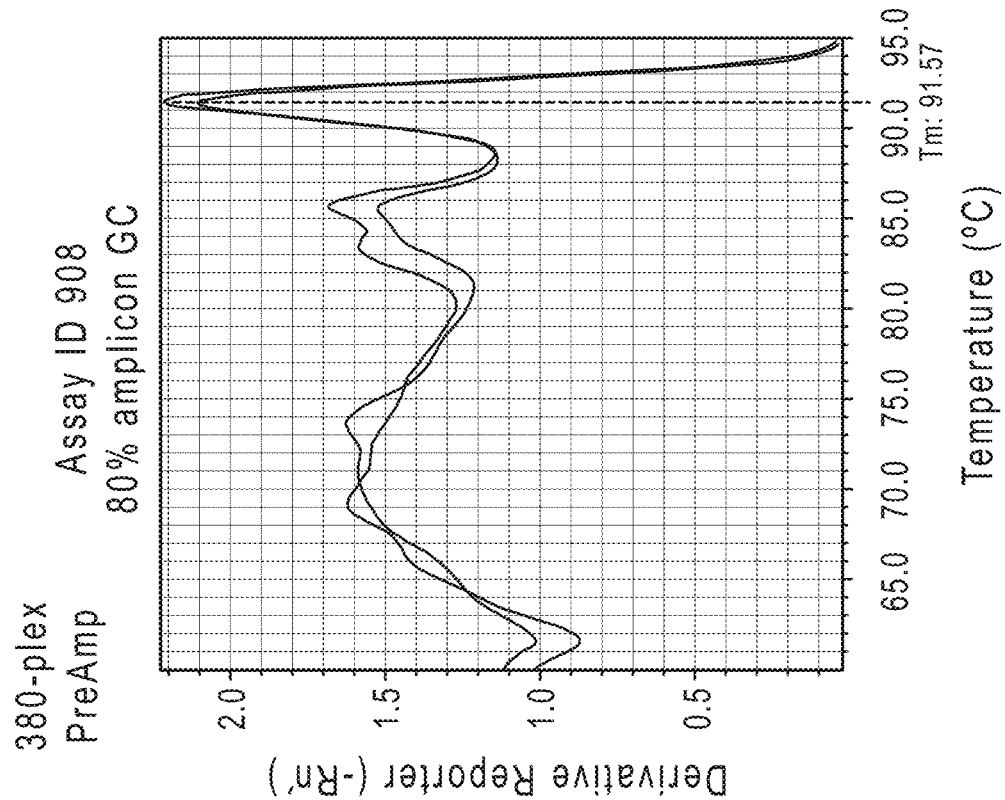
Figure 4G:
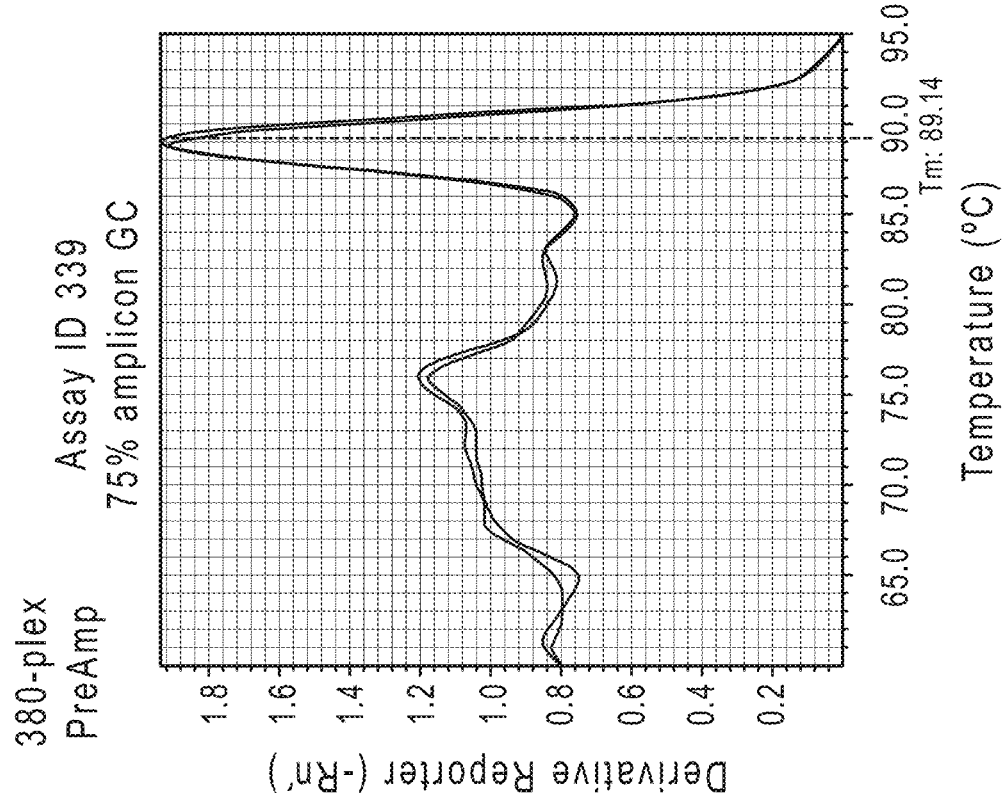

This example demonstrates that target-specific primers containing modified nucleotides generated substantially fewer primer-dimers than a corresponding non-modified primer pool. In this example, a population of non-modified primer pairs were prepared using conventional methods and subjected to the library amplification process as described in Example 1. A corresponding primer set containing modified nucleotides were prepared and amplified as described in Example 1. The amount of amplicon product and non-specific amplification product generated for each primer pool was compared. The amount of primer-dimers observed in the non-modified primer pool was found to greatly exceed the amount of primer-dimers in the corresponding modified primer pool (FIGS. 3A and 3B). The production of amplification artifacts can cause significant, if not permanent, amplification issues in downstream amplification events such as those commonly used in next-generating sequencing assays. The use of modified primers as disclosed herein can be used to alleviate these issues and decrease the output of amplification artifacts per multiplex reaction.

Example 4

Generation of a 384-Plex (Multiplex) PCR Reaction

In this example, a multiplex polymerase chain reaction was performed to amplify 384 amplicons across genomic DNA. A primer pool containing modified forward and reverse primer pairs was cycled with genomic DNA and subjected to library amplification as described in Example 1. The data obtained from 3 individual runs on an Ion Torrent PGM™ Sequencer was averaged and is presented in FIG. 5. The data shows an average read rate of 1000 per amplicon.

Example 5

Figure 6A:
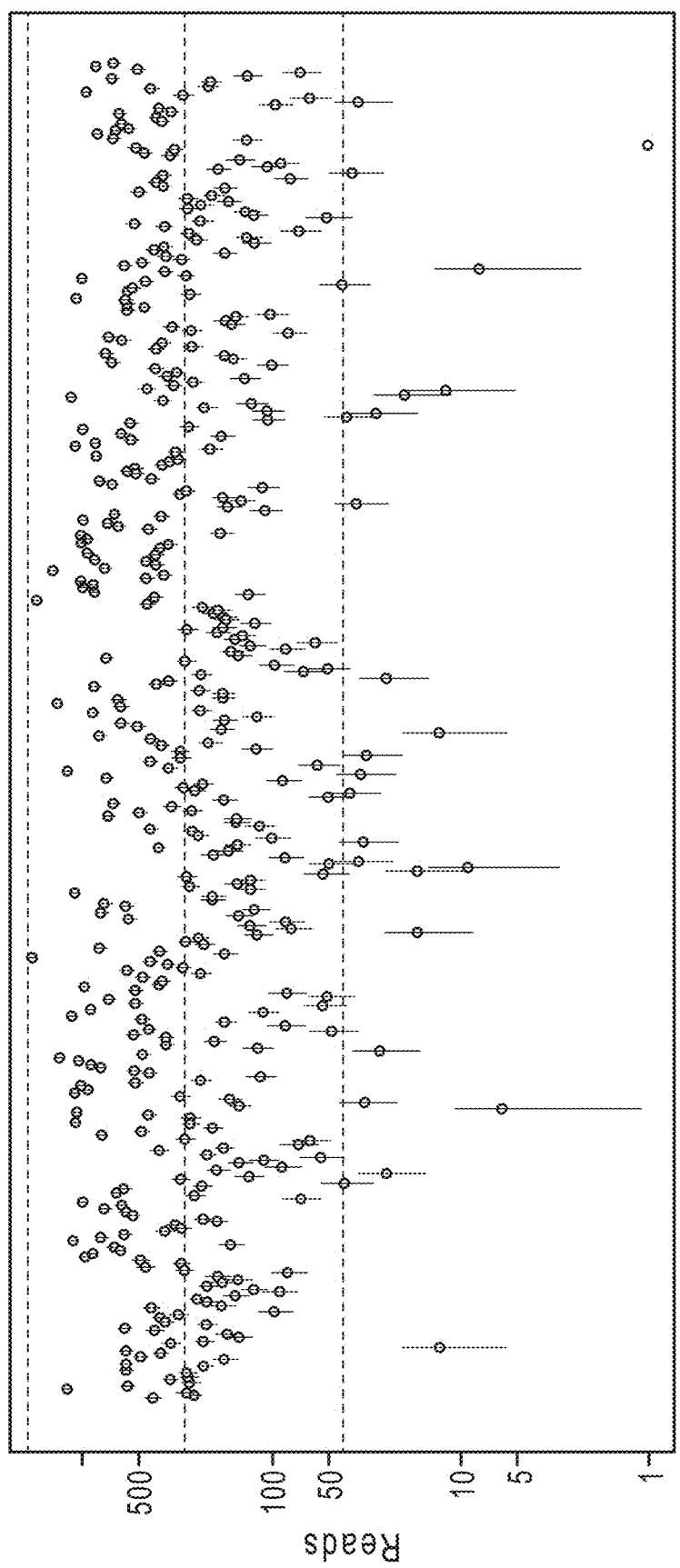
FIG. 6A-6B show quantification of the abundance and reproducibility of an exemplary multiplex reaction on genomic DNA when analyzed using an Ion Torrent PGM™ Sequencer (Life Technologies). The data shows the number of reads per amplicon for both the forward (FIG. 6A) and reverse primers (FIG. 6B) in the primer pool.
Figure 6B:
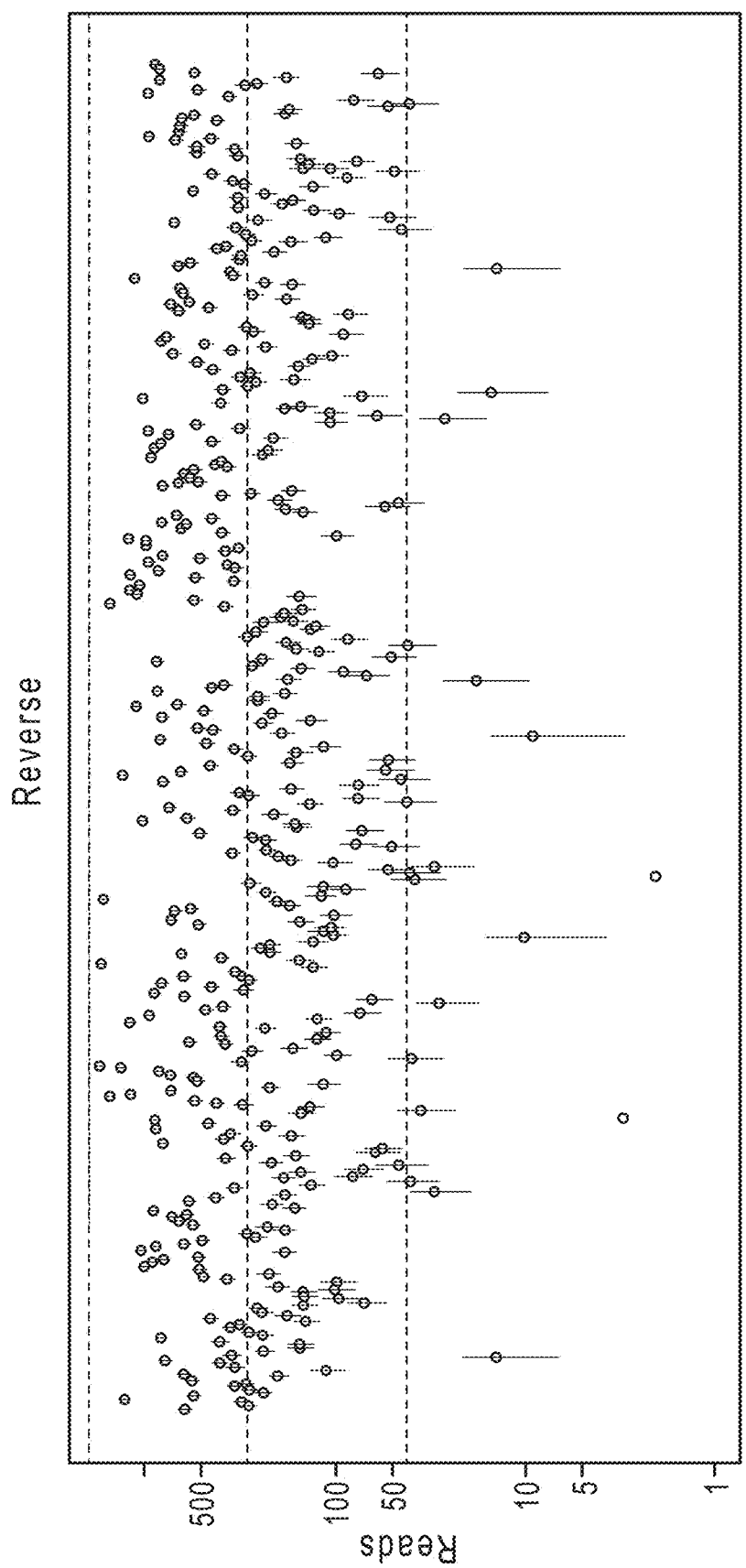

Effect of Forward and Reverse Primers on the Coverage of a 384-Plex Multiplex PCR Reaction In this example, a multiplex polymerase chain reaction was performed to amplify 411 amplicons across genomic DNA. The primer pool for the amplification reaction contained modified forward and reverse primers and was subjected to library amplification as described in Example 1. The data obtained from a single run on an Ion Torrent PGM™ Sequencer shows the average read rate of about 400 for both the reverse and forward modified primers (FIGS. 6A and 6B).

Example 6

Reproducibility of 384-Multiplex Reactions

Figure 7:
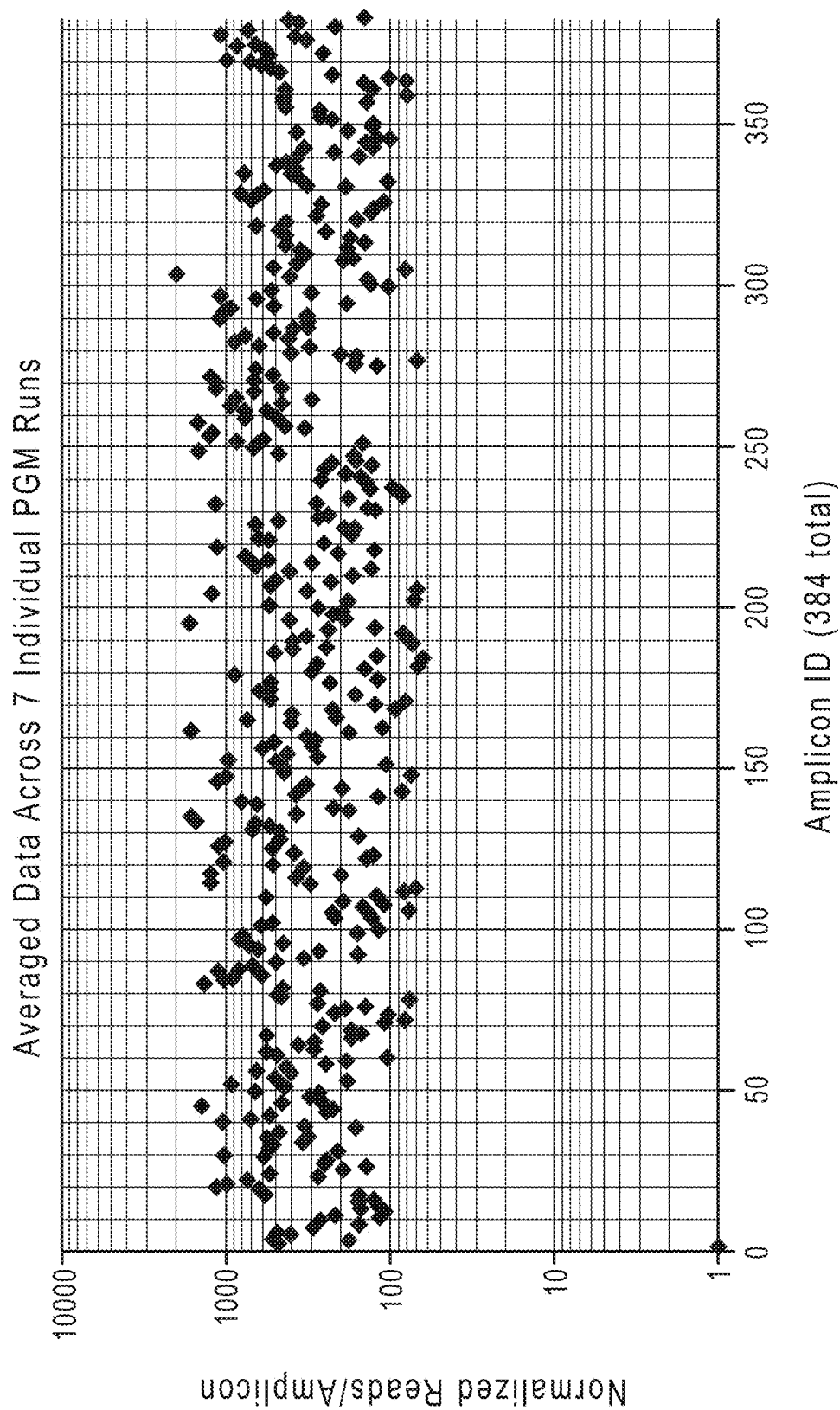
FIG. 7 shows quantification of the abundance and reproducibility of an exemplary 384-plex reaction on a genomic DNA sample across 7 individual runs on an Ion Torrent PGM™ Sequencer (Life Technologies). The average number of reads per amplicon is 400.

In this example, a multiplex polymerase chain reaction was performed to amplify 384 amplicons across genomic DNA. The primer pool contained modified forward and reverse primer pairs and was subjected to library amplification as described in Example 1. The data obtained from 7 individual runs on the Ion Torrent PGM™ Sequencer was averaged and is presented in FIG. 7. The data shows an average read rate of about 400 per amplicon.

Example 7

Reproducibility of 411-Multiplex Reactions

Figure 8:
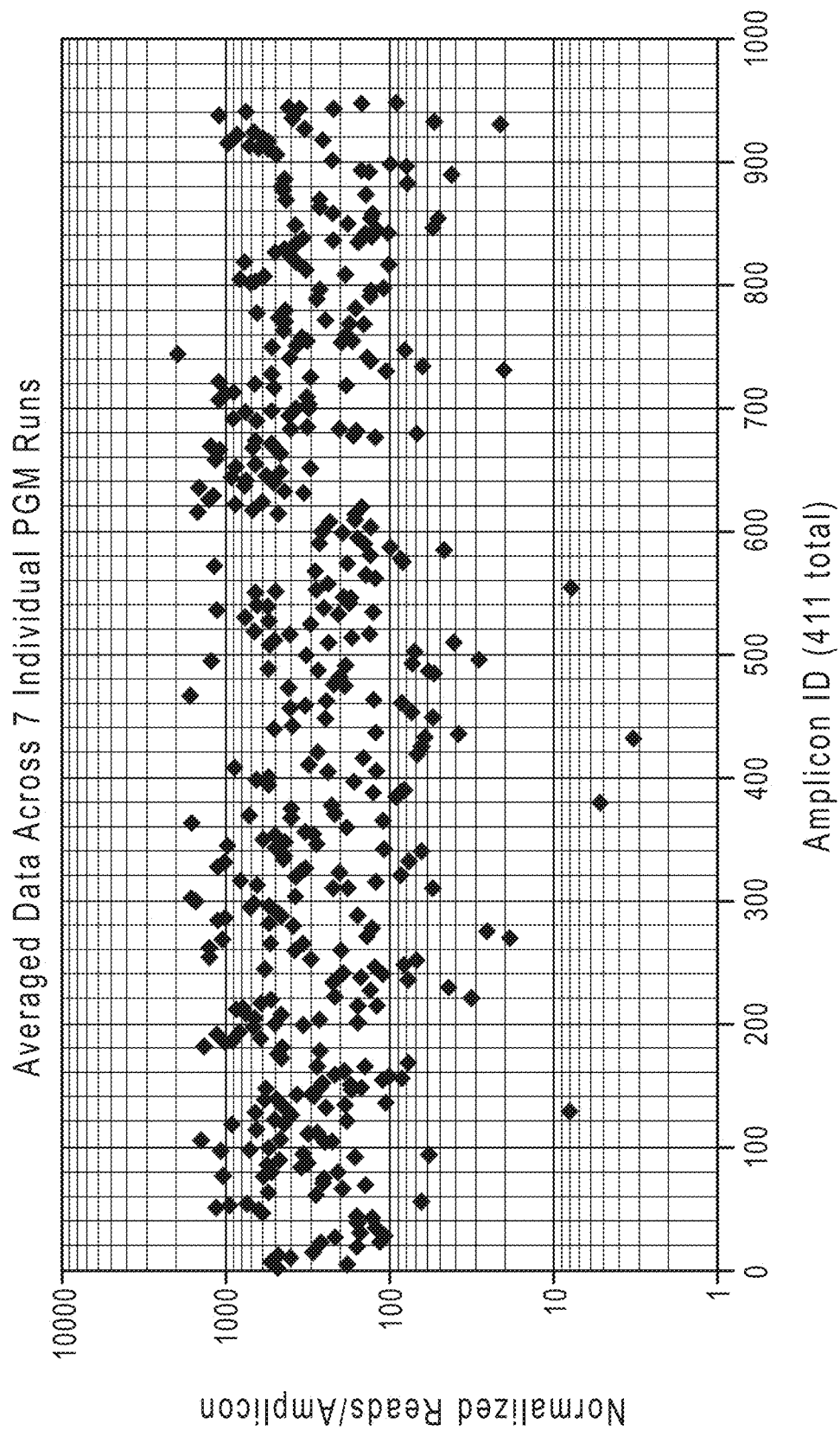
FIG. 8 shows quantification of the abundance and reproducibility of an exemplary 411-plex PCR of genomic DNA across 7 individual runs on an Ion Torrent PGM™ Sequencer (Life Technologies). The average number of reads per amplicon is 400.

In this example, a multiplex polymerase chain reaction was performed to amplify 411 amplicons across genomic DNA. The primer pool contained modified forward and reverse primer pairs and was subjected to library amplification as described in Example 1. The data obtained from 7 individual runs on the Ion Torrent PGM™ Sequencer was averaged and is presented in FIG. 8. The data shows an average read rate of about 400 per amplicon.

Example 8

FFPE Samples as Amendable Substrates for Low Multiplex PCR

Figure 9:
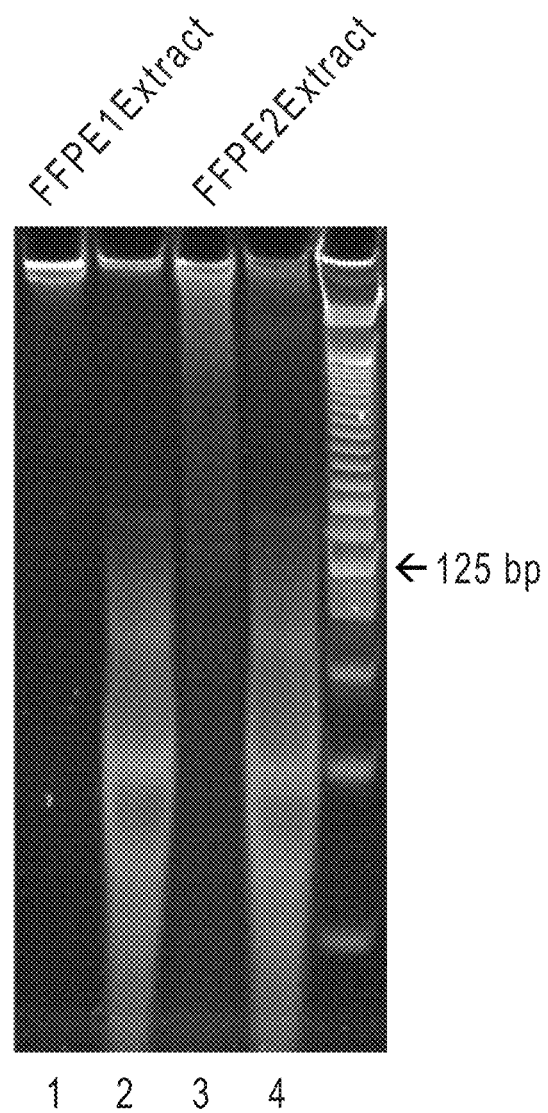
FIG. 9 shows an image of agarose gel electrophoresis visualizing exemplary amplification products (lanes 2 and 4) after performing a multiplex PCR and library amplification on an FFPE sample according to an exemplary embodiment.

In this example, a multiplex polymerase chain reaction was performed to amplify 96 amplicons from a Fresh-Frozen Paraffin-Embedded (FFPE) sample. Fresh-Frozen and FFPE samples are often problematic for amplification processes due to the small amount of DNA that can be extracted from such samples. Additionally, because of the harsh chemical treatment required to preserve these samples, the quality of DNA extracted from such a sample is generally very poor. DNA was extracted from a FFPE sample and loaded onto an agarose gel for visualization (lanes 1 and 3) or subjected to multiplex PCR and library amplification as described in Example 1 and then loaded onto the agarose gel for visualization (lanes 2 and 4). A 96-plex PCR reaction and library amplification was performed on 10 ng of FFPE DNA as described in Example 1. FIG. 9 shows a photograph of the agarose electrophoresis gel including FFPE DNA prior to and after library amplification as described in Example 1.

Example 9

FFPE Samples as Amenable Substrates for High Multiplex PCR

Figure 10:
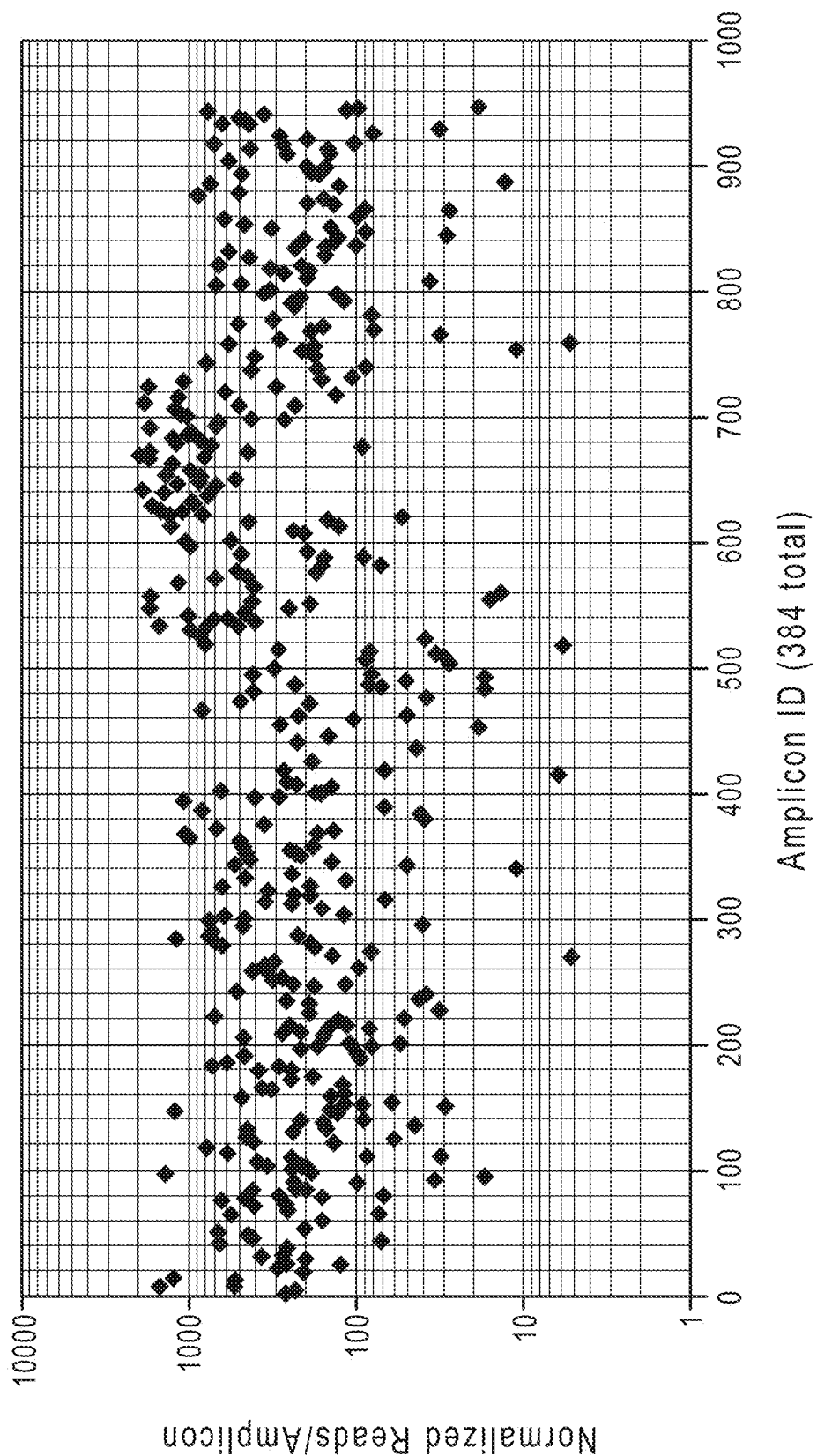
FIG. 10 shows quantification of the abundance and reproducibility of data obtained from an FFPE DNA sample (10 ng) in an exemplary 384-plea PCR obtained using an Ion Torrent PGM™ Sequencer (Life Technologies). The average number of reads per amplicon is 400.
Figure 11A:
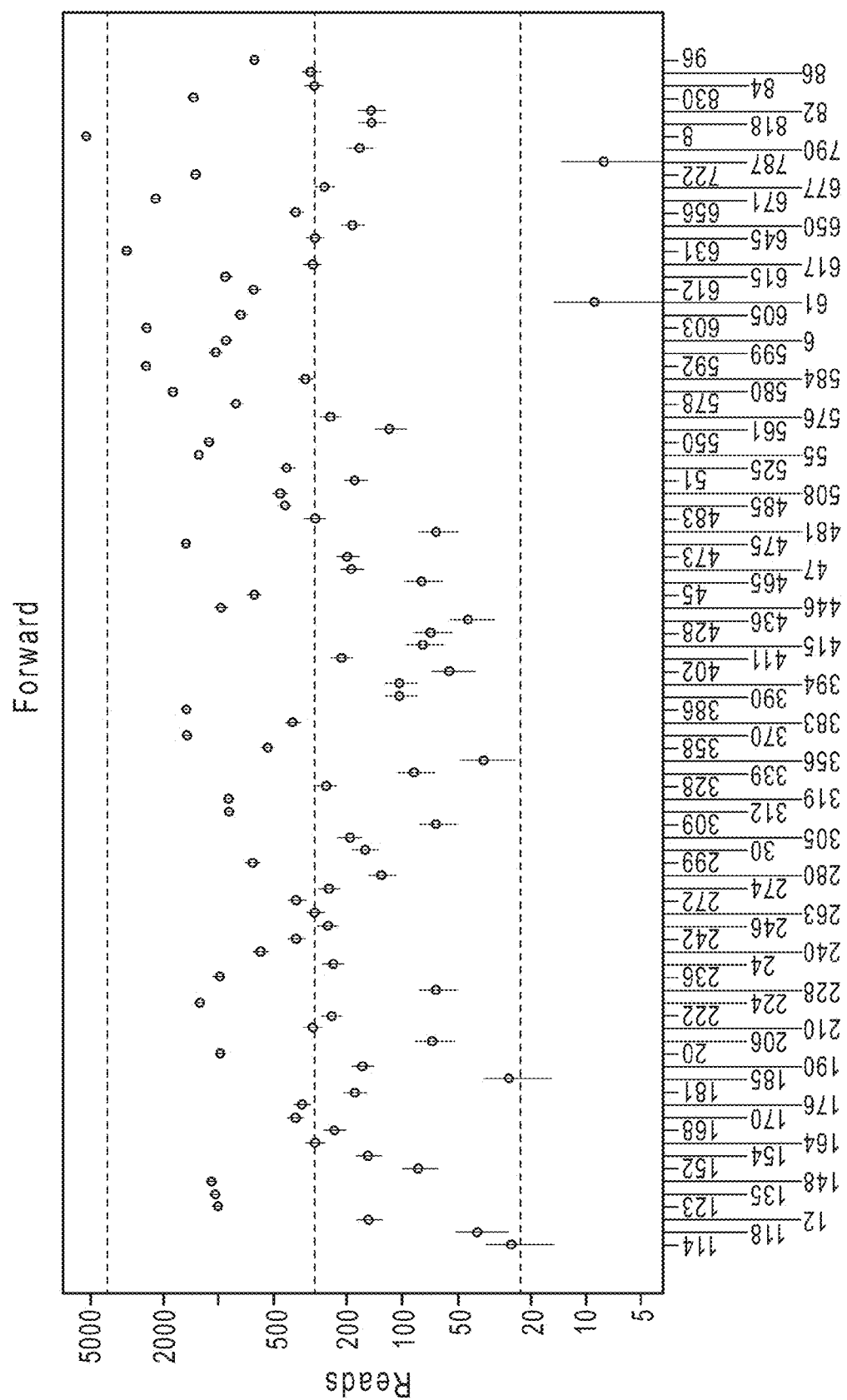
FIG. 11A-11B show quantification of the abundance and reproducibility of data obtained from a FFPE DNA sample (10 ng) after an exemplary 94-plex reaction. The data shows the number of reads per amplicon for both the forward (FIG. 11A) and reverse primers (FIG. 11B) in the primer pool.
Figure 11B:
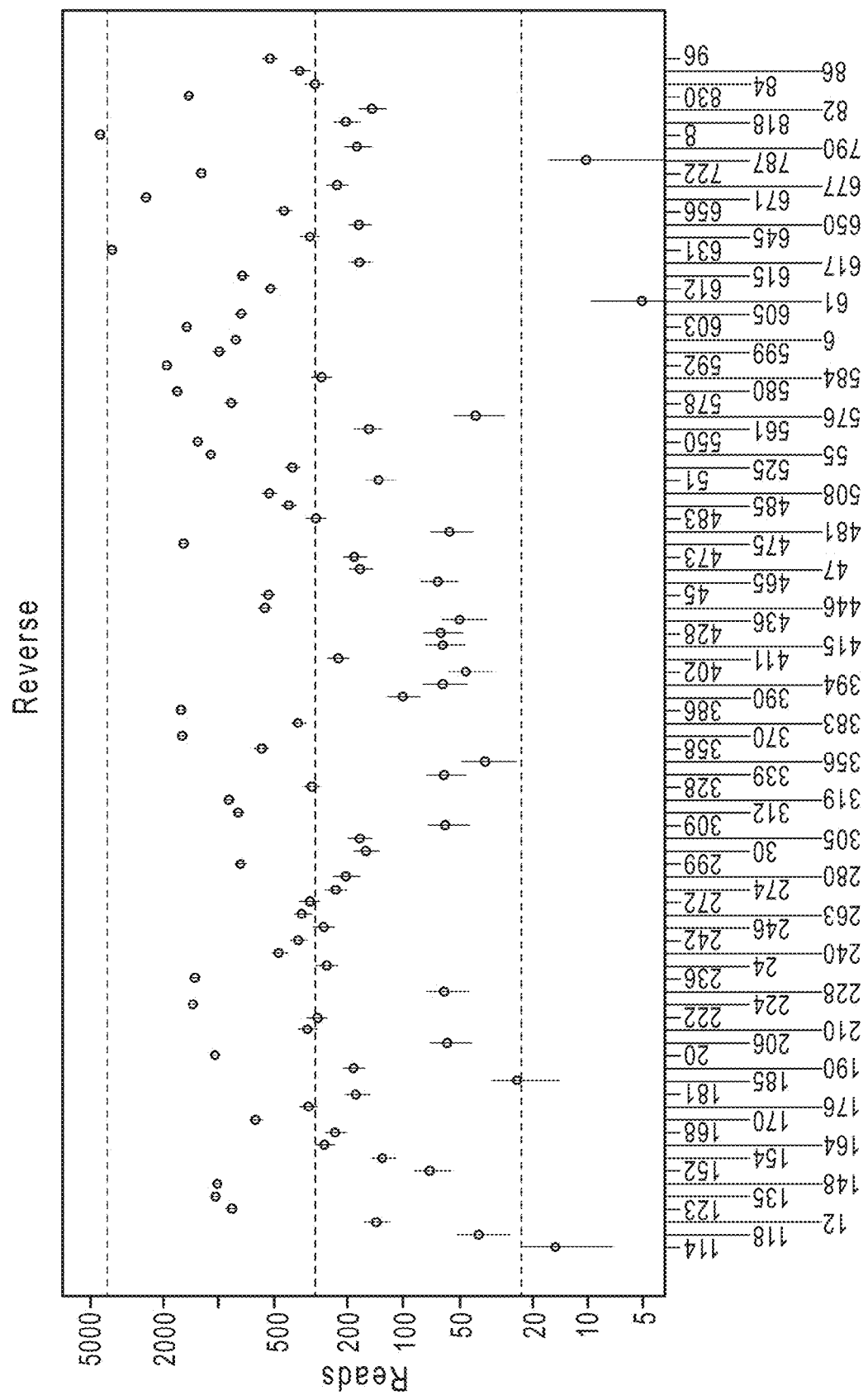

In this example, a multiplex polymerase chain reaction was performed to amplify 384 amplicons from a Fresh-Frozen Paraffin-Embedded (FFPE) sample. As discussed in Example 8, Fresh-Frozen and FFPE samples are often problematic for amplification due to low extracted DNA quantity and quality. In this example, 10 ng of DNA was extracted from a FFPE sample and subjected to a 384-plex PCR reaction and library amplification as described by Example 1. The data obtained from the Ion Torrent PGM™ Sequencer was averaged and is presented in FIG. 10. The data shows an average read rate of about 400 per amplicon. Further analysis of the read rate for some of the modified forward and reverse primer pairs used in the 384-plex reaction is presented in FIGS. 11A and 11B.

Example 10

Detection of Variants in Control Mix of KRAS Codon 12 and Codon 13 Mutants

Figure 12:
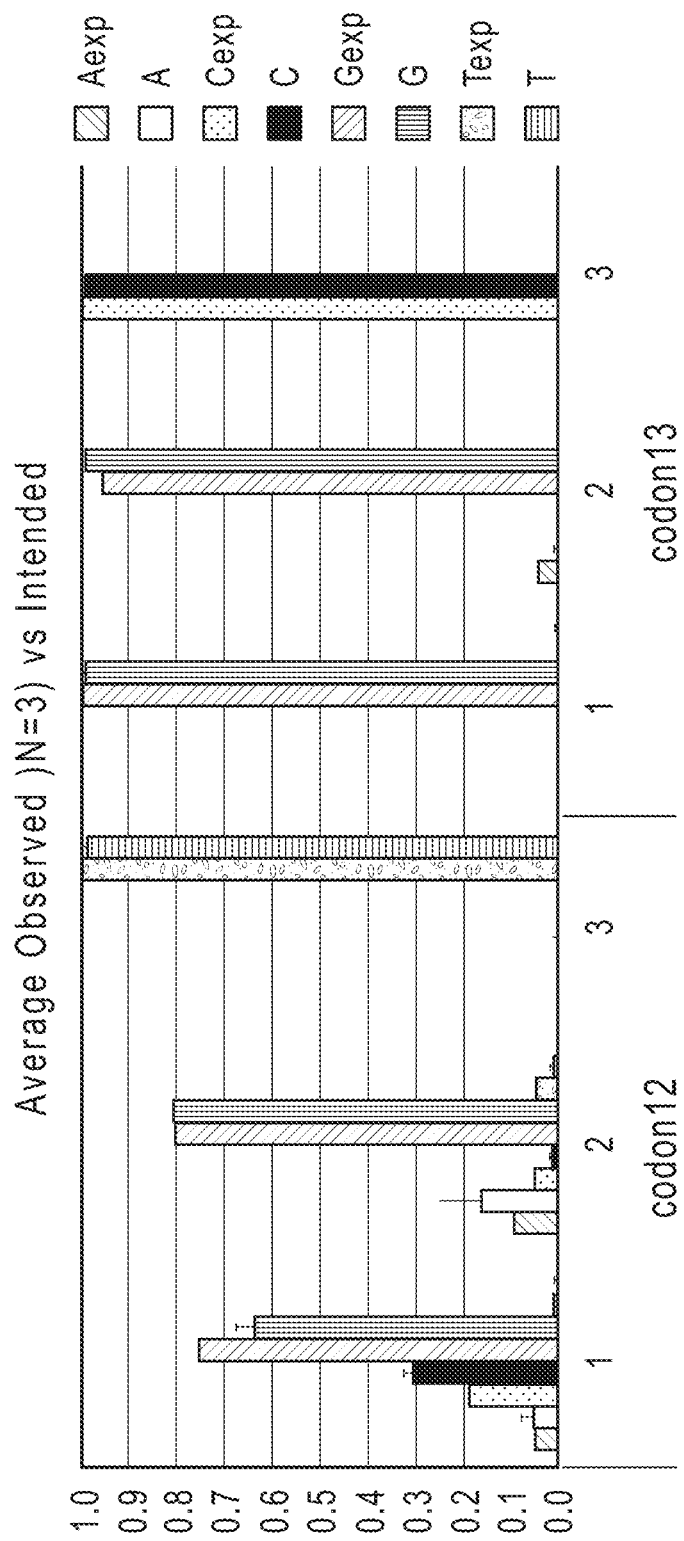
FIG. 12 shows a graph reporting the detection of mutations in codon 12 and codon 13 of the KRAS gene obtained by performing multiplex PCR and library amplification of control DNA and sequencing on an Ion Torrent PGM™ Sequencer (Life Technologies).

In this example, a sample of DNA containing spiked amounts of mutations of the KRAS gene at codon 12 and codon 13 were provided as a blind test sample. The sample was amplified using target-specific modified primer pairs developed for the KRAS gene. The primer pool and samples were amplified as described in Example 1. The amplified library was prepared as a template and enriched. The enriched template was applied to an Ion 314™ Chip and analyzed using an Ion Torrent PGM™ Sequencer as described in Example 1. The data from 3 individual runs was averaged and is provided as FIG. 12. The amplicon products generated during the library amplification process correspond to the expected level of mutations present in the control DNA sample for the KRAS gene at codon 12 and codon 13.

Example 11

Resequencing the Cystic Fibrosis Transmembrane Conductance Regulator (CFTR) Gene Coding Region The CFTR protein is encoded by the CFTR gene which is approximately 200 kbp, spanning 27 exons. CFTR is an ABC transporter-class ion channel that transports chloride and thiocyanate ions across epithelial cell membranes. Mutations of the CFTR gene affect functioning of the chloride ion channels in these cell membranes, leading to cystic fibrosis and congenital absence of the vas deferens. As a consequence, a male carrier of the mutation in the CFTR gene can be infertile so the detection of the defect is key in IVD considerations.

Figure 13:
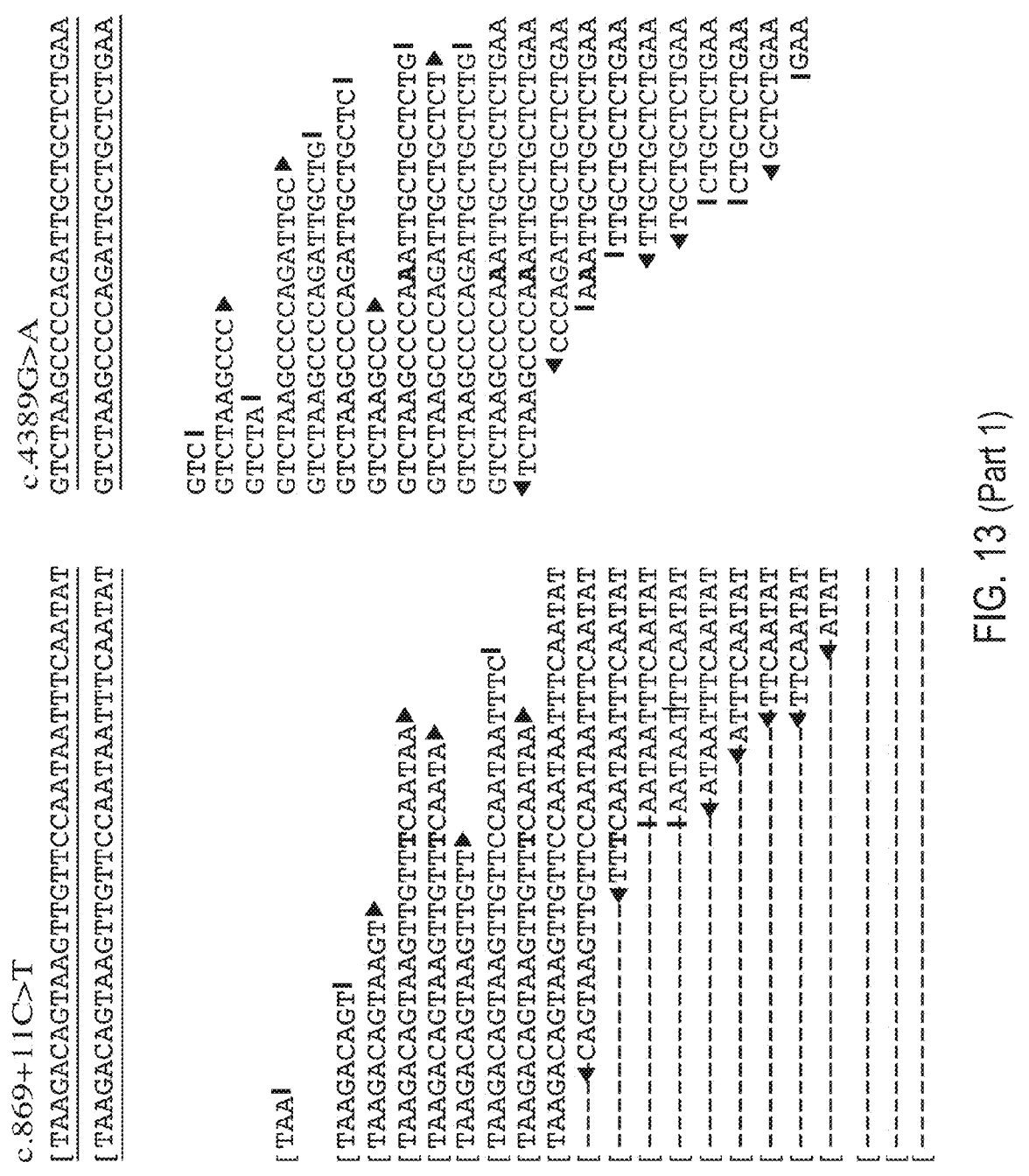

In this example, genomic DNA (gDNA) was obtained containing mutations of the CFTR gene. The gDNA was prepared for library amplification, template preparation and applied to Ion Torrent 314™ Chip as described in Example 1. Over 8947 bases were amplified during the multiplex PCR reaction. The resulting amplicon library contained 34 amplicons with an average amplicon length of 104 bp. Sequence analysis of the amplicon library was conducted against the CFTR gene sequence reference: NCBI gi|287325315|ref|NG_016465.1|, 195703 bp The generated amplicon library was used to evaluate detection of the CFTR gene mutations in the sample. It was found that the library amplification process detected and identified 5 point mutations and 1 insertion/deletion at low coverage (4,001 reads) (FIG. 13 (Part I-Part III). The naming system for the 6 mutations is as follows:

Naming System: CFMD (UMD)
c.869+11C>T (1001+11C/T)
c.1408A>G (M470V)
c.2562T>G (2694T/G)
c.4389G>A (4521G/A)
c.1-8G>C (125G/C)
c.1521_1523delCTT (ΔF508)

Most resequencing assays are based on amplicons that are greater than 100 bp. This example demonstrates the applicability and amenability of the library amplification process exemplified in Example 1, to generate amplicons of a length necessary for resequencing assays. The example also shows the accuracy of the Ion Torrent PGM™ Sequencer to correctly identify point mutations and insertions/deletion mutations in a given sample.

Example 12

Generation of Target-Specific Primers

Table 2 (see in U.S. Ser. No. 13/458,739, filed Apr. 27, 2012, hereby incorporated by reference in its entirety) provides a list of target-specific forward and reverse uracil containing primers that were used in the above examples to amplify target-specific regions of gDNA or DNA extracted from samples, such as FFPE samples. Table 2 (from U.S. Ser. No. 13/458,739, filed Apr. 27, 2012, hereby incorporated by reference in its entirety) provides the chromosome location of each primer pair, the nucleotide sequence of each forward and reverse primer in each primer pair. Table 2 (from U.S. Ser. No. 13/458,739, filed Apr. 27, 2012, hereby incorporated by reference in its entirety) also provides the coordinates of the 5' end of the upstream/forward primer, the length of each amplicon, the corresponding amplicon nucleotide sequence, the length of each forward and reverse primer, and the $T_m$ for each forward or reverse primer. Tables 3a-3d (found in U.S. Ser. No. 13/458,739, filed Apr. 27, 2012, hereby incorporated by reference in its entirety) also provide a list of distinct target-specific forward and reverse primer pairs that were used in example 13 to amplify target-specific regions of gDNA or DNA extracted from FFPE samples from the genes of Table 1 (from U.S. Ser. No. 13/458,739, filed Apr. 27, 2012, hereby incorporated by reference in its entirety) that are associated with cancer. The following primer pair was also included for coverage of a mutation in the AKT1 gene (c.49G>A). Forward primer: GCCGCCAGGUCTTGATGUA and reverse primer: GCACAUCTGTCCUGGCACA.

Example 13

Alternate Library Protocol

PCR Amplify Genomic DNA Targets

In this example, a multiplex polymerase chain reaction was performed to amplify multiple individual amplicons across a genomic DNA sample or FFPE sample. A representative list of genes associated with cancers that were incorporated for investigation while synthesizing the primer pool is provided in Table 1 (found in U.S. Ser. No. 13/458,739, filed Apr. 27, 2012, hereby incorporated by reference in its entirety). Each primer pair in the primer pool was designed to contain at least one uracil nucleotide in each of the forward and reverse primer (Tables 3a-3d found in U.S. Ser. No. 13/458,739, filed Apr. 27, 2012, hereby incorporated by reference in its entirety). Each primer pair was also designed to selectively hybridize to, and promote amplification of a specific gene or gene fragment of the genomic DNA sample to reduce formation of non-specific amplification products.

To a single well of a 96-well PCR plate was added 4 microliters of 5× Primer Pool (containing the primer pairs) at a concentration of 250 nm each in TE, 10 ng of genomic DNA and 10 microliters of an amplification reaction mixture (2× Stoffel HiFi Master Mix) that can include glycerol, dNTPs and Stoffel fragment of Amplitaq® DNA Polymerase (Invitrogen, Catalog No. N8080038) to a final volume of 20 microliters with nuclease free water (Life Technologies, CA, Part No. 600004).

The PCR plate was sealed and loaded into a thermal cycler (GeneAmp® PCR system 9700 Dual 96-well thermal cycler (Life Technologies, CA, Part No. N8050200 and 4314445)) and run on the following temperature profile to generate the preamplified amplicon library. Variation to the number of cycles was performed based on the total plexy of the reaction mixture under investigation. For example, a plexy of 48-96 was run for 17 cycles; a plexy of 97-192 was run for 16 cycles; a plexy of 193-384 was run for 15 cycles; a plexy of 385-768 was run for 14 cycles; a plexy of 769-1536 was run for 13 cycles. Additionally, for reaction mixtures containing barcodes or pooled reaction mixtures the number of cycles was lowered by one or more additional cycles. For example, 2-3 barcodes per sample were subtracted by one cycle; 4-8 barcodes per sample were subtracted by 2 cycles, and 9-16 barcodes were subtracted by 3 cycles. An initial holding stage was performed at 99° C. for 2 minutes, followed by X cycles (as determined above) of denaturing at 99° C. for 15 seconds and an annealing and extending stage at 60° C. for 4 minutes. After cycling, the preamplified amplicon library was held at 4° C. until proceeding to the digestion and phosphorylation step outlined below.

Digest/Phosphorylate/Heat Kill the Amplicons

To the preamplified library (~20 microliters), 2 microliters of FuPa reagent was added. Typically, the FuPa reagent comprises one or more uracil degradable enzymes such as UDG, FPG and the like, a DNA polymerase such as Pol I, T4PNK, Klenow and the like, and an antibody such as an anti-Taq antibody. In this example, the relative amount of each enzymatic component in the FuPa reagent was 1:1:1:1 but can be varied according to the number of required cycles, variations to the temperature profile, etc., as can be determined by one of ordinary skill in the art. The PCR plate was sealed and loaded into a thermal cycler (GeneAmp® PCR system 9700 Dual 96-well thermal cycler (Life Technologies, CA, Part No. N8050200 and 4314445)) and run on the following temperature profile. An initial holding stage was performed at 37° C. for 5 minutes, followed by 55° C. for 10 minutes and then 60° C. for 20 minutes. After cycling, the preamplified amplicon library was held at 4° C. until proceeding to the ligation/nick translation step outlined below.

Ligate Adpaters to the Amplicons and Nick Translate

After phosphorylation, the amplicon preamplification library (~22 µl) proceeded directly to a ligation step. In this example, the preamplification library now containing the phosphorylated amplicon library was combined with 1 microliter of A/P1 Adaptersadapters (20 um each) (sold as a component of the Ion Fragment Library Kit, Life Technologies, Part No. 4466464), 2 microliters of 10× ligation buffer and 1 microliter of DNA ligase (sold as components of the Ion Fragment Library Kit, Life Technologies, Part No. 4466464). The PCR plate was sealed and loaded into a thermal cycler (GeneAmp® PCR system 9700 Dual 96-well thermal cycler (Life Technologies, CA, Part No. N8050200 and 4314445)) and run on the following temperature profile. An initial holding stage was performed at 22° C. for 30 minutes, followed by 65° C. for 10 minutes and then held at 4° C. until proceeding to the next step.

If the amplicon library is to contain barcodes (for example Ion DNA Barcoding 1-16 kit, Life Technologies, Part No. 4468654, incorporated herein in its entirety), the barcodes can be added at this step to the PCR plate essentially according to the manufacturer's instructions prior to proceeding to the next step 1.8×AMPure XP Purification 1.8× sample volume of AgenCourt® AMPure® Reagent (Beckman Coulter, CA) was added to the ligated DNA. The mixture was mixed and incubated at room temperature for 5 minutes. After the solution had cleared, the supernatant was discarded. An ethanol wash was performed and the supernatant discarded. Any remaining ethanol was removed and the pellet was air-dried for about 5 minutes at room temperature. The pellet was resuspended in 20 microliters of DNase/RNase Free Water (Life Technologies, CA, Part No. 600004). In some instances, an optional library amplification step can be performed on the amplicon library, as outlined below.

Nick Translate and Amplify the Amplicon Library and Purify the Library

The ligated DNA (~20 microliters) was combined with 78 microliters of Platinum® PCR SuperMix High Fidelity (Life Technologies, CA, Part No. 12532-016, sold as a component of the Ion Fragment Library Kit, Life Technologies, Part No. 4466464) and 4 microliters of Library Amplification Primer Mix (5 µM each) (Life Technologies, CA, Part No. 602-1068-01, sold as a component of the Ion Fragment Library Kit, Life Technologies, Part No. 4466464). The solution was applied to a single well of a 96-well PCR plate and sealed. The plate was loaded into a thermal cycler (GeneAmp® PCR system 9700 Dual 96-well thermal cycler (Life Technologies, CA, Part No. N8050200 and 4314445)) and run on the following temperate profile to generate the final amplicon library.

A nick-translation was performed at 72° C. for 1 minute, followed by an enzyme activation stage at 98° C. for 2 minutes, followed by 7 cycles of denaturing at 98° C. for 15 seconds and an annealing and extending stage at 60° C. for 1 minute. After cycling, the final amplicon library was held at 4° C. until proceeding to the final purification step outlined below.

The final amplicon library (~100 microliters) was combined with 1.8× sample volume of Agencourt® AMPure® XP reagent (Beckman Coulter, CA). The mixture was then incubated for 5 minutes at room temperature. The PCR plate containing the final amplicon library was washed with 70% ethanol and the supernatant discarded. Any remaining ethanol was removed and air-dried for about 5 minutes at room temperature. Once dry, the library was resuspended in 20 microliters of Low TE (Life Technologies, CA, Part No. 602-1066-01).

Assess the Library Size Distribution and Determine the Template Dilution Factor

The final amplicon library was quantitated to determine the library dilution (Template Dilution Factor) that results in a concentration within the optimized target range for Template Preparation (e.g., PCR-mediated addition of library molecules onto Ion Sphere™ Particles). The final amplicon library is typically quantitated for downstream Template Preparation procedure using an Ion Library Quantitation Kit (qPCR) (Life Technologies, Part No. 4468802) and/or a Bioanalyzer™ (Agilent Technologies, Agilent 2100 Bioanalyzer) to determine the molar concentration of the amplicon library, from which the Template Dilution Factor is calculated. For example, instructions to determine the Template Dilution Factor by quantitative real-time PCR (qPCR) can be found in the Ion Library Quantitation Kit User Guide (Life Technologies, Part No. 4468986).

In this example, 1 microliter of the final amplicon library preparation was analyzed on the 2100 Bioanalyzer™ with an Agilent High Sensitivity DNA Kit (Agilent Technologies, Part No. 5067-4626) to generate peaks in the 135-205 bp size range and at a concentration of about $5 \times 10^9$ copies per microliter.

Proceed to Template Preparation

An aliquot of the final library was used to prepare DNA templates that were clonally amplified on Ion Sphere™ Particles using emulsion PCR (emPCR). The preparation of template in the instant example was prepared according to the manufacturer's instructions using an Ion Xpress Template Kit (Life Technologies, Part No. 4466457). Once template-positive Ion Sphere Particles were enriched, an aliquot of the Ion Spheres were loaded onto an Ion 314TH Chip (Life Technologies, Part No. 4462923) as described in the Ion Sequencing User Guide (Part No. 4467391), and subjected to analysis and sequencing as described in the Ion Torrent PGM Sequencer User Guide (Life Technologies, Part No. 4462917).

Example 14

Alternate Library Protocol

PCR Amplify Genomic DNA Targets

In this example, a multiplex polymerase chain reaction was performed to amplify multiple individual amplicons across a genomic DNA sample. A representative list of genes associated with cancers that were incorporated for investigation while synthesizing the primer pool is provided in Table 1 (found in U.S. Ser. No. 13/458,739, filed Apr. 27, 2012, hereby incorporated by reference in its entirety). Each primer pair in the primer pool was designed to contain at least one uracil nucleotide in each of the forward and reverse primer (Table 2-see U.S. Ser. No. 13/458,739, filed Apr. 27, 2012, hereby incorporated by reference in its entirety). Each primer pair was also designed to selectively hybridize to, and promote amplification of a specific gene or gene fragment of the genomic DNA sample to reduce formation of non-specific amplification products.

To a single well of a 96-well PCR plate was added 5 microliters of 4×HSM Primer Pool (containing the primer pairs of Table 2 (see U.S. Ser. No. 13/458,739, filed Apr. 27, 2012, hereby incorporated by reference in its entirety)) at a concentration of 250 nm each in TE, 50 ng of genomic DNA and 10 microliters of an amplification reaction mixture (2×PreAmp HiFi Master Mix) that can include glycerol, dNTPs and a DNA Polymerase (such as Taq DNA Polymerase, Invitrogen, Catalog No. N8080038) to a final volume of 20 microliters with nuclease free water (Life Technologies, CA, Part No. 600004).

The PCR plate was sealed and loaded into a thermal cycler (GeneAmp® PCR system 9700 Dual 96-well thermal cycler (Life Technologies, CA, Part No. N8050200 and 4314445)) and run on the following temperature profile to generate the preamplified amplicon library. An initial holding stage was performed at 98° C. for 2 minutes, followed by 16 cycles of denaturing at 98° C. for 15 seconds and an annealing and extending stage at 60° C. for 4 minutes. After cycling, the preamplified amplicon library was held at 4° C. until proceeding to the purification step outlined below.

Purify the Amplicons from input DNA and Primers

Two rounds of Agencourt® AMPure® XP Reagent (Beckman Coulter, CA) binding, wash, and elution at 0.6× and 1.2× volume ratios were found to remove genomic DNA and unbound or excess primers. In a 1.5 ml LoBind tube (Eppendorf, Part No. 022431021), the preamplified amplicon library (20 microliters) was combined with 12 microliters (0.6× volumes) of Agencourt® AMPure® XP reagent (Beckman Coulter, CA). The bead suspension was pipetted up and down to thoroughly mix the bead suspension with the preamplified amplicon library. The sample was then pulse-spin and incubated for 5 minutes at room temperature.

The tube containing the sample was placed on a magnetic rack such as a DynaMag™-2 spin magnet (Life Technologies, CA, Part No. 123-21D) for 2 minutes to capture the beads. Once the solution cleared, the supernatant was transferred to a new tube, where 24 microliters (1.2× volume) of Agencourt® AMPure® XP beads (Beckman Coulter, CA) were added to the supernatant. The mixture was pipetted to ensure the bead suspension mixed with the preamplified amplicon library. The sample was then pulse-spin and incubated at room temperature for 5 minutes. The tube containing the sample was placed on the magnetic rack for 2 minutes to capture the beads. Once the solution cleared, the supernatant was carefully discarded without disturbing the bead pellet. The desired preamplified amplicon library was now bound to the beads. Without removing the tube from the magnetic rack, 200 microliters of freshly prepared 70% ethanol was introduced into the sample. The sample was incubated for 30 seconds while gently rotating the tube on the magnetic rack. After the solution cleared, the supernatant was discarded without disturbing the pellet. A second ethanol wash was performed and the supernatant discarded. Any remaining ethanol was removed by pulse-spinning the tube and carefully removing residual ethanol while not disturbing the pellet. The pellet was air-dried for about 5 minutes at room temperature.

Once the tube was dry, the tube was removed from the magnetic rack and 20 microliters of DNase/RNase Free Water was added (Life Technologies, CA, Part No. 600004). The tube was vortexed and pipetted to ensure the sample was mixed thoroughly. The sample was pulse-spin and placed on the magnetic rack for two minutes. After the solution cleared, the supernatant containing the eluted DNA was transferred to a new tube.

Phosphorylate the Amplicons

To the eluted DNA (~20 microliters), 3 microliters of DNA ligase buffer (Invitrogen, Catalog No. 15224041), 2 microliters dNTP mix (10 mm), and 2 microliters of FuP reagent were added. The reaction mixture was mixed thoroughly to ensure uniformity and incubated at 37° C. for 10 minutes.

Ligate Adpaters to the Amplicons and Purify the Ligated Amplicons

After incubation, the reaction mixture proceeded directly to a ligation step. Here, the reaction mixture now containing the phosphorylated amplicon library was combined with 1 microliter of A/P1 adapters (20 um each) (sold as a component of the Ion Fragment Library Kit, Life Technologies, Part No. 4466464) and 1 microliter of DNA ligase (sold as a component of the Ion Fragment Library Kit, Life Technologies, Part No. 4466464), and incubated at room temperature for 30 minutes.

After the incubation step, 52 microliters (1.8× sample volume) of AgenCourt® AMPure® Reagent (Beckman Coulter, CA) was added to the ligated DNA. The mixture was pipetted thoroughly to mix the bead suspension with the ligated DNA. The mixture was pulse-spin and incubated at room temperature for 5 minutes. The samples underwent another pulse-spin and were placed on a magnetic rack such as a DynaMag™-2 spin magnet (Life Technologies, CA, Part No. 123-21D) for two minutes. After the solution had cleared, the supernatant was discarded. Without removing the tube from the magnetic rack, 200 microliters of freshly prepared 70% ethanol was introduced into the sample. The sample was incubated for 30 seconds while gently rotating the tube on the magnetic rack. After the solution cleared, the supernatant was discarded without disturbing the pellet. A second ethanol wash was performed and the supernatant discarded. Any remaining ethanol was removed by pulse-spinning the tube and carefully removing residual ethanol while not disturbing the pellet. The pellet was air-dried for about 5 minutes at room temperature.

The pellet was resuspended in 20 microliters of DNase/RNase Free Water (Life Technologies, CA, Part No. 600004) and vortexed to ensure the sample was mixed thoroughly. The sample was pulse-spin and placed on the magnetic rack for two minutes. After the solution cleared, the supernatant containing the ligated DNA was transferred to a new Lobind tube (Eppendorf, Part No. 022431021).

Nick Translate and Amplify the Amplicon Library and Purify the Library

The ligated DNA (~20 microliters) was combined with 76 microliters of Platinum® PCR SuperMix High Fidelity (Life Technologies, CA, Part No. 12532-016, sold as a component of the Ion Fragment Library Kit, Life Technologies, Part No. 4466464) and 4 microliters of Library Amplification Primer Mix (5 µM each) (Life Technologies, CA, Part No. 602-1068-01, sold as a component of the Ion Fragment Library Kit, Life Technologies, Part No. 4466464), the mixture was pipetted thoroughly to ensure a uniformed solution. The solution was applied to a single well of a 96-well PCR plate and sealed. The plate was loaded into a thermal cycler (GeneAmp® PCR system 9700 Dual 96-well thermal cycler (Life Technologies, CA, Part No. N8050200 and 4314445)) and run on the following temperate profile to generate the final amplicon library.

A nick-translation was performed at 72° C. for 1 minute, followed by an enzyme activation stage at 98° C. for 2 minutes, followed by 6 cycles of denaturing at 98° C. for 15 seconds and an annealing and extending stage at 60° C. for 1 minute. After cycling, the final amplicon library was held at 4° C. until proceeding to the final purification step outlined below.

In a 1.5 ml LoBind tube (Eppendorf, Part No. 022431021), the final amplicon library (~100 microliters) was combined with 180 microliters (1.8× sample volume) of Agencourt® AMPure® XP reagent (Beckman Coulter, CA). The bead suspension was pipetted up and down to thoroughly mix the bead suspension with the final amplicon library. The sample was then pulse-spin and incubated for 5 minutes at room temperature.

The tube containing the final amplicon library was placed on a magnetic rack such as a DynaMag™-2 spin magnet (Life Technologies, CA, Part No. 123-21D) for 2 minutes to capture the beads. Once the solution cleared, the supernatant was carefully discarded without disturbing the bead pellet. Without removing the tube from the magnetic rack, 400 microliters of freshly prepared 70% ethanol was introduced into the sample. The sample was incubated for 30 seconds while gently rotating the tube on the magnetic rack. After the solution cleared, the supernatant was discarded without disturbing the pellet. A second ethanol wash was performed and the supernatant discarded. Any remaining ethanol was removed by pulse-spinning the tube and carefully removing residual ethanol while not disturbing the pellet. The pellet was air-dried for about 5 minutes at room temperature.

Once the tube was dry, the tube was removed from the magnetic rack and 20 microliters of Low TE was added (Life Technologies, CA, Part No. 602-1066-01). The tube was pipetted and vortexed to ensure the sample was mixed thoroughly. The sample was pulse-spin and placed on the magnetic rack for two minutes. After the solution cleared, the supernatant containing the final amplicon library was transferred to a new Lobind tube (Eppendorf, Part No. 022431021).

Assess the Library Size Distribution and Determine the Template Dilution Factor

The final amplicon library was quantitated to determine the library dilution (Template Dilution Factor) that results in a concentration within the optimized target range for Template Preparation (e.g., PCR-mediated addition of library molecules onto Ion Sphere™ Particles). The final amplicon library is typically quantitated for downstream Template Preparation procedure using an Ion Library Quantitation Kit (qPCR) (Life Technologies, Part No. 4468802) and/or a Bioanalyzer™ (Agilent Technologies, Agilent 2100 Bioanalyzer) to determine the molar concentration of the amplicon library, from which the Template Dilution Factor is calculated. For example, instructions to determine the Template Dilution Factor by quantitative real-time PCR (qPCR) can be found in the Ion Library Quantitation Kit User Guide (Life Technologies, Part No. 4468986).

In this example, 1 microliter of the final amplicon library preparation was analyzed on the 2100 Bioanalyzer™ with an Agilent High Sensitivity DNA Kit (Agilent Technologies, Part No. 5067-4626).

Proceed to Template Preparation

An aliquot of the final library was used to prepare DNA templates that were clonally amplified on Ion Sphere™ Particles using emulsion PCR (emPCR). The preparation of template in the instant example was prepared according to the manufacturer's instructions using an Ion Xpress Template Kit (Life Technologies, Part No. 4466457). Once template-positive Ion Sphere Particles were enriched, an aliquot of the Ion Spheres were loaded onto an Ion 314TH Chip (Life Technologies, Part No. 4462923) as described in the Ion Sequencing User Guide (Part No. 4467391), and subjected to analysis and sequencing as described in the Ion Torrent PGM Sequencer User Guide (Life Technologies, Part No. 4462917).

Example 15

Alternate Library Protocol

PCR Amplify Genomic DNA Targets

In this example, a multiplex polymerase chain reaction was performed to amplify multiple individual amplicons across a genomic DNA sample. A representative list of genes associated with cancers that were incorporated for investigation while synthesizing the primer pool is provided in Table 1 (see U.S. Ser. No. 13/458,739, filed Apr. 27, 2012, hereby incorporated by reference in its entirety). Each primer pair in the primer pool was designed to contain at least one uracil nucleotide in each of the forward and reverse primer (Table 2-see U.S. Ser. No. 13/458,739, filed Apr. 27, 2012, hereby incorporated by reference in its entirety). Each primer pair was also designed to selectively hybridize to, and promote amplification of a specific gene or gene fragment of the genomic DNA sample to reduce formation of non-specific amplification products.

To a single well of a 96-well PCR plate was added 10 microliters of 2× Primer Pool (containing the primer pairs of Table 2 (found in U.S. Ser. No. 13/458,739, filed Apr. 27, 2012, hereby incorporated by reference in its entirety)) at a concentration of 250 nm each, 10 ng of genomic DNA and 4 microliters of an amplification reaction mixture (5× Ion Ampliseq Master Mix) that can include glycerol, dNTPs and a DNA polymerase (for example, Stoffel fragment of Amplitaq® DNA Polymerase (Invitrogen Catalog No. N8080038)) to a final volume of 20 microliters with nuclease free water (Life Technologies, CA, Part No. 600004).

The PCR plate was sealed and loaded into a thermal cycler (GeneAmp® PCR system 9700 Dual 96-well thermal cycler (Life Technologies, CA, Part No. N8050200 and 4314445)) and run on the following temperature profile to generate the preamplified amplicon library. Variation to the number of cycles was performed based on the total plexy of the reaction mixture under investigation. For example, a plexy of 48-96 was run for 17 cycles; a plexy of 97-192 was run for 16 cycles; a plexy of 193-384 was run for 15 cycles; a plexy of 385-768 was run for 14 cycles; a plexy of 769-1536 was run for 13 cycles. Additionally, for reaction mixtures containing barcodes or pooled reaction mixtures the number of cycles was lowered by one or more additional cycles. For example, 2-3 barcodes per sample were subtracted by one cycle; 4-8 barcodes per sample were subtracted by 2 cycles, and 9-16 barcodes were subtracted by 3 cycles. For samples that contain fragmented DNA, e.g., enzymatically digested DNA, the number of cycles can be increased for up to 3 cycles. For selective amplification of one or more DNA samples using a starting input of 1 ng or less DNA, the number of cycles was increased by an additional 3 cycles. An initial holding stage was performed at 99° C. for 2 minutes, followed by X cycles (as determined above) of denaturing at 99° C. for 15 seconds and an annealing and extending stage at 60° C. for 4 minutes. After cycling, the preamplified amplicon library was held at 4° C. until proceeding to the purification step outlined below.

Digest/Phosphorylate/Heat Kill the Amplicons

To the preamplified library (~20 microliters), 2 microliters of FuPa reagent was added. Typically, the FuPa reagent comprises one or more uracil degradable enzymes such as UDG, FPG and the like, a DNA polymerase such as Klenow fragment, and an antibody such as an anti-Taq antibody. In this example, the relative amount of each enzymatic component in the FuPa reagent was 1:1:1:2 but can be varied according to the number of required cycles, variations to the temperature profile, etc., as can be determined by one of ordinary skill in the art. The PCR plate was sealed and loaded into a thermal cycler (GeneAmp® PCR system 9700 Dual 96-well thermal cycler (Life Technologies, CA, Part No. N8050200 and 4314445)) and run on the following temperature profile. An initial holding stage was performed at 37° C. for 10 minutes, followed by 55° C. for 10 minutes and then 60° C. for 20 minutes. After cycling, the preamplified amplicon library was held at 4° C. until proceeding to the ligation/nick translation step outlined below.

Ligate Adpaters to the Amplicons and Nick Translate

After phosphorylation, the amplicon preamplification library (~22 µl) proceeded directly to a ligation step. In this example, the preamplification library now containing the phosphorylated amplicon library was combined with 2 microliters of A/P1 Adaptersadapters (5 um each) (sold as a component of the Ion Fragment Library Kit, Life Technologies, Part No. 4466464), 4 microliters of 7.5× ligation buffer and 2 microliters of T4 DNA ligase (5 u/µl). The PCR plate was sealed and loaded into a thermal cycler (GeneAmp® PCR system 9700 Dual 96-well thermal cycler (Life Technologies, CA, Part No. N8050200 and 4314445)) and run on the following temperature profile. An initial holding stage was performed at 22° C. for 30 minutes, followed by 60° C. for 5 minutes and then held at 4° C. until proceeding to the next step.

If the amplicon library is to contain barcodes (for example Ion DNA Barcoding 1-16 kit, Life Technologies, Part No. 4468654, incorporated herein in its entirety), the barcodes are added at this step to the PCR plate essentially according to the manufacturer's instructions prior to proceeding to the next step. Optionally, all the samples or barcodes can be pooled into a single tube at this step.

1.6×AMPure XP Purification 1.6× sample volume of AgenCourt® AMPure® Reagent (Beckman Coulter, CA) was added to the ligated DNA. The mixture was mixed and incubated at room temperature for 5 minutes. An ethanol wash was performed and the supernatant discarded. Any remaining ethanol was removed and air-dried for about 5 minutes at room temperature. The dry tube containing the library was resuspended in 20 microliters of Nuclease Free Water (Life Technologies, CA, Part No. 600004). In some instances, an optional nick translation/library amplification step can be performed on the amplicon library, as outlined below.

Nick Translate and Amplify the Amplicon Library and Purify the Library

The ligated DNA (~20 microliters) was combined with 78 microliters of Platinum® PCR SuperMix High Fidelity (Life Technologies, CA, Part No. 12532-016, sold as a component of the Ion Fragment Library Kit, Life Technologies, Part No. 4466464) and 4 microliters of Library Amplification Primer Mix (5 µM each) (Life Technologies, CA, Part No. 602-1068-01, sold as a component of the Ion Fragment Library Kit, Life Technologies, Part No. 4466464). The solution was applied to a single well of a 96-well PCR plate and sealed. The plate was loaded into a thermal cycler (GeneAmp® PCR system 9700 Dual 96-well thermal cycler (Life Technologies, CA, Part No. N8050200 and 4314445)) and run on the following temperate profile to generate the final amplicon library.

A nick-translation was performed at 72° C. for 1 minute, followed by an enzyme activation stage at 98° C. for 2 minutes, followed by 7 cycles of denaturing at 98° C. for 15 seconds and an annealing and extending stage at 60° C. for 1 minute. After cycling, the final amplicon library was held at 4° C. until proceeding to the final purification step outlined below.

The final amplicon library (~100 microliters) was combined with 1.8× sample volume of Agencourt® AMPure® XP reagent (Beckman Coulter, CA). The mixture was then incubated for 5 minutes at room temperature. The final amplicon library was washed with 70% ethanol and the supernatant discarded. Any remaining ethanol was removed and air-dried for about 5 minutes at room temperature. Once dry, the library was resuspended in 20 microliters of Low TE (Life Technologies, CA, Part No. 602-1066-01). In this example, 1 microliter of the final amplicon library preparation was analyzed on the 2100 Bioanalyzer™ with an Agilent High Sensitivity DNA Kit (Agilent Technologies, Part No. 5067-4626).

Example 16

In this example, an amplicon library was prepared using 2946 target-specific primer pairs. The primer pairs were prepared from the list of genes in Tables 1 and 18 (both found in U.S. Ser. No. 13/458,739, filed Apr. 27, 2012, hereby incorporated by reference in its entirety). Each primer pair was designed to selectively hybridize and promote amplification of the selected targeted region. The libraries were prepared according to Example 14 except that the primer pool was pooled into a single PCR tube, evaporated and resuspended in low TE and supplemented with 0.25 mM magnesium chloride prior to incubating with DNA and the amplification reaction mixture. In this example, both high molecular weight DNA or mechanically sheared DNA were applied as input DNA (10 ng input). The results from this sequencing experiment are provided in the Table below and demonstrated approximately 91-98% of all reads were on target, greater than 99% target coverage at 1× when normalized to 100×, and greater than 98% base accuracy.

| Plexity of PreAmp | 2946 | 2946 |
|---|---|---|
| Target DNA | Sheared | HMW |
| Percent greater than 0.01 mean reads per base | 99.40% | 99.29% |
| Percent greater than 0.1 mean reads per base | 96.33% | 95.16% |
| Percent greater than 0.2 mean reads per base | 92.26% | 89.40% |
| Percent no strand bias of all Amps | 71.15% | 72.98% |
| Percent no strand bias of all Amps >100 reads | 73.31% | 77.12% |
| Percent end to end read of on target reads | −1.00% | −1.00% |
| Per base accuracy | 98.34% | 98.59% |
| Percent of total reads mapped on target | 99.10% | 99.14% |
| Percent wells with read | 35.94% | 31.23% |
| Number of total reads | 2277968 | 1979529 |
| Number of mapped reads | 2257427 | 1962501 |
| Number of targets | 2946 | 2946 |
| Number of reads on target | 2094328 | 1941916 |
| Percent all reads on target | 91.94% | 98.10% |
| Percent mapped reads on target | 92.78% | 98.95% |
| Percent reads off target | 7.16% | 1.04% |
| Percent reads unmapped | 0.90% | 0.86% |
| Bases in targeted reference | 327815 | 327815 |
| Bases covered (at least 1×) | 326642 | 326656 |
| Total base reads on target | 220235195 | 206585756 |
| Average base coverage depth | 671.83 | 630.19 |
| Maximum base read depth | 3070 | 2520 |
| Average base read depth | 674.23 | 632.43 |
| Std.Dev base read depth | 431.42 | 466.91 |
| Target coverage at 1× | 99.64% | 99.65% |
| Target coverage at 10× | 99.23% | 99.12% |
| Target coverage at 20× | 98.77% | 98.42% |
| Target coverage at 1×-norm 100 | 99.40% | 99.29% |
| Target coverage at 10×-norm 100 | 96.33% | 95.16% |
| Target coverage at 20×-norm 100 | 92.26% | 89.40% |
| Percent end to end read of on target reads | −1.00% | −1.00% |
| Percent forward end to end read of on target reads | −1.00% | −1.00% |
| Percent reverse end to end read of on target reads | −1.00% | −1.00% |
| Coverage needed for 99 percentile base with at least 1× coverage | 52.2 | 48.96 |
| Coverage needed for 98 percentile base with at least 10× coverage | 207.65 | 247.24 |
| Coverage needed for 95 percentile base with at least 20× coverage | 145.33 | 203.58 |

Example 17

In this example, an amplicon library was prepared using 6110 target-specific primer pairs. The library corresponds to approximately 450 cancer genes. The primer pairs were prepared from the list of genes in Tables 1 and 18 (both found in U.S. Ser. No. 13/458,739, filed Apr. 27, 2012, hereby incorporated by reference in its entirety). Each primer pair was designed to selectively hybridize and promote amplification of the selected targeted region using the target-specific selection criteria outline herein. The libraries were prepared according to Example 14 except that the primer pools were prepared as two tubes (3188-plex and 2946-plex) and supplemented with 0.5 mM magnesium chloride. The PCR preamplification cycling steps were also modified to increase the denaturing temperature to 99° C., included an extending step of 72° C. for 5 minutes, after the 60° C. annealing step, which was also extended to 10 minutes. After cycling, each tube containing the amplicon library was combined into a single emulsion for emulsion PCR enrichment. The amplicon library was used to prepare DNA templates that were clonally amplified on Ion Sphere™ Particles using emulsion PCR (emPCR). The preparation of template in the instant example was prepared according to the manufacturer's instructions using an Ion Xpress Template Kit (Life Technologies, Part No. 4466457). Once template-positive Ion Sphere Particles were enriched, an aliquot of the Ion Spheres were loaded onto an Ion 316TH Chip (Life Technologies, Part No. 4466616) as described in the Ion Sequencing User Guide (Part No. 4467391), and subjected to analysis and sequencing as described in the Ion Torrent PGM Sequencer User Guide (Life Technologies, Part No. 4462917).

In this example, high molecular weight DNA was applied as the input DNA (10 ng). The results from this experiment are provided in the Table below and demonstrated approximately 95% of all reads were on target, approximately 95% of all reads (greater than 100 reads) showed no strand bias, and greater than 97% base accuracy.

| | |
|---|---|
| Percent greater than 0.01 mean reads per base | 81.58% |
| Percent greater than 0.1 mean reads per base | 75.40% |
| Percent greater than 0.2 mean reads per base | 69.73% |
| Percent no strand bias of all bases | 92.16% |
| Percent no strand bias of all Amps | 72.16% |
| Percent no strand bias of all Amps >100 reads | 95.06% |
| Percent end to end read of on target reads | −1.00% |
| Per base accuracy | 97.78% |
| Percent of total reads mapped to hg19 | 98.05% |
| Percent wells with read | 34.51% |
| Number of total reads | 2190638 |
| Number of mapped reads | 2147835 |
| Number of targets | 6110 |
| Number of reads on target | 2098176 |

-continued

| | |
|---|---|
| Percent all reads on target | 95.78% |
| Percent mapped reads on target | 97.69% |
| Percent reads off target | 2.27% |
| Percent reads unmapped | 1.95% |
| Bases in targeted reference | 677270 |
| Bases covered (at least 1×) | 556880 |
| Total base reads on target | 243058082 |
| Average base coverage depth | 358.88 |
| Maximum base read depth | 2402 |
| Average base read depth | 436.45 |
| Std.Dev base read depth | 371.45 |
| Target coverage at 1× | 82.22% |
| Target coverage at 10× | 80.45% |
| Target coverage at 20× | 78.41% |
| Target coverage at 100× | 66.15% |
| Target coverage at 500× | 29.11% |
| Target coverage at 1×-norm 100 | 81.58% |
| Target coverage at 10×-norm 100 | 75.40% |
| Target coverage at 20×-norm 100 | 69.73% |
| Target coverage at 100×-norm 100 | 40.40% |
| Target coverage at 500×-norm 100 | 0.34% |
| Percent end to end read of on target reads | −1.00% |
| Percent forward end to end read of on target reads | −1.00% |
| Percent reverse end to end read of on target reads | −1.00% |
| Coverage needed for 99 percentile base with at least 1× coverage | 865.36 |
| Coverage needed for 98 percentile base with at least 20× coverage | 8653.57 |
| Coverage needed for 95 percentile base with at least 350× coverage | 60574.98 |
| Percent priority 1 design covered | 0 |
| Percent priority 9 design covered | 0 |

Example 18

In this example, an amplicon library was prepared using approximately 1500 target-specific primer pairs. The primer pairs were prepared from genes in Table 1 (see U.S. Ser. No. 13/458,739, filed Apr. 27, 2012, hereby incorporated by reference in its entirety). Each primer pair was designed to selectively hybridize and promote amplification of the selected targeted region using the target-specific primer selection criteria outlined herein. The libraries were prepared according to Example 15 except that the number of preamplification PCR cycles was amended as follows: Plexy: 12-24=18 cycles; 25-48=17 cycles; 48-96=16 cycles; 97-192=15 cycles; 193-384=14 cycles; 385-768=13 cycles; 769-1536=12 cycles; 1537-3072=11 cycles. When using fragmented DNA, up to 2 additional cycles were added to the preamplification PCR process. Additionally, the annealing temperature (60° C.) can be increased from 4 minutes to 8 minutes when using 1537+plexy.

During the nick translation and library amplification step, the number of PCR cycles can be increased, for example to about 10, when necessary.

The amplicon library was used to prepare DNA templates that were clonally amplified on Ion Sphere™ Particles using emulsion PCR (emPCR). The preparation of template in the instant example was prepared according to the manufacturer's instructions using an Ion Xpress Template Kit (Life Technologies, Part No. 4466457). Once template-positive Ion Sphere Particles were enriched, an aliquot of the Ion Spheres were loaded onto an Ion 316TH Chip (Life Technologies, Part No. 4466616) as described in the Ion Sequencing User Guide (Part No. 4467391), and subjected to analysis and sequencing as described in the Ion Torrent PGM Sequencer User Guide (Life Technologies, Part No. 4462917).

In this example, 10 ng FFPE DNA was applied as the input DNA. The results from this experiment are provided in the Table below and demonstrated approximately 94% showed base without strand bias, greater than 98% per base accuracy, and 99% of bases with greater than 20× coverage when average coverage normalized to 100×.

| | |
|---|---|
| Number of targets | 1459 |
| Per Base Accuracy | 98.70% |
| Percent bases >0.2× mean | 99.20% |
| Target coverage at 20× if normalized to 100× average coverage depth | 99.20% |
| Base without Strand Bias | 94.12% |
| Percent of reads on target | 80.54% |
| Coverage needed for 98 percentile base with at least 20× coverage | 65.07 |
| Percent bases >0.01× mean | 99.77% |

Example 19

Multiplex PCR with 12,500 Target Specific Primers

In this example, several amplicon libraries were prepared using approximately 12,000 target-specific primer pairs in a single reaction. The target-specific primer pairs were prepared from genes associated with cancers, provided in Table 18 (found in U.S. Ser. No. 13/458,739, filed Apr. 27, 2012, hereby incorporated by reference in its entirety). The target-specific primers were designed using the primer selection criteria outlined herein. In this example, primers from Table 6 of U.S. Application 61/598,881 hereby incorporated by reference in its entirety were used as target-specific primers in the reaction. Each target-specific primer pair was designed to promote amplification of the intended target sequence outlined in Table 18 (from U.S. Ser. No. 13/458,739, filed Apr. 27, 2012, hereby incorporated by reference in its entirety). Each amplicon library was prepared according to the section of Example 13 titled PCR amplify genomic DNA targets, except that the concentration of target-specific primers in the primer pool was amended to 25 nM and the number of target-specific primers was about 12,000. Additionally, the preamplification PCR cycles was amended as follows: An initial holding stage was performed at 99° C. for 2 minutes, followed by 11 cycles of denaturing at 99° C. for 15 seconds; a first annealing stage at 60° C. for 10 minutes; a second annealing stage at 63° C. for 5 minutes; a third annealing stage at 66° C. for 5 minutes; a fourth annealing stage at 69° C. for 5 minutes; and an extending stage at 72° C. for 5 minutes; followed by 5 cycles of denaturing at 99° C. for 15 seconds; a first annealing stage at 60° C. for 10 minutes; a second annealing stage at 63° C. for 6 minutes; a third annealing stage at 66° C. for 6 minutes; a fourth annealing stage at 69° C. for 6 minutes; and an extending stage at 72° C. for 6 minutes. After cycling, the preamplified amplicon library was held at 4° C. until proceeding to the next step as outlined below.

Purify the Amplicons from input DNA and Primers

One round of Agencourt® AMPure® XP Reagent (Beckman Coulter, CA) binding, wash, and elution at 1.2× volume ratio was found to remove genomic DNA and unbound or excess primers.

In a 1.5 ml LoBind tube (Eppendorf, Part No. 022431021), the preamplified amplicon library (20 microliters) was combined with 24 microliters (1.2× volume) of Agencourt® AMPure® XP reagent (Beckman Coulter, CA). The bead suspension was pipetted up and down to thoroughly mix the bead suspension with the preamplified amplicon library. The sample was then pulse-spin and incubated for 5 minutes at room temperature. The tube containing the sample was placed on a magnetic rack such as a DynaMag™-2 spin magnet (Life Technologies, CA, Part No. 123-21D) for 2 minutes to capture the beads. Once the solution cleared, the supernatant was transferred to a new tube, where 13.3 ul of nuclease free water was added. Then, 48 microliters of Agen-Court® AMPure® XP beads (Beckman Coulter, CA) were added to the diluted supernatant. The mixture was pipetted to ensure the bead suspension mixed with the preamplified amplicon library. The sample was then pulse-spin and incubated at room temperature for 5 minutes. The tube containing the sample was placed on the magnetic rack for 2 minutes to capture the beads. Once the solution cleared, the supernatant was carefully discarded without disturbing the bead pellet. The desired preamplified amplicon library was now bound to the beads. Without removing the tube from the magnetic rack, 200 microliters of freshly prepared 70% ethanol was introduced into the sample. The sample was incubated for 30 seconds while gently rotating the tube on the magnetic rack. After the solution cleared, the supernatant was discarded without disturbing the pellet. A second ethanol wash was performed and the supernatant discarded. Any remaining ethanol was removed by pulse-spinning the tube and carefully removing residual ethanol while not disturbing the pellet. The pellet was air-dried for about 5 minutes at room temperature.

Once the tube was dry, the tube was removed from the magnetic rack and 20 microliters of DNase/RNase Free Water was added (Life Technologies, CA, Part No. 600004). The tube was vortexed and pipetted to ensure the sample was mixed thoroughly. The sample was pulse-spin and placed on the magnetic rack for two minutes. After the solution cleared, the supernatant containing the eluted DNA was transferred to a new tube.

Phosphorylate the Amplicons

To the eluted DNA (~20 microliters), 3 microliters of DNA ligase buffer (Invitrogen, Catalog No. 15224041), 2 microliters dNTP mix, and 2 microliters of FuP reagent were added. The reaction mixture was mixed thoroughly to ensure uniformity and incubated at 37° C. for 13 minutes.

Ligate Adpaters to the Amplicons and Purify the Ligated Amplicons

After incubation, the reaction mixture proceeded directly to a ligation step. Here, the reaction mixture now containing the phosphorylated amplicon library was combined with 1.5 microliter of A/P1 adapters (20 µm each) (sold as a component of the Ion Fragment Library Kit, Life Technologies, Part No. 4466464) and 1 microliter of DNA ligase (sold as a component of the Ion Fragment Library Kit, Life Technologies, Part No. 4466464), and incubated at room temperature for 30 minutes.

After the incubation step, 52 microliters (1.8× sample volume) of AgenCourt® AMPure® Reagent (Beckman Coulter, CA) was added to the ligated DNA. The mixture was pipetted thoroughly to mix the bead suspension with the ligated DNA. The mixture was pulse-spin and incubated at room temperature for 5 minutes. The samples underwent another pulse-spin and were placed on a magnetic rack such as a DynaMag™-2 spin magnet (Life Technologies, CA, Part No. 123-21D) for two minutes. After the solution had cleared, the supernatant was discarded. Without removing the tube from the magnetic rack, 200 microliters of freshly prepared 70% ethanol was introduced into the sample. The sample was incubated for 30 seconds while gently rotating the tube on the magnetic rack. After the solution cleared, the supernatant was discarded without disturbing the pellet. A second ethanol wash was performed and the supernatant discarded. Any remaining ethanol was removed by pulse-spinning the tube and carefully removing residual ethanol while not disturbing the pellet. The pellet was air-dried for about 5 minutes at room temperature.

The pellet was resuspended in 20 microliters of DNase/RNase Free Water (Life Technologies, CA, Part No. 600004) and vortexed to ensure the sample was mixed thoroughly. The sample was pulse-spin and placed on the magnetic rack for two minutes. After the solution cleared, the supernatant containing the ligated DNA was transferred to a new Lobind tube (Eppendorf, Part No. 022431021).

Nick Translate and Amplify the Amplicon Library and Purify the Library

The ligated DNA (~20 microliters) was combined with 76 microliters of Platinum® PCR SuperMix High Fidelity (Life Technologies, CA, Part No. 12532-016, sold as a component of the Ion Fragment Library Kit, Life Technologies, Part No. 4466464) and 4 microliters of Library Amplification Primer Mix (5 µM each) (Life Technologies, CA, Part No. 602-1068-01, sold as a component of the Ion Fragment Library Kit, Life Technologies, Part No. 4466464), the mixture was pipetted thoroughly to ensure a uniformed solution. The solution was applied to a single well of a 96-well PCR plate and sealed. The plate was loaded into a thermal cycler (GeneAmp® PCR system 9700 Dual 96-well thermal cycler (Life Technologies, CA, Part No. N8050200 and 4314445)) and run on the following temperate profile to generate the final amplicon library.

A nick-translation was performed at 72° C. for 1 minute, followed by an enzyme activation stage at 98° C. for 2 minutes, followed by 6 cycles of denaturing at 98° C. for 15 seconds and an annealing and extending stage at 60° C. for 1 minute. After cycling, the final amplicon library was held at 4° C. until proceeding to the final purification step outlined below.

In a 1.5 ml LoBind tube (Eppendorf, Part No. 022431021), the final amplicon library (~100 microliters) was combined with 180 microliters (1.8× sample volume) of Agencourt® AMPure® XP reagent (Beckman Coulter, CA). The bead suspension was pipetted up and down to thoroughly mix the bead suspension with the final amplicon library. The sample was then pulse-spin and incubated for 5 minutes at room temperature. The tube containing the final amplicon library was placed on a magnetic rack such as a DynaMag™-2 spin magnet (Life Technologies, CA, Part No. 123-21D) for 2 minutes to capture the beads. Once the solution cleared, the supernatant was carefully discarded without disturbing the bead pellet. Without removing the tube from the magnetic rack, 400 microliters of freshly prepared 70% ethanol was introduced into the sample. The sample was incubated for 30 seconds while gently rotating the tube on the magnetic rack. After the solution cleared, the supernatant was discarded without disturbing the pellet. A second ethanol wash was performed and the supernatant discarded. Any remaining ethanol was removed by pulse-spinning the tube and carefully removing residual ethanol while not disturbing the pellet. The pellet was air-dried for about 5 minutes at room temperature.

Once the tube was dry, the tube was removed from the magnetic rack and 20 microliters of Low TE was added (Life Technologies, CA, Part No. 602-1066-01). The tube was pipetted and vortexed to ensure the sample was mixed thoroughly. The sample was pulse-spin and placed on the magnetic rack for two minutes. After the solution cleared, the supernatant containing the final amplicon library was transferred to a new Lobind tube (Eppendorf, Part No. 022431021).

Assess the Library Size Distribution and Determine the Template Dilution Factor

The final amplicon library was quantitated to determine the library dilution (Template Dilution Factor) that results in a concentration within the optimized target range for Template Preparation (e.g., PCR-mediated addition of library molecules onto Ion Sphere™ Particles). The final amplicon library is typically quantitated for downstream Template Preparation procedure using an Ion Library Quantitation Kit (qPCR) (Life Technologies, Part No. 4468802) and/or a Bioanalyzer™ (Agilent Technologies, Agilent 2100 Bioanalyzer) to determine the molar concentration of the amplicon library, from which the Template Dilution Factor is calculated. For example, instructions to determine the Template Dilution Factor by quantitative real-time PCR (qPCR) can be found in the Ion Library Quantitation Kit User Guide (Life Technologies, Part No. 4468986).

In this example, 1 microliter of the final amplicon library preparation was analyzed on the 2100 Bioanalyzer™ with an Agilent High Sensitivity DNA Kit (Agilent Technologies, Part No. 5067-4626) to generate peaks in the 135-205 bp size range and at a concentration of about $5 \times 10^9$ copies per microliter.

Proceed to Template Preparation

An aliquot of the final library was used to prepare DNA templates that were clonally amplified on Ion Sphere™ Particles using emulsion PCR (emPCR). The preparation of template in the instant example was prepared according to the manufacturer's instructions using an Ion Xpress Template Kit (Life Technologies, Part No. 4466457). Once template-positive Ion Sphere Particles were enriched, an aliquot of the Ion Spheres were loaded onto an Ion 314TH Chip (Life Technologies, Part No. 4462923) as described in the Ion Sequencing User Guide (Part No. 4467391), and subjected to analysis and sequencing as described in the Ion Torrent PGM Sequencer User Guide (Life Technologies, Part No. 4462917). The data obtained from this example is provided in the Table below.

| Ampliseq 1.0 work flow mod Sample (50 ng NA12878) | | | | enrich unbound |
|---|---|---|---|---|
| Plexity | 6,000 | 12,000 | 12,000 | 12,000 |
| C450 oligo pool | pool 1 + 3 | pool 1 + 2 + 3 + 4 | pool 1 + 2 + 3 + 4 | pool 1 + 2 + 3 + 4 |
| PreAmp cycle (6 hr = PA1; 9 hr = PA2) | 6 hr | 6 hr | 9 hr | 9 hr |
| PA enzyme/load % | Taq/69% | Taq/82% | Stoffel/35% | Stoffel/43% |
| Percent greater than 0.01 mean reads per base | 97.72% | 79.15% | 82.08% | 78.42% |
| Percent greater than 0.1 mean reads per base | 84.32% | 54.28% | 82.08% | 54.22% |
| Percent greater than 0.2 mean reads per base | 73.79% | 44.86% | 68.80% | 45.45% |
| Percent no strand bias of all bases | 80.42% | 68.48% | 45.19% | 66.01% |
| Percent no strand bias of all Amps | 81.23% | 62.87% | 32.68% | 54.80% |
| Percent no strand bias of all Amps >100 reads | 139.07% | 229.75% | 8126.00% | 334.62% |
| Percent end to end read of on target reads | 71.40% | 60.05% | 53.32% | 77.87% |
| Per base accuracy | 97.38% | 97.47% | 97.18% | 98.87% |
| Percent of total reads mapped to hg19 | 98.17% | 97.86% | 97.65% | 97.10% |
| Percent wells with read | 25.93% | 30.34% | 1.62% | 12.97% |
| Number of total reads | 1643486 | 1916570 | 102466 | 821799 |
| Number of mapped reads | 1613458 | 1875619 | 100261 | 797953 |
| Number of targets | 6249 | 12469 | 12469 | 12469 |
| Number of reads on target | 1634973 | 1793835 | 93560 | 753982 |
| Percent all reads on target | 93.40% | 93.60% | 91.31% | 92.96% |
| Percent mapped reads on target | 95.14% | 95.64% | 93.32% | 95.74% |
| Percent reads off target | 4.78% | 4.27% | 6.54% | 4.13% |
| Percent reads unmapped | 1.83% | 2.14% | 2.15% | 2.90% |
| Bases in targeted reference | 668162 | 1249178 | 1249178 | 1249178 |
| Bases coverered (at least 1×) | 661416 | 1076079 | 1025284 | 979564 |
| Total base reads on target | 156995237 | 189835769 | 9789500 | 80845870 |
| Average base coverage depth | 234.97 | 151.97 | 7.94 | 64.72 |
| Maximum base read depth | 2391 | 4284 | 339 | 3921 |
| Average base read depth | 237.32 | 176.23 | 9.52 | 82.46 |
| Std.Dev base read depth | 277.21 | 351.91 | 16.09 | 157.73 |
| Target coverage at 1× | 98.99% | 86.14% | 82.08% | 78.42% |
| Target coverage at 10× | 93.38% | 60.43% | 22.25% | 49.45% |
| Target coverage at 20× | 86.73% | 51.08% | 9.49% | 39.12% |
| Target coverage at 100× | 57.38% | 28.62% | 0.44% | 17.75% |
| Target coverage at 500× | 14.24% | 9.07% | 0.00% | 2.34% |
| Target coverage at1×-norm 100 | 97.72% | 79.15% | 82.08% | 78.42% |
| Target coverage at 10×-norm 100 | 84.32% | 54.28% | 82.08% | 54.22% |
| Target coverage at 20×-norm 100 | 73.79% | 44.86% | 68.80% | 45.45% |
| Target coverage at 100×-norm 100 | 33.67% | 23.15% | 27.66% | 23.26% |
| Target ceverage at 500×-norm 100 | 1.20% | 5.22% | 3.24% | 5.22% |
| Percent end to end read of on target reads | 71.40% | 69.05% | 53.32% | 77.87% |
| Percent forward end to end read of on target reads | 36.45% | 35.07% | 26.64% | 39.40% |
| Percent reverse end to end read of on target reads | 34.95% | 33.96% | 26.67% | 38.47% |
| Coverage needed for 99 percentile base with at least 1× coverage | 156.65 | 475.51 | 215.63 | 274.86 |

Example 20

Assessment of Relative Copy Number Variation (CNV)

In this example, several DNA samples were amplified using 3000 target-specific primer pairs. The target-specific primers were designed using the target-specific primer selection criteria outlined herein. The sequences of the selected target-specific primers used in this experiment can be found in Table 17 (see U.S. Ser. No. 13/458,739, filed Apr. 27, 2012, hereby incorporated by reference in its entirety) (or Table 6 of U.S. Application 61/598,881 hereby incorporated by reference in its entirety). The DNA samples were barcoded during the library amplification process (as outlined in Example 13). In this example, the DNA samples were obtained from a commercial source (Coriell DNA) and contained known variations in copy number to demonstrate that the multiplex amplification methods disclosed herein can be used to assess copy number variation.

Four DNA samples were purchased from Coriell DNA that contained a 3 Mb deletion on chromosome 22 that was associated with DiGeorge Syndrome. An additional DNA sample was purchased from Coriell DNA that contained a 16 Mb deletion on chromosome 7 associated with Grieg Cephalopolysyndactyly Syndrome (GCPS). An amplicon library was prepared for each DNA sample including a barcode for the purposes of distinguishing one DNA sample from another. Each amplicon library was prepared according to the method outlined in Example 15, except in this example, 3000 target-specific primer pairs were used in a single preamplification reaction. The target-specific primer pairs were prepared from the genes in Table 18 (see U.S. Ser. No. 13/458, 739, filed Apr. 27, 2012, hereby incorporated by reference in its entirety). Each amplicon library was prepared using 10 ng of DNA from the starting material. The libraries were prepared according to Example 15 except that the number of preamplification PCR cycles was amended as follows: Plexy: 12-24=18 cycles; 25-48=17 cycles; 48-96=16 cycles; 97-192=15 cycles; 193-384=14 cycles; 385-768=13 cycles; 769-1536=12 cycles; 1537-3072=11 cycles. When using fragmented DNA (e.g., FFPE DNA samples), up to 2 additional cycles can be added to the preamplification PCR process. Additionally, the annealing temperature (60° C.) can be increased from 4 minutes to 8 minutes when using 1537+ plexy, if a higher yield is necessary.

If required, the number of PCR cycles can be increased during the nick translation and library amplification step, for example to about 10 cycles.

The amplicon library was used to prepare DNA templates that were clonally amplified on Ion Sphere™ Particles using emulsion PCR (emPCR). The preparation of template in the instant example was prepared according to the manufacturer's instructions using an Ion Xpress Template Kit (Life Technologies, Part No. 4466457). Once template-positive Ion Sphere Particles were enriched, an aliquot of the Ion Spheres were loaded onto an Ion 316TH Chip (Life Technologies, Part No. 4466616) as described in the Ion Sequencing User Guide (Part No. 4467391), and subjected to analysis and sequencing as described in the Ion Torrent PGM Sequencer User Guide (Life Technologies, Part No. 4462917).

In this example, 10 ng DNA was applied as the input DNA. The results from this experiment are provided in FIGS. 14-15.

Figure 14:
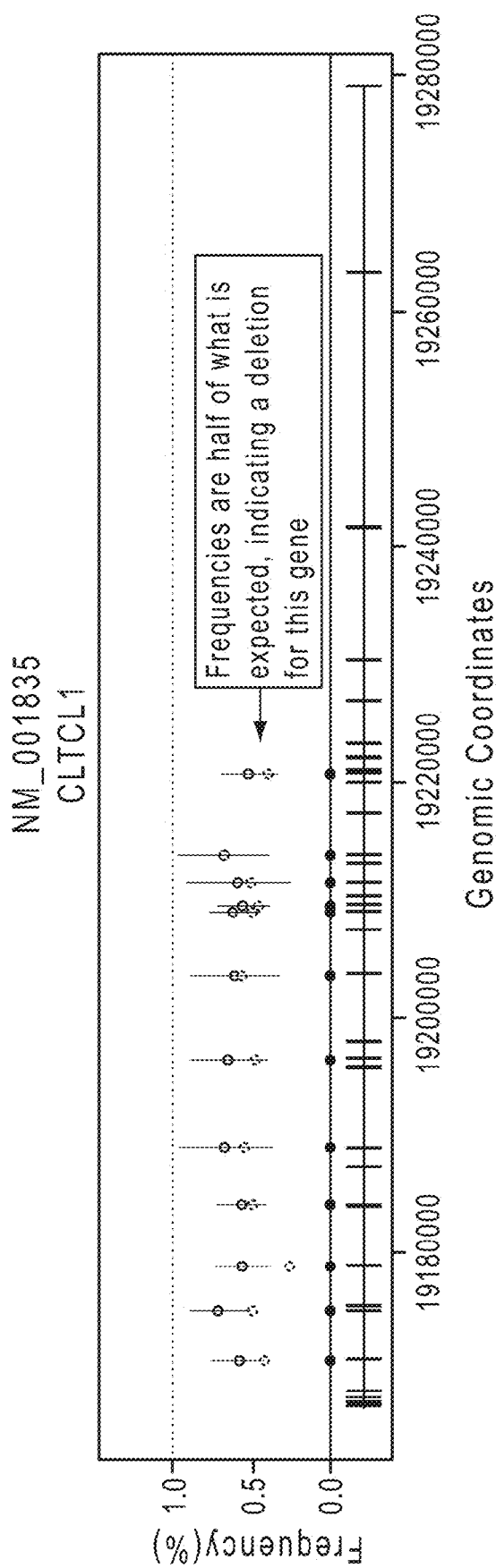
FIG. 14 shows the frequencies of twelve different amplicons obtained for a region of the CLTCL1 gene in several DNA samples containing known copy number variation. The amplicons were obtained according to exemplary embodiments of the disclosure.

FIG. 14 shows that the multiplex PCR amplification methods disclosed herein can be used to assess copy number variation. FIG. 14 shows the amplicon frequency data for 12 amplicons spanning part of the critical region of the gene CLTCL1 associated with DiGeorge Syndrome. The circles plotted at frequency 0 represent each amplicon of CLTCL1 amplified by the multiplex amplification method. The (solo) circles are data points from a single DiGeorge Syndrome DNA sample obtained from Coriell DNA. Four DiGeorge Syndrome DNA samples were tested in this experiment and an average ratio of percent total reads filtered for DiGeorge samples compared to controls are plotted as circles with error bars. The dotted line at frequency 1.0 is the frequency expected for a normal sample (i.e., a sample not containing a variation in copy number). As is shown in FIG. 14, the frequencies of the tested DiGeorge Syndrome samples are about 0.5, indicating that a deletion within the CLTCL1 gene has occurred and can be observed and detected using the amplification methods disclosed herein.

Figure 15:
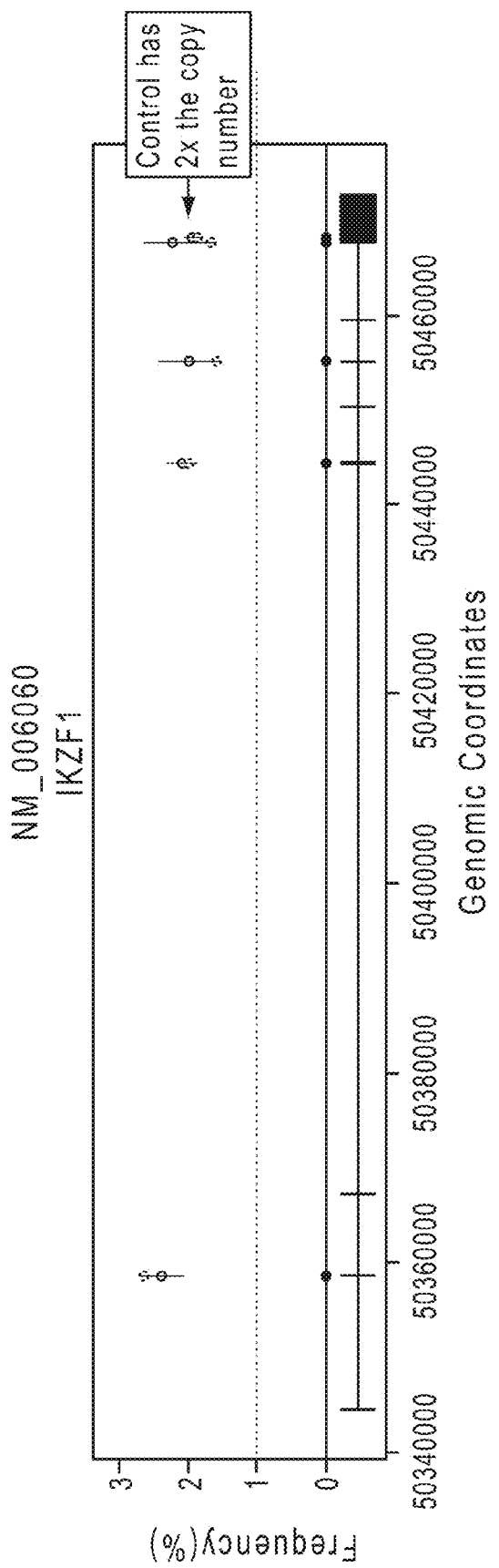
FIG. 15 shows the frequencies of four different amplicons obtained for a region of the IKZF1 gene in several DNA samples containing known copy number variation. The amplicons were obtained according to exemplary embodiments of the multiplex PCR methods disclosed herein.

FIG. 15 shows that the multiplex amplification methods disclosed herein can be used to assess copy number variation in a different chromosome. FIG. 15 shows the amplicon frequency data for 4 amplicons spanning part of the gene IKZF1, associated with Greig Cephalopolysyndactyly Syndrome (GCPS). The circles plotted at frequency 0 represent each of the four amplicons of IKZF1 that were amplified by the multiplex PCR amplification method outlined in this example. Ratios were obtained for a single GCPS sample as compared to four control samples and their frequencies are plotted in FIG. 15. GCPS DNA has only one copy of the GCPS gene, whereas normal (or control) DNA samples contain two copies of the gene. As noted in FIG. 15, the control samples show 2× for copy number as compared to the expected frequency (dotted line). As is demonstrated by FIG. 15, variation in copy number can be determined using the multiplex PCR amplification method disclosed herein.

Example 21

Multiplex Amplification with an Inosine Cleavable Group

In this example, target-specific primers containing one or more cleavable groups denoted as an inosine were prepared according to the primer selection criteria disclosed herein. After an initial in silico evaluation of the primer pairs to proposed target sequences, the evaluated target-specific primers (disclosed in Table 19-see U.S. Ser. No. 13/458,739, filed Apr. 27, 2012, hereby incorporated by reference in its entirety) were ordered from Integrated DNA Technologies (IDT) (Coravilla, Iowa). The inosine containing primers were received from IDT and subjected to multiplex amplification, performed according to the method of Example 15 with the following exceptions. The 2× Primer Pool (containing primer from Table 2-see U.S. Ser. No. 13/458,739, filed Apr. 27, 2012, hereby incorporated by reference in its entirety) was replaced with the Inosine containing primers (disclosed on Table 19 (see U.S. Ser. No. 13/458,739, filed Apr. 27, 2012, hereby incorporated by reference in its entirety), corresponding to SEQ ID NOs: 103122-103143). Additionally, after performing PCR amplification of genomic DNA targets, the samples was subjected to digestion with EndoV and FuPa.

In this example, an aliquot of the final library was used to prepare DNA templates that were clonally amplified on Ion Sphere™ Particles using emulsion PCR (emPCR). The preparation of template in the instant example was prepared according to the manufacturer's instructions using an Ion Xpress Template Kit (Life Technologies, Part No. 4466457). Once template-positive Ion Sphere Particles were enriched, an aliquot of the Ion Spheres were loaded onto an Ion 314TH Chip (Life Technologies, Part No. 4462923) as described in the Ion Sequencing User Guide (Part No. 4467391), and subjected to analysis and sequencing as described in the Ion Torrent PGM Sequencer User Guide (Life Technologies, Part No. 4462917). The data obtained from this example included a per base accuracy percentage of 97.17% and percent of reads on target were observed as 96.83%.

Example 22

Alternative Multiplex PCR Protocol

In this example, various alternative embodiments are presented over one or more of the prior multiplex PCR methods.

PCR Amplify Genomic DNA Targets

In this example, a multiplex polymerase chain reaction was performed to amplify multiple individual amplicons (target sequences) across a genomic DNA sample and an FFPE sample. A representative list of genes associated with cancers and inherited diseases that were incorporated for investigation while synthesizing the primer pool is provided in at least Tables 1 and 4 (both found in U.S. Ser. No. 13/458,739, filed Apr. 27, 2012, hereby incorporated by reference in its entirety). Each primer pair in the primer pool was designed to contain at least one uracil nucleotide in each of the forward and reverse primer (Table 2-see U.S. Ser. No. 13/458,739, filed Apr. 27, 2012, hereby incorporated by reference in its entirety) or designed to contain at least one inosine residue in each of the forward and reverse primer (Table 19-see U.S. Ser. No. 13/458,739, filed Apr. 27, 2012, hereby incorporated by reference in its entirety). Each primer pair was also designed to selectively hybridize to, and promote amplification of a specific gene or gene fragment of the genomic DNA or FFPE sample to reduce formation of non-specific amplification products.

To a single well of a 96-well PCR plate was added 10 microliters of 2× Primer Pool (containing the primer pairs of Table 2-found in U.S. Ser. No. 13/458,739, filed Apr. 27, 2012, hereby incorporated by reference in its entirety), 4 microliters of 5× Cancer Primer pool (containing the primer pairs of Table 17-found in U.S. Ser. No. 13/458,739, filed Apr. 27, 2012, hereby incorporated by reference in its entirety), 4 microliters of 5×IDP Primer pool (containing the primer pairs of Table 15-found in U.S. Ser. No. 13/458,739, filed Apr. 27, 2012, hereby incorporated by reference in its entirety) or 10 microliters of 2×HID Primer Pool (containing the primer pairs of Tables 13 and 14-both found in U.S. Ser. No. 13/458, 739, filed Apr. 27, 2012, hereby incorporated by reference in its entirety), at a concentration of 200 nm each for plexy under 96, or at a concentration of 50 nm for plexy above 96. 10 ng of genomic DNA or FFPE DNA and 4 microliters of an amplification reaction mixture (5× Ion Ampliseq HiFi Master Mix) was added to a final volume of 20 microliters with nuclease free water (Life Technologies, CA, Part No. 600004).

The PCR plate was sealed and loaded into a thermal cycler (GeneAmp® PCR system 9700 Dual 96-well thermal cycler (Life Technologies, CA, Part No. N8050200 and 4314445)) and run on the following temperature profile to generate the preamplified amplicon library. Variation to the number of cycles was performed based on the total plexy of the reaction mixture under investigation. For example, a plexy of 12-24 was run for 20 cycles; a plexy of 25-48 was run for 19 cycles; a plexy of 48-96 was run for 18 cycles; a plexy of 97-192 was run for 17 cycles; a plexy of 193-384 was run for 16 cycles; a plexy of 385-768 was run for 15 cycles; a plexy of 769-1536 was run for 14 cycles; a plexy of 1537-3072 was run for 13 cycles; a plexy of 3073-6144 was run for 12 cycles. Additionally, for reaction mixtures containing barcodes or pooled reaction mixtures the number of cycles was lowered by one or more additional cycles. For example, 2-3 barcodes per sample were subtracted by one cycle; 4-8 barcodes per sample were subtracted by 2 cycles, and 9-16 barcodes were subtracted by 3 cycles. For samples that contain fragmented DNA, e.g., FFPE or enzymatically digested DNA, the number of cycles can be increased for up to 3 cycles.

An initial holding stage was performed at 99° C. for 2 minutes, followed by X cycles (as determined above) of denaturing at 99° C. for 15 seconds and an annealing and extending stage at 60° C. for 4 minutes. For plexy above 1536, the annealing and extending stage was increase to 8 minutes at 60° C. After cycling, the preamplified amplicon library was held at 10° C. until proceeding to the purification step outlined below.

Digest/Phosphorylate/Heat Kill the Amplicons

To the preamplified library (~20 microliters), 2 microliters of FuPa reagent was added. The PCR plate was sealed and loaded into a thermal cycler (GeneAmp® PCR system 9700 Dual 96-well thermal cycler (Life Technologies, CA, Part No. N8050200 and 4314445)) and run on the following temperature profile. An initial holding stage was performed at 50° C. for 10 minutes, followed by 55° C. for 10 minutes and then 65° C. for 20 minutes. After cycling, the preamplified amplicon library was held at 10° C. until proceeding to the ligation/nick translation step outlined below.

Ligate Adpaters to the Amplicons and Nick Translate

After phosphorylation, the amplicon preamplification library (~22 µl) proceeded directly to a ligation step. In this example, the preamplification library now containing the phosphorylated amplicon library was combined with 2 microliters of A/P1 Adapter (5 um each) (sold as a component of the Ion Fragment Library Kit, Life Technologies, Part No. 4466464), 4 microliters of Switch Solution and 2 microliters of DNA ligase (5u/µl). The PCR plate was sealed and loaded into a thermal cycler (GeneAmp® PCR system 9700 Dual 96-well thermal cycler (Life Technologies, CA, Part No. N8050200 and 4314445)) and run on the following temperature profile. An initial holding stage was performed at 22° C. for 30 minutes, followed by 72° C. for 10 minutes and then held at 10° C. until proceeding to the next step.

If the amplicon library is to contain barcodes (for example Ion DNA Barcoding 1-16 kit, Life Technologies, Part No. 4468654, incorporated herein in its entirety), the barcodes are added at this step to the PCR plate essentially according to the manufacturer's instructions prior to proceeding to the next step. Optionally, all the samples or barcodes can be pooled into a single tube at this step.

1.5×AMPure XP Purification 1.5× sample volume (45 microliters) of AgenCourt® AMPure® Reagent (Beckman Coulter, CA) was added to the ligated DNA. The mixture was mixed and incubated at room temperature for 5 minutes and then transferred to a magnet plate. Sample was incubated on the magnet plate for 2 minutes, and the supernatant discarded. An ethanol wash was performed and the supernatant discarded. Any remaining ethanol was removed and air-dried for about 5 minutes at room temperature. The dry tube containing the library was resuspended in 20 microliters of Nuclease Free Water (Life Technologies, CA, Part No. 600004) or low Tris-EDTA buffer. In some instances, an optional nick translation/library amplification step can be performed on the amplicon library, as outlined below.

Nick Translate and Amplify the Amplicon Library and Purify the Library

The ligated DNA (~20 microliters) was combined with 50 microliters of Platinum® PCR SuperMix High Fidelity (Life Technologies, CA, Part No. 12532-016, sold as a component of the Ion Fragment Library Kit, Life Technologies, Part No. 4466464) and placed on a magnet plate for 2 minutes. 48 ul of the eluted amplicons in the PCR supermix were transferred to a new well of a 96-well plate to which was added 2 microliters of Library Amplification Primer Mix (Life Technologies, CA, Part No. 602-1068-01, sold as a component of the Ion Fragment Library Kit, Life Technologies, Part No. 4466464). The PCR plate was sealed and loaded into a thermal cycler (GeneAmp® PCR system 9700 Dual 96-well thermal cycler (Life Technologies, CA, Part No. N8050200 and 4314445)) and run on the following temperate profile to generate the final amplicon library.

An enzyme activation stage at 98° C. for 2 minutes, followed by 5 cycles of denaturing at 98° C. for 15 seconds and an annealing and extending stage at 60° C. for 1 minute. After cycling, the final amplicon library was held at 4° C. until proceeding to the final purification step outlined below.

The final amplicon library (~100 microliters) was combined with 0.5× sample volume of Agencourt® AMPure® XP reagent (Beckman Coulter, CA). The mixture was then incubated for 5 minutes at room temperature. The sample was transferred to a magnet plate for 2 minutes and the supernatant (~75 microliters) removed to a new well. 1.2× volume of Agencourt® AMPure® XP reagent (Beckman Coulter, CA) was added and incubated at room temperature for 5 minutes. The sample was then placed on a magnet plate for 2 minutes and the supernatant discarded. The final amplicon library was washed with 70% ethanol and the supernatant discarded. Any remaining ethanol was removed and air-dried for about 5 minutes at room temperature. Once dry, the library was resuspended in 20 microliters of Low TE (Life Technologies, CA, Part No. 602-1066-01). In this example, 1 microliter of the final amplicon library preparation was analyzed on a 2100 Bioanalyzer™ with an Agilent High Sensitivity DNA Kit (Agilent Technologies, Part No. 5067-4626) or analyzed on a Qubit machine using the DSDNA HS Assay Kit (Part number Q32851).

SEQUENCE LISTING (103213 sequences)

SEQ ID NO: 1 - DNA, 22 bp, Artificial Sequence
  Synthetic
ttcgcctgucctcatgtatugg

SEQ ID NO: 2 - DNA, 28 bp, Artificial Sequence
  Synthetic
agtggttatagauggtgaaacctgttug

SEQ ID NO: 3 - DNA, 100 bp, Artificial Sequence
  Synthetic
ttcgcctgtcctcatgtattggtctctcatggcactgtactcttcttgtccagctgtatccagtatgtccaacaaacaggtttcaccatctataaccact

SEQ ID NO: 4 - DNA, 27 bp, Artificial Sequence
  Synthetic
catctacaaaguggttctggatuagct

SEQ ID NO: 5 - DNA, 26 bp, Artificial Sequence
  Synthetic
ctggtgtgaaaugactgaguacaaac

SEQ ID NO: 6 - DNA, 101 bp, Artificial Sequence
  Synthetic
catctacaaagtggttctggattagctggattgtcagtgcgcttttcccaacaccacctgctccaaccaccaccagtttgtactcagtcatttcacaccag

SEQ ID NO: 7 - DNA, 27 bp, Artificial Sequence
  Synthetic
ccaacatgactuacttgatccccauaa

SEQ ID NO: 8 - DNA, 28 bp, Artificial Sequence
  Synthetic
gagaagccatuatctgcaaaaatauccc

SEQ ID NO: 9 - DNA, 103 bp, Artificial Sequence
  Synthetic
ccaacatgacttacttgatccccataagcatgacgacctatgatgataggttttacccatccactcacaagccgggggatatttttgcagataatggcttctc

SEQ ID NO: 10 - DNA, 25 bp, Artificial Sequence
  Synthetic
tgtaaacgtcaauagtgcagauggg

SEQ ID NO: 11 - DNA, 25 bp, Artificial Sequence
  Synthetic
accttuggaggaaaaccctatgaug

SEQ ID NO: 12 - DNA, 109 bp, Artificial Sequence
  Synthetic
tgtaaacgtcaatagtgcagatgggaggctgaggcaaacgttctcctttctctaataaatcagggatttctcgcgttggaattccatcatagggttttcctccaaaggt

SEQ ID NO: 13 - DNA, 23 bp, Artificial Sequence
  Synthetic
catcgccacauaggguagaacat

SEQ ID NO: 14 - DNA, 22 bp, Artificial Sequence
  Synthetic
catggcctuccaacttgacuct

SEQ ID NO: 15 - DNA, 103 bp, Artificial Sequence
  Synthetic
catcgccacatagggtagaacattttgagaaattaaaaagaataattctacttacatcctgaactaccatttgttgacacaagagtcaagttggaaggccatg

SEQ ID NO: 16 - DNA, 25 bp, Artificial Sequence
  Synthetic
acttacguggacatttctugacaca

SEQ ID NO: 17 - DNA, 26 bp, Artificial Sequence
  Synthetic
caaaccuttgtctacaauccaaccac

SEQ ID NO: 18 - DNA, 100 bp, Artificial Sequence
  Synthetic
acttacgtggacatttcttgacacagaatgctccatatgtgtactttgcattgaaattgtgctccagttgaaaggtggttggattgtagacaaaggtttg

SEQ ID NO: 19 - DNA, 23 bp, Artificial Sequence
  Synthetic
ccaaugcagcgaacaatgttcug

SEQ ID NO: 20 - DNA, 24 bp, Artificial Sequence
  Synthetic
ccagtttaagauttgcccagacuc

SEQ ID NO: 21 - DNA, 100 bp, Artificial Sequence
  Synthetic
ccaatgcagcgaacaatgttctggtggttgaatttgctgcagagcagagagggatgtaaccaaaattaactgagctgagtctgggcaaatcttaaactgg

SEQ ID NO: 22 - DNA, 28 bp, Artificial Sequence
  Synthetic
gacagtaacccuacatatacaatugcct

SEQ ID NO: 23 - DNA, 27 bp, Artificial Sequence
  Synthetic
gaaactttggacutcaagaactuggat

SEQ ID NO: 24 - DNA, 117 bp, Artificial Sequence
  Synthetic
gacagtaaccctacatatacaattgccttatattgataatgaaagcatatttgccattttggatatattccttacctgtcaagttctttaatccaagttcttgaagtccaaagtttc

SEQ ID NO: 25 - DNA, 29 bp, Artificial Sequence
  Synthetic
ccagtgactagaaagaucaaattcccaut

SEQ ID NO: 26 - DNA, 21 bp, Artificial Sequence
  Synthetic
ggcatuggcacaggatcatug

SEQ ID NO: 27 - DNA, 110 bp, Artificial Sequence
  Synthetic
ccagtgactagaaagatcaaattcccattgatcttggtacagtttatgaatttgtcaatgttactggaatccacagtctgagctgacatcaatgatcctgtgccaatgcc

SEQ ID NO: 28 - DNA, 26 bp, Artificial Sequence
  Synthetic
aaucaaauagggaaggaaaggagagc

SEQ ID NO: 29 - DNA, 21 bp, Artificial Sequence
  Synthetic
tgactgcugccatcgagaaug

SEQ ID NO: 30 - DNA, 119 bp, Artificial Sequence
  Synthetic
aatcaaatagggaaggaaaggagagcaggataataaaagagagaaatcacagacatacaaagcagtctgtgtccttaggtcctgagcagcctccagcacattctcgatggcagcagtca

SEQ ID NO: 31 - DNA, 24 bp, Artificial Sequence
  Synthetic
gaggcagtcuttactcacctguag

SEQ ID NO: 32 - DNA, 22 bp, Artificial Sequence
  Synthetic
ccagaaacugcctcttgaccug

SEQ ID NO: 33 - DNA, 100 bp, Artificial Sequence
  Synthetic
gaggcagtctttactcacctgtagatgtctcgggccatcccgaagtctccaatcttggccactcttccagggcctggacaggtcaagaggcagtttctgg

SEQ ID NO: 34 - DNA, 25 bp, Artificial Sequence
  Synthetic
ggtttttgcccutccagtgtauact

SEQ ID NO: 35 - DNA, 21 bp, Artificial Sequence
  Synthetic
cctgacgaugtccagtcucct

SEQ ID NO: 36 - DNA, 100 bp, Artificial Sequence
  Synthetic
ggtttttgcccttccagtgtatactctgaaagagcgatgcctccaggttgtccggagcctagtcaagcctgagaattacaggagactggacatcgtcagg

SEQ ID NO: 37 - DNA, 26 bp, Artificial Sequence
  Synthetic
aaaaugacaaagaacagcucaaagca

SEQ ID NO: 38 - DNA, 26 bp, Artificial Sequence
  Synthetic
cattttagcacutacctgtgacucca

SEQ ID NO: 39 - DNA, 106 bp, Artificial Sequence
  Synthetic
aaaatgacaaagaacagctcaaagcaatttctacacgagatcctctctctgaaatcactgagcaggagaaagattttctatggagtcacaggtaagtgctaaaatg

SEQ ID NO: 40 - DNA, 29 bp, Artificial Sequence
  Synthetic
acattttcguaagtgttacucaagaagca

SEQ ID NO: 41 - DNA, 28 bp, Artificial Sequence
  Synthetic
ggttgcctacuggttcaattactttuaa

SEQ ID NO: 42 - DNA, 120 bp, Artificial Sequence
  Synthetic
acattttcgtaagtgttactcaagaagcagaaagggaagaattttttgatgaaacaagacgactttgtgaccttcggctttttcaaccctttttaaaagtaattgaaccagtaggcaacc

SEQ ID NO: 43 - DNA, 26 bp, Artificial Sequence
  Synthetic
gggaagaaaagugttttgaaatgugt

SEQ ID NO: 44 - DNA, 27 bp, Artificial Sequence
  Synthetic
caaacaagttuatatttccccaugcca

SEQ ID NO: 45 - DNA, 108 bp, Artificial Sequence
  Synthetic
gggaagaaaagtgttttgaaatgtgttttataatttagactagtgaatatttttctttgttttttaaggaacactgtccattggcatggggaaatataaacttgtttg

SEQ ID NO: 46 - DNA, 26 bp, Artificial Sequence
  Synthetic
tggatctuccacacaatuaaacagca

SEQ ID NO: 47 - DNA, 26 bp, Artificial Sequence
  Synthetic
gctgagagttautaacagtgcagugt

SEQ ID NO: 48 - DNA, 103 bp, Artificial Sequence
  Synthetic
tggatcttccacacaattaaacagcatgcattgaactgaaaagataactgagaaaatgaaagctcactctggattccacactgcactgttaataactctcagc

SEQ ID NO: 49 - DNA, 23 bp, Artificial Sequence
  Synthetic
tgacctcgucttctacttcugga

SEQ ID NO: 50 - DNA, 22 bp, Artificial Sequence
  Synthetic
agaggcugcagaaatgcaucaa

SEQ ID NO: 51 - DNA, 103 bp, Artificial Sequence
  Synthetic
tgacctcgtcttctacttctggaagtagtgataaggtctatgcccaccagatggttcgtacagattcccgggaacagaagcttgatgcatttctgcagcctct

SEQ ID NO: 52 - DNA, 26 bp, Artificial Sequence
  Synthetic
tgtctttgagtuccattccacttgut

SEQ ID NO: 53 - DNA, 28 bp, Artificial Sequence
  Synthetic
gatctcttgatacaucaatccgtgttug

SEQ ID NO: 54 - DNA, 105 bp, Artificial Sequence
  Synthetic
tgtctttgagttccattccacttgttaacgactggtgccctgttaacgtgtgaatgcaattccctgtctccacatcccaaacacggattgatgtatcaagagatc

SEQ ID NO: 55 - DNA, 24 bp, Artificial Sequence
  Synthetic
ccctccugccatcatatugaacac

SEQ ID NO: 56 - DNA, 21 bp, Artificial Sequence
  Synthetic
tctgcagagutgttagcggut

SEQ ID NO: 57 - DNA, 129 bp, Artificial Sequence
  Synthetic
ccctcctgccatcatattgaacacagcggactgctgcaacatgacccatcaaaacatgtaaacactggcctgtctcaatatcccaaaccctaagagtggcatctcgagaaccgctaacaactctgcaga

SEQ ID NO: 58 - DNA, 27 bp, Artificial Sequence
  Synthetic
accatgacaagautttcccttacctut

SEQ ID NO: 59 - DNA, 23 bp, Artificial Sequence
  Synthetic
actcaaagugtggaaugcagaga

SEQ ID NO: 60 - DNA, 116 bp, Artificial Sequence
  Synthetic
accatgacaagattttcccttaccttttttcatgaagatgcatacaacgcacagtggaagtatgcccatataaggtgtgtatacattctccagtctctgcattccacactttgagt

SEQ ID NO: 61 - DNA, 27 bp, Artificial Sequence
  Synthetic
actgctgaccaaacutttaaagtgtug

SEQ ID NO: 62 - DNA, 28 bp, Artificial Sequence
  Synthetic
ttcttataggtgcugaaaggacatgaug

SEQ ID NO: 63 - DNA, 113 bp, Artificial Sequence
  Synthetic
actgctgaccaaacttttaaagtgttgtcatcagaaccactaactattcggttaccacaaaactgtaagcatgtgatcacatgatcatcatgtcctttcagcacctataagaa

SEQ ID NO: 64 - DNA, 27 bp, Artificial Sequence
  Synthetic
cctcttuagggagcaatgaaaugaagt

SEQ ID NO: 65 - DNA, 28 bp, Artificial Sequence
  Synthetic
tgaactcautgatagttgugaaccaaca

SEQ ID NO: 66 - DNA, 101 bp, Artificial Sequence
  Synthetic
cctctttagggagcaatgaaatgaagtctcgttgaaactggggttctatcacttgcatcatatgttttacttgtgttggttcacaactatcaatgagttca

SEQ ID NO: 67 - DNA, 26 bp, Artificial Sequence
  Synthetic
tgggactttgguaattcaccagtuac

SEQ ID NO: 68 - DNA, 28 bp, Artificial Sequence
  Synthetic
ctgcatcggguccacataaatatatuca

SEQ ID NO: 69 - DNA, 129 bp, Artificial Sequence
  Synthetic
tgggactttggtaattcaccagttacctgtcctggtcatttatagaaaccgaggtatgaaattcgctggagggtcattgaatcaatcagcccagatggacatgaatatatttatgtggacccgatgcag

SEQ ID NO: 70 - DNA, 23 bp, Artificial Sequence
  Synthetic
cccatctccuaacggcttttguc

SEQ ID NO: 71 - DNA, 24 bp, Artificial Sequence
  Synthetic
ggctcaggaagcuatccctatuct

SEQ ID NO: 72 - DNA, 114 bp, Artificial Sequence
  Synthetic
cccatctcctaacggcttttgtccccataggccccatttacatcatcacagagtattgcttctatggagatttggtcaactatttgcataagaatagggatagcttcctgagcc

SEQ ID NO: 73 - DNA, 27 bp, Artificial Sequence
  Synthetic
caagctctcatguctgaactgaagaua

SEQ ID NO: 74 - DNA, 23 bp, Artificial Sequence
  Synthetic
aaaatcctcacuccaggtcagug

SEQ ID NO: 75 - DNA, 118 bp, Artificial Sequence
  Synthetic
caagctctcatgtctgaactgaagataatgactcacctggggccacatttgaacattgtaaacttgctgggagcctgcaccaagtcaggtgggctcactgacctggagtgaggatttt

SEQ ID NO: 76 - DNA, 27 bp, Artificial Sequence
  Synthetic
ccatccauccaggaaaatcagactuaa

SEQ ID NO: 77 - DNA, 28 bp, Artificial Sequence
  Synthetic
cttattctcattcguttcatccaggauc

SEQ ID NO: 78 - DNA, 122 bp, Artificial Sequence
  Synthetic
ccatccatccaggaaaatcagacttaatagtccgcgtgggcgacgagattaggctgttatgcactgatccgggctttgtcaaatggacttttgagatcctggatgaaacgaatgagaataag

SEQ ID NO: 79 - DNA, 23 bp, Artificial Sequence
  Synthetic
tttcgtaatcguagctggcauga

SEQ ID NO: 80 - DNA, 25 bp, Artificial Sequence
  Synthetic
tcagtcatuagagcactcuggagag

SEQ ID NO: 81 - DNA, 108 bp, Artificial Sequence
  Synthetic
tttcgtaatcgtagctggcatgatgtgcattattgtgatgattctgacctacaaatatttacaggtaaccatttatttgttctctctccagagtgctctaatgactga

SEQ ID NO: 82 - DNA, 21 bp, Artificial Sequence
  Synthetic
caacgatgugggcaagactuc

SEQ ID NO: 83 - DNA, 27 bp, Artificial Sequence
  Synthetic
agcctaaacauccccttaaattggaut

SEQ ID NO: 84 - DNA, 100 bp, Artificial Sequence
  Synthetic
caacgatgtgggcaagacttctgcctattttaactttgcatttaaaggtaacaacaaaggtatatttctttttaatccaatttaaggggatgtttaggct

SEQ ID NO: 85 - DNA, 22 bp, Artificial Sequence
  Synthetic
ggaagcccucatgtctgaacuc

SEQ ID NO: 86 - DNA, 23 bp, Artificial Sequence
  Synthetic
caauaaaaggcagctuggacacg

SEQ ID NO: 87 - DNA, 119 bp, Artificial Sequence
  Synthetic
ggaagccctcatgtctgaactcaaagtcctgagttaccttggtaatcacatgaatattgtgaatctacttggagcctgcaccattggaggtaaagccgtgtccaagctgccttttattg

SEQ ID NO: 88 - DNA, 26 bp, Artificial Sequence
  Synthetic
ccttctacatgucccacttgatucag

SEQ ID NO: 89 - DNA, 24 bp, Artificial Sequence
  Synthetic
gccttggtugggacaacauaagaa

SEQ ID NO: 90 - DNA, 117 bp, Artificial Sequence
  Synthetic
ccttctacatgtcccacttgattcagtcatgacttgtttcatctctcccagcagcgatagtactaatgagtacatggacatgaaacctggagtttcttatgttgtcccaaccaaggc

SEQ ID NO: 91 - DNA, 30 bp, Artificial Sequence
  Synthetic
accttctttctaaccutttcttatgtgcut

SEQ ID NO: 92 - DNA, 30 bp, Artificial Sequence
  Synthetic
ctgctttgaacaaauaaatgaatcacgtut

SEQ ID NO: 93 - DNA, 126 bp, Artificial Sequence
  Synthetic
accttctttctaaccttttcttatgtgcttttagggcccaccctggtcattacagaatattgttgctatggtgatcttttgaattttttgagaagaaaacgtgattcatttatttgttcaaagcag

SEQ ID NO: 94 - DNA, 25 bp, Artificial Sequence
  Synthetic
ccttactcauggtcggaucacaaag

SEQ ID NO: 95 - DNA, 22 bp, Artificial Sequence
  Synthetic
ggactgucaagcagagaauggg

SEQ ID NO: 96 - DNA, 117 bp, Artificial Sequence
  Synthetic
ccttactcatggtcggatcacaaagatttgtgattttggtctagccagagacatcaagaatgattctaattatgtggttaaaggaaacgtgagtacccattctctgcttgacagtcc

SEQ ID NO: 97 - DNA, 22 bp, Artificial Sequence
  Synthetic
ctcgacuacctgtgaaguggat

SEQ ID NO: 98 - DNA, 26 bp, Artificial Sequence
  Synthetic
acagcucccaaagaaaaatcccauag

SEQ ID NO: 99 - DNA, 102 bp, Artificial Sequence
  Synthetic
ctcgactacctgtgaagtggatggcacctgaaagcattttcaactgtgtatacacgtttgaaagtgacgtctggtcctatgggatttttctttgggagctgt

SEQ ID NO: 100 - DNA, 22 bp, Artificial Sequence
  Synthetic
gggtgtggaugcttcctttuaa

SEQ ID NO: 101 - DNA, 25 bp, Artificial Sequence
  Synthetic
agctgauagagattggagugcaaac

SEQ ID NO: 102 - DNA, 107 bp, Artificial Sequence
  Synthetic
gggtgtggatgcttccttttaaacaggaggagagctcagtgtggtccccgagtcaggctggagaatctgggctgtgctaccggtttgcactccaatctctatcagct

SEQ ID NO: 103 - DNA, 26 bp, Artificial Sequence
  Synthetic
agctttaaaagutctgcttccucact

SEQ ID NO: 104 - DNA, 21 bp, Artificial Sequence
  Synthetic
tggcatcugaaggcucaaacc

SEQ ID NO: 105 - DNA, 106 bp, Artificial Sequence
  Synthetic
agctttaaaagttctgcttcctcactggagtacacggtggtgtctgtgtcatcggagtgatatccggactggtagccgcttgtctggtttgagccttcagatgcca

SEQ ID NO: 106 - DNA, 23 bp, Artificial Sequence
  Synthetic
cagtacctgautcctgctgtgut

SEQ ID NO: 107 - DNA, 22 bp, Artificial Sequence
  Synthetic
gcauggaagaggattcuggact

SEQ ID NO: 108 - DNA, 115 bp, Artificial Sequence
  Synthetic
cagtacctgattcctgctgtgttgtcataatggaatttggggtcacatacttcctcctcctccatacaggaaacaggtgaggtaggcagagagagtccagaatcctcttccatgc

SEQ ID NO: 109 - DNA, 25 bp, Artificial Sequence
  Synthetic
ctgagcattagcutgcaagagatut

SEQ ID NO: 110 - DNA, 25 bp, Artificial Sequence
  Synthetic
gtgttttgcutctctagguaccaga

SEQ ID NO: 111 - DNA, 120 bp, Artificial Sequence
  Synthetic
ctgagcattagcttgcaagagatttcccaaatgttccaccaactctgaaaacgtgggtctctgactgggctccccgtgccagcagtccagcatggtctggtacctagagaagcaaaacac

SEQ ID NO: 112 - DNA, 26 bp, Artificial Sequence
  Synthetic
ccagtaccttccucttcttctacauc

SEQ ID NO: 113 - DNA, 21 bp, Artificial Sequence
  Synthetic
ttggagcaauccctgtggauc

SEQ ID NO: 114 - DNA, 124 bp, Artificial Sequence
  Synthetic
ccagtaccttcctcttcttctacatcactgagggacttctcctccacaaatccagagctggctgagctctggctactggtgatgctgtccaagcgccgtttcagatccacagggattgctccaa

SEQ ID NO: 115 - DNA, 24 bp, Artificial Sequence
  Synthetic
gaccacautgagatggugaccaat

SEQ ID NO: 116 - DNA, 27 bp, Artificial Sequence
  Synthetic
gtccatacctaugatttccctcttugt

SEQ ID NO: 117 - DNA, 123 bp, Artificial Sequence
  Synthetic
gaccacattgagatggtgaccaatatgaatgaggatcttgagttcagacatgagagctcgatgctcactgtgtgttgctccttctacaaatacagtacaaagagggaaatcataggtatggac

SEQ ID NO: 118 - DNA, 23 bp, Artificial Sequence
  Synthetic
cgaagaaggguattcccagtuga

SEQ ID NO: 119 - DNA, 28 bp, Artificial Sequence
  Synthetic
tctcatggaatugaactatctgtuggag

SEQ ID NO: 120 - DNA, 105 bp, Artificial Sequence
  Synthetic
cgaagaagggtattcccagttgaagtcaatccccacatttagttcagttcttgctgtacaatttaagacaagcttttctccaacagatagttcaattccatgaga

SEQ ID NO: 121 - DNA, 27 bp, Artificial Sequence
  Synthetic
cttcaattttauttcctcccuggaagt

SEQ ID NO: 122 - DNA, 26 bp, Artificial Sequence
  Synthetic
gcgctgttauctctttcttauagcca

SEQ ID NO: 123 - DNA, 106 bp, Artificial Sequence
  Synthetic
cttcaattttatttcctccctggaagtcctccacacttctccattcttcacaagggtatgggtttgtcactgagacagcttggctataagaaagagataacagcgc

SEQ ID NO: 124 - DNA, 28 bp, Artificial Sequence
  Synthetic
aaaaatttcutcatctcacucccagact

SEQ ID NO: 125 - DNA, 25 bp, Artificial Sequence
  Synthetic
tgctttggaagutcagtcaactcut

SEQ ID NO: 126 - DNA, 101 bp, Artificial Sequence
  Synthetic
aaaaatttcttcatctcactcccagactgggtttttaggtctcggtttacaagtttcttatgctgatgctgaaaaaaagagttgactgaacttccaaagca

SEQ ID NO: 127 - DNA, 25 bp, Artificial Sequence
  Synthetic
ggaattggtcuaggcaactaccauc

SEQ ID NO: 128 - DNA, 25 bp, Artificial Sequence
  Synthetic
acttcttccaugactttggcaauct

SEQ ID NO: 129 - DNA, 113 bp, Artificial Sequence
  Synthetic
ggaattggtctaggcaactaccatccagcaacagaaaatccaggaacttcttcaaagcgaggtttgcagatctccaccactgcagcccagattgccaaagtcatggaagaagt

SEQ ID NO: 130 - DNA, 23 bp, Artificial Sequence
  Synthetic
tgtgtttcuccatacaggucacg

SEQ ID NO: 131 - DNA, 27 bp, Artificial Sequence
  Synthetic
gacacaaagacuggcttacatttugat

SEQ ID NO: 132 - DNA, 100 bp, Artificial Sequence
  Synthetic
tgtgtttctccatacaggtcacggggagccaatggttcagaaacaaatcgagtgggttctaatcatggaattaatcaaaatgtaagccagtctttgtgtc

SEQ ID NO: 133 - DNA, 22 bp, Artificial Sequence
  Synthetic
caccatgacuttgaggtugagc

SEQ ID NO: 134 - DNA, 23 bp, Artificial Sequence
  Synthetic
gtgugttctgcttuccagagagt

SEQ ID NO: 135 - DNA, 104 bp, Artificial Sequence
  Synthetic
caccatgactttgaggttgagcccctcccccacggtcacctcctggatgaggttctgctcagagctcaagttcaagtaggcactctctggaaagcagaacacac

SEQ ID NO: 136 - DNA, 24 bp, Artificial Sequence
  Synthetic
caggttctuccagatgctgauact

SEQ ID NO: 137 - DNA, 24 bp, Artificial Sequence
  Synthetic
gtataaatggcucatcgaggcuca

SEQ ID NO: 138 - DNA, 112 bp, Artificial Sequence
  Synthetic
caggttcttccagatgctgatactttattacattttgccacggaaagtactccagatggattttcttgttcatccagcctgagtgctctgagcctcgatgagccatttatac

SEQ ID NO: 139 - DNA, 28 bp, Artificial Sequence
  Synthetic
gcagccuaaagaatcaaaugaaaaccaa

SEQ ID NO: 140 - DNA, 33 bp, Artificial Sequence
  Synthetic
agtatttcaatatcaucatcatctgaatcauct

SEQ ID NO: 141 - DNA, 105 bp, Artificial Sequence
  Synthetic
gcagcctaaagaatcaaatgaaaaccaagagaaagaggcagaaaaaactattgattctgaaaaggacctattagatgattcagatgatgatgatattgaaatact

SEQ ID NO: 142 - DNA, 21 bp, Artificial Sequence
  Synthetic
tggtacuccctgtcgucaact

SEQ ID NO: 143 - DNA, 21 bp, Artificial Sequence
  Synthetic
gagctctagugagcaccugac

SEQ ID NO: 144 - DNA, 108 bp, Artificial Sequence
  Synthetic
tggtactccctgtcgtcaactcctcagcagaactgatagttgttgggctgcagcaagggctgggcgatatccccttgctcgcagcaggtcaggtgctcactagagctc

SEQ ID NO: 145 - DNA, 21 bp, Artificial Sequence
  Synthetic
atacagucggaggttcacugc

SEQ ID NO: 146 - DNA, 24 bp, Artificial Sequence
  Synthetic
agttgaugaaccggtccttuacag

SEQ ID NO: 147 - DNA, 124 bp, Artificial Sequence
  Synthetic
atacagtcggaggttcactgcatattctccccacagatagaagagcccagccagtgtcctgactgtgtggtgagcgccctgggagccaaagtcctttcatctgtaaaggaccggttcatcaact

SEQ ID NO: 148 - DNA, 22 bp, Artificial Sequence
  Synthetic
gaaccaauggatcgatcugcca

SEQ ID NO: 149 - DNA, 26 bp, Artificial Sequence
  Synthetic
tgctggagacauctcacattgtttut

SEQ ID NO: 150 - DNA, 101 bp, Artificial Sequence
  Synthetic
gaaccaatggatcgatctgccatgtgtgcattccctatcaaatatgtcaacgacttcttcaacaagatcgtcaacaaaaacaatgtgagatgtctccagca

SEQ ID NO: 151 - DNA, 25 bp, Artificial Sequence
  Synthetic
agtgaattagutcgctacgaugcaa

SEQ ID NO: 152 - DNA, 27 bp, Artificial Sequence
  Synthetic
gaaaagtagcucggtagtctacagaut

SEQ ID NO: 153 - DNA, 127 bp, Artificial Sequence
  Synthetic
agtgaattagttcgctacgatgcaagagtacacactcctcatttggataggcttgtaagtgcccgaagtgtaagcccaactacagaaatggtttcaaatgaatctgtagactaccgagctacttttc

SEQ ID NO: 154 - DNA, 23 bp, Artificial Sequence
  Synthetic
gttacgcagugctaaccaagtuc

SEQ ID NO: 155 - DNA, 26 bp, Artificial Sequence
  Synthetic
gccacttacugttcaaggattucaca

SEQ ID NO: 156 - DNA, 127 bp, Artificial Sequence
  Synthetic
gttacgcagtgctaaccaagttctttcttttgcacagggcattttggttgtgtatatcatgggactttgttggacaatgatggcaagaaaattcactgtgctgtgaaatccttgaacagtaagtggc

SEQ ID NO: 157 - DNA, 24 bp, Artificial Sequence
  Synthetic
gtgggcuacaagaactaccgauac

SEQ ID NO: 158 - DNA, 21 bp, Artificial Sequence
  Synthetic
ttcacucacctcggaugagga

SEQ ID NO: 159 - DNA, 100 bp, Artificial Sequence
  Synthetic
gtgggctacaagaactaccgataccgtgcgggcttcgtgctggccccaatcggcctggtgctcatcgtgggaggctacttcctcatccgaggtgagtgaa

SEQ ID NO: 160 - DNA, 24 bp, Artificial Sequence
  Synthetic
gattttggtctugccagagacaug

SEQ ID NO: 161 - DNA, 24 bp, Artificial Sequence
  Synthetic
ttgagttugcagacttuccaaagc

SEQ ID NO: 162 - DNA, 111 bp, Artificial Sequence
  Synthetic
gattttggtcttgccagagacatgtatgataaagaatactatagtgtacacaacaaaacaggtgcaaagctgccagtgaagtggatggctttggaaagtctgcaaactcaa

SEQ ID NO: 163 - DNA, 28 bp, Artificial Sequence
  Synthetic
acattacatactuaccatgccacttucc

SEQ ID NO: 164 - DNA, 24 bp, Artificial Sequence
  Synthetic
gagtgatgatugggagattccuga

SEQ ID NO: 165 - DNA, 110 bp, Artificial Sequence
  Synthetic
acattacatacttaccatgccactttcccttgtagactgttccaaatgatccagatccaattctttgtcccactgtaatctgcccatcaggaatctcccaatcatcactc

SEQ ID NO: 166 - DNA, 23 bp, Artificial Sequence
  Synthetic
gttatgtccucattgcccucaac

SEQ ID NO: 167 - DNA, 28 bp, Artificial Sequence
  Synthetic
gctaaggcauaggaattttcgtaguaca

SEQ ID NO: 168 - DNA, 100 bp, Artificial Sequence
  Synthetic
gttatgtcctcattgccctcaacacagtggagcgaattcctttggaaaacctgcagatcatcagaggaaatatgtactacgaaaattcctatgccttagc

SEQ ID NO: 169 - DNA, 23 bp, Artificial Sequence
  Synthetic
gaccagacaacugtatccagugt

SEQ ID NO: 170 - DNA, 22 bp, Artificial Sequence
  Synthetic
ttccagaccagggugttgttut

SEQ ID NO: 171 - DNA, 103 bp, Artificial Sequence
  Synthetic
gaccagacaactgtatccagtgtgcccactacattgacggcccccactgcgtcaagacctgcccggcaggagtcatgggagaaaacaacaccctggtctggaa

SEQ ID NO: 172 - DNA, 22 bp, Artificial Sequence
  Synthetic
cctctuacacccaguggagaag

SEQ ID NO: 173 - DNA, 21 bp, Artificial Sequence
  Synthetic
acctuatacaccgugccgaac

SEQ ID NO: 174 - DNA, 116 bp, Artificial Sequence
  Synthetic
cctcttacacccagtggagaagctcccaaccaagctctcttgaggatcttgaaggaaactgaattcaaaaagatcaaagtgctgggctccggtgcgttcggcacggtgtataaggt

SEQ ID NO: 175 - DNA, 23 bp, Artificial Sequence
  Synthetic
ccacguaccagatggatgugaac

SEQ ID NO: 176 - DNA, 23 bp, Artificial Sequence
  Synthetic
caaggatgccugaccagtuagag

SEQ ID NO: 177 - DNA, 116 bp, Artificial Sequence
  Synthetic
ccacgtaccagatggatgtgaaccccgagggcaaatacagctttggtgccacctgcgtgaagaagtgtccccgtgagtcctcctctgtgggccctctaactggtcaggcatccttg

SEQ ID NO: 178 - DNA, 25 bp, Artificial Sequence
  Synthetic
tcttccttcuctctctgtcauaggg

SEQ ID NO: 179 - DNA, 23 bp, Artificial Sequence
  Synthetic
tcgaggattuccttgttggctut

SEQ ID NO: 180 - DNA, 121 bp, Artificial Sequence
  Synthetic
tcttccttctctctctgtcatagggactctggatcccagaaggtgagaaagttaaaattcccgtcgctatcaaggaattaagagaagcaacatctccgaaagccaacaaggaaatcctcga

SEQ ID NO: 181 - DNA, 26 bp, Artificial Sequence
  Synthetic
cagcatgtcaagaucacagatttugg

SEQ ID NO: 182 - DNA, 24 bp, Artificial Sequence
  Synthetic
acctaaagccaccuccttacttug

SEQ ID NO: 183 - DNA, 101 bp, Artificial Sequence
  Synthetic
cagcatgtcaagatcacagattttgggctggccaaactgctgggtgcggaagagaaagaataccatgcagaaggaggcaaagtaaggaggtggctttaggt

SEQ ID NO: 184 - DNA, 22 bp, Artificial Sequence
  Synthetic
acatgaacuccacgttgcuacc

SEQ ID NO: 185 - DNA, 22 bp, Artificial Sequence
  Synthetic
ctcctcucccatctuccacaga

SEQ ID NO: 186 - DNA, 105 bp, Artificial Sequence
  Synthetic
acatgaactccacgttgctacccagggccactgttttgttggcgggcaaccctgcttgcaggatgggccggtgaggggaccgctctgtggaagatgggagaggag

SEQ ID NO: 187 - DNA, 26 bp, Artificial Sequence
  Synthetic
ggtttggttuggtgttatctgttuct

SEQ ID NO: 188 - DNA, 23 bp, Artificial Sequence
  Synthetic
tgcccctucttcttcccauagat

SEQ ID NO: 189 - DNA, 105 bp, Artificial Sequence
  Synthetic
ggtttggtttggtgttatctgtttctttctcctctgaagaggagtcatcatcatcatcatcatcctccgaggaggggagagcatctatgggaagaagaaggggca

SEQ ID NO: 190 - DNA, 23 bp, Artificial Sequence
  Synthetic
cccacugaaaagcacttccugaa

SEQ ID NO: 191 - DNA, 25 bp, Artificial Sequence
  Synthetic
ctttcatgacugcagcttcttucaa

SEQ ID NO: 192 - DNA, 107 bp, Artificial Sequence
  Synthetic
cccactgaaaagcacttcctgaaataatttcaccttcgtttttttccttctgcaggaggacaccatggaggtggaagagttcttgaaagaagctgcagtcatgaaag

SEQ ID NO: 193 - DNA, 24 bp, Artificial Sequence
  Synthetic
tgttgaagtccucgttgtcttgut

SEQ ID NO: 194 - DNA, 21 bp, Artificial Sequence
  Synthetic
gtagtccaggaggutcccgua

SEQ ID NO: 195 - DNA, 100 bp, Artificial Sequence
  Synthetic
tgttgaagtcctcgttgtcttgttggcaggggtctgcacccgggagcccccgttctatatcatcactgagttcatgacctacgggaacctcctggactac

SEQ ID NO: 196 - DNA, 23 bp, Artificial Sequence
  Synthetic
ccaactacgacaagugggagaug

SEQ ID NO: 197 - DNA, 23 bp, Artificial Sequence
  Synthetic
ccgtcaggcugtatttctuccac

SEQ ID NO: 198 - DNA, 114 bp, Artificial Sequence
  Synthetic
ccaactacgacaagtgggagatggaacgcacggacatcaccatgaagcacaagctgggcgggggccagtacggggaggtgtacgagggcgtgtggaagaaatacagcctgacgg

SEQ ID NO: 199 - DNA, 23 bp, Artificial Sequence
  Synthetic
gcagcaaguatgaugagcaagct

SEQ ID NO: 200 - DNA, 28 bp, Artificial Sequence
  Synthetic
agaaaggcatuagaaagcctgtagttut

SEQ ID NO: 201 - DNA, 110 bp, Artificial Sequence
  Synthetic
gcagcaagtatgatgagcaagctttctcacaagcatttggttttaaattatggagtatgtgtctgtggagacgagagtaagtaaaactacaggctttctaatgcctttct

SEQ ID NO: 202 - DNA, 21 bp, Artificial Sequence
  Synthetic
gattttggccugagcaggtug

SEQ ID NO: 203 - DNA, 25 bp, Artificial Sequence
  Synthetic
cggacttgauggagaacttgttgua

SEQ ID NO: 204 - DNA, 121 bp, Artificial Sequence
  Synthetic
gattttggcctgagcaggttgatgacaggggacacctacacagcccatgctggagccaagttccccatcaaatggactgcacccgagagcctggcctacaacaagttctccatcaagtccg

SEQ ID NO: 205 - DNA, 25 bp, Artificial Sequence
  Synthetic
gagtatttgggcgaaugcagtttut

SEQ ID NO: 206 - DNA, 28 bp, Artificial Sequence
  Synthetic
tgaugaagatgatugggaaacacaagaa

SEQ ID NO: 207 - DNA, 100 bp, Artificial Sequence
  Synthetic
gagtatttgggcgaatgcagtttttcctcctactcaccatcctgtgtgcaggctccaagaagatttatgatattcttgtgtttcccaatcatcttcatca

SEQ ID NO: 208 - DNA, 22 bp, Artificial Sequence
  Synthetic
ttcttcatucggcacaggauga

SEQ ID NO: 209 - DNA, 22 bp, Artificial Sequence
  Synthetic
caatcuagcgccuggaagagaa

SEQ ID NO: 210 - DNA, 129 bp, Artificial Sequence
  Synthetic
ttcttcattcggcacaggatgactgttaccaccatacaggcgattaagaagacccctatgcagtaaatggctatctccaggtagtctggggaagctgtaatctccttttctcttccaggcgctagattg

SEQ ID NO: 211 - DNA, 26 bp, Artificial Sequence
  Synthetic
ccagttgtggguacctttagatucag

SEQ ID NO: 212 - DNA, 22 bp, Artificial Sequence
  Synthetic
gtggaucaagcacguggaaaag

SEQ ID NO: 213 - DNA, 110 bp, Artificial Sequence
  Synthetic
ccagttgtgggtacctttagattcagaaagtcctcaccttgagaaccttgaggtagggcagcccgtcgggcccgtatttactgccgttcttttccacgtgcttgatccac

SEQ ID NO: 214 - DNA, 20 bp, Artificial Sequence
  Synthetic
cttccaggagcgaucgttug

SEQ ID NO: 215 - DNA, 22 bp, Artificial Sequence
  Synthetic
ctgctucaggacgttgaacuct

SEQ ID NO: 216 - DNA, 104 bp, Artificial Sequence
  Synthetic
cttccaggagcgatcgtttgcaacctgctctgtgctgcatttcagagaacgcctccccgagtgagctgcgagacctgctgtcagagttcaacgtcctgaagcag

SEQ ID NO: 217 - DNA, 21 bp, Artificial Sequence
  Synthetic
gactuggcagccagaaacauc

SEQ ID NO: 218 - DNA, 24 bp, Artificial Sequence
  Synthetic
tcctcttcacguaggaatcctcut

SEQ ID NO: 219 - DNA, 106 bp, Artificial Sequence
  Synthetic
gacttggcagccagaaacatcctggtagctgaggggcggaagatgaagatttcggatttcggcttgtcccgagatgtttatgaagaggattcctacgtgaagagga

SEQ ID NO: 220 - DNA, 25 bp, Artificial Sequence
  Synthetic
catcttctcttuagggtcggatucc

SEQ ID NO: 221 - DNA, 23 bp, Artificial Sequence
  Synthetic
aacacccacacutacacaucact

SEQ ID NO: 222 - DNA, 100 bp, Artificial Sequence
  Synthetic
catcttctctttagggtcggattccagttaaatggatggcaattgaatccctttttgatcatatctacaccacgcaaagtgatgtgtaagtgtgggtgtt

SEQ ID NO: 223 - DNA, 24 bp, Artificial Sequence
  Synthetic
tttttctguccaccagggaguaac

SEQ ID NO: 224 - DNA, 26 bp, Artificial Sequence
  Synthetic
tgccactgguctataatccagaugat

SEQ ID NO: 225 - DNA, 100 bp, Artificial Sequence
  Synthetic
tttttctgtccaccagggagtaactattcccagtcagaggcgctatgtgtattattatagctacctgttaaagaatcatctggattatagaccagtggca

SEQ ID NO: 226 - DNA, 22 bp, Artificial Sequence
  Synthetic
cccagacaugacagccatcauc

SEQ ID NO: 227 - DNA, 23 bp, Artificial Sequence
  Synthetic
ccgcagaaauggatacaggucaa

SEQ ID NO: 228 - DNA, 102 bp, Artificial Sequence
  Synthetic
cccagacatgacagccatcatcaaagagatcgttagcagaaacaaaaggagatatcaagaggatggattcgacttagacttgacctgtatccatttctgcgg

SEQ ID NO: 229 - DNA, 26 bp, Artificial Sequence
  Synthetic
catttgaccguggagaagtagaauca

SEQ ID NO: 230 - DNA, 28 bp, Artificial Sequence
  Synthetic
tcgtttgcaucactaacactactaucag

SEQ ID NO: 231 - DNA, 127 bp, Artificial Sequence
  Synthetic
catttgaccgtggagaagtagaatcaatggaagatgatactaatggaaatctaatggaggtggaggatcagtcatccatgaatctatttaacgattaccctgatagtagtgttagtgatgcaaacga

SEQ ID NO: 232 - DNA, 26 bp, Artificial Sequence
  Synthetic
gacagtuaaaggcatttcctgugaaa

SEQ ID NO: 233 - DNA, 28 bp, Artificial Sequence
  Synthetic
ggtcctgaatuggaggaatatatctuca

SEQ ID NO: 234 - DNA, 112 bp, Artificial Sequence
  Synthetic
gacagttaaaggcatttcctgtgaaataatactggtatgtatttaaccatgcagatcctcagtttgtggtctgccagctaaaggtgaagatatattcctccaattcaggacc

SEQ ID NO: 235 - DNA, 28 bp, Artificial Sequence
  Synthetic
aggatttcguaatattgccgucaaagaa

SEQ ID NO: 236 - DNA, 29 bp, Artificial Sequence
  Synthetic
acaggaaattuctaaatgtgacaugacct

SEQ ID NO: 237 - DNA, 104 bp, Artificial Sequence
  Synthetic
aggatttcgtaatattgccgtcaaagaaaatttgattgaattgatggcagatatctgtcaccaggtacagtaagtaggtcatgtcacatttagaaatttcctgt

SEQ ID NO: 238 - DNA, 27 bp, Artificial Sequence
  Synthetic
gaagaaaauagaactaggcugggaagt

SEQ ID NO: 239 - DNA, 29 bp, Artificial Sequence
  Synthetic
gacactgaaugagaaaatggtaacactut

SEQ ID NO: 240 - DNA, 109 bp, Artificial Sequence
  Synthetic
gaagaaaatagaactaggctgggaagtaataaaagatcaccttcagaagtcacagaatgattttgatcttgtgccttggtaaagtgttaccattttctcattcagtgtc

SEQ ID NO: 241 - DNA, 26 bp, Artificial Sequence
  Synthetic
acatggctttuggtcttctaagugaa

SEQ ID NO: 242 - DNA, 28 bp, Artificial Sequence
  Synthetic
gcagcttuacagtttttcatagugagac

SEQ ID NO: 243 - DNA, 113 bp, Artificial Sequence
  Synthetic
acatggcttttggtcttctaagtgaagctttttgtttttctttgtagtaattttcctcatcttgtactggagaaaattcttgtgagtctcactatgaaaaactgtaaagctgc

SEQ ID NO: 244 - DNA, 22 bp, Artificial Sequence
  Synthetic
tgtcaaagutcgaucagcagct

SEQ ID NO: 245 - DNA, 23 bp, Artificial Sequence
  Synthetic
ctgtagauaggccagcatuggat

SEQ ID NO: 246 - DNA, 118 bp, Artificial Sequence
  Synthetic
tgtcaaagttcgatcagcagctgttacctgtttgaaaaacattttagccacaaagactggacatagtttctgggagatttataagatgacaacagatccaatgctggcctatctacag

SEQ ID NO: 247 - DNA, 28 bp, Artificial Sequence
  Synthetic
agtcattuaaagcagaatttcgctuagc

SEQ ID NO: 248 - DNA, 21 bp, Artificial Sequence
  Synthetic
agggaaggcucacctuaacaa

SEQ ID NO: 249 - DNA, 114 bp, Artificial Sequence
  Synthetic
agtcatttaaagcagaatttcgcttagcaggaggtgtaaatttaccaaaaataatagattgtgtaggttccgatggcaaggagaggagacagcttgttaaggtgagccttccct

SEQ ID NO: 250 - DNA, 27 bp, Artificial Sequence
  Synthetic
cttaattattcugaagggccgtgauga

SEQ ID NO: 251 - DNA, 23 bp, Artificial Sequence
  Synthetic
tcctagttuccgtgtttctcugc

SEQ ID NO: 252 - DNA, 104 bp, Artificial Sequence
  Synthetic
cttaattattctgaagggccgtgatgacctgagacaagatgctgtcatgcaacaggtcttccagatgtgtaatacattactgcagagaaacacggaaactagga

SEQ ID NO: 253 - DNA, 24 bp, Artificial Sequence
  Synthetic
cctatgaggguaccagagacagug

SEQ ID NO: 254 - DNA, 28 bp, Artificial Sequence
  Synthetic
gccatacctgtuttcccaataagtttuc

SEQ ID NO: 255 - DNA, 105 bp, Artificial Sequence
  Synthetic
cctatgagggtaccagagacagtgggatggcacagcaaagagagactgctaccaaggtctatgatatgcttaaaagtgaaaacttattgggaaaacaggtatggc

SEQ ID NO: 256 - DNA, 26 bp, Artificial Sequence
  Synthetic
ctatatgtagaggcugttggaagcug

SEQ ID NO: 257 - DNA, 25 bp, Artificial Sequence
  Synthetic
cttaagggccutggtataagaugca

SEQ ID NO: 258 - DNA, 108 bp, Artificial Sequence
  Synthetic
ctatatgtagaggctgttggaagctgcttgggagaagtgggtcctatagatttctctaccatagctatacaacatagtaaagatgcatcttataccaaggcccttaag

SEQ ID NO: 259 - DNA, 28 bp, Artificial Sequence
  Synthetic
gaaguacccagattugacaaagaaaacc

SEQ ID NO: 260 - DNA, 28 bp, Artificial Sequence
  Synthetic
cacaagtcagtguctttatccaaatguc

SEQ ID NO: 261 - DNA, 109 bp, Artificial Sequence
  Synthetic
gaagtacccagatttgacaaagaaaacccttttgaaggcctggatgatataaatctgtggattcctctaagtgaaaatcatgacatttggataaagacactgacttgtg

SEQ ID NO: 262 - DNA, 25 bp, Artificial Sequence
  Synthetic
gagcagucagcagaacttgtacaua

SEQ ID NO: 263 - DNA, 25 bp, Artificial Sequence
  Synthetic
gtaggcaaacaacautccatgauga

SEQ ID NO: 264 - DNA, 105 bp, Artificial Sequence
  Synthetic
gagcagtcagcagaacttgtacatatagatctaggtaagtaataaaatctatgtatctattctttttagtaaatatttggtcatcatggaatgttgtttgcctac

SEQ ID NO: 265 - DNA, 28 bp, Artificial Sequence
  Synthetic
ttctgttaaagtucatggcttttgtgut

SEQ ID NO: 266 - DNA, 23 bp, Artificial Sequence
  Synthetic
cagggctaautcatccaacucca

SEQ ID NO: 267 - DNA, 100 bp, Artificial Sequence
  Synthetic
ttctgttaaagttcatggcttttgtgttttaccttaattattctatgcaagatacacagtaaaggttcagcgagagctggagttggatgaattagccctg

SEQ ID NO: 268 - DNA, 26 bp, Artificial Sequence
  Synthetic
cctcactgaaaccuttgtgttttugt

SEQ ID NO: 269 - DNA, 23 bp, Artificial Sequence
  Synthetic
gccttcttccacucctttcagut

SEQ ID NO: 270 - DNA, 114 bp, Artificial Sequence
  Synthetic
cctcactgaaacctttgtgtttttgtccttagtgatattgaccagagtttcaacaaagtagctgaacgtgtcttaatgagactacaagagaaactgaaaggagtggaagaaggc

SEQ ID NO: 271 - DNA, 24 bp, Artificial Sequence
  Synthetic
gtccacaaaauggttctggaucag

SEQ ID NO: 272 - DNA, 24 bp, Artificial Sequence
  Synthetic
cctgaggagcgaugacggaataua

SEQ ID NO: 273 - DNA, 101 bp, Artificial Sequence
  Synthetic
gtccacaaaatggttctggatcagctggatggtcagcgcactcttgcccacaccgccggcgcccaccaccaccagcttatattccgtcatcgctcctcagg

SEQ ID NO: 274 - DNA, 24 bp, Artificial Sequence
  Synthetic
gatgctgugagaaaaccauggaag

SEQ ID NO: 275 - DNA, 28 bp, Artificial Sequence
  Synthetic
atgagatacacaguctacctgguaagaa

SEQ ID NO: 276 - DNA, 126 bp, Artificial Sequence
  Synthetic
gatgctgtgagaaaaccatggaagtgatgagaaactctcaggaaactctgttaaccattgtagaggtaaagtattttataaggaagactttattttttttcttaccaggtagactgtgtatctcat

SEQ ID NO: 277 - DNA, 25 bp, Artificial Sequence
  Synthetic
ggtggacaagugaatttgctcauac

SEQ ID NO: 278 - DNA, 28 bp, Artificial Sequence
  Synthetic
catatactgaagaucacacccaagctut

SEQ ID NO: 279 - DNA, 100 bp, Artificial Sequence
  Synthetic
ggtggacaagtgaatttgctcatacagcaggccatagaccccaaaaatctcagccgacttttcccaggatggaaagcttgggtgtgatcttcagtatatg

SEQ ID NO: 280 - DNA, 25 bp, Artificial Sequence
  Synthetic
gatgtttcctucgtaggtgtugact

SEQ ID NO: 281 - DNA, 26 bp, Artificial Sequence
  Synthetic
gataaatcgguactgtgcttctguct

SEQ ID NO: 282 - DNA, 111 bp, Artificial Sequence
  Synthetic
gatgtttccttcgtaggtgttgactgcgatattgacgttcccaaaaccatccagatggtgcggtctcagaggtcagggatggtccagacagaagcacagtaccgatttatc

SEQ ID NO: 283 - DNA, 21 bp, Artificial Sequence
  Synthetic
tcctcatguactggtcccuca

SEQ ID NO: 284 - DNA, 25 bp, Artificial Sequence
  Synthetic
tgtttctccctuctcaggattccua

SEQ ID NO: 285 - DNA, 126 bp, Artificial Sequence
  Synthetic
tcctcatgtactggtccctcattgcactgtactcctcttgacctgctgtgtcgagaatatccaagagacaggtttctccatcaattactacttgcttcctgtaggaatcctgagaagggagaaaca

SEQ ID NO: 286 - DNA, 25 bp, Artificial Sequence
  Synthetic
agtaggaaauagcagcctcacatug

SEQ ID NO: 287 - DNA, 22 bp, Artificial Sequence
  Synthetic
ccacgggaaaguggtgaagaua

SEQ ID NO: 288 - DNA, 103 bp, Artificial Sequence
  Synthetic
agtaggaaatagcagcctcacattgcccctgacaacatagttggaatcactcatgatatctcgagccaatccaaagtcacatatcttcaccactttcccgtgg

SEQ ID NO: 289 - DNA, 22 bp, Artificial Sequence
  Synthetic
ggugatgagcuaccaaccaaga

SEQ ID NO: 290 - DNA, 22 bp, Artificial Sequence
  Synthetic
gggttcttcugcctctcauagg

SEQ ID NO: 291 - DNA, 101 bp, Artificial Sequence
  Synthetic
ggtgatgagctaccaaccaagaaggggcggaggaaccgtttcaagtggggcccagcatcccagcagatcctgttccaggcctatgagaggcagaagaaccc

SEQ ID NO: 292 - DNA, 32 bp, Artificial Sequence
  Synthetic
gacauaacagttatgatttugcagaaaacaga

SEQ ID NO: 293 - DNA, 23 bp, Artificial Sequence
  Synthetic
caggcucaggactuagcaagaag

SEQ ID NO: 294 - DNA, 124 bp, Artificial Sequence
  Synthetic
gacataacagttatgattttgcagaaaacagatctgtatttatttcagtgttacttacctgtcttgtctttgctgatgtttcaataaaaggaattccataacttcttgctaagtcctgagcctg

SEQ ID NO: 295 - DNA, 22 bp, Artificial Sequence
  Synthetic
gaagtgggtuacctgacagugt

SEQ ID NO: 296 - DNA, 25 bp, Artificial Sequence
  Synthetic
tgaaagagaggcacucatgucagaa

SEQ ID NO: 297 - DNA, 107 bp, Artificial Sequence
  Synthetic
gaagtgggttacctgacagtgtgcacgcccccagcaggttcacaatattctcgtggcttcccagctgggtcatcatcttgagttctgacatgagtgcctctctttca

SEQ ID NO: 298 - DNA, 24 bp, Artificial Sequence
  Synthetic
gcagaaacauttggcacatuccat

SEQ ID NO: 299 - DNA, 23 bp, Artificial Sequence
  Synthetic
accggctccucagataatgagua

SEQ ID NO: 300 - DNA, 124 bp, Artificial Sequence
  Synthetic
gcagaaacatttggcacattccattcttaccaaactctaaattttctcttggaaactcccatttgagatcatattcatattctctgaaatcaacgtagaagtactcattatctgaggagccggt

SEQ ID NO: 301 - DNA, 25 bp, Artificial Sequence
  Synthetic
cttcttccagguccaagatgguaat

SEQ ID NO: 302 - DNA, 28 bp, Artificial Sequence
  Synthetic
acgttcttttcuatagggaaaccucaag

SEQ ID NO: 303 - DNA, 105 bp, Artificial Sequence
  Synthetic
cttcttccaggtccaagatggtaatgggtatccatccgagaaacaggacgcctgacttgccgatgcttctgcgagcacttgaggtttccctatagaaaagaacgt

SEQ ID NO: 304 - DNA, 23 bp, Artificial Sequence
  Synthetic
ggtcaccugtaccatctguagct

SEQ ID NO: 305 - DNA, 25 bp, Artificial Sequence
  Synthetic
ttctttcctcuatctgcagaacugc

SEQ ID NO: 306 - DNA, 102 bp, Artificial Sequence
  Synthetic
ggtcacctgtaccatctgtagctggctttcatacctaaattgcttcagagatgaaatgatgagtcagttaggaataggcagttctgcagatagaggaaagaa

SEQ ID NO: 307 - DNA, 24 bp, Artificial Sequence
  Synthetic
ggucgacaaaggacagcctattut

SEQ ID NO: 308 - DNA, 25 bp, Artificial Sequence
  Synthetic
gaccaagaaauggatctgtgggtua

SEQ ID NO: 309 - DNA, 117 bp, Artificial Sequence
  Synthetic
ggtcgacaaaggacagcctatttttccctcgacacccgattcaaagtgggcacagatggtgtgattacagtcaaaaggcctctacggtttcataacccacagatccatttcttggtc

SEQ ID NO: 310 - DNA, 21 bp, Artificial Sequence
  Synthetic
tggttcaagcugctgacctuc

SEQ ID NO: 311 - DNA, 25 bp, Artificial Sequence
  Synthetic
gaattaccguggtgggatugaagat

SEQ ID NO: 312 - DNA, 114 bp, Artificial Sequence
  Synthetic
tggttcaagctgctgaccttcaaggtgaggggttaagcacaacagcaacagctgtgatcacagtcactgacaccaacgataatcctccgatcttcaatcccaccacggtaattc

SEQ ID NO: 313 - DNA, 26 bp, Artificial Sequence
  Synthetic
tcttcctcagacautcaaacgtgtut

SEQ ID NO: 314 - DNA, 28 bp, Artificial Sequence
  Synthetic
ggtggaagcauactgcaaaatatttgut

SEQ ID NO: 315 - DNA, 121 bp, Artificial Sequence
  Synthetic
tcttcctcagacattcaaacgtgttttgatcaaagaagaggagtatgattctattatagtattctataactcggtcttcatgcagagactgaaaacaaatattttgcagtatgcttccacc

SEQ ID NO: 316 - DNA, 22 bp, Artificial Sequence
  Synthetic
ggctaacgucgtaaucaccaca

SEQ ID NO: 317 - DNA, 28 bp, Artificial Sequence
  Synthetic
gacaaattguccaccatcatcatucaat

SEQ ID NO: 318 - DNA, 109 bp, Artificial Sequence
  Synthetic
ggctaacgtcgtaatcaccacactgaaagtgactgatgctgatgcccccaataccccagcgtgggaggctgtatacaccatattgaatgatgatggtggacaatttgtc

SEQ ID NO: 319 - DNA, 33 bp, Artificial Sequence
  Synthetic
tattctttcctttguagtgtccataaattctut

SEQ ID NO: 320 - DNA, 28 bp, Artificial Sequence
  Synthetic
gctgaagagugcaaacaatacatcauac

SEQ ID NO: 321 - DNA, 126 bp, Artificial Sequence
  Synthetic
tattctttcctttgtagtgtccataaattctttaacttactaaaagaaattgataccagtaccaaagttgataatgctatgtcaagactgttgaagaagtatgatgtattgtttgcactcttcagc

SEQ ID NO: 322 - DNA, 26 bp, Artificial Sequence
  Synthetic
tctgcattggugctaaaagtttctug

SEQ ID NO: 323 - DNA, 30 bp, Artificial Sequence
  Synthetic
agtccaaaggaaugccaatttaattatuac

SEQ ID NO: 324 - DNA, 118 bp, Artificial Sequence
  Synthetic
tctgcattggtgctaaaagtttcttggatcacatttttattagctaaaggtaagttcattatatttattaaatgctaatatttcaaatgtaataattaaattggcattcctttggact

SEQ ID NO: 325 - DNA, 29 bp, Artificial Sequence
  Synthetic
ggcaactugacaagagaaatgauaaaaca

SEQ ID NO: 326 - DNA, 27 bp, Artificial Sequence
  Synthetic
ttgttagccauatgcacatgaaugaat

SEQ ID NO: 327 - DNA, 129 bp, Artificial Sequence
  Synthetic
ggcaacttgacaagagaaatgataaaacatttagaacgatgtgaacatcgaatcatggaatcccttgcatggctctcagtaagtagctaaataattgaagaaattcattcatgtgcatatggctaacaa

SEQ ID NO: 328 - DNA, 22 bp, Artificial Sequence
  Synthetic
gtctacatgggugcttcccaut

SEQ ID NO: 329 - DNA, 22 bp, Artificial Sequence
  Synthetic
tgacatggtugggactctugac

SEQ ID NO: 330 - DNA, 111 bp, Artificial Sequence
  Synthetic
gtctacatgggtgcttcccattccaggggatgagctacctggaggatgtgcggctcgtacacagggacttggccgctcggaacgtgctggtcaagagtcccaaccatgtca

SEQ ID NO: 331 - DNA, 21 bp, Artificial Sequence
  Synthetic
ccttguccccaggaagcauac

SEQ ID NO: 332 - DNA, 22 bp, Artificial Sequence
  Synthetic
gccatagggcauaagctgtguc

SEQ ID NO: 333 - DNA, 117 bp, Artificial Sequence
  Synthetic
ccttgtccccaggaagcatacgtgatggctggtgtgggctccccatatgtctcccgccttctgggcatctgcctgacatccacggtgcagctggtgacacagcttatgccctatggc

SEQ ID NO: 334 - DNA, 24 bp, Artificial Sequence
  Synthetic
ctggagtctuccagtgtgatgaug

SEQ ID NO: 335 - DNA, 22 bp, Artificial Sequence
  Synthetic
cctaggtuggctctgactguac

SEQ ID NO: 336 - DNA, 115 bp, Artificial Sequence
  Synthetic
ctggagtcttccagtgtgatgatggtgaggatgggcctccggttcatgccgcccatgcaggaactgttacacatgtagttgtagtggatggtggtacagtcagagccaacctagg

SEQ ID NO: 337 - DNA, 27 bp, Artificial Sequence
  Synthetic
tggcctgatctucacaaaaatgaacua

SEQ ID NO: 338 - DNA, 27 bp, Artificial Sequence
  Synthetic
caactcgttcguagtgatatggatuca

SEQ ID NO: 339 - DNA, 109 bp, Artificial Sequence
  Synthetic
tggcctgatcttcacaaaaatgaactaaaacatgttaaatattgtcagtatgcgtttgacttaaaatgtgatagtgtctgtgtgaatccatatcactacgaacgagttg

SEQ ID NO: 340 - DNA, 28 bp, Artificial Sequence
  Synthetic
gaaggatgaataugtgcatgacttugag

SEQ ID NO: 341 - DNA, 23 bp, Artificial Sequence
  Synthetic
cgatgcacgautacttgguggat

SEQ ID NO: 342 - DNA, 100 bp, Artificial Sequence
  Synthetic
gaaggatgaatatgtgcatgactttgagggacagccatcgttgtccactgaaggacattcaattcaaaccatccagcatccaccaagtaatcgtgcatcg

SEQ ID NO: 343 - DNA, 23 bp, Artificial Sequence
  Synthetic
ctctaggucagcctgccagtaua

SEQ ID NO: 344 - DNA, 24 bp, Artificial Sequence
  Synthetic
ccagtaaatccautctgctgcugt

SEQ ID NO: 345 - DNA, 103 bp, Artificial Sequence
  Synthetic
ctctaggtcagcctgccagtatactggggggcagccatagtgaaggactgttgcagatagcatcagggcctcagccaggacagcagcagaatggatttactgg

SEQ ID NO: 346 - DNA, 24 bp, Artificial Sequence
  Synthetic
gtctttgattugcgtcagtgucat

SEQ ID NO: 347 - DNA, 24 bp, Artificial Sequence
  Synthetic
gagctattccaccuactgatccug

SEQ ID NO: 348 - DNA, 130 bp, Artificial Sequence
  Synthetic
gtctttgatttgcgtcagtgtcatcgacagatgcagcagcaggcggctactgcacaagctgcagcagctgcccaggcagcagccgtggcaggaaacatccctggcccaggatcagtaggtggaatagctc

SEQ ID NO: 349 - DNA, 22 bp, Artificial Sequence
  Synthetic
ctctgaccutagcaggauccag

SEQ ID NO: 350 - DNA, 23 bp, Artificial Sequence
  Synthetic
acttagcutggaagcugacaagt

SEQ ID NO: 351 - DNA, 104 bp, Artificial Sequence
  Synthetic
ctctgaccttagcaggatccagggcactgatgggcatggtgacgccactaaacacttcccagaccgtggcgccgaagccccacttgtcagcttccaagctaagt

SEQ ID NO: 352 - DNA, 20 bp, Artificial Sequence
  Synthetic
agatgccgguacgacactug

SEQ ID NO: 353 - DNA, 27 bp, Artificial Sequence
  Synthetic
cacaaaattugggattattggagugga

SEQ ID NO: 354 - DNA, 117 bp, Artificial Sequence
  Synthetic
agatgccggtacgacacttggctcatcaagctcgctgcttccaggaatgactggggaaggtgggaagggagagaagatgcgtgggtttcttccactccaataatcccaaattttgtg

SEQ ID NO: 355 - DNA, 21 bp, Artificial Sequence
  Synthetic
aacaucaccacgggtctguac

SEQ ID NO: 356 - DNA, 22 bp, Artificial Sequence
  Synthetic
caccttucagcaggucagagag

SEQ ID NO: 357 - DNA, 127 bp, Artificial Sequence
  Synthetic
aacatcaccacgggtctgtaccccttcgaaggggacaacatctacaagttgtttgagaacatcgggaaggggagctacgccatcccgggcgactgtggccccccgctctctgacctgctgaaaggtg

SEQ ID NO: 358 - DNA, 28 bp, Artificial Sequence
  Synthetic
gagatccatugacctcaattttgttuca

SEQ ID NO: 359 - DNA, 24 bp, Artificial Sequence
  Synthetic
ggtaacagutggcttacuggaagt

SEQ ID NO: 360 - DNA, 120 bp, Artificial Sequence
  Synthetic
gagatccattgacctcaattttgtttcaggacctgcttcgctgccgtgtcctgacttctggaatctttgagaccaagttccaggtggacaaagtcaacttccagtaagccaactgttacc

SEQ ID NO: 361 - DNA, 23 bp, Artificial Sequence
  Synthetic
gtgggaaacuacctccgtatgut

SEQ ID NO: 362 - DNA, 28 bp, Artificial Sequence
  Synthetic
caactattttcutcctctctuccacagt

SEQ ID NO: 363 - DNA, 100 bp, Artificial Sequence
  Synthetic
gtgggaaactacctccgtatgttccgaggttctctgtacaagagatacccctcactctggaggcgactagccactgtggaagagaggaagaaaatagttg

SEQ ID NO: 364 - DNA, 23 bp, Artificial Sequence
  Synthetic
tgtgatccaugagaacgcatcuc

SEQ ID NO: 365 - DNA, 25 bp, Artificial Sequence
  Synthetic
tgtaccattcaugttccaggugaag

SEQ ID NO: 366 - DNA, 112 bp, Artificial Sequence
  Synthetic
tgtgatccatgagaacgcatctcagcccgaggtgctggtccccatccggctggacatggagatcgatgggcagaagctgcgagacgccttcacctggaacatgaatggtaca

SEQ ID NO: 367 - DNA, 22 bp, Artificial Sequence
  Synthetic
gcuccacaaccaucaacaggaa

SEQ ID NO: 368 - DNA, 22 bp, Artificial Sequence
  Synthetic
gagaacuaaggcggaaucagca

SEQ ID NO: 369 - DNA, 113 bp, Artificial Sequence
  Synthetic
gctccacaaccatcaacaggaaccgcatgggccgagacaagaagagaaccttccccctttggtgtggatgcatcgctgcactcaccctccgtgctgattccgccttagttctc

SEQ ID NO: 370 - DNA, 22 bp, Artificial Sequence
  Synthetic
tgagtuccaaggcctcatucag

SEQ ID NO: 371 - DNA, 28 bp, Artificial Sequence
  Synthetic
tgaaccatctttuaactcaggtactgug

SEQ ID NO: 372 - DNA, 122 bp, Artificial Sequence
  Synthetic
tgagttccaaggcctcattcagctctcggaacatctcgaagcgctcacgcccacggatctgcagcaacagaggagggggagaagtaagtatatacacagtacctgagttaaaagatggttca

SEQ ID NO: 373 - DNA, 24 bp, Artificial Sequence
  Synthetic
gaattggtgtugatgaccttcguc

SEQ ID NO: 374 - DNA, 20 bp, Artificial Sequence
  Synthetic
gggcccggugtaagtgaaut

SEQ ID NO: 375 - DNA, 132 bp, Artificial Sequence
  Synthetic
gaattggtgttgatgaccttcgtcgcttatgcatactcaggatgagttttgtgaaaggctggggaccggattacccaagacagagcatcaaagaaacaccttgctggattgaaattcacttacaccgggccc

SEQ ID NO: 376 - DNA, 22 bp, Artificial Sequence
  Synthetic
tcttgtccugcttgcttaccuc

SEQ ID NO: 377 - DNA, 23 bp, Artificial Sequence
  Synthetic
gguaatctacugggacggaacag

SEQ ID NO: 378 - DNA, 155 bp, Artificial Sequence
  Synthetic
tcttgtcctgcttgcttacctcgcttagtgctccctgggggcagctcgtggtgaggctcccctttcttgcggagattctcttcctctgtgcgccggtctctcccaggacaggcacaaacacgcacctcaaagctgttccgtcccagtagattacc

SEQ ID NO: 379 - DNA, 28 bp, Artificial Sequence
  Synthetic
gccagaactacaaucttttgatgacaut

SEQ ID NO: 380 - DNA, 24 bp, Artificial Sequence
  Synthetic
caatccauttttgttguccagcca

SEQ ID NO: 381 - DNA, 141 bp, Artificial Sequence
  Synthetic
gccagaactacaatcttttgatgacattgcatacattcgaaagaccctagccttagataaaactgagcaagaggctttggagtatttcatgaaacaaatgaatgatgcacatcatggtggctggacaacaaaaatggattg

SEQ ID NO: 382 - DNA, 23 bp, Artificial Sequence
  Synthetic
gutgttgauggcaaacacacaca

SEQ ID NO: 383 - DNA, 21 bp, Artificial Sequence
  Synthetic
gaagcagguggtcattgaugg

SEQ ID NO: 384 - DNA, 136 bp, Artificial Sequence
  Synthetic
gttgttgatggcaaacacacacaggaagccctccccggtgcgcatgtactggtcccgcatggcgctgtactcctcctggccggcggtatccaggatgtccaacaggcacgtctccccatcaatgaccacctgcttc

SEQ ID NO: 385 - DNA, 28 bp, Artificial Sequence
  Synthetic
gagtattggtgtuccattgcttacttug

SEQ ID NO: 386 - DNA, 23 bp, Artificial Sequence
  Synthetic
gacautggagagtugacccaaac

SEQ ID NO: 387 - DNA, 150 bp, Artificial Sequence
  Synthetic
gagtattggtgttccattgcttactttgaaatggatgttcaggtaggagagacatttaaggttccttcaagctgccctattgttactgttgatggatacgtggacccttctggaggagatcgcttttgtttgggtcaactctccaatgtc

SEQ ID NO: 388 - DNA, 21 bp, Artificial Sequence
  Synthetic
ctctcugcacagctccaauga

SEQ ID NO: 389 - DNA, 21 bp, Artificial Sequence
  Synthetic
ccagggcuttgaaggaagugt

SEQ ID NO: 390 - DNA, 131 bp, Artificial Sequence
  Synthetic
ctctctgcacagctccaatgagactctgtcctgcgtcatcatctttgtcatcgtgtactacgccctgatggctggtgtggtttggtttgtggtcctcacctatgcctggcacacttccttcaaagccctgg

SEQ ID NO: 391 - DNA, 24 bp, Artificial Sequence
  Synthetic
cagaatgaggugcagaacaucaag

SEQ ID NO: 392 - DNA, 20 bp, Artificial Sequence
  Synthetic
cctctgugaagagcgggtuc

SEQ ID NO: 393 - DNA, 139 bp, Artificial Sequence
  Synthetic
cagaatgaggtgcagaacatcaagttcaacagttcaggccagtgcgaagtgcccttggttcggacagacaaccccaagagctggtacgaggacgtggagggctgcggcatccagtgccagaacccgctcttcacagagg

SEQ ID NO: 394 - DNA, 19 bp, Artificial Sequence
  Synthetic
cgtctccuccgaccacugt

SEQ ID NO: 395 - DNA, 28 bp, Artificial Sequence
  Synthetic
gcttatttattgguctctcattcuccca

SEQ ID NO: 396 - DNA, 134 bp, Artificial Sequence
  Synthetic
cgtctcctccgaccactgtggaggcatttgccggcagtccggcttggaggatgggccggtgaggcgatcgctctggtggagagagggaagaaaggaggagtggggatgggagaatgagagaccaataaataagc

SEQ ID NO: 397 - DNA, 20 bp, Artificial Sequence
  Synthetic
cctccaggaagccuacguga

SEQ ID NO: 398 - DNA, 27 bp, Artificial Sequence
  Synthetic
aatattgtctttgugttcccggacaua

SEQ ID NO: 399 - DNA, 151 bp, Artificial Sequence
  Synthetic
cctccaggaagcctacgtgatggccagcgtggacaacccccacgtgtgccgcctgctgggcatctgcctcacctccaccgtgcagctcatcacgcagctcatgcccttcggctgcctcctggactatgtccgggaacacaaagacaatatt

SEQ ID NO: 400 - DNA, 21 bp, Artificial Sequence
  Synthetic
cagtgtgtaugcaggcaucct

SEQ ID NO: 401 - DNA, 19 bp, Artificial Sequence
  Synthetic
gggagaucttgugcacggt

SEQ ID NO: 402 - DNA, 137 bp, Artificial Sequence
  Synthetic
cagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctccc

SEQ ID NO: 403 - DNA, 32 bp, Artificial Sequence
  Synthetic
ttaaatacagaaggcauaaatatuccagcaga

SEQ ID NO: 404 - DNA, 33 bp, Artificial Sequence
  Synthetic
tcaagagttaatugcaaattaccttaattucca

SEQ ID NO: 405 - DNA, 115 bp, Artificial Sequence
  Synthetic
ttaaatacagaaggcataaatattccagcagaccagccaattactaaacttaagaatttagaagatgttgttgtccctactatggaaattaaggtaatttgcaattaactcttga

SEQ ID NO: 406 - DNA, 21 bp, Artificial Sequence
  Synthetic
ccagauagcccuggacaaacc

SEQ ID NO: 407 - DNA, 24 bp, Artificial Sequence
  Synthetic
cagcatttacugcagcttgctuag

SEQ ID NO: 408 - DNA, 154 bp, Artificial Sequence
  Synthetic
ccagatagccctggacaaaccatgccaccaagcagaagtaaaacacctccaccacctcctcaaacagctcaaaccaagcgagaagtacctaaaaataaagcacctactgctgaaaagagagagagtggacctaagcaagctgcagtaaatgctg

SEQ ID NO: 409 - DNA, 33 bp, Artificial Sequence
  Synthetic
aacaaaaccatgtaauaaaattctgactactut

SEQ ID NO: 410 - DNA, 25 bp, Artificial Sequence
  Synthetic
gaggaagatccutgtatgctgtuac

SEQ ID NO: 411 - DNA, 144 bp, Artificial Sequence
  Synthetic
aacaaaaccatgtaataaaattctgactacttttacatcaatttatttactagattatgatgtgttccatgtatggcatatgcaaagtgaagaatatagaccttaaattcaaaatcattgtaacagcatacaaggatcttcctc

SEQ ID NO: 412 - DNA, 25 bp, Artificial Sequence
  Synthetic
ctauttttccctttcuccccacaga

SEQ ID NO: 413 - DNA, 23 bp, Artificial Sequence
  Synthetic
tgaccaaaacucagcctgttuct

SEQ ID NO: 414 - DNA, 155 bp, Artificial Sequence
  Synthetic
ctatttttccctttctccccacagaaacccatgtatgaagtacagtggaaggttgttgaggagataaatggaaacaattatgtttacatagacccaacacaacttccttatgatcacaaatgggagtttcccagaaacaggctgagttttggtca

SEQ ID NO: 415 - DNA, 22 bp, Artificial Sequence
  Synthetic
ctcaccaucgctatcugagcag

SEQ ID NO: 416 - DNA, 20 bp, Artificial Sequence
  Synthetic
gtgcagcugtgggttgatuc

SEQ ID NO: 417 - DNA, 138 bp, Artificial Sequence
  Synthetic
ctcaccatcgctatctgagcagcgctcatggtgggggcagcgcctcacaacctccgtcatgtgctgtgactgcttgtagatggccatggcgcggacgcgggtgccgggcgggggtgtggaatcaacccacagctgcac

SEQ ID NO: 418 - DNA, 21 bp, Artificial Sequence
  Synthetic
cttaccctugggtgcagttug

SEQ ID NO: 419 - DNA, 25 bp, Artificial Sequence
  Synthetic
gctcucattttaaagauggcccaaa

SEQ ID NO: 420 - DNA, 138 bp, Artificial Sequence
  Synthetic
cttacccttgggtgcagtttggatggcatgggtggcactcccgatctggatcagcatacttgaaaatgaaactgtttgccccctgtaagccatctggacatttttccacacagtttgggccatctttaaaatgagagc

SEQ ID NO: 421 - DNA, 21 bp, Artificial Sequence
  Synthetic
ccagtugcaaaccagaccuca

SEQ ID NO: 422 - DNA, 26 bp, Artificial Sequence
  Synthetic
ctgattcctcacugattgctctuagg

SEQ ID NO: 423 - DNA, 155 bp, Artificial Sequence
  Synthetic
ccagttgcaaaccagacctcaggcggctcatagggcaccaccacactatgtcgaaaagtgtttctgtcatccaaatactccacacgcaaatttccttccactcggataagatgctgaggaggggccagacctaagagcaatcagtgaggaatcag

SEQ ID NO: 424 - DNA, 24 bp, Artificial Sequence
  Synthetic
tutatcttcagaaucagccaggca

SEQ ID NO: 425 - DNA, 28 bp, Artificial Sequence
  Synthetic
ctgacagaaguacatctgctaaacauga

SEQ ID NO: 426 - DNA, 150 bp, Artificial Sequence
  Synthetic
tttatcttcagaatcagccaggcacaaagctgttgaattttcttcaggagcgaaatctccctccaaaagtggtgctcagacacccaaaagtccacctgaacactatgttcaggagaccccactcatgtttagcagatgtacttctgtcag

SEQ ID NO: 427 - DNA, 24 bp, Artificial Sequence
  Synthetic
gataggtcaccuttggctctucag

SEQ ID NO: 428 - DNA, 23 bp, Artificial Sequence
  Synthetic
agtaccuggcagtgtgatatugg

SEQ ID NO: 429 - DNA, 133 bp, Artificial Sequence
  Synthetic
gataggtcacctttggctcttcagagatgcagggacacacgatgggcttctggttaaccaaactgaattatttgtgccatctctcaatgttgacggacagcctatttttgccaatatcacactgccaggtact

SEQ ID NO: 430 - DNA, 20 bp, Artificial Sequence
  Synthetic
gcagtgtguccaccgtgauc

SEQ ID NO: 431 - DNA, 25 bp, Artificial Sequence
  Synthetic
gtacactgccuttcgacacatagut

SEQ ID NO: 432 - DNA, 131 bp, Artificial Sequence
  Synthetic
gcagtgtgtccaccgtgatctggctgctcgcaacgtcctcctggcacaaggaaaaattgtgaagatctgtgactttggcctggccagagacatcatgcatgattcgaactatgtgtcgaaaggcagtgtac

SEQ ID NO: 433 - DNA, 27 bp, Artificial Sequence
  Synthetic
gatgtctatgaagugttgtggttccut

SEQ ID NO: 434 - DNA, 29 bp, Artificial Sequence
  Synthetic
actgtuacagaaatgaaauaagacggaaa

SEQ ID NO: 435 - DNA, 153 bp, Artificial Sequence
  Synthetic
gatgtctatgaagtgttgtggttccttaaccacatttctttttttttttttccaggctattcaagatctctggcagtggaggaagtctctttaagaaaatagtttaaacaatttgttaaaaaattttccgtcttatttcatttctgtaacagt

SEQ ID NO: 436 - DNA, 33 bp, Artificial Sequence
  Synthetic
caaattgtaaatttucagtatgtgaatgactuc

SEQ ID NO: 437 - DNA, 28 bp, Artificial Sequence
  Synthetic
ggaaaattcataccuaactggagtgugt

SEQ ID NO: 438 - DNA, 140 bp, Artificial Sequence
  Synthetic
caaattgtaaattttcagtatgtgaatgacttcacttattgttatttagttttgaaacacagagaacaccacgaaaaagtaaccttgatgaagaggtgaatgtaattcctccacacactccagttaggtatgaattttcc

SEQ ID NO: 439 - DNA, 22 bp, Artificial Sequence
  Synthetic
ctgutcaaactgaugggaccca

SEQ ID NO: 440 - DNA, 27 bp, Artificial Sequence
  Synthetic
tgcttgctctgauaggaaaatgagauc

SEQ ID NO: 441 - DNA, 152 bp, Artificial Sequence
  Synthetic
ctgttcaaactgatgggacccactccatcgagatttcactgtagctagaccaaaatcacctatttttactgtgaggtcttcatgaagaaatatatctgaggtgtagtaagtaaaggaaaacagtagatctcattttcctatcagagcaagca

SEQ ID NO: 442 - DNA, 22 bp, Artificial Sequence
  Synthetic
gaagaaauggagctgucaccca

SEQ ID NO: 443 - DNA, 24 bp, Artificial Sequence
  Synthetic
cttttaatugcccgtgatgtucca

SEQ ID NO: 444 - DNA, 132 bp, Artificial Sequence
  Synthetic
gaagaaatggagctgtcacccacatcaagattcagaacactggtgattactatgacctgtatggaggggagaaatttgccactttggctgagttggtccagtattacatggaacatcacgggcaattaaaag

SEQ ID NO: 445 - DNA, 28 bp, Artificial Sequence
  Synthetic
cactcacagtutccataggtcugaaaat

SEQ ID NO: 446 - DNA, 21 bp, Artificial Sequence
  Synthetic
atccccacutttcctctugca

SEQ ID NO: 447 - DNA, 131 bp, Artificial Sequence
  Synthetic
cactcacagtttccataggtctgaaaatgtttcctgactcagagggggctcgacgctaggatctgactgcggctcctccatggcagtgacccggaaggcagtctggctgctgcaagaggaaaagtggggat

SEQ ID NO: 448 - DNA, 28 bp, Artificial Sequence
  Synthetic
gtcatcagcugaagatgaaataggaugt

SEQ ID NO: 449 - DNA, 21 bp, Artificial Sequence
  Synthetic
gctgtgacacugctggaacut

SEQ ID NO: 450 - DNA, 146 bp, Artificial Sequence
  Synthetic
gtcatcagctgaagatgaaataggatgtaatcagacgacacaggaagcagattctgctaataccctgcaaatagcagaaataaaagaaaagattggaactaggtcagctgaagatcctgtgagcgaagttccagcagtgtcacagc

SEQ ID NO: 451 - DNA, 21 bp, Artificial Sequence
  Synthetic
ccccaaauctgaaucccgaga

SEQ ID NO: 452 - DNA, 25 bp, Artificial Sequence
  Synthetic
cgctacttccucctcaagaatgaug

SEQ ID NO: 453 - DNA, 142 bp, Artificial Sequence
  Synthetic
ccccaaatctgaatcccgagaggccaaggggatacttacgcgccacagagaagttgttgaggggagcctcacgttggtccacatcctgcggccgctccttgtagccaatgaaggtgccatcattcttgaggaggaagtagcg

SEQ ID NO: 454 - DNA, 21 bp, Artificial Sequence
  Synthetic
cagaggttuggcctgctttug

SEQ ID NO: 455 - DNA, 27 bp, Artificial Sequence
  Synthetic
atccttcttctccugtttgagaatguc

SEQ ID NO: 456 - DNA, 132 bp, Artificial Sequence
  Synthetic
cagaggtttggcctgcttttggagtcctattgtcgtgcatgtgggatgtatttgaagcacctgaataggcaagtcgaggcaatggaaaagctcattaacttaactgacattctcaaacaggagaagaaggat

SEQ ID NO: 457 - DNA, 19 bp, Artificial Sequence
  Synthetic
gtgcgucacgctugaagac

SEQ ID NO: 458 - DNA, 20 bp, Artificial Sequence
  Synthetic
ggactgugcggagcatguac

SEQ ID NO: 459 - DNA, 155 bp, Artificial Sequence
  Synthetic
gtgcgtcacgcttgaagaccacgttggtgtgcagcacgcggctgagctcccgcaggaagtggaaggagctgttgcgcagctgctccggcggcatcagcaccaccaccaccagcgtgccggccgccagcctctcgggtacatgctccgcacagtcc

SEQ ID NO: 460 - DNA, 28 bp, Artificial Sequence
  Synthetic
caatttttaatgaugctttctggcugga

SEQ ID NO: 461 - DNA, 30 bp, Artificial Sequence
  Synthetic
catacttttcttauctgcatagatttcugc

SEQ ID NO: 462 - DNA, 125 bp, Artificial Sequence
  Synthetic
caatttttaatgatgctttctggctggatttaaattatctagaagttgccaaggtagctcagtcttgtgctgctcactttacagctttactctatgcagaaatctatgcagataagaaaagtatg

SEQ ID NO: 463 - DNA, 23 bp, Artificial Sequence
  Synthetic
cgaggacaacgugatgaagaucg

SEQ ID NO: 464 - DNA, 19 bp, Artificial Sequence
  Synthetic
ggcgtccuactggcaugac

SEQ ID NO: 465 - DNA, 132 bp, Artificial Sequence
  Synthetic
cgaggacaacgtgatgaagatcgcagacttcgggctggcccgggacgtgcacaacctcgactactacaagaagacgaccaacgtgagcccggccctggggtgcgggggtgggggtcatgccagtaggacgcc

SEQ ID NO: 466 - DNA, 31 bp, Artificial Sequence
  Synthetic
tgcttactaatguggttttaatttcatcaug

SEQ ID NO: 467 - DNA, 27 bp, Artificial Sequence
  Synthetic
gatuaagaggacaagcagatucaaggt

SEQ ID NO: 468 - DNA, 126 bp, Artificial Sequence
  Synthetic
tgcttactaatgtggttttaatttcatcatgtttcatataggattcacctttatttgatcttattaaacaatcaaaggaccgagaaggaccaactgatcaccttgaatctgcttgtcctcttaatc

SEQ ID NO: 469 - DNA, 26 bp, Artificial Sequence
  Synthetic
gcgtgcagauaatgacaaggaatauc

SEQ ID NO: 470 - DNA, 27 bp, Artificial Sequence
  Synthetic
gtcaacaacccccacaaaaugttuaat

SEQ ID NO: 471 - DNA, 142 bp, Artificial Sequence
  Synthetic
gcgtgcagataatgacaaggaatatctagtacttactttaacaaaaaatgatcttgacaaagcaaataaagacaaagccaaccgatacttttctccaaattttaaggtcagttaaattaaacattttgtgggggttgttgac

SEQ ID NO: 472 - DNA, 23 bp, Artificial Sequence
  Synthetic
cgacgggaagacaagutcatgua

SEQ ID NO: 473 - DNA, 30 bp, Artificial Sequence
  Synthetic
ttctcccaatgaaaguaaagtacaaaccut

SEQ ID NO: 474 - DNA, 132 bp, Artificial Sequence
  Synthetic
cgacgggaagacaagttcatgtactttgagttccctcagccgttacctgtgtgtggtgatatcaaagtagagttcttccacaaacagaacaagatgctaaaaaaggtttgtactttactttcattgggagaa

SEQ ID NO: 475 - DNA, 24 bp, Artificial Sequence
  Synthetic
gctgatttgauggagttggacaug

SEQ ID NO: 476 - DNA, 23 bp, Artificial Sequence
  Synthetic
caggattgccuttaccacucaga

SEQ ID NO: 477 - DNA, 145 bp, Artificial Sequence
  Synthetic
gctgatttgatggagttggacatggccatggaaccagacagaaaagcggctgttagtcactggcagcaacagtcttacctggactctggaatccattctggtgccactaccacagctccttctctgagtggtaaaggcaatcctg

SEQ ID NO: 478 - DNA, 27 bp, Artificial Sequence
  Synthetic
atggtggctttutgtttgtttgtttug

SEQ ID NO: 479 - DNA, 31 bp, Artificial Sequence
  Synthetic
caagcagataactutcacttaatagttgtut

SEQ ID NO: 480 - DNA, 152 bp, Artificial Sequence
  Synthetic
atggtggctttttgtttgtttgttttgttttaaggtttttggattcaaagcataaaaaccattacaagatatacaatctgtaagtatgttttcttatttgtatgcttgcaaatatcttctaaaacaactattaagtgaaagttatctgcttg

SEQ ID NO: 481 - DNA, 22 bp, Artificial Sequence
  Synthetic
caagaaucgcccgagccttcug

SEQ ID NO: 482 - DNA, 23 bp, Artificial Sequence
  Synthetic
caccagguacgcctccagaugag

SEQ ID NO: 483 - DNA, 123 bp, Artificial Sequence
  Synthetic
caagaatcgcccgagccttctggtggagaagatcaacctgtttgccatgtttggaactggcatcgccatgagcacctgggtctggaccaaggccacgctgctcatctggaggcgtacctggtg

SEQ ID NO: 484 - DNA, 18 bp, Artificial Sequence
  Synthetic
gaaugcggccacgucggt

SEQ ID NO: 485 - DNA, 22 bp, Artificial Sequence
  Synthetic
ggtcccagccccuctctgatug

SEQ ID NO: 486 - DNA, 119 bp, Artificial Sequence
  Synthetic
gaatgcggccacgtcggtggcactctggaagcactgcgaggaggcctgcacacactgccggttgtcaatctccaggtagacgatggagctgggcggacaatcagagaggggctgggacc

SEQ ID NO: 487 - DNA, 22 bp, Artificial Sequence
  Synthetic
gacacgttcauccaccgcaucg

SEQ ID NO: 488 - DNA, 22 bp, Artificial Sequence
  Synthetic
ccgaguccagcacctcctucac

SEQ ID NO: 489 - DNA, 142 bp, Artificial Sequence
  Synthetic
gacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcgg

SEQ ID NO: 490 - DNA, 20 bp, Artificial Sequence
  Synthetic
cacgggucgggtgagagugg

SEQ ID NO: 491 - DNA, 23 bp, Artificial Sequence
  Synthetic
caccctggcuctgaccattcugt

SEQ ID NO: 492 - DNA, 131 bp, Artificial Sequence
  Synthetic
cacgggtcgggtgagagtggcggggtcggcgcagttgggctccgcgccgtggagcagcagcagctccgccactcgggcgctgcccatcatcatgacctgccagagagaacagaatggtcagagccagggtg

SEQ ID NO: 493 - DNA, 22 bp, Artificial Sequence
  Synthetic
cactcctctuccaggcggauga

SEQ ID NO: 494 - DNA, 21 bp, Artificial Sequence
  Synthetic
gagaggcggcccaaucttcug

SEQ ID NO: 495 - DNA, 110 bp, Artificial Sequence
  Synthetic
cactcctcttccaggcggatgaggcgtcttgccaacacggccccggcctggtaaccagcccatcagcacacggctcccacggagcatctcagaagattgggccgcctctc

SEQ ID NO: 496 - DNA, 33 bp, Artificial Sequence
  Synthetic
cacttttggguaaatacattcttcauaccagga

SEQ ID NO: 497 - DNA, 27 bp, Artificial Sequence
  Synthetic
cacgctctauactgcaaatgctaucga

SEQ ID NO: 498 - DNA, 112 bp, Artificial Sequence
  Synthetic
cacttttgggtaaatacattcttcataccaggaccagaggaaacctcagaaaaagtagaaaatggaagtctatgtgatcaagaaatcgatagcatttgcagtatagagcgtg

SEQ ID NO: 499 - DNA, 28 bp, Artificial Sequence
  Synthetic
gagaatgtgaaaautccagtggccauca

SEQ ID NO: 500 - DNA, 23 bp, Artificial Sequence
  Synthetic
gggtcctucctgtcctccuagca

SEQ ID NO: 501 - DNA, 122 bp, Artificial Sequence
  Synthetic
gagaatgtgaaaattccagtggccatcaaagtgttgagggaaaacacatcccccaaagccaacaaagaaatcttagacgtaagcccctccaccctctcctgctaggaggacaggaaggaccc

SEQ ID NO: 502 - DNA, 23 bp, Artificial Sequence
  Synthetic
cagacttggcugtcccagaaugc

SEQ ID NO: 503 - DNA, 20 bp, Artificial Sequence
  Synthetic
cccugcaccagcagctccua

SEQ ID NO: 504 - DNA, 143 bp, Artificial Sequence
  Synthetic
cagacttggctgtcccagaatgcaagaagcccagacggaaaccgtagctgccctggtaggttttctgggaagggacagaagatgacaggggccaggagggggctggtgcaggggccgccggtgtaggagctgctggtgcaggg

SEQ ID NO: 505 - DNA, 19 bp, Artificial Sequence
  Synthetic
ccagugcccaucccaccga

SEQ ID NO: 506 - DNA, 26 bp, Artificial Sequence
  Synthetic
caccgtgaagucctgagtgtagauga

SEQ ID NO: 507 - DNA, 150 bp, Artificial Sequence
  Synthetic
ccagtgcccatcccaccgagcccagacaccaaggaccggtggcgcagcatgactgtggtgccgtacttggaggacctgcacggcgcggacgaggacgaggacctcttcgacatcgaggatgacatcatctacactcaggacttcacggtg

SEQ ID NO: 508 - DNA, 24 bp, Artificial Sequence
  Synthetic
acatggccacucagatctcgucag

SEQ ID NO: 509 - DNA, 21 bp, Artificial Sequence
  Synthetic
ctccacgcccugtgacuccat

SEQ ID NO: 510 - DNA, 110 bp, Artificial Sequence
  Synthetic
acatggccactcagatctcgtcagccatggagtacctggagaagaaaaacttcatccacaggtaggggcctggccaggcagcctgcgccatggagtcacagggcgtggag

SEQ ID NO: 511 - DNA, 21 bp, Artificial Sequence
  Synthetic
ccccacccacagauccacugt

SEQ ID NO: 512 - DNA, 22 bp, Artificial Sequence
  Synthetic
tgguagcagtggaugcagaagg

SEQ ID NO: 513 - DNA, 115 bp, Artificial Sequence
  Synthetic
ccccacccacagatccactgtgcgacgagctgtgccgcacggtgatcgcagccgctgtcctcttctccttcatcgtctcggtgctgctgtctgccttctgcatccactgctacca

SEQ ID NO: 514 - DNA, 23 bp, Artificial Sequence
  Synthetic
gcccagcaugtcaccaagauggt

SEQ ID NO: 515 - DNA, 26 bp, Artificial Sequence
  Synthetic
ccttccuccagaagcttgaactcuca

SEQ ID NO: 516 - DNA, 111 bp, Artificial Sequence
  Synthetic
gcccagcatgtcaccaagatggtggctcggagaggagccatactgccccaggatatttctgtcacccctgtggcaactccaggtatgagagttcaagcttctggaggaagg

SEQ ID NO: 517 - DNA, 21 bp, Artificial Sequence
  Synthetic
tcccctgcagcuggtccttug

SEQ ID NO: 518 - DNA, 20 bp, Artificial Sequence
  Synthetic
cagtuggcgggcttguccat

SEQ ID NO: 519 - DNA, 136 bp, Artificial Sequence
  Synthetic
tcccctgcagctggtcctttggggtcctgctctgggagatcttcacgctggggggctccccgtaccccggcatccctgtggaggagctcttcaagctgctgaaggagggccaccgcatggacaagcccgccaactg

SEQ ID NO: 520 - DNA, 21 bp, Artificial Sequence
  Synthetic
tccttggugaccgctcugcat

SEQ ID NO: 521 - DNA, 20 bp, Artificial Sequence
  Synthetic
cctgguccaccgccagtcuc

SEQ ID NO: 522 - DNA, 129 bp, Artificial Sequence
  Synthetic
tccttggtgaccgctctgcatctagtgctgggcctcagcgccgtcctgggcctgctgctgctgaggtggcagtttcctgcacactacaggtaccgcccccgccaggcaggagactggcggtggaccagg

SEQ ID NO: 523 - DNA, 21 bp, Artificial Sequence
  Synthetic
tgcauagccagggcattgugc

SEQ ID NO: 524 - DNA, 20 bp, Artificial Sequence
  Synthetic
ccccuagcacgtgccuacct

SEQ ID NO: 525 - DNA, 116 bp, Artificial Sequence
  Synthetic
tgcatagccagggcattgtgcacaaggacatcaagccggggaacctgctgctcaccaccggtggcaccctcaaaatctccgacctgggcgtggccgaggtaggcacgtgctagggg

SEQ ID NO: 526 - DNA, 23 bp, Artificial Sequence
  Synthetic
ggcugctggacatugacgagaca

SEQ ID NO: 527 - DNA, 23 bp, Artificial Sequence
  Synthetic
gttctcccaugggcuagacacca

SEQ ID NO: 528 - DNA, 110 bp, Artificial Sequence
  Synthetic
ggctgctggacattgacgagacagagtaccatgcagatgggggcaaggttaggtgaaggaccaaggagcagaggaggctgggtggagtggtgtctagcccatgggagaac

SEQ ID NO: 529 - DNA, 20 bp, Artificial Sequence
  Synthetic
gggacgacuccgtgttugcc

SEQ ID NO: 530 - DNA, 22 bp, Artificial Sequence
  Synthetic
ctgcuagggacccctcacatug

SEQ ID NO: 531 - DNA, 111 bp, Artificial Sequence
  Synthetic
gggacgactccgtgtttgcccacgacctgctgcccccggccccacccagcagtgggggctcgcggacgtgaagggccactggtccccaacaatgtgaggggtccctagcag

SEQ ID NO: 532 - DNA, 21 bp, Artificial Sequence
  Synthetic
tguccccaucacaggcacagg

SEQ ID NO: 533 - DNA, 20 bp, Artificial Sequence
  Synthetic
ggcccgcugtacgtguccat

SEQ ID NO: 534 - DNA, 130 bp, Artificial Sequence
  Synthetic
tgtccccatcacaggcacaggggctgggctccaacctcgtcacggaggtgcgtgtctacaactggtttgccaaccggcgcaaagaagaagccttccggcacaagctggccatggacacgtacagcgggcc

SEQ ID NO: 535 - DNA, 19 bp, Artificial Sequence
  Synthetic
ggtggccccugagcgucat

SEQ ID NO: 536 - DNA, 21 bp, Artificial Sequence
  Synthetic
gcagtggaacuccacgucgct

SEQ ID NO: 537 - DNA, 117 bp, Artificial Sequence
  Synthetic
ggtggcccctgagcgtcatctgcccccacagagcgctccccgcaccggcccatcctgcaggcggggctgccggccaaccagacggcggtgctgggcagcgacgtggagttccactgc

SEQ ID NO: 538 - DNA, 30 bp, Artificial Sequence
  Synthetic
cttttttcttccuaaggttgcacauaggca

SEQ ID NO: 539 - DNA, 23 bp, Artificial Sequence
  Synthetic
actctguacaaagaccgcguggt

SEQ ID NO: 540 - DNA, 110 bp, Artificial Sequence
  Synthetic
cttttttcttcctaaggttgcacataggcaaaggtgtgcagttggaatgtaaaggtgaaggtgatgtttgggtcaggtgccttagtgaccacgcggtctttgtacagagt

SEQ ID NO: 541 - DNA, 32 bp, Artificial Sequence
  Synthetic
gaatttttgttgtcttutctttagggcctgut

SEQ ID NO: 542 - DNA, 37 bp, Artificial Sequence
  Synthetic
ttcaatcaccactaaaucaatctaaatacaggaaauc

SEQ ID NO: 543 - DNA, 131 bp, Artificial Sequence
  Synthetic
gaatttttgttgtcttttctttagggcctgttcacaatgagcttgcattccagcctcccatttccaatcatcctggtaagtgtatttcaaaattgatttcctgtatttagattgatttagtggtgattgaa

SEQ ID NO: 544 - DNA, 32 bp, Artificial Sequence
  Synthetic
acctctattgtuggatcatattcguccacaaa

SEQ ID NO: 545 - DNA, 37 bp, Artificial Sequence
  Synthetic
tttttattataaggccugctgaaaatgactgaataua

SEQ ID NO: 546 - DNA, 137 bp, Artificial Sequence
  Synthetic
acctctattgttggatcatattcgtccacaaaatgattctgaattagctgtatcgtcaaggcactcttgcctacgccaccagctccaactaccacaagtttatattcagtcattttcagcaggccttataataaaaa

SEQ ID NO: 547 - DNA, 30 bp, Artificial Sequence
  Synthetic
aatggagaaacauctacaaaatcccttugg

SEQ ID NO: 548 - DNA, 37 bp, Artificial Sequence
  Synthetic
aaaataataagcatcagcauttgactttaccttauca

SEQ ID NO: 549 - DNA, 135 bp, Artificial Sequence
  Synthetic
aatggagaaacatctacaaaatccctttgggttataaatagtgcactcagaataaaaattctttgtgcaacctacgtgaatgtaaatattcgagacattgataaggtaaagtcaaatgctgatgcttattatttt

SEQ ID NO: 550 - DNA, 37 bp, Artificial Sequence
  Synthetic
agtaaaaatgactaattttucttattcccacagtgua

SEQ ID NO: 551 - DNA, 22 bp, Artificial Sequence
  Synthetic
gggtgtgcuggaaaagggucca

SEQ ID NO: 552 - DNA, 135 bp, Artificial Sequence
  Synthetic
agtaaaaatgactaatttttcttattcccacagtgtatcggctagcctatctccggctaaatacactttgtgaacgccttctgtctgagcacccagaattagaacatatcatctggacccttttccagcacaccc

SEQ ID NO: 553 - DNA, 25 bp, Artificial Sequence
  Synthetic
ggattaaagcuggctatggcaccug

SEQ ID NO: 554 - DNA, 22 bp, Artificial Sequence
  Synthetic
gtgctgtugagacctctguggg

SEQ ID NO: 555 - DNA, 139 bp, Artificial Sequence
  Synthetic
ggattaaagctggctatggcacctgcaactgcttccctgaggaggagaagtgcttctgcgagcccgaagacatccagggtgagtgggtggcggccgggaccaccaccacctcccagccccacagaggtctcaacagcac

SEQ ID NO: 556 - DNA, 19 bp, Artificial Sequence
  Synthetic
cgtcgtgcugcccgtaugg

SEQ ID NO: 557 - DNA, 20 bp, Artificial Sequence
  Synthetic
gcccgtaccucggtagcugt

SEQ ID NO: 558 - DNA, 103 bp, Artificial Sequence
  Synthetic
cgtcgtgctgcccgtatggctcaacttcgacggcgagccgcagccctacccaacgctgccgcctggcacgggccgccgcatccacagctaccgaggtacgggc

SEQ ID NO: 559 - DNA, 27 bp, Artificial Sequence
  Synthetic
ggcaaatgucagtgcaaggttuacaca

SEQ ID NO: 560 - DNA, 37 bp, Artificial Sequence
  Synthetic
ttttttttaatcagauaactttgtggtagatuccagt

SEQ ID NO: 561 - DNA, 122 bp, Artificial Sequence
  Synthetic
ggcaaatgtcagtgcaaggtttacacattttaatcccattttcttctacttccatcttggaactagggcaggcacgcacacaagaactggaatctaccacaaagttatctgattaaaaaaaa

SEQ ID NO: 562 - DNA, 20 bp, Artificial Sequence
  Synthetic
gagcggcccaccutcgagua

SEQ ID NO: 563 - DNA, 21 bp, Artificial Sequence
  Synthetic
ccgcctgugcctagaggtuct

SEQ ID NO: 564 - DNA, 100 bp, Artificial Sequence
  Synthetic
gagcggcccaccttcgagtacctgcaggccttcctggaggactacttcacgtccaccgagccccagtaccagcccggggagaacctctaggcacaggcgg

SEQ ID NO: 565 - DNA, 20 bp, Artificial Sequence
  Synthetic
ggcaggtcutggccagtugg

SEQ ID NO: 566 - DNA, 26 bp, Artificial Sequence
  Synthetic
ctgttcacttgugccctgacttucaa

SEQ ID NO: 567 - DNA, 100 bp, Artificial Sequence
  Synthetic
ggcaggtcttggccagttggcaaaacatcttgttgagggcaggggagtactgtaggaagaggaaggagacagagttgaaagtcagggcacaagtgaacag

SEQ ID NO: 568 - DNA, 22 bp, Artificial Sequence
  Synthetic
ttcgcctgucctcatgtatugg

SEQ ID NO: 569 - DNA, 27 bp, Artificial Sequence
  Synthetic
catctacaaaguggttctggatuagct

SEQ ID NO: 570 - DNA, 27 bp, Artificial Sequence
  Synthetic
ccaacatgactuacttgatccccauaa

SEQ ID NO: 571 - DNA, 25 bp, Artificial Sequence
  Synthetic
tgtaaacgtcaauagtgcagauggg

SEQ ID NO: 572 - DNA, 23 bp, Artificial Sequence
  Synthetic
catcgccacauaggguagaacat

SEQ ID NO: 573 - DNA, 25 bp, Artificial Sequence
  Synthetic
acttacguggacatttctugacaca

SEQ ID NO: 574 - DNA, 23 bp, Artificial Sequence
  Synthetic
ccaaugcagcgaacaatgttcug

SEQ ID NO: 575 - DNA, 28 bp, Artificial Sequence
  Synthetic
gacagtaacccuacatatacaatugcct

SEQ ID NO: 576 - DNA, 29 bp, Artificial Sequence
  Synthetic
ccagtgactagaaagaucaaattcccaut

SEQ ID NO: 577 - DNA, 26 bp, Artificial Sequence
  Synthetic
aaucaaauagggaaggaaaggagagc

SEQ ID NO: 578 - DNA, 24 bp, Artificial Sequence
  Synthetic
gaggcagtcuttactcacctguag

SEQ ID NO: 579 - DNA, 25 bp, Artificial Sequence
  Synthetic
ggtttttgcccutccagtgtauact

SEQ ID NO: 580 - DNA, 26 bp, Artificial Sequence
  Synthetic
aaaaugacaaagaacagcucaaagca

SEQ ID NO: 581 - DNA, 29 bp, Artificial Sequence
  Synthetic
acattttcguaagtgttacucaagaagca

SEQ ID NO: 582 - DNA, 26 bp, Artificial Sequence
  Synthetic
gggaagaaaagugttttgaaatgugt

SEQ ID NO: 583 - DNA, 26 bp, Artificial Sequence
  Synthetic
tggatctuccacacaatuaaacagca

SEQ ID NO: 584 - DNA, 23 bp, Artificial Sequence
  Synthetic
tgacctcgucttctacttcugga

SEQ ID NO: 585 - DNA, 26 bp, Artificial Sequence
  Synthetic
tgtctttgagtuccattccacttgut

SEQ ID NO: 586 - DNA, 24 bp, Artificial Sequence
  Synthetic
ccctccugccatcatatugaacac

SEQ ID NO: 587 - DNA, 27 bp, Artificial Sequence
  Synthetic
accatgacaagautttcccttacctut

SEQ ID NO: 588 - DNA, 27 bp, Artificial Sequence
  Synthetic
actgctgaccaaacutttaaagtgtug

SEQ ID NO: 589 - DNA, 27 bp, Artificial Sequence
  Synthetic
cctcttuagggagcaatgaaaugaagt

SEQ ID NO: 590 - DNA, 26 bp, Artificial Sequence
  Synthetic
tgggactttgguaattcaccagtuac

SEQ ID NO: 591 - DNA, 23 bp, Artificial Sequence
  Synthetic
cccatctccuaacggcttttguc

SEQ ID NO: 592 - DNA, 27 bp, Artificial Sequence
  Synthetic
caagctctcatguctgaactgaagaua

SEQ ID NO: 593 - DNA, 27 bp, Artificial Sequence
  Synthetic
ccatccauccaggaaaatcagactuaa

SEQ ID NO: 594 - DNA, 23 bp, Artificial Sequence
  Synthetic
tttcgtaatcguagctggcauga

SEQ ID NO: 595 - DNA, 21 bp, Artificial Sequence
  Synthetic
caacgatgugggcaagactuc

SEQ ID NO: 596 - DNA, 22 bp, Artificial Sequence
  Synthetic
ggaagcccucatgtctgaacuc

SEQ ID NO: 597 - DNA, 26 bp, Artificial Sequence
  Synthetic
ccttctacatgucccacttgatucag

SEQ ID NO: 598 - DNA, 30 bp, Artificial Sequence; identical to SEQ ID NO: 91
  Synthetic

SEQ ID NO: 599 - DNA, 25 bp, Artificial Sequence
  Synthetic
ccttactcauggtcggaucacaaag

SEQ ID NO: 600 - DNA, 22 bp, Artificial Sequence
  Synthetic
ctcgacuacctgtgaaguggat

SEQ ID NO: 601 - DNA, 22 bp, Artificial Sequence
  Synthetic
gggtgtggaugcttcctttuaa

SEQ ID NO: 602 - DNA, 26 bp, Artificial Sequence
  Synthetic
agctttaaaagutctgcttccucact

SEQ ID NO: 603 - DNA, 23 bp, Artificial Sequence
  Synthetic
cagtacctgautcctgctgtgut

SEQ ID NO: 604 - DNA, 25 bp, Artificial Sequence
  Synthetic
ctgagcattagcutgcaagagatut

SEQ ID NO: 605 - DNA, 26 bp, Artificial Sequence
  Synthetic
ccagtaccttccucttcttctacauc

SEQ ID NO: 606 - DNA, 24 bp, Artificial Sequence
  Synthetic
gaccacautgagatggugaccaat

SEQ ID NO: 607 - DNA, 23 bp, Artificial Sequence
  Synthetic
cgaagaaggguattcccagtuga

SEQ ID NO: 608 - DNA, 27 bp, Artificial Sequence
  Synthetic
cttcaattttauttcctcccuggaagt

SEQ ID NO: 609 - DNA, 28 bp, Artificial Sequence
  Synthetic
aaaaatttcutcatctcacucccagact

SEQ ID NO: 610 - DNA, 25 bp, Artificial Sequence
  Synthetic
ggaattggtcuaggcaactaccauc

SEQ ID NO: 611 - DNA, 23 bp, Artificial Sequence
  Synthetic
tgtgtttcuccatacaggucacg

SEQ ID NO: 612 - DNA, 22 bp, Artificial Sequence
  Synthetic
caccatgacuttgaggtugagc

SEQ ID NO: 613 - DNA, 24 bp, Artificial Sequence
  Synthetic
caggttctuccagatgctgauact

SEQ ID NO: 614 - DNA, 28 bp, Artificial Sequence
  Synthetic
gcagccuaaagaatcaaaugaaaaccaa

SEQ ID NO: 615 - DNA, 21 bp, Artificial Sequence
  Synthetic
tggtacuccctgtcgucaact

SEQ ID NO: 616 - DNA, 21 bp, Artificial Sequence
  Synthetic
atacagucggaggttcacugc

SEQ ID NO: 617 - DNA, 22 bp, Artificial Sequence
  Synthetic
gaaccaauggatcgatcugcca

SEQ ID NO: 618 - DNA, 25 bp, Artificial Sequence
  Synthetic
agtgaattagutcgctacgaugcaa

SEQ ID NO: 619 - DNA, 23 bp, Artificial Sequence
  Synthetic
gttacgcagugctaaccaagtuc

SEQ ID NO: 620 - DNA, 24 bp, Artificial Sequence
  Synthetic
gtgggcuacaagaactaccgauac

SEQ ID NO: 621 - DNA, 24 bp, Artificial Sequence
  Synthetic
gattttggtctugccagagacaug

SEQ ID NO: 622 - DNA, 28 bp, Artificial Sequence
  Synthetic
acattacatactuaccatgccacttucc

SEQ ID NO: 623 - DNA, 23 bp, Artificial Sequence
  Synthetic
gttatgtccucattgcccucaac

SEQ ID NO: 624 - DNA, 23 bp, Artificial Sequence
  Synthetic
gaccagacaacugtatccagugt

SEQ ID NO: 625 - DNA, 22 bp, Artificial Sequence
  Synthetic
cctctuacacccaguggagaag

SEQ ID NO: 626 - DNA, 23 bp, Artificial Sequence
  Synthetic
ccacguaccagatggatgugaac

SEQ ID NO: 627 - DNA, 25 bp, Artificial Sequence
  Synthetic
tcttccttcuctctctgtcauaggg

SEQ ID NO: 628 - DNA, 26 bp, Artificial Sequence
  Synthetic
cagcatgtcaagaucacagatttugg

SEQ ID NO: 629 - DNA, 22 bp, Artificial Sequence
  Synthetic
acatgaacuccacgttgcuacc

SEQ ID NO: 630 - DNA, 26 bp, Artificial Sequence
  Synthetic
ggtttggttuggtgttatctgttuct

SEQ ID NO: 631 - DNA, 23 bp, Artificial Sequence
  Synthetic
cccacugaaaagcacttccugaa

SEQ ID NO: 632 - DNA, 24 bp, Artificial Sequence
  Synthetic
tgttgaagtccucgttgtcttgut

SEQ ID NO: 633 - DNA, 23 bp, Artificial Sequence
  Synthetic
ccaactacgacaagugggagaug

SEQ ID NO: 634 - DNA, 23 bp, Artificial Sequence
  Synthetic
gcagcaaguatgaugagcaagct

SEQ ID NO: 635 - DNA, 21 bp, Artificial Sequence
  Synthetic
gattttggccugagcaggtug

SEQ ID NO: 636 - DNA, 25 bp, Artificial Sequence
  Synthetic
gagtatttgggcgaaugcagtttut

SEQ ID NO: 637 - DNA, 22 bp, Artificial Sequence
  Synthetic
ttcttcatucggcacaggauga

SEQ ID NO: 638 - DNA, 26 bp, Artificial Sequence
  Synthetic
ccagttgtggguacctttagatucag

SEQ ID NO: 639 - DNA, 20 bp, Artificial Sequence
  Synthetic
cttccaggagcgaucgttug

SEQ ID NO: 640 - DNA, 21 bp, Artificial Sequence
  Synthetic
gactuggcagccagaaacauc

SEQ ID NO: 641 - DNA, 25 bp, Artificial Sequence
  Synthetic
catcttctcttuagggtcggatucc

SEQ ID NO: 642 - DNA, 24 bp, Artificial Sequence
  Synthetic
tttttctguccaccagggaguaac

SEQ ID NO: 643 - DNA, 22 bp, Artificial Sequence
  Synthetic
cccagacaugacagccatcauc

SEQ ID NO: 644 - DNA, 26 bp, Artificial Sequence
  Synthetic
catttgaccguggagaagtagaauca

SEQ ID NO: 645 - DNA, 26 bp, Artificial Sequence
  Synthetic
gacagtuaaaggcatttcctgugaaa

SEQ ID NO: 646 - DNA, 28 bp, Artificial Sequence
  Synthetic
aggatttcguaatattgccgucaaagaa

SEQ ID NO: 647 - DNA, 27 bp, Artificial Sequence
  Synthetic
gaagaaaauagaactaggcugggaagt

SEQ ID NO: 648 - DNA, 26 bp, Artificial Sequence
  Synthetic
acatggctttuggtcttctaagugaa

SEQ ID NO: 649 - DNA, 22 bp, Artificial Sequence
  Synthetic
tgtcaaagutcgaucagcagct

SEQ ID NO: 650 - DNA, 28 bp, Artificial Sequence
  Synthetic
agtcattuaaagcagaatttcgctuagc

SEQ ID NO: 651 - DNA, 27 bp, Artificial Sequence
  Synthetic
cttaattattcugaagggccgtgauga

SEQ ID NO: 652 - DNA, 24 bp, Artificial Sequence
  Synthetic
cctatgaggguaccagagacagug

SEQ ID NO: 653 - DNA, 26 bp, Artificial Sequence
  Synthetic
ctatatgtagaggcugttggaagcug

SEQ ID NO: 654 - DNA, 28 bp, Artificial Sequence
  Synthetic
gaaguacccagattugacaaagaaaacc

SEQ ID NO: 655 - DNA, 25 bp, Artificial Sequence
  Synthetic
gagcagucagcagaacttgtacaua

SEQ ID NO: 656 - DNA, 28 bp, Artificial Sequence
  Synthetic
ttctgttaaagtucatggcttttgtgut

SEQ ID NO: 657 - DNA, 26 bp, Artificial Sequence
  Synthetic
cctcactgaaaccuttgtgttttugt

SEQ ID NO: 658 - DNA, 24 bp, Artificial Sequence
  Synthetic
gtccacaaaauggttctggaucag

SEQ ID NO: 659 - DNA, 24 bp, Artificial Sequence
  Synthetic
gatgctgugagaaaaccauggaag

SEQ ID NO: 660 - DNA, 25 bp, Artificial Sequence
  Synthetic
ggtggacaagugaatttgctcauac

SEQ ID NO: 661 - DNA, 25 bp, Artificial Sequence
  Synthetic
gatgtttcctucgtaggtgtugact

SEQ ID NO: 662 - DNA, 21 bp, Artificial Sequence
  Synthetic
tcctcatguactggtcccuca

SEQ ID NO: 663 - DNA, 25 bp, Artificial Sequence
  Synthetic
agtaggaaauagcagcctcacatug

SEQ ID NO: 664 - DNA, 22 bp, Artificial Sequence
  Synthetic
ggugatgagcuaccaaccaaga

SEQ ID NO: 665 - DNA, 32 bp, Artificial Sequence; identical to SEQ ID NO: 292
  Synthetic

SEQ ID NO: 666 - DNA, 22 bp, Artificial Sequence
  Synthetic
gaagtgggtuacctgacagugt

SEQ ID NO: 667 - DNA, 24 bp, Artificial Sequence
  Synthetic
gcagaaacauttggcacatuccat

SEQ ID NO: 668 - DNA, 25 bp, Artificial Sequence
  Synthetic
cttcttccagguccaagatgguaat

SEQ ID NO: 669 - DNA, 23 bp, Artificial Sequence
  Synthetic
ggtcaccugtaccatctguagct

SEQ ID NO: 670 - DNA, 24 bp, Artificial Sequence
  Synthetic
ggucgacaaaggacagcctattut

SEQ ID NO: 671 - DNA, 21 bp, Artificial Sequence
  Synthetic
tggttcaagcugctgacctuc

SEQ ID NO: 672 - DNA, 26 bp, Artificial Sequence
  Synthetic
tcttcctcagacautcaaacgtgtut

SEQ ID NO: 673 - DNA, 22 bp, Artificial Sequence
  Synthetic
ggctaacgucgtaaucaccaca

SEQ ID NO: 674 - DNA, 33 bp, Artificial Sequence; identical to SEQ ID NO: 319
  Synthetic

SEQ ID NO: 675 - DNA, 26 bp, Artificial Sequence
  Synthetic
tctgcattggugctaaaagtttctug

SEQ ID NO: 676 - DNA, 29 bp, Artificial Sequence
  Synthetic
ggcaactugacaagagaaatgauaaaaca

SEQ ID NO: 677 - DNA, 22 bp, Artificial Sequence
  Synthetic
gtctacatgggugcttcccaut

SEQ ID NO: 678 - DNA, 21 bp, Artificial Sequence
  Synthetic
ccttguccccaggaagcauac

SEQ ID NO: 679 - DNA, 24 bp, Artificial Sequence
  Synthetic
ctggagtctuccagtgtgatgaug

SEQ ID NO: 680 - DNA, 27 bp, Artificial Sequence
  Synthetic
tggcctgatctucacaaaaatgaacua

SEQ ID NO: 681 - DNA, 28 bp, Artificial Sequence
  Synthetic
gaaggatgaataugtgcatgacttugag

SEQ ID NO: 682 - DNA, 23 bp, Artificial Sequence
  Synthetic
ctctaggucagcctgccagtaua

SEQ ID NO: 683 - DNA, 24 bp, Artificial Sequence
  Synthetic
gtctttgattugcgtcagtgucat

SEQ ID NO: 684 - DNA, 22 bp, Artificial Sequence
  Synthetic
ctctgaccutagcaggauccag

SEQ ID NO: 685 - DNA, 20 bp, Artificial Sequence
  Synthetic
agatgccgguacgacactug

SEQ ID NO: 686 - DNA, 21 bp, Artificial Sequence
  Synthetic
aacaucaccacgggtctguac

SEQ ID NO: 687 - DNA, 28 bp, Artificial Sequence
  Synthetic
gagatccatugacctcaattttgttuca

SEQ ID NO: 688 - DNA, 23 bp, Artificial Sequence
  Synthetic
gtgggaaacuacctccgtatgut

SEQ ID NO: 689 - DNA, 23 bp, Artificial Sequence
  Synthetic
tgtgatccaugagaacgcatcuc

SEQ ID NO: 690 - DNA, 22 bp, Artificial Sequence
  Synthetic
gcuccacaaccaucaacaggaa

SEQ ID NO: 691 - DNA, 22 bp, Artificial Sequence
  Synthetic
tgagtuccaaggcctcatucag

SEQ ID NO: 692 - DNA, 24 bp, Artificial Sequence
  Synthetic
gaattggtgtugatgaccttcguc

SEQ ID NO: 693 - DNA, 22 bp, Artificial Sequence
  Synthetic
tcttgtccugcttgcttaccuc

SEQ ID NO: 694 - DNA, 28 bp, Artificial Sequence
  Synthetic
gccagaactacaaucttttgatgacaut

SEQ ID NO: 695 - DNA, 23 bp, Artificial Sequence
  Synthetic
gutgttgauggcaaacacacaca

SEQ ID NO: 696 - DNA, 28 bp, Artificial Sequence
  Synthetic
gagtattggtgtuccattgcttacttug

SEQ ID NO: 697 - DNA, 21 bp, Artificial Sequence
  Synthetic
ctctcugcacagctccaauga

SEQ ID NO: 698 - DNA, 24 bp, Artificial Sequence
  Synthetic
cagaatgaggugcagaacaucaag

SEQ ID NO: 699 - DNA, 19 bp, Artificial Sequence
  Synthetic
cgtctccuccgaccacugt

SEQ ID NO: 700 - DNA, 20 bp, Artificial Sequence
  Synthetic
cctccaggaagccuacguga

SEQ ID NO: 701 - DNA, 21 bp, Artificial Sequence
  Synthetic
cagtgtgtaugcaggcaucct

SEQ ID NO: 702 - DNA, 32 bp, Artificial Sequence; identical to SEQ ID NO: 403
  Synthetic

SEQ ID NO: 703 - DNA, 21 bp, Artificial Sequence
  Synthetic
ccagauagcccuggacaaacc

SEQ ID NO: 704 - DNA, 33 bp, Artificial Sequence; identical to SEQ ID NO: 409
  Synthetic

SEQ ID NO: 705 - DNA, 25 bp, Artificial Sequence
  Synthetic
ctauttttccctttcuccccacaga

SEQ ID NO: 706 - DNA, 22 bp, Artificial Sequence
  Synthetic
ctcaccaucgctatcugagcag

SEQ ID NO: 707 - DNA, 21 bp, Artificial Sequence
  Synthetic
cttaccctugggtgcagttug

SEQ ID NO: 708 - DNA, 21 bp, Artificial Sequence
  Synthetic
ccagtugcaaaccagaccuca

SEQ ID NO: 709 - DNA, 24 bp, Artificial Sequence
  Synthetic
tutatcttcagaaucagccaggca

SEQ ID NO: 710 - DNA, 24 bp, Artificial Sequence
  Synthetic
gataggtcaccuttggctctucag

SEQ ID NO: 711 - DNA, 20 bp, Artificial Sequence
  Synthetic
gcagtgtguccaccgtgauc

SEQ ID NO: 712 - DNA, 27 bp, Artificial Sequence
  Synthetic
gatgtctatgaagugttgtggttccut

SEQ ID NO: 713 - DNA, 33 bp, Artificial Sequence; identical to SEQ ID NO: 436
  Synthetic

SEQ ID NO: 714 - DNA, 22 bp, Artificial Sequence
  Synthetic
ctgutcaaactgaugggaccca

SEQ ID NO: 715 - DNA, 22 bp, Artificial Sequence
  Synthetic
gaagaaauggagctgucaccca

SEQ ID NO: 716 - DNA, 28 bp, Artificial Sequence
  Synthetic
cactcacagtutccataggtcugaaaat

SEQ ID NO: 717 - DNA, 28 bp, Artificial Sequence
  Synthetic
gtcatcagcugaagatgaaataggaugt

SEQ ID NO: 718 - DNA, 21 bp, Artificial Sequence
  Synthetic
ccccaaauctgaaucccgaga

SEQ ID NO: 719 - DNA, 21 bp, Artificial Sequence
  Synthetic
cagaggttuggcctgctttug

SEQ ID NO: 720 - DNA, 19 bp, Artificial Sequence
  Synthetic
gtgcgucacgctugaagac

SEQ ID NO: 721 - DNA, 28 bp, Artificial Sequence
  Synthetic
caatttttaatgaugctttctggcugga

SEQ ID NO: 722 - DNA, 23 bp, Artificial Sequence
  Synthetic
cgaggacaacgugatgaagaucg

SEQ ID NO: 723 - DNA, 31 bp, Artificial Sequence; identical to SEQ ID NO: 466
  Synthetic

SEQ ID NO: 724 - DNA, 26 bp, Artificial Sequence
  Synthetic
gcgtgcagauaatgacaaggaatauc

SEQ ID NO: 725 - DNA, 23 bp, Artificial Sequence
  Synthetic
cgacgggaagacaagutcatgua

SEQ ID NO: 726 - DNA, 24 bp, Artificial Sequence
  Synthetic
gctgatttgauggagttggacaug

SEQ ID NO: 727 - DNA, 27 bp, Artificial Sequence
  Synthetic
atggtggctttutgtttgtttgtttug

SEQ ID NO: 728 - DNA, 22 bp, Artificial Sequence
  Synthetic
caagaaucgcccgagccttcug

SEQ ID NO: 729 - DNA, 18 bp, Artificial Sequence
  Synthetic
gaaugcggccacgucggt

SEQ ID NO: 730 - DNA, 22 bp, Artificial Sequence
  Synthetic
gacacgttcauccaccgcaucg

SEQ ID NO: 731 - DNA, 20 bp, Artificial Sequence
  Synthetic
cacgggucgggtgagagugg

SEQ ID NO: 732 - DNA, 22 bp, Artificial Sequence
  Synthetic
cactcctctuccaggcggauga

SEQ ID NO: 733 - DNA, 33 bp, Artificial Sequence; identical to SEQ ID NO: 496
  Synthetic

SEQ ID NO: 734 - DNA, 28 bp, Artificial Sequence
  Synthetic
gagaatgtgaaaautccagtggccauca

SEQ ID NO: 735 - DNA, 23 bp, Artificial Sequence
  Synthetic
cagacttggcugtcccagaaugc

SEQ ID NO: 736 - DNA, 19 bp, Artificial Sequence
  Synthetic
ccagugcccaucccaccga

SEQ ID NO: 737 - DNA, 24 bp, Artificial Sequence
  Synthetic
acatggccacucagatctcgucag

SEQ ID NO: 738 - DNA, 21 bp, Artificial Sequence
  Synthetic
ccccacccacagauccacugt

SEQ ID NO: 739 - DNA, 23 bp, Artificial Sequence
  Synthetic
gcccagcaugtcaccaagauggt

SEQ ID NO: 740 - DNA, 21 bp, Artificial Sequence
  Synthetic
tcccctgcagcuggtccttug

SEQ ID NO: 741 - DNA, 21 bp, Artificial Sequence
  Synthetic
tccttggugaccgctcugcat

SEQ ID NO: 742 - DNA, 21 bp, Artificial Sequence
  Synthetic
tgcauagccagggcattgugc

SEQ ID NO: 743 - DNA, 23 bp, Artificial Sequence
  Synthetic
ggcugctggacatugacgagaca

SEQ ID NO: 744 - DNA, 20 bp, Artificial Sequence
  Synthetic
gggacgacuccgtgttugcc

SEQ ID NO: 745 - DNA, 21 bp, Artificial Sequence
  Synthetic
tguccccaucacaggcacagg

SEQ ID NO: 746 - DNA, 19 bp, Artificial Sequence
  Synthetic
ggtggccccugagcgucat

SEQ ID NO: 747 - DNA, 30 bp, Artificial Sequence; identical to SEQ ID NO: 538
  Synthetic

SEQ ID NO: 748 - DNA, 32 bp, Artificial Sequence; identical to SEQ ID NO: 541
  Synthetic

SEQ ID NO: 749 - DNA, 32 bp, Artificial Sequence; identical to SEQ ID NO: 544
  Synthetic

SEQ ID NO: 750 - DNA, 30 bp, Artificial Sequence; identical to SEQ ID NO: 547
  Synthetic

SEQ ID NO: 751 - DNA, 37 bp, Artificial Sequence; identical to SEQ ID NO: 550
  Synthetic

SEQ ID NO: 752 - DNA, 25 bp, Artificial Sequence
  Synthetic
ggattaaagcuggctatggcaccug

SEQ ID NO: 753 - DNA, 19 bp, Artificial Sequence
  Synthetic
cgtcgtgcugcccgtaugg

SEQ ID NO: 754 - DNA, 27 bp, Artificial Sequence
  Synthetic
ggcaaatgucagtgcaaggttuacaca

SEQ ID NO: 755 - DNA, 20 bp, Artificial Sequence
  Synthetic
gagcggcccaccutcgagua

SEQ ID NO: 756 - DNA, 20 bp, Artificial Sequence
  Synthetic
ggcaggtcutggccagtugg

SEQ ID NO: 757 - DNA, 28 bp, Artificial Sequence
  Synthetic
agtggttatagauggtgaaacctgttug

SEQ ID NO: 758 - DNA, 26 bp, Artificial Sequence
  Synthetic
ctggtgtgaaaugactgaguacaaac

SEQ ID NO: 759 - DNA, 28 bp, Artificial Sequence
  Synthetic
gagaagccatuatctgcaaaaatauccc

SEQ ID NO: 760 - DNA, 25 bp, Artificial Sequence
  Synthetic
accttuggaggaaaaccctatgaug

SEQ ID NO: 761 - DNA, 22 bp, Artificial Sequence
  Synthetic
catggcctuccaacttgacuct

SEQ ID NO: 762 - DNA, 26 bp, Artificial Sequence
  Synthetic
caaaccuttgtctacaauccaaccac

SEQ ID NO: 763 - DNA, 24 bp, Artificial Sequence
  Synthetic
ccagtttaagauttgcccagacuc

SEQ ID NO: 764 - DNA, 27 bp, Artificial Sequence
  Synthetic
gaaactttggacutcaagaactuggat

SEQ ID NO: 765 - DNA, 21 bp, Artificial Sequence
  Synthetic
ggcatuggcacaggatcatug

SEQ ID NO: 766 - DNA, 21 bp, Artificial Sequence
  Synthetic
tgactgcugccatcgagaaug

SEQ ID NO: 767 - DNA, 22 bp, Artificial Sequence
  Synthetic
ccagaaacugcctcttgaccug

SEQ ID NO: 768 - DNA, 21 bp, Artificial Sequence
  Synthetic
cctgacgaugtccagtcucct

SEQ ID NO: 769 - DNA, 26 bp, Artificial Sequence
  Synthetic
cattttagcacutacctgtgacucca

SEQ ID NO: 770 - DNA, 28 bp, Artificial Sequence
  Synthetic
ggttgcctacuggttcaattactttuaa

SEQ ID NO: 771 - DNA, 27 bp, Artificial Sequence
  Synthetic
caaacaagttuatatttccccaugcca

SEQ ID NO: 772 - DNA, 26 bp, Artificial Sequence
  Synthetic
gctgagagttautaacagtgcagugt

SEQ ID NO: 773 - DNA, 22 bp, Artificial Sequence
  Synthetic
agaggcugcagaaatgcaucaa

SEQ ID NO: 774 - DNA, 28 bp, Artificial Sequence
  Synthetic
gatctcttgatacaucaatccgtgttug

SEQ ID NO: 775 - DNA, 21 bp, Artificial Sequence
  Synthetic
tctgcagagutgttagcggut

SEQ ID NO: 776 - DNA, 23 bp, Artificial Sequence
  Synthetic
actcaaagugtggaaugcagaga

SEQ ID NO: 777 - DNA, 28 bp, Artificial Sequence
  Synthetic
ttcttataggtgcugaaaggacatgaug

SEQ ID NO: 778 - DNA, 28 bp, Artificial Sequence
  Synthetic
tgaactcautgatagttgugaaccaaca

SEQ ID NO: 779 - DNA, 28 bp, Artificial Sequence
  Synthetic
ctgcatcggguccacataaatatatuca

SEQ ID NO: 780 - DNA, 24 bp, Artificial Sequence
  Synthetic
ggctcaggaagcuatccctatuct

SEQ ID NO: 781 - DNA, 23 bp, Artificial Sequence
  Synthetic
aaaatcctcacuccaggtcagug

SEQ ID NO: 782 - DNA, 28 bp, Artificial Sequence
  Synthetic
cttattctcattcguttcatccaggauc

SEQ ID NO: 783 - DNA, 25 bp, Artificial Sequence
  Synthetic
tcagtcatuagagcactcuggagag

SEQ ID NO: 784 - DNA, 27 bp, Artificial Sequence
  Synthetic
agcctaaacauccccttaaattggaut

SEQ ID NO: 785 - DNA, 23 bp, Artificial Sequence
  Synthetic
caauaaaaggcagctuggacacg

SEQ ID NO: 786 - DNA, 24 bp, Artificial Sequence
  Synthetic
gccttggtugggacaacauaagaa

SEQ ID NO: 787 - DNA, 30 bp, Artificial Sequence; identical to SEQ ID NO: 92
  Synthetic

SEQ ID NO: 788 - DNA, 22 bp, Artificial Sequence
  Synthetic
ggactgucaagcagagaauggg

SEQ ID NO: 789 - DNA, 26 bp, Artificial Sequence
  Synthetic
acagcucccaaagaaaaatcccauag

SEQ ID NO: 790 - DNA, 25 bp, Artificial Sequence
  Synthetic
agctgauagagattggagugcaaac

SEQ ID NO: 791 - DNA, 21 bp, Artificial Sequence
  Synthetic
tggcatcugaaggcucaaacc

SEQ ID NO: 792 - DNA, 22 bp, Artificial Sequence
  Synthetic
gcauggaagaggattcuggact

SEQ ID NO: 793 - DNA, 25 bp, Artificial Sequence
  Synthetic
gtgttttgcutctctagguaccaga

SEQ ID NO: 794 - DNA, 21 bp, Artificial Sequence
  Synthetic
ttggagcaauccctgtggauc

SEQ ID NO: 795 - DNA, 27 bp, Artificial Sequence
  Synthetic
gtccatacctaugatttccctcttugt

SEQ ID NO: 796 - DNA, 28 bp, Artificial Sequence
  Synthetic
tctcatggaatugaactatctgtuggag

SEQ ID NO: 797 - DNA, 26 bp, Artificial Sequence
  Synthetic
gcgctgttauctctttcttauagcca

SEQ ID NO: 798 - DNA, 25 bp, Artificial Sequence
  Synthetic
tgctttggaagutcagtcaactcut

SEQ ID NO: 799 - DNA, 25 bp, Artificial Sequence
  Synthetic
acttcttccaugactttggcaauct

SEQ ID NO: 800 - DNA, 27 bp, Artificial Sequence
  Synthetic
gacacaaagacuggcttacatttugat

SEQ ID NO: 801 - DNA, 23 bp, Artificial Sequence
  Synthetic
gtgugttctgcttuccagagagt

SEQ ID NO: 802 - DNA, 24 bp, Artificial Sequence
  Synthetic
gtataaatggcucatcgaggcuca

SEQ ID NO: 803 - DNA, 33 bp, Artificial Sequence; identical to SEQ ID NO: 140
  Synthetic

SEQ ID NO: 804 - DNA, 21 bp, Artificial Sequence
  Synthetic
gagctctagugagcaccugac

SEQ ID NO: 805 - DNA, 24 bp, Artificial Sequence
  Synthetic
agttgaugaaccggtccttuacag

SEQ ID NO: 806 - DNA, 26 bp, Artificial Sequence
  Synthetic
tgctggagacauctcacattgtttut

SEQ ID NO: 807 - DNA, 27 bp, Artificial Sequence
  Synthetic
gaaaagtagcucggtagtctacagaut

SEQ ID NO: 808 - DNA, 26 bp, Artificial Sequence
  Synthetic
gccacttacugttcaaggattucaca

SEQ ID NO: 809 - DNA, 21 bp, Artificial Sequence
  Synthetic
ttcacucacctcggaugagga

SEQ ID NO: 810 - DNA, 24 bp, Artificial Sequence
  Synthetic
ttgagttugcagacttuccaaagc

SEQ ID NO: 811 - DNA, 24 bp, Artificial Sequence
  Synthetic
gagtgatgatugggagattccuga

SEQ ID NO: 812 - DNA, 28 bp, Artificial Sequence
  Synthetic
gctaaggcauaggaattttcgtaguaca

SEQ ID NO: 813 - DNA, 22 bp, Artificial Sequence
  Synthetic
ttccagaccagggugttgttut

SEQ ID NO: 814 - DNA, 21 bp, Artificial Sequence
  Synthetic
acctuatacaccgugccgaac

SEQ ID NO: 815 - DNA, 23 bp, Artificial Sequence
  Synthetic
caaggatgccugaccagtuagag

SEQ ID NO: 816 - DNA, 23 bp, Artificial Sequence
  Synthetic
tcgaggattuccttgttggctut

SEQ ID NO: 817 - DNA, 24 bp, Artificial Sequence
  Synthetic
acctaaagccaccuccttacttug

SEQ ID NO: 818 - DNA, 22 bp, Artificial Sequence
  Synthetic
ctcctcucccatctuccacaga

SEQ ID NO: 819 - DNA, 23 bp, Artificial Sequence
  Synthetic
tgcccctucttcttcccauagat

SEQ ID NO: 820 - DNA, 25 bp, Artificial Sequence
  Synthetic
ctttcatgacugcagcttcttucaa

SEQ ID NO: 821 - DNA, 21 bp, Artificial Sequence
  Synthetic
gtagtccaggaggutcccgua

SEQ ID NO: 822 - DNA, 23 bp, Artificial Sequence
  Synthetic
ccgtcaggcugtatttctuccac

SEQ ID NO: 823 - DNA, 28 bp, Artificial Sequence
  Synthetic
agaaaggcatuagaaagcctgtagttut

SEQ ID NO: 824 - DNA, 25 bp, Artificial Sequence
  Synthetic
cggacttgauggagaacttgttgua

SEQ ID NO: 825 - DNA, 28 bp, Artificial Sequence
  Synthetic
tgaugaagatgatugggaaacacaagaa

SEQ ID NO: 826 - DNA, 22 bp, Artificial Sequence
  Synthetic
caatcuagcgccuggaagagaa

SEQ ID NO: 827 - DNA, 22 bp, Artificial Sequence
  Synthetic
gtggaucaagcacguggaaaag

SEQ ID NO: 828 - DNA, 22 bp, Artificial Sequence
  Synthetic
ctgctucaggacgttgaacuct

SEQ ID NO: 829 - DNA, 24 bp, Artificial Sequence
  Synthetic
tcctcttcacguaggaatcctcut

SEQ ID NO: 830 - DNA, 23 bp, Artificial Sequence
  Synthetic
aacacccacacutacacaucact

SEQ ID NO: 831 - DNA, 26 bp, Artificial Sequence
  Synthetic
tgccactgguctataatccagaugat

SEQ ID NO: 832 - DNA, 23 bp, Artificial Sequence
  Synthetic
ccgcagaaauggatacaggucaa

SEQ ID NO: 833 - DNA, 28 bp, Artificial Sequence
  Synthetic
tcgtttgcaucactaacactactaucag

SEQ ID NO: 834 - DNA, 28 bp, Artificial Sequence
  Synthetic
ggtcctgaatuggaggaatatatctuca

SEQ ID NO: 835 - DNA, 29 bp, Artificial Sequence
  Synthetic
acaggaaattuctaaatgtgacaugacct

SEQ ID NO: 836 - DNA, 29 bp, Artificial Sequence
  Synthetic
gacactgaaugagaaaatggtaacactut

SEQ ID NO: 837 - DNA, 28 bp, Artificial Sequence
  Synthetic
gcagcttuacagtttttcatagugagac

SEQ ID NO: 838 - DNA, 23 bp, Artificial Sequence
  Synthetic
ctgtagauaggccagcatuggat

SEQ ID NO: 839 - DNA, 21 bp, Artificial Sequence
  Synthetic
agggaaggcucacctuaacaa

SEQ ID NO: 840 - DNA, 23 bp, Artificial Sequence
  Synthetic
tcctagttuccgtgtttctcugc

SEQ ID NO: 841 - DNA, 28 bp, Artificial Sequence
  Synthetic
gccatacctgtuttcccaataagtttuc

SEQ ID NO: 842 - DNA, 25 bp, Artificial Sequence
  Synthetic
cttaagggccutggtataagaugca

SEQ ID NO: 843 - DNA, 28 bp, Artificial Sequence
  Synthetic
cacaagtcagtguctttatccaaatguc

SEQ ID NO: 844 - DNA, 25 bp, Artificial Sequence
  Synthetic
gtaggcaaacaacautccatgauga

SEQ ID NO: 845 - DNA, 23 bp, Artificial Sequence
  Synthetic
cagggctaautcatccaacucca

SEQ ID NO: 846 - DNA, 23 bp, Artificial Sequence
  Synthetic
gccttcttccacucctttcagut

SEQ ID NO: 847 - DNA, 24 bp, Artificial Sequence
  Synthetic
cctgaggagcgaugacggaataua

SEQ ID NO: 848 - DNA, 28 bp, Artificial Sequence
  Synthetic
atgagatacacaguctacctgguaagaa

SEQ ID NO: 849 - DNA, 28 bp, Artificial Sequence
  Synthetic
catatactgaagaucacacccaagctut

SEQ ID NO: 850 - DNA, 26 bp, Artificial Sequence
  Synthetic
gataaatcgguactgtgcttctguct

SEQ ID NO: 851 - DNA, 25 bp, Artificial Sequence
  Synthetic
tgtttctccctuctcaggattccua

SEQ ID NO: 852 - DNA, 22 bp, Artificial Sequence
  Synthetic
ccacgggaaaguggtgaagaua

SEQ ID NO: 853 - DNA, 22 bp, Artificial Sequence
  Synthetic
gggttcttcugcctctcauagg

SEQ ID NO: 854 - DNA, 23 bp, Artificial Sequence
  Synthetic
caggcucaggactuagcaagaag

SEQ ID NO: 855 - DNA, 25 bp, Artificial Sequence
  Synthetic
tgaaagagaggcacucatgucagaa

SEQ ID NO: 856 - DNA, 23 bp, Artificial Sequence
  Synthetic
accggctccucagataatgagua

SEQ ID NO: 857 - DNA, 28 bp, Artificial Sequence
  Synthetic
acgttcttttcuatagggaaaccucaag

SEQ ID NO: 858 - DNA, 25 bp, Artificial Sequence
  Synthetic
ttctttcctcuatctgcagaacugc

SEQ ID NO: 859 - DNA, 25 bp, Artificial Sequence
  Synthetic
gaccaagaaauggatctgtgggtua

SEQ ID NO: 860 - DNA, 25 bp, Artificial Sequence
  Synthetic
gaattaccguggtgggatugaagat

SEQ ID NO: 861 - DNA, 28 bp, Artificial Sequence
  Synthetic
ggtggaagcauactgcaaaatatttgut

SEQ ID NO: 862 - DNA, 28 bp, Artificial Sequence
  Synthetic
gacaaattguccaccatcatcatucaat

SEQ ID NO: 863 - DNA, 28 bp, Artificial Sequence
  Synthetic
gctgaagagugcaaacaatacatcauac

SEQ ID NO: 864 - DNA, 30 bp, Artificial Sequence; identical to SEQ ID NO: 323
  Synthetic

SEQ ID NO: 865 - DNA, 27 bp, Artificial Sequence
  Synthetic
ttgttagccauatgcacatgaaugaat

SEQ ID NO: 866 - DNA, 22 bp, Artificial Sequence
  Synthetic
tgacatggtugggactctugac

SEQ ID NO: 867 - DNA, 22 bp, Artificial Sequence
  Synthetic
gccatagggcauaagctgtguc

SEQ ID NO: 868 - DNA, 22 bp, Artificial Sequence
  Synthetic
cctaggtuggctctgactguac

SEQ ID NO: 869 - DNA, 27 bp, Artificial Sequence
  Synthetic
caactcgttcguagtgatatggatuca

SEQ ID NO: 870 - DNA, 23 bp, Artificial Sequence
  Synthetic
cgatgcacgautacttgguggat

SEQ ID NO: 871 - DNA, 24 bp, Artificial Sequence
  Synthetic
ccagtaaatccautctgctgcugt

SEQ ID NO: 872 - DNA, 24 bp, Artificial Sequence
  Synthetic
gagctattccaccuactgatccug

SEQ ID NO: 873 - DNA, 23 bp, Artificial Sequence
  Synthetic
acttagcutggaagcugacaagt

SEQ ID NO: 874 - DNA, 27 bp, Artificial Sequence
  Synthetic
cacaaaattugggattattggagugga

SEQ ID NO: 875 - DNA, 22 bp, Artificial Sequence
  Synthetic
caccttucagcaggucagagag

SEQ ID NO: 876 - DNA, 24 bp, Artificial Sequence
  Synthetic
ggtaacagutggcttacuggaagt

SEQ ID NO: 877 - DNA, 28 bp, Artificial Sequence
  Synthetic
caactattttcutcctctctuccacagt

SEQ ID NO: 878 - DNA, 25 bp, Artificial Sequence
  Synthetic
tgtaccattcaugttccaggugaag

SEQ ID NO: 879 - DNA, 22 bp, Artificial Sequence
  Synthetic
gagaacuaaggcggaaucagca

SEQ ID NO: 880 - DNA, 28 bp, Artificial Sequence
  Synthetic
tgaaccatctttuaactcaggtactgug

SEQ ID NO: 881 - DNA, 20 bp, Artificial Sequence
  Synthetic
gggcccggugtaagtgaaut

SEQ ID NO: 882 - DNA, 23 bp, Artificial Sequence
  Synthetic
gguaatctacugggacggaacag

SEQ ID NO: 883 - DNA, 24 bp, Artificial Sequence
  Synthetic
caatccauttttgttguccagcca

SEQ ID NO: 884 - DNA, 21 bp, Artificial Sequence
  Synthetic
gaagcagguggtcattgaugg

SEQ ID NO: 885 - DNA, 23 bp, Artificial Sequence
  Synthetic
gacautggagagtugacccaaac

SEQ ID NO: 886 - DNA, 21 bp, Artificial Sequence
  Synthetic
ccagggcuttgaaggaagugt

SEQ ID NO: 887 - DNA, 20 bp, Artificial Sequence
  Synthetic
cctctgugaagagcgggtuc

SEQ ID NO: 888 - DNA, 28 bp, Artificial Sequence
  Synthetic
gcttatttattgguctctcattcuccca

SEQ ID NO: 889 - DNA, 27 bp, Artificial Sequence
  Synthetic
aatattgtctttgugttcccggacaua

SEQ ID NO: 890 - DNA, 19 bp, Artificial Sequence
  Synthetic
gggagaucttgugcacggt

SEQ ID NO: 891 - DNA, 33 bp, Artificial Sequence; identical to SEQ ID NO: 404
  Synthetic

SEQ ID NO: 892 - DNA, 24 bp, Artificial Sequence
  Synthetic
cagcatttacugcagcttgctuag

SEQ ID NO: 893 - DNA, 25 bp, Artificial Sequence
  Synthetic
gaggaagatccutgtatgctgtuac

SEQ ID NO: 894 - DNA, 23 bp, Artificial Sequence
  Synthetic
tgaccaaaacucagcctgttuct

SEQ ID NO: 895 - DNA, 20 bp, Artificial Sequence
  Synthetic
gtgcagcugtgggttgatuc

SEQ ID NO: 896 - DNA, 25 bp, Artificial Sequence
  Synthetic
gctcucattttaaagauggcccaaa

SEQ ID NO: 897 - DNA, 26 bp, Artificial Sequence
  Synthetic
ctgattcctcacugattgctctuagg

SEQ ID NO: 898 - DNA, 28 bp, Artificial Sequence
  Synthetic
ctgacagaaguacatctgctaaacauga

SEQ ID NO: 899 - DNA, 23 bp, Artificial Sequence
  Synthetic
agtaccuggcagtgtgatatugg

SEQ ID NO: 900 - DNA, 25 bp, Artificial Sequence
  Synthetic
gtacactgccuttcgacacatagut

SEQ ID NO: 901 - DNA, 29 bp, Artificial Sequence
  Synthetic
actgtuacagaaatgaaauaagacggaaa

SEQ ID NO: 902 - DNA, 28 bp, Artificial Sequence
  Synthetic
ggaaaattcataccuaactggagtgugt

SEQ ID NO: 903 - DNA, 27 bp, Artificial Sequence
  Synthetic
tgcttgctctgauaggaaaatgagauc

SEQ ID NO: 904 - DNA, 24 bp, Artificial Sequence
  Synthetic
cttttaatugcccgtgatgtucca

SEQ ID NO: 905 - DNA, 21 bp, Artificial Sequence
  Synthetic
atccccacutttcctctugca

SEQ ID NO: 906 - DNA, 21 bp, Artificial Sequence
  Synthetic
gctgtgacacugctggaacut

SEQ ID NO: 907 - DNA, 25 bp, Artificial Sequence
  Synthetic
cgctacttccucctcaagaatgaug

SEQ ID NO: 908 - DNA, 27 bp, Artificial Sequence
  Synthetic
atccttcttctccugtttgagaatguc

SEQ ID NO: 909 - DNA, 20 bp, Artificial Sequence
  Synthetic
ggactgugcggagcatguac

SEQ ID NO: 910 - DNA, 30 bp, Artificial Sequence; identical to SEQ ID NO: 461
  Synthetic

SEQ ID NO: 911 - DNA, 19 bp, Artificial Sequence
  Synthetic
ggcgtccuactggcaugac

SEQ ID NO: 912 - DNA, 27 bp, Artificial Sequence
  Synthetic
gatuaagaggacaagcagatucaaggt

SEQ ID NO: 913 - DNA, 27 bp, Artificial Sequence
  Synthetic
gtcaacaacccccacaaaaugttuaat

SEQ ID NO: 914 - DNA, 30 bp, Artificial Sequence; identical to SEQ ID NO: 473
  Synthetic

SEQ ID NO: 915 - DNA, 23 bp, Artificial Sequence
  Synthetic
caggattgccuttaccacucaga

SEQ ID NO: 916 - DNA, 31 bp, Artificial Sequence; identical to SEQ ID NO: 479
  Synthetic

SEQ ID NO: 917 - DNA, 23 bp, Artificial Sequence
  Synthetic
caccagguacgcctccagaugag

SEQ ID NO: 918 - DNA, 22 bp, Artificial Sequence
  Synthetic
ggtcccagccccuctctgatug

SEQ ID NO: 919 - DNA, 22 bp, Artificial Sequence
  Synthetic
ccgaguccagcacctcctucac

SEQ ID NO: 920 - DNA, 23 bp, Artificial Sequence
  Synthetic
caccctggcuctgaccattcugt

SEQ ID NO: 921 - DNA, 21 bp, Artificial Sequence
  Synthetic
gagaggcggcccaaucttcug

SEQ ID NO: 922 - DNA, 27 bp, Artificial Sequence
  Synthetic
cacgctctauactgcaaatgctaucga

SEQ ID NO: 923 - DNA, 23 bp, Artificial Sequence
  Synthetic
gggtcctucctgtcctccuagca

SEQ ID NO: 924 - DNA, 20 bp, Artificial Sequence
  Synthetic
cccugcaccagcagctccua

SEQ ID NO: 925 - DNA, 26 bp, Artificial Sequence
  Synthetic
caccgtgaagucctgagtgtagauga

SEQ ID NO: 926 - DNA, 21 bp, Artificial Sequence
  Synthetic
ctccacgcccugtgacuccat

SEQ ID NO: 927 - DNA, 22 bp, Artificial Sequence
  Synthetic
tgguagcagtggaugcagaagg

SEQ ID NO: 928 - DNA, 26 bp, Artificial Sequence
  Synthetic
ccttccuccagaagcttgaactcuca

SEQ ID NO: 929 - DNA, 20 bp, Artificial Sequence
  Synthetic
cagtuggcgggcttguccat

SEQ ID NO: 930 - DNA, 20 bp, Artificial Sequence
  Synthetic
cctgguccaccgccagtcuc

SEQ ID NO: 931 - DNA, 20 bp, Artificial Sequence
  Synthetic
ccccuagcacgtgccuacct

SEQ ID NO: 932 - DNA, 23 bp, Artificial Sequence
  Synthetic
gttctcccaugggcuagacacca

SEQ ID NO: 933 - DNA, 22 bp, Artificial Sequence
  Synthetic
ctgcuagggacccctcacatug

SEQ ID NO: 934 - DNA, 20 bp, Artificial Sequence
  Synthetic
ggcccgcugtacgtguccat

SEQ ID NO: 935 - DNA, 21 bp, Artificial Sequence
  Synthetic
gcagtggaacuccacgucgct

SEQ ID NO: 936 - DNA, 23 bp, Artificial Sequence
  Synthetic
actctguacaaagaccgcguggt

SEQ ID NO: 937 - DNA, 37 bp, Artificial Sequence; identical to SEQ ID NO: 542
  Synthetic

SEQ ID NO: 938 - DNA, 37 bp, Artificial Sequence; identical to SEQ ID NO: 545
  Synthetic

SEQ ID NO: 939 - DNA, 37 bp, Artificial Sequence; identical to SEQ ID NO: 548
  Synthetic

SEQ ID NO: 940 - DNA, 22 bp, Artificial Sequence
  Synthetic
gggtgtgcuggaaaagggucca

SEQ ID NO: 941 - DNA, 22 bp, Artificial Sequence
  Synthetic
gtgctgtugagacctctguggg

SEQ ID NO: 942 - DNA, 20 bp, Artificial Sequence
  Synthetic
gcccgtaccucggtagcugt

SEQ ID NO: 943 - DNA, 37 bp, Artificial Sequence; identical to SEQ ID NO: 560
  Synthetic

SEQ ID NO: 944 - DNA, 21 bp, Artificial Sequence
  Synthetic
ccgcctgugcctagaggtuct

SEQ ID NO: 945 - DNA, 26 bp, Artificial Sequence
  Synthetic
ctgttcacttgugccctgacttucaa

SEQ ID NO: 946 - DNA, 17 bp, Artificial Sequence
  Synthetic
cgcccucggagcugaag

SEQ ID NO: 947 - DNA, 19 bp, Artificial Sequence
  Synthetic
cctgcagcuccttucccag

SEQ ID NO: 948 - DNA, 17 bp, Artificial Sequence
  Synthetic
gccucctcacucagccg

SEQ ID NO: 949 - DNA, 21 bp, Artificial Sequence
  Synthetic
ttgttguccgccatgttgtug

SEQ ID NO: 950 - DNA, 17 bp, Artificial Sequence
  Synthetic
gcgacuacaguggcggg

SEQ ID NO: 951 - DNA, 19 bp, Artificial Sequence
  Synthetic
cgtggtggcucctttgtug

SEQ ID NO: 952 - DNA, 20 bp, Artificial Sequence
  Synthetic
gtacccgaugaccaugcagg

SEQ ID NO: 953 - DNA, 28 bp, Artificial Sequence
  Synthetic
attctatagcucacagatcagatttugg

SEQ ID NO: 954 - DNA, 21 bp, Artificial Sequence
  Synthetic
ccacaggcucagtctcctuac

SEQ ID NO: 955 - DNA, 22 bp, Artificial Sequence
  Synthetic
ggcaggagguagggauatctua

SEQ ID NO: 956 - DNA, 22 bp, Artificial Sequence
  Synthetic
tgagcacaucagggattuccag

SEQ ID NO: 957 - DNA, 19 bp, Artificial Sequence
  Synthetic
cgagaguggtccugagcga

SEQ ID NO: 958 - DNA, 19 bp, Artificial Sequence
  Synthetic
cagccttauctccgcguca

SEQ ID NO: 959 - DNA, 24 bp, Artificial Sequence
  Synthetic
aaggaactgutttctcctcucacc

SEQ ID NO: 960 - DNA, 27 bp, Artificial Sequence
  Synthetic
tccagttcaaauctaaaagcucagagt

SEQ ID NO: 961 - DNA, 26 bp, Artificial Sequence
  Synthetic
ggttgatcaugccagccatactatua

SEQ ID NO: 962 - DNA, 22 bp, Artificial Sequence
  Synthetic
acaggcuttgaatcugacccat

SEQ ID NO: 963 - DNA, 21 bp, Artificial Sequence
  Synthetic
cutctcctcagugaaggccag

SEQ ID NO: 964 - DNA, 27 bp, Artificial Sequence
  Synthetic
tgtttgtgtgagagutaaacactguca

SEQ ID NO: 965 - DNA, 23 bp, Artificial Sequence
  Synthetic
ggctttaaguctcctccttcugc

SEQ ID NO: 966 - DNA, 23 bp, Artificial Sequence
  Synthetic
agggtagatuaccaggcttguca

SEQ ID NO: 967 - DNA, 21 bp, Artificial Sequence
  Synthetic
tcccaucgccacatttccuag

SEQ ID NO: 968 - DNA, 20 bp, Artificial Sequence
  Synthetic
gcccacccuaatcctgtgut

SEQ ID NO: 969 - DNA, 20 bp, Artificial Sequence
  Synthetic
ccagtccautcccagcuacc

SEQ ID NO: 970 - DNA, 20 bp, Artificial Sequence
  Synthetic
tccautccagttuggccgag

SEQ ID NO: 971 - DNA, 28 bp, Artificial Sequence
  Synthetic
cctgttggcauaattataggtcatguca

SEQ ID NO: 972 - DNA, 20 bp, Artificial Sequence
  Synthetic
ccaauggagaaccgcaccuc

SEQ ID NO: 973 - DNA, 21 bp, Artificial Sequence
  Synthetic
ggtgataucccgccgaaucat

SEQ ID NO: 974 - DNA, 26 bp, Artificial Sequence
  Synthetic
agtcaataautctgttctuaggccac

SEQ ID NO: 975 - DNA, 23 bp, Artificial Sequence
  Synthetic
tgccaaagauctcaaucaggcat

SEQ ID NO: 976 - DNA, 25 bp, Artificial Sequence
  Synthetic
ttgacaagctuccagtaaagaucgt

SEQ ID NO: 977 - DNA, 22 bp, Artificial Sequence
  Synthetic
ctctgtctugctctcgaagugg

SEQ ID NO: 978 - DNA, 22 bp, Artificial Sequence
  Synthetic
acaguaaggaugagaccccact

SEQ ID NO: 979 - DNA, 24 bp, Artificial Sequence
  Synthetic
ttggacatcucaaagtcatugcct

SEQ ID NO: 980 - DNA, 20 bp, Artificial Sequence
  Synthetic
tggacggacucctacacugg

SEQ ID NO: 981 - DNA, 22 bp, Artificial Sequence
  Synthetic
acattgttgucctggatgcuga

SEQ ID NO: 982 - DNA, 20 bp, Artificial Sequence
  Synthetic
cccaccctutgagccaacua

SEQ ID NO: 983 - DNA, 23 bp, Artificial Sequence
  Synthetic
atcaacggtgauaccgagatguc

SEQ ID NO: 984 - DNA, 21 bp, Artificial Sequence
  Synthetic
cctaaagaauggccgagccut

SEQ ID NO: 985 - DNA, 27 bp, Artificial Sequence
  Synthetic
acttgtttuccccacctctcttaauac

SEQ ID NO: 986 - DNA, 20 bp, Artificial Sequence
  Synthetic
gtggagutcctggugaagca

SEQ ID NO: 987 - DNA, 25 bp, Artificial Sequence
  Synthetic
ccacgtttautgaagatttguggct

SEQ ID NO: 988 - DNA, 23 bp, Artificial Sequence
  Synthetic
ctctctctcacuttccctctugg

SEQ ID NO: 989 - DNA, 22 bp, Artificial Sequence
  Synthetic
cagagtcctucaggtgtcctut

SEQ ID NO: 990 - DNA, 23 bp, Artificial Sequence
  Synthetic
agaaaagccaugcagttgacuga

SEQ ID NO: 991 - DNA, 27 bp, Artificial Sequence
  Synthetic
ctgtcagcaacguagtgatuacaaaaa

SEQ ID NO: 992 - DNA, 29 bp, Artificial Sequence
  Synthetic
tgtattucaagaaacttgctuaggacact

SEQ ID NO: 993 - DNA, 25 bp, Artificial Sequence
  Synthetic
catcagactgtutcttcaggcaauc

SEQ ID NO: 994 - DNA, 28 bp, Artificial Sequence
  Synthetic
aaaaatccaagttugtatctgcaacugg

SEQ ID NO: 995 - DNA, 24 bp, Artificial Sequence
  Synthetic
aaagcatgtguatgacctgaaugt

SEQ ID NO: 996 - DNA, 23 bp, Artificial Sequence
  Synthetic
ctccgttuacaagaatgctgugt

SEQ ID NO: 997 - DNA, 25 bp, Artificial Sequence
  Synthetic
ggaggagggcguttttatgtuacat

SEQ ID NO: 998 - DNA, 28 bp, Artificial Sequence
  Synthetic
cacatttctttcugacttccttgagtug

SEQ ID NO: 999 - DNA, 30 bp, Artificial Sequence
  Synthetic
aagttcaaagggagaauactaatcugcaaa

SEQ ID NO: 1000 - DNA, 27 bp, Artificial Sequence
  Synthetic
cttaauagcagagaaatcugcaacagg

SEQ ID NO: 1001 - DNA, 28 bp, Artificial Sequence
  Synthetic
tgcaataccttatauctgcgtagagcut

SEQ ID NO: 1002 - DNA, 20 bp, Artificial Sequence
  Synthetic
acggaccuccaauccagaca

SEQ ID NO: 1003 - DNA, 28 bp, Artificial Sequence
  Synthetic
tggattgaaagagugacacttcaaagut

SEQ ID NO: 1004 - DNA, 25 bp, Artificial Sequence
  Synthetic
caaagagttauacatgctccuggca

SEQ ID NO: 1005 - DNA, 26 bp, Artificial Sequence
  Synthetic
gtgataaagugaaaccagtgttgcuc

SEQ ID NO: 1006 - DNA, 27 bp, Artificial Sequence
  Synthetic
cutggcttcaaaauacaagaaaaccct

SEQ ID NO: 1007 - DNA, 24 bp, Artificial Sequence
  Synthetic
auttgggattuagccgacacagat

SEQ ID NO: 1008 - DNA, 28 bp, Artificial Sequence
  Synthetic
atctacaggcauacaatcaagagtugac

SEQ ID NO: 1009 - DNA, 30 bp, Artificial Sequence
  Synthetic
tgtttatttcagtuatcaagtgggaaucct

SEQ ID NO: 1010 - DNA, 29 bp, Artificial Sequence
  Synthetic
ggaagtgtagtugaagagaagatggtaut

SEQ ID NO: 1011 - DNA, 23 bp, Artificial Sequence
  Synthetic
ctctgaaaaacugagggcaucca

SEQ ID NO: 1012 - DNA, 26 bp, Artificial Sequence
  Synthetic
ccctttttcuacttgatgtucgacaa

SEQ ID NO: 1013 - DNA, 30 bp, Artificial Sequence
  Synthetic
gccttagaaaattuacgtgtatacctgugt

SEQ ID NO: 1014 - DNA, 22 bp, Artificial Sequence
  Synthetic
attgacttgugcacctttgcug

SEQ ID NO: 1015 - DNA, 29 bp, Artificial Sequence
  Synthetic
ttttaacacatcutaggcagaacugaagt

SEQ ID NO: 1016 - DNA, 18 bp, Artificial Sequence
  Synthetic
ggtagccccaugctugct

SEQ ID NO: 1017 - DNA, 23 bp, Artificial Sequence
  Synthetic
tccaaaacaccaccuttctucca

SEQ ID NO: 1018 - DNA, 21 bp, Artificial Sequence
  Synthetic
gtccgugaggcaaggtaauga

SEQ ID NO: 1019 - DNA, 23 bp, Artificial Sequence
  Synthetic
cccacttccugatccagtgtaut

SEQ ID NO: 1020 - DNA, 21 bp, Artificial Sequence
  Synthetic
cctcattcugcttggctguga

SEQ ID NO: 1021 - DNA, 20 bp, Artificial Sequence
  Synthetic
gttccucaaggttcccucgt

SEQ ID NO: 1022 - DNA, 19 bp, Artificial Sequence
  Synthetic
cagaggaggcccugaccua

SEQ ID NO: 1023 - DNA, 20 bp, Artificial Sequence
  Synthetic
ccuggaggagcattauggca

SEQ ID NO: 1024 - DNA, 19 bp, Artificial Sequence
  Synthetic
ccugagagcagccgtguat

SEQ ID NO: 1025 - DNA, 24 bp, Artificial Sequence
  Synthetic
gagaaacugaagaaggagcuggag

SEQ ID NO: 1026 - DNA, 20 bp, Artificial Sequence
  Synthetic
ggtgcccaugtgacugaagt

SEQ ID NO: 1027 - DNA, 21 bp, Artificial Sequence
  Synthetic
catccauggaccttcugagca

SEQ ID NO: 1028 - DNA, 26 bp, Artificial Sequence
  Synthetic
ctcaggattucaatcaatgcatucca

SEQ ID NO: 1029 - DNA, 21 bp, Artificial Sequence
  Synthetic
tcatggtgugcctatggcauc

SEQ ID NO: 1030 - DNA, 23 bp, Artificial Sequence
  Synthetic
gaagtattuccgccgactcctut

SEQ ID NO: 1031 - DNA, 20 bp, Artificial Sequence
  Synthetic
cagaggccutcccucaggaa

SEQ ID NO: 1032 - DNA, 25 bp, Artificial Sequence
  Synthetic
aaacaagttcuagtgtgtgctguct

SEQ ID NO: 1033 - DNA, 22 bp, Artificial Sequence
  Synthetic
cgctgtgctuctctctgtctug

SEQ ID NO: 1034 - DNA, 18 bp, Artificial Sequence
  Synthetic
cuggaccgggagagucct

SEQ ID NO: 1035 - DNA, 24 bp, Artificial Sequence
  Synthetic
ttgggatctgcugaagagctatug

SEQ ID NO: 1036 - DNA, 20 bp, Artificial Sequence
  Synthetic
gggccaauacaggccaugat

SEQ ID NO: 1037 - DNA, 25 bp, Artificial Sequence
  Synthetic
gaaccauttcatcuggagaaaaggg

SEQ ID NO: 1038 - DNA, 24 bp, Artificial Sequence
  Synthetic
ggtacagagccautttctgauggt

SEQ ID NO: 1039 - DNA, 21 bp, Artificial Sequence
  Synthetic
ttcggcccutccattucagag

SEQ ID NO: 1040 - DNA, 25 bp, Artificial Sequence
  Synthetic
cagcatggagaugaacaggatgaut

SEQ ID NO: 1041 - DNA, 22 bp, Artificial Sequence
  Synthetic
ccaaacucaagtucccgaccag

SEQ ID NO: 1042 - DNA, 23 bp, Artificial Sequence
  Synthetic
cutgcggaatcucagagaaccaa

SEQ ID NO: 1043 - DNA, 24 bp, Artificial Sequence
  Synthetic
ccacagatatauccaagggctucc

SEQ ID NO: 1044 - DNA, 22 bp, Artificial Sequence
  Synthetic
caaaaccuccccttcagagucc

SEQ ID NO: 1045 - DNA, 23 bp, Artificial Sequence
  Synthetic
actatcagguctagcagtcucca

SEQ ID NO: 1046 - DNA, 27 bp, Artificial Sequence
  Synthetic
aggaatgggcautaatacacagaaucc

SEQ ID NO: 1047 - DNA, 20 bp, Artificial Sequence
  Synthetic
gggaccccaugaggagguat

SEQ ID NO: 1048 - DNA, 21 bp, Artificial Sequence
  Synthetic
ccccaaagutcagcagaugca

SEQ ID NO: 1049 - DNA, 26 bp, Artificial Sequence
  Synthetic
gcgggatagaucaaactcaggtatuc

SEQ ID NO: 1050 - DNA, 26 bp, Artificial Sequence
  Synthetic
atgatgucaccagcacaatcuacaat

SEQ ID NO: 1051 - DNA, 19 bp, Artificial Sequence
  Synthetic
ccatcaugccctgcaugga

SEQ ID NO: 1052 - DNA, 26 bp, Artificial Sequence
  Synthetic
ggaagggagaggaacutttattcugt

SEQ ID NO: 1053 - DNA, 25 bp, Artificial Sequence
  Synthetic
gatcagagcaacagcuacaacaaug

SEQ ID NO: 1054 - DNA, 27 bp, Artificial Sequence
  Synthetic
cgattttcctgutactctccttauggt

SEQ ID NO: 1055 - DNA, 22 bp, Artificial Sequence
  Synthetic
cgtactucccagtttggtgugg

SEQ ID NO: 1056 - DNA, 23 bp, Artificial Sequence
  Synthetic
ggccctguaaagcagcacataua

SEQ ID NO: 1057 - DNA, 22 bp, Artificial Sequence
  Synthetic
cccaacuccttttgguccacag

SEQ ID NO: 1058 - DNA, 21 bp, Artificial Sequence
  Synthetic
ctgggugactgcucaacagat

SEQ ID NO: 1059 - DNA, 25 bp, Artificial Sequence
  Synthetic
ctacactcuccaacacaauccagag

SEQ ID NO: 1060 - DNA, 27 bp, Artificial Sequence
  Synthetic
ttacauaatgtcaacauagccaaagga

SEQ ID NO: 1061 - DNA, 22 bp, Artificial Sequence
  Synthetic
atcucccgacacaacatugagg

SEQ ID NO: 1062 - DNA, 23 bp, Artificial Sequence
  Synthetic
gatctcugcaggtattuggccat

SEQ ID NO: 1063 - DNA, 27 bp, Artificial Sequence
  Synthetic
gggcagtctgautgcttttaatctcut

SEQ ID NO: 1064 - DNA, 23 bp, Artificial Sequence
  Synthetic
ttcaaaacaggagucacggaguc

SEQ ID NO: 1065 - DNA, 27 bp, Artificial Sequence
  Synthetic
tuctatttctttttctugcgcaggaac

SEQ ID NO: 1066 - DNA, 24 bp, Artificial Sequence
  Synthetic
gcttaatagcccuctggacaaugg

SEQ ID NO: 1067 - DNA, 26 bp, Artificial Sequence
  Synthetic
atactgatgauaagcaaggactguct

SEQ ID NO: 1068 - DNA, 25 bp, Artificial Sequence
  Synthetic
accatgtccuctcttttctcttugg

SEQ ID NO: 1069 - DNA, 24 bp, Artificial Sequence
  Synthetic
gggctttctugatgtaaccaucct

SEQ ID NO: 1070 - DNA, 30 bp, Artificial Sequence
  Synthetic
gatttaataccaccucttcactcattcuct

SEQ ID NO: 1071 - DNA, 25 bp, Artificial Sequence
  Synthetic
tccactctcauacacacattcaugg

SEQ ID NO: 1072 - DNA, 19 bp, Artificial Sequence
  Synthetic
ggcccggcuatgactaugt

SEQ ID NO: 1073 - DNA, 25 bp, Artificial Sequence
  Synthetic
tttgtgccuccttaaagaagtucca

SEQ ID NO: 1074 - DNA, 25 bp, Artificial Sequence
  Synthetic
aaaacactagcugtctgtcttcucc

SEQ ID NO: 1075 - DNA, 23 bp, Artificial Sequence
  Synthetic
cccccaguaagtcccttcaaaut

SEQ ID NO: 1076 - DNA, 23 bp, Artificial Sequence
  Synthetic
acctagugaacaaggguccaact

SEQ ID NO: 1077 - DNA, 22 bp, Artificial Sequence
  Synthetic
cttgctgagguttctccctuga

SEQ ID NO: 1078 - DNA, 25 bp, Artificial Sequence
  Synthetic
aagagtacugagacatctucaggag

SEQ ID NO: 1079 - DNA, 23 bp, Artificial Sequence
  Synthetic
ggcacugacatcuagggcaaaat

SEQ ID NO: 1080 - DNA, 31 bp, Artificial Sequence
  Synthetic
accctagtttgtugataccattttagaaugt

SEQ ID NO: 1081 - DNA, 28 bp, Artificial Sequence
  Synthetic
cggugaacaaaatuaagagaggaaaggt

SEQ ID NO: 1082 - DNA, 27 bp, Artificial Sequence
  Synthetic
gagacttucaccttttgucaagaacag

SEQ ID NO: 1083 - DNA, 24 bp, Artificial Sequence
  Synthetic
tgccattctccauccttcaaggua

SEQ ID NO: 1084 - DNA, 22 bp, Artificial Sequence
  Synthetic
acgtgagaacucagggatcuga

SEQ ID NO: 1085 - DNA, 22 bp, Artificial Sequence
  Synthetic
cagtgatguggtgcagagguag

SEQ ID NO: 1086 - DNA, 20 bp, Artificial Sequence
  Synthetic
aggucagcacatuccagcag

SEQ ID NO: 1087 - DNA, 20 bp, Artificial Sequence
  Synthetic
gtgatgccuccaccucaagt

SEQ ID NO: 1088 - DNA, 22 bp, Artificial Sequence
  Synthetic
cagcuggagtgtgttucagagt

SEQ ID NO: 1089 - DNA, 25 bp, Artificial Sequence
  Synthetic
caaggguaaagagaagaatgguggg

SEQ ID NO: 1090 - DNA, 22 bp, Artificial Sequence
  Synthetic
cagttccugggaagggtcatug

SEQ ID NO: 1091 - DNA, 24 bp, Artificial Sequence
  Synthetic
aggcttcttuacaccacgctuaat

SEQ ID NO: 1092 - DNA, 22 bp, Artificial Sequence
  Synthetic
cttcctauccctggugaagcat

SEQ ID NO: 1093 - DNA, 30 bp, Artificial Sequence
  Synthetic
agattcacttctugtcttttaagttacuga

SEQ ID NO: 1094 - DNA, 24 bp, Artificial Sequence
  Synthetic
tggaacatgguttcaaaagctugg

SEQ ID NO: 1095 - DNA, 27 bp, Artificial Sequence
  Synthetic
acaccactggauattgaatttcugcaa

SEQ ID NO: 1096 - DNA, 22 bp, Artificial Sequence
  Synthetic
actctctggugctgtccactua

SEQ ID NO: 1097 - DNA, 24 bp, Artificial Sequence
  Synthetic
cacattagggutctcttucccaca

SEQ ID NO: 1098 - DNA, 29 bp, Artificial Sequence
  Synthetic
caagtgatugagcacaaaagaaaaagaug

SEQ ID NO: 1099 - DNA, 22 bp, Artificial Sequence
  Synthetic
gcggtcaguatggagaggttua

SEQ ID NO: 1100 - DNA, 22 bp, Artificial Sequence
  Synthetic
ctactcucactttcucgcacca

SEQ ID NO: 1101 - DNA, 23 bp, Artificial Sequence
  Synthetic
gaagttcgcuctaagaaugggca

SEQ ID NO: 1102 - DNA, 22 bp, Artificial Sequence
  Synthetic
gtggttaucaagcctcccugaa

SEQ ID NO: 1103 - DNA, 22 bp, Artificial Sequence
  Synthetic
gtatggtccutgggacagtuct

SEQ ID NO: 1104 - DNA, 19 bp, Artificial Sequence
  Synthetic
ggctgtuagtgctgcugct

SEQ ID NO: 1105 - DNA, 18 bp, Artificial Sequence
  Synthetic
guactgucgcaggacgct

SEQ ID NO: 1106 - DNA, 22 bp, Artificial Sequence
  Synthetic
caggaaugcctgctgugaaaat

SEQ ID NO: 1107 - DNA, 30 bp, Artificial Sequence
  Synthetic
cagttatgtcatcauctagatcagtctuga

SEQ ID NO: 1108 - DNA, 26 bp, Artificial Sequence
  Synthetic
gcactccagcacautaaataagugac

SEQ ID NO: 1109 - DNA, 27 bp, Artificial Sequence
  Synthetic
tgccttctttucctttgaatcttucct

SEQ ID NO: 1110 - DNA, 27 bp, Artificial Sequence
  Synthetic
gaaacaaggttgucaacgagaaaauga

SEQ ID NO: 1111 - DNA, 26 bp, Artificial Sequence
  Synthetic
ccagtctugaggcataagttuaaggg

SEQ ID NO: 1112 - DNA, 29 bp, Artificial Sequence
  Synthetic
gtaaaaatgataacutctctccacccuct

SEQ ID NO: 1113 - DNA, 28 bp, Artificial Sequence
  Synthetic
aatgacgtttgugatagctgagttcuaa

SEQ ID NO: 1114 - DNA, 25 bp, Artificial Sequence
  Synthetic
gggaatggcaaaaaucacaataguc

SEQ ID NO: 1115 - DNA, 25 bp, Artificial Sequence
  Synthetic
ttccccagaccuacagaagacauaa

SEQ ID NO: 1116 - DNA, 23 bp, Artificial Sequence
  Synthetic
gagcgagagagugtgtgtactut

SEQ ID NO: 1117 - DNA, 26 bp, Artificial Sequence
  Synthetic
aaaggttatgtgugactgtcatguga

SEQ ID NO: 1118 - DNA, 21 bp, Artificial Sequence
  Synthetic
tcactgcucgtgaucacaagg

SEQ ID NO: 1119 - DNA, 27 bp, Artificial Sequence
  Synthetic
aatggaactuccagagaatttgucact

SEQ ID NO: 1120 - DNA, 21 bp, Artificial Sequence
  Synthetic
caaccgguggcttttuggaag

SEQ ID NO: 1121 - DNA, 28 bp, Artificial Sequence
  Synthetic
ctttgaactccuccaatgtaaagcttut

SEQ ID NO: 1122 - DNA, 24 bp, Artificial Sequence
  Synthetic
gttcttgtcuggaggttctctgua

SEQ ID NO: 1123 - DNA, 25 bp, Artificial Sequence
  Synthetic
guttaagctttugcaggcagaagag

SEQ ID NO: 1124 - DNA, 25 bp, Artificial Sequence
  Synthetic
aattcctttttcucttctgggugct

SEQ ID NO: 1125 - DNA, 18 bp, Artificial Sequence
  Synthetic
cctctucgctccgcugaa

SEQ ID NO: 1126 - DNA, 18 bp, Artificial Sequence
  Synthetic
ggtcaucccaccugcagt

SEQ ID NO: 1127 - DNA, 24 bp, Artificial Sequence
  Synthetic
tcttcaaaccguctcctgtttugt

SEQ ID NO: 1128 - DNA, 22 bp, Artificial Sequence
  Synthetic
ggttgacgauggagaggtcaut

SEQ ID NO: 1129 - DNA, 25 bp, Artificial Sequence
  Synthetic
tcaaaggactuctttgccaagtuca

SEQ ID NO: 1130 - DNA, 20 bp, Artificial Sequence
  Synthetic
ggcccagcacucacaaatuc

SEQ ID NO: 1131 - DNA, 21 bp, Artificial Sequence
  Synthetic
agaccccuggaactgcuacat

SEQ ID NO: 1132 - DNA, 23 bp, Artificial Sequence
  Synthetic
agagtucccaggcaacaaactua

SEQ ID NO: 1133 - DNA, 22 bp, Artificial Sequence
  Synthetic
caagaggtagutggcctgctuc

SEQ ID NO: 1134 - DNA, 22 bp, Artificial Sequence
  Synthetic
caatcaugggcttgttcugcac

SEQ ID NO: 1135 - DNA, 20 bp, Artificial Sequence
  Synthetic
ttccagccugtccugacaac

SEQ ID NO: 1136 - DNA, 18 bp, Artificial Sequence
  Synthetic
gaggagcuggcaguggaa

SEQ ID NO: 1137 - DNA, 17 bp, Artificial Sequence
  Synthetic
ggcuaccacgccugagc

SEQ ID NO: 1138 - DNA, 17 bp, Artificial Sequence
  Synthetic
agggcugcggagaucct

SEQ ID NO: 1139 - DNA, 21 bp, Artificial Sequence
  Synthetic
gcagctacutccagagctuca

SEQ ID NO: 1140 - DNA, 18 bp, Artificial Sequence
  Synthetic
caguagccuccaggccat

SEQ ID NO: 1141 - DNA, 19 bp, Artificial Sequence
  Synthetic
ggugagtccucagcaccag

SEQ ID NO: 1142 - DNA, 22 bp, Artificial Sequence
  Synthetic
agggtgugtaggatgugacact

SEQ ID NO: 1143 - DNA, 19 bp, Artificial Sequence
  Synthetic
gatccaccuctggccucac

SEQ ID NO: 1144 - DNA, 19 bp, Artificial Sequence
  Synthetic
gaagugagtgugcgaccga

SEQ ID NO: 1145 - DNA, 21 bp, Artificial Sequence
  Synthetic
ggctacgucacttcccttgug

SEQ ID NO: 1146 - DNA, 20 bp, Artificial Sequence
  Synthetic
ccutgtgcaacuccgaagga

SEQ ID NO: 1147 - DNA, 20 bp, Artificial Sequence
  Synthetic
cctaccaccucctcuggcaa

SEQ ID NO: 1148 - DNA, 23 bp, Artificial Sequence
  Synthetic
tccaaaatgauggcaaagtuggg

SEQ ID NO: 1149 - DNA, 20 bp, Artificial Sequence
  Synthetic
tcgcacccucaacgtatucg

SEQ ID NO: 1150 - DNA, 21 bp, Artificial Sequence
  Synthetic
gggtgaggcaguctttacuca

SEQ ID NO: 1151 - DNA, 31 bp, Artificial Sequence
  Synthetic
gtacactcatctucctagggataaaatuagg

SEQ ID NO: 1152 - DNA, 22 bp, Artificial Sequence
  Synthetic
agggtgtctcuctgtggcttua

SEQ ID NO: 1153 - DNA, 20 bp, Artificial Sequence
  Synthetic
gctgcagutctcagcucaca

SEQ ID NO: 1154 - DNA, 23 bp, Artificial Sequence
  Synthetic
acactattcagucctgcctucct

SEQ ID NO: 1155 - DNA, 21 bp, Artificial Sequence
  Synthetic
gctgatccuctctgtggugac

SEQ ID NO: 1156 - DNA, 24 bp, Artificial Sequence
  Synthetic
gaggactgaccuaagcaagttugt

SEQ ID NO: 1157 - DNA, 22 bp, Artificial Sequence
  Synthetic
ctctgctcuggtttgctacuca

SEQ ID NO: 1158 - DNA, 21 bp, Artificial Sequence
  Synthetic
ggtggaacgugtctgtctugg

SEQ ID NO: 1159 - DNA, 25 bp, Artificial Sequence
  Synthetic
agtcaggttgaauttaccagagcut

SEQ ID NO: 1160 - DNA, 24 bp, Artificial Sequence
  Synthetic
ggatgtacagcaugtcatcctuct

SEQ ID NO: 1161 - DNA, 20 bp, Artificial Sequence
  Synthetic
gggagccaacgutctttguc

SEQ ID NO: 1162 - DNA, 23 bp, Artificial Sequence
  Synthetic
gctccttgtutgggtttctcuca

SEQ ID NO: 1163 - DNA, 23 bp, Artificial Sequence
  Synthetic
ccctgaaaucaaccctcaccuaa

SEQ ID NO: 1164 - DNA, 21 bp, Artificial Sequence
  Synthetic
ccacaggcucaagccttcaua

SEQ ID NO: 1165 - DNA, 27 bp, Artificial Sequence
  Synthetic
aatcataccttgucctctgactctuct

SEQ ID NO: 1166 - DNA, 22 bp, Artificial Sequence
  Synthetic
catgctctcaugcctgggauaa

SEQ ID NO: 1167 - DNA, 20 bp, Artificial Sequence
  Synthetic
gaaugggacagtccuccagc

SEQ ID NO: 1168 - DNA, 25 bp, Artificial Sequence
  Synthetic
gtgtaaucaaaagccaaaucaccug

SEQ ID NO: 1169 - DNA, 22 bp, Artificial Sequence
  Synthetic
cagccctcuggaaggtacatug

SEQ ID NO: 1170 - DNA, 20 bp, Artificial Sequence
  Synthetic
cagctctggutcctgagguc

SEQ ID NO: 1171 - DNA, 22 bp, Artificial Sequence
  Synthetic
agaugaaggccaacctccuagt

SEQ ID NO: 1172 - DNA, 22 bp, Artificial Sequence
  Synthetic
ccagucccgaagatcuggaaga

SEQ ID NO: 1173 - DNA, 22 bp, Artificial Sequence
  Synthetic
cgagctgtucagttggtggaut

SEQ ID NO: 1174 - DNA, 18 bp, Artificial Sequence
  Synthetic
gcaguccagagcuagcga

SEQ ID NO: 1175 - DNA, 19 bp, Artificial Sequence
  Synthetic
cgggagccacucagcuact

SEQ ID NO: 1176 - DNA, 20 bp, Artificial Sequence
  Synthetic
ccuagagaacgagcggguca

SEQ ID NO: 1177 - DNA, 18 bp, Artificial Sequence
  Synthetic
gacuccccagccgtacuc

SEQ ID NO: 1178 - DNA, 25 bp, Artificial Sequence
  Synthetic
cccatgtccugtataaccaauggaa

SEQ ID NO: 1179 - DNA, 25 bp, Artificial Sequence
  Synthetic
gggagatcuctaccacatucagaca

SEQ ID NO: 1180 - DNA, 29 bp, Artificial Sequence
  Synthetic
cctucaacacccaaattaauaccaaaagt

SEQ ID NO: 1181 - DNA, 28 bp, Artificial Sequence
  Synthetic
aaccagacauacataactgtacaugcaa

SEQ ID NO: 1182 - DNA, 31 bp, Artificial Sequence
  Synthetic
ttcttcattgtaccutcctaattcctuaagt

SEQ ID NO: 1183 - DNA, 24 bp, Artificial Sequence
  Synthetic
ccggucggaagaaggtaaacatua

SEQ ID NO: 1184 - DNA, 24 bp, Artificial Sequence
  Synthetic
ggcattagtuctgtgtgctatugg

SEQ ID NO: 1185 - DNA, 23 bp, Artificial Sequence
  Synthetic
atcctacuccacgctcaaaagug

SEQ ID NO: 1186 - DNA, 27 bp, Artificial Sequence
  Synthetic
aatcttgcccuatcgttaattguaagt

SEQ ID NO: 1187 - DNA, 25 bp, Artificial Sequence
  Synthetic
tggtatttgcauctgttgggugaaa

SEQ ID NO: 1188 - DNA, 23 bp, Artificial Sequence
  Synthetic
agactcagguggagtcatgctua

SEQ ID NO: 1189 - DNA, 24 bp, Artificial Sequence
  Synthetic
tgttacacugcagctctttctcuc

SEQ ID NO: 1190 - DNA, 22 bp, Artificial Sequence
  Synthetic
gcacaaucagagctguagcaga

SEQ ID NO: 1191 - DNA, 28 bp, Artificial Sequence
  Synthetic
tcagttaacggtuaatatcacacagcut

SEQ ID NO: 1192 - DNA, 26 bp, Artificial Sequence
  Synthetic
acttcttaacagguggtttgttcugg

SEQ ID NO: 1193 - DNA, 24 bp, Artificial Sequence
  Synthetic
aattgcagtgaagugctgtgaaug

SEQ ID NO: 1194 - DNA, 26 bp, Artificial Sequence
  Synthetic
tcttcagcuaatttttctgcauccct

SEQ ID NO: 1195 - DNA, 28 bp, Artificial Sequence
  Synthetic
gggatacugaaacagatggacttuacaa

SEQ ID NO: 1196 - DNA, 22 bp, Artificial Sequence
  Synthetic
ccgtctctuccactgaaagugt

SEQ ID NO: 1197 - DNA, 22 bp, Artificial Sequence
  Synthetic
agtttgtuccaggctgttcucc

SEQ ID NO: 1198 - DNA, 19 bp, Artificial Sequence
  Synthetic
cuggaaggactcugcagga

SEQ ID NO: 1199 - DNA, 28 bp, Artificial Sequence
  Synthetic
agagcccttaagutctgagaaaattuga

SEQ ID NO: 1200 - DNA, 25 bp, Artificial Sequence
  Synthetic
tttcatgtgtttcuccagggtacug

SEQ ID NO: 1201 - DNA, 21 bp, Artificial Sequence
  Synthetic
ctatgcctgugcccagaguag

SEQ ID NO: 1202 - DNA, 18 bp, Artificial Sequence
  Synthetic
gatcccuccgtccagcuc

SEQ ID NO: 1203 - DNA, 21 bp, Artificial Sequence
  Synthetic
aggcagcucaaagatccctuc

SEQ ID NO: 1204 - DNA, 17 bp, Artificial Sequence
  Synthetic
gtggaaggccucgcuga

SEQ ID NO: 1205 - DNA, 17 bp, Artificial Sequence
  Synthetic
ctacggcutcgggcuga

SEQ ID NO: 1206 - DNA, 20 bp, Artificial Sequence
  Synthetic
gacgattugtgcatgugcgt

SEQ ID NO: 1207 - DNA, 19 bp, Artificial Sequence
  Synthetic
cugcggcaagacgtucaaa

SEQ ID NO: 1208 - DNA, 20 bp, Artificial Sequence
  Synthetic
gtcaaaggcacucgggugat

SEQ ID NO: 1209 - DNA, 24 bp, Artificial Sequence
  Synthetic
aggatcagtaucgagagaggctuc

SEQ ID NO: 1210 - DNA, 29 bp, Artificial Sequence
  Synthetic
ggacatttguagaagaaataaggcucaac

SEQ ID NO: 1211 - DNA, 25 bp, Artificial Sequence
  Synthetic
gctgtagtgcutgattttgggttuc

SEQ ID NO: 1212 - DNA, 23 bp, Artificial Sequence
  Synthetic
tgggttactuacgcgagaatucc

SEQ ID NO: 1213 - DNA, 17 bp, Artificial Sequence
  Synthetic
gugaaccgagccgucgt

SEQ ID NO: 1214 - DNA, 20 bp, Artificial Sequence
  Synthetic
gccctgtugggagtacugga

SEQ ID NO: 1215 - DNA, 22 bp, Artificial Sequence
  Synthetic
ctcaggauagcacaccuagcat

SEQ ID NO: 1216 - DNA, 27 bp, Artificial Sequence
  Synthetic
aggaacaattcugctcattcacuagac

SEQ ID NO: 1217 - DNA, 23 bp, Artificial Sequence
  Synthetic
gcttctgggccugtttctcttut

SEQ ID NO: 1218 - DNA, 25 bp, Artificial Sequence
  Synthetic
agctgcaguacacacataattugga

SEQ ID NO: 1219 - DNA, 29 bp, Artificial Sequence
  Synthetic
gttgcactuaagccataatgacgttuaat

SEQ ID NO: 1220 - DNA, 23 bp, Artificial Sequence
  Synthetic
ggtcggcuggaagaagttaaguc

SEQ ID NO: 1221 - DNA, 23 bp, Artificial Sequence
  Synthetic
tttccctgugctgactctguaac

SEQ ID NO: 1222 - DNA, 20 bp, Artificial Sequence
  Synthetic
tctcagaguccttgguggca

SEQ ID NO: 1223 - DNA, 24 bp, Artificial Sequence
  Synthetic
aacttctcucccctcuaaaggaca

SEQ ID NO: 1224 - DNA, 18 bp, Artificial Sequence
  Synthetic
ctcctgcucggacuccag

SEQ ID NO: 1225 - DNA, 18 bp, Artificial Sequence
  Synthetic
ctccgugaccugcgagaa

SEQ ID NO: 1226 - DNA, 23 bp, Artificial Sequence
  Synthetic
ttgatctccutctctcucaggct

SEQ ID NO: 1227 - DNA, 26 bp, Artificial Sequence
  Synthetic
tggcuaaacaaagttaauccccacaa

SEQ ID NO: 1228 - DNA, 23 bp, Artificial Sequence
  Synthetic
caccagguaactgttaccagugt

SEQ ID NO: 1229 - DNA, 28 bp, Artificial Sequence
  Synthetic
tctttgtacctcuttgttccttcttuca

SEQ ID NO: 1230 - DNA, 21 bp, Artificial Sequence
  Synthetic
ctccccugtatgatgugcagt

SEQ ID NO: 1231 - DNA, 25 bp, Artificial Sequence
  Synthetic
actgtgttcagaacuttcctccauc

SEQ ID NO: 1232 - DNA, 21 bp, Artificial Sequence
  Synthetic
gctgctggugtggaagttgua

SEQ ID NO: 1233 - DNA, 28 bp, Artificial Sequence
  Synthetic
tgatagatccaaucagagtcatctcgut

SEQ ID NO: 1234 - DNA, 26 bp, Artificial Sequence
  Synthetic
ggtcattgagaaugatttctgggcut

SEQ ID NO: 1235 - DNA, 26 bp, Artificial Sequence
  Synthetic
gtgtttcagctucttgtggtgttuat

SEQ ID NO: 1236 - DNA, 22 bp, Artificial Sequence
  Synthetic
gcgatgaguggtactccatgua

SEQ ID NO: 1237 - DNA, 29 bp, Artificial Sequence
  Synthetic
aggagtatctttucttctggagacuaaca

SEQ ID NO: 1238 - DNA, 23 bp, Artificial Sequence
  Synthetic
gtaagccatutcctgtgtgucct

SEQ ID NO: 1239 - DNA, 21 bp, Artificial Sequence
  Synthetic
cactccagugcttgctttuga

SEQ ID NO: 1240 - DNA, 22 bp, Artificial Sequence
  Synthetic
cctggaggaagcuccaagttut

SEQ ID NO: 1241 - DNA, 25 bp, Artificial Sequence
  Synthetic
tgtacaccaugaaccccaacaaaut

SEQ ID NO: 1242 - DNA, 22 bp, Artificial Sequence
  Synthetic
ttgtctgtucagcaaguggaca

SEQ ID NO: 1243 - DNA, 22 bp, Artificial Sequence
  Synthetic
ccattagcaccuactccaugct

SEQ ID NO: 1244 - DNA, 24 bp, Artificial Sequence
  Synthetic
tgtgggcttuaggtcaatgtugat

SEQ ID NO: 1245 - DNA, 29 bp, Artificial Sequence
  Synthetic
ttgagcacaguaacaagatttuaaaaccc

SEQ ID NO: 1246 - DNA, 24 bp, Artificial Sequence
  Synthetic
gaaagtctcugtgatgagcucagt

SEQ ID NO: 1247 - DNA, 21 bp, Artificial Sequence
  Synthetic
ggaggtaccugctggtcagua

SEQ ID NO: 1248 - DNA, 22 bp, Artificial Sequence
  Synthetic
gactctgaggaugcccaagaut

SEQ ID NO: 1249 - DNA, 24 bp, Artificial Sequence
  Synthetic
gcaccaaaguggatgaatauggag

SEQ ID NO: 1250 - DNA, 20 bp, Artificial Sequence
  Synthetic
ggtccgcucggtctctttug

SEQ ID NO: 1251 - DNA, 18 bp, Artificial Sequence
  Synthetic
cacaucacggcgccuaga

SEQ ID NO: 1252 - DNA, 28 bp, Artificial Sequence
  Synthetic
ttccaaggttcuctgcattcataagaut

SEQ ID NO: 1253 - DNA, 26 bp, Artificial Sequence
  Synthetic
tcttgttgutttagtgtucaagcaca

SEQ ID NO: 1254 - DNA, 24 bp, Artificial Sequence
  Synthetic
tggaattggcaaauccctgaagua

SEQ ID NO: 1255 - DNA, 28 bp, Artificial Sequence
  Synthetic
tcattcattaaaacagugctgtgaaucc

SEQ ID NO: 1256 - DNA, 30 bp, Artificial Sequence
  Synthetic
cctcttataactucacaactgactcaaucc

SEQ ID NO: 1257 - DNA, 23 bp, Artificial Sequence
  Synthetic
ttcctgacttugcccctctttut

SEQ ID NO: 1258 - DNA, 23 bp, Artificial Sequence
  Synthetic
ggttgtgtaucctacgtgcucat

SEQ ID NO: 1259 - DNA, 22 bp, Artificial Sequence
  Synthetic
ggagaaacgcuttgagtccauc

SEQ ID NO: 1260 - DNA, 24 bp, Artificial Sequence
  Synthetic
gcatccattuaccctgtctgtcut

SEQ ID NO: 1261 - DNA, 29 bp, Artificial Sequence
  Synthetic
tgagttatgttcugcacatttgcatttut

SEQ ID NO: 1262 - DNA, 24 bp, Artificial Sequence
  Synthetic
tugcctttaaagucacgaaagcac

SEQ ID NO: 1263 - DNA, 26 bp, Artificial Sequence
  Synthetic
ctgtcatttgtuggttttcagctuct

SEQ ID NO: 1264 - DNA, 23 bp, Artificial Sequence
  Synthetic
gaacgtucattcaaguaggccat

SEQ ID NO: 1265 - DNA, 26 bp, Artificial Sequence
  Synthetic
ctctccaaatcuaggacctaggacuc

SEQ ID NO: 1266 - DNA, 27 bp, Artificial Sequence
  Synthetic
aaaatccattggcutttagttgccaut

SEQ ID NO: 1267 - DNA, 25 bp, Artificial Sequence
  Synthetic
catcagtggtcugtgcatactguag

SEQ ID NO: 1268 - DNA, 27 bp, Artificial Sequence
  Synthetic
catttgcataatttutcccgtcctcut

SEQ ID NO: 1269 - DNA, 29 bp, Artificial Sequence
  Synthetic
cttttagctccucaatcaatgtcttgtut

SEQ ID NO: 1270 - DNA, 23 bp, Artificial Sequence
  Synthetic
caggtgtguctctccaccuaaaa

SEQ ID NO: 1271 - DNA, 22 bp, Artificial Sequence
  Synthetic
cggcctattguggcagagaauc

SEQ ID NO: 1272 - DNA, 25 bp, Artificial Sequence
  Synthetic
ttggatgcautgtgatatucgggat

SEQ ID NO: 1273 - DNA, 32 bp, Artificial Sequence
  Synthetic
aatattttccagaaacuagaggttagctgaua

SEQ ID NO: 1274 - DNA, 27 bp, Artificial Sequence
  Synthetic
aaacatgguaagcaaagaccgaaaauc

SEQ ID NO: 1275 - DNA, 32 bp, Artificial Sequence
  Synthetic
gcctcttattatauccatcattccattttuct

SEQ ID NO: 1276 - DNA, 22 bp, Artificial Sequence
  Synthetic
ggtcucgagccatcctugaaaa

SEQ ID NO: 1277 - DNA, 32 bp, Artificial Sequence
  Synthetic
atttcaactcctttcuagttacgaatatagug

SEQ ID NO: 1278 - DNA, 22 bp, Artificial Sequence
  Synthetic
ccaaacgtcacuctgatgggug

SEQ ID NO: 1279 - DNA, 24 bp, Artificial Sequence
  Synthetic
aaauatgatuaaggccagcccaaa

SEQ ID NO: 1280 - DNA, 23 bp, Artificial Sequence
  Synthetic
accutagctatcuggacacacca

SEQ ID NO: 1281 - DNA, 25 bp, Artificial Sequence
  Synthetic
agtatggatcauccacacctagucc

SEQ ID NO: 1282 - DNA, 30 bp, Artificial Sequence
  Synthetic
ctaaaacaaaacutaactaacgataugcgt

SEQ ID NO: 1283 - DNA, 26 bp, Artificial Sequence
  Synthetic
acccaatcaagcucaacttcgtatut

SEQ ID NO: 1284 - DNA, 30 bp, Artificial Sequence
  Synthetic
tttgttcatgataacuaggaaaggattuga

SEQ ID NO: 1285 - DNA, 29 bp, Artificial Sequence
  Synthetic
gaatgatgtttuctgttctgtaatugcct

SEQ ID NO: 1286 - DNA, 24 bp, Artificial Sequence
  Synthetic
gtccttcaaagcucatgaggugaa

SEQ ID NO: 1287 - DNA, 21 bp, Artificial Sequence
  Synthetic
gtgtgcaaccauctgtgtucc

SEQ ID NO: 1288 - DNA, 22 bp, Artificial Sequence
  Synthetic
gctgatttccutcagggacugg

SEQ ID NO: 1289 - DNA, 25 bp, Artificial Sequence
  Synthetic
ccttattttacuccggaatgcgtut

SEQ ID NO: 1290 - DNA, 29 bp, Artificial Sequence
  Synthetic
agaatctcttcagutttgtctacacttug

SEQ ID NO: 1291 - DNA, 30 bp, Artificial Sequence
  Synthetic
cattgacaaautcataaactguaccaagat

SEQ ID NO: 1292 - DNA, 32 bp, Artificial Sequence
  Synthetic
tttggttattcttautctgttacttacgugga

SEQ ID NO: 1293 - DNA, 22 bp, Artificial Sequence
  Synthetic
cagtguccccaaacctttguct

SEQ ID NO: 1294 - DNA, 23 bp, Artificial Sequence
  Synthetic
ccagaggcaugaaauggaccaat

SEQ ID NO: 1295 - DNA, 24 bp, Artificial Sequence
  Synthetic
cctttttcccutttcgtgttcugc

SEQ ID NO: 1296 - DNA, 24 bp, Artificial Sequence
  Synthetic
gccaaggcauatcgatcctcauaa

SEQ ID NO: 1297 - DNA, 30 bp, Artificial Sequence
  Synthetic
cagagtgacaaautcgttttauaacacagg

SEQ ID NO: 1298 - DNA, 18 bp, Artificial Sequence
  Synthetic
agaatcgcugggcuggac

SEQ ID NO: 1299 - DNA, 25 bp, Artificial Sequence
  Synthetic
gggatatgccauttggacatguaat

SEQ ID NO: 1300 - DNA, 20 bp, Artificial Sequence
  Synthetic
cacctgcagugacgagctua

SEQ ID NO: 1301 - DNA, 30 bp, Artificial Sequence
  Synthetic
tgaatacagtattutgatctgccttuaaca

SEQ ID NO: 1302 - DNA, 22 bp, Artificial Sequence
  Synthetic
ctaccccaccucccaaaatuca

SEQ ID NO: 1303 - DNA, 23 bp, Artificial Sequence
  Synthetic
tgtacttauaggcagtgggcugt

SEQ ID NO: 1304 - DNA, 27 bp, Artificial Sequence
  Synthetic
tgctttaucacacaccttgatucaaga

SEQ ID NO: 1305 - DNA, 25 bp, Artificial Sequence
  Synthetic
cgggtatcaaaaugactcaccacut

SEQ ID NO: 1306 - DNA, 24 bp, Artificial Sequence
  Synthetic
actagacaucactcgcctguaact

SEQ ID NO: 1307 - DNA, 31 bp, Artificial Sequence
  Synthetic
gaaaatataccatugcctgaatgttctucac

SEQ ID NO: 1308 - DNA, 23 bp, Artificial Sequence
  Synthetic
aggagccacutgctagtaaguct

SEQ ID NO: 1309 - DNA, 30 bp, Artificial Sequence
  Synthetic
actttagctgaaaucaaccaaaaauggaat

SEQ ID NO: 1310 - DNA, 32 bp, Artificial Sequence
  Synthetic
taactgatgaattuaactaagagagauaggga

SEQ ID NO: 1311 - DNA, 30 bp, Artificial Sequence
  Synthetic
ggcctggauacaagacttgaagataaauag

SEQ ID NO: 1312 - DNA, 18 bp, Artificial Sequence
  Synthetic
gcgaccauccggtuccat

SEQ ID NO: 1313 - DNA, 20 bp, Artificial Sequence
  Synthetic
ggttucccgaggcttcctug

SEQ ID NO: 1314 - DNA, 25 bp, Artificial Sequence
  Synthetic
ggagttgacagguagtaacttuagc

SEQ ID NO: 1315 - DNA, 28 bp, Artificial Sequence
  Synthetic
tgggtgtgagggutttatagagatcaua

SEQ ID NO: 1316 - DNA, 27 bp, Artificial Sequence
  Synthetic
tutggtcttcattuaagccagaagaga

SEQ ID NO: 1317 - DNA, 27 bp, Artificial Sequence
  Synthetic
aagtatugaaaacagaccaauggaagt

SEQ ID NO: 1318 - DNA, 26 bp, Artificial Sequence
  Synthetic
accacatagaacuaaagacgatguca

SEQ ID NO: 1319 - DNA, 26 bp, Artificial Sequence
  Synthetic
aacttcagtcaguttctcaacccaut

SEQ ID NO: 1320 - DNA, 22 bp, Artificial Sequence
  Synthetic
tcatacgaaccutcggctctuc

SEQ ID NO: 1321 - DNA, 29 bp, Artificial Sequence
  Synthetic
aactaccaaaaacuatggatccagtgaut

SEQ ID NO: 1322 - DNA, 25 bp, Artificial Sequence
  Synthetic
caaaccgaatuaaagcaaagccugt

SEQ ID NO: 1323 - DNA, 28 bp, Artificial Sequence
  Synthetic
cgtgttcccaagagucttttgttctuaa

SEQ ID NO: 1324 - DNA, 24 bp, Artificial Sequence
  Synthetic
tgaatatttgacuggctgctgcut

SEQ ID NO: 1325 - DNA, 29 bp, Artificial Sequence
  Synthetic
tcaccttcaactutgtttgtaagagtuct

SEQ ID NO: 1326 - DNA, 27 bp, Artificial Sequence
  Synthetic
attgttgatacagcugaatctcaugaa

SEQ ID NO: 1327 - DNA, 21 bp, Artificial Sequence
  Synthetic
cccttuggaagtcctguggat

SEQ ID NO: 1328 - DNA, 29 bp, Artificial Sequence
  Synthetic
catttaggaaatcauggatcggatcuaca

SEQ ID NO: 1329 - DNA, 25 bp, Artificial Sequence
  Synthetic
gcacagtggaguattacgtccttut

SEQ ID NO: 1330 - DNA, 29 bp, Artificial Sequence
  Synthetic
tggauactttaatactgauaagccacacc

SEQ ID NO: 1331 - DNA, 24 bp, Artificial Sequence
  Synthetic
gagccacctutgtccattttcauc

SEQ ID NO: 1332 - DNA, 29 bp, Artificial Sequence
  Synthetic
gcagatcguaaaaaggaccttguaaaact

SEQ ID NO: 1333 - DNA, 25 bp, Artificial Sequence
  Synthetic
ttccacgttctuacctgtttgcaua

SEQ ID NO: 1334 - DNA, 28 bp, Artificial Sequence
  Synthetic
acaccatttgcuaagaacttaaauacct

SEQ ID NO: 1335 - DNA, 23 bp, Artificial Sequence
  Synthetic
catctgucaccagaccagttuca

SEQ ID NO: 1336 - DNA, 24 bp, Artificial Sequence
  Synthetic
actcagtgtcuctccctctgatuc

SEQ ID NO: 1337 - DNA, 21 bp, Artificial Sequence
  Synthetic
gggttguggagcaggtaucat

SEQ ID NO: 1338 - DNA, 23 bp, Artificial Sequence
  Synthetic
atgttaaagagcucgtcctgguc

SEQ ID NO: 1339 - DNA, 22 bp, Artificial Sequence
  Synthetic
ggtctcagguttgcttgtguct

SEQ ID NO: 1340 - DNA, 19 bp, Artificial Sequence
  Synthetic
ggcuccgggaactucacac

SEQ ID NO: 1341 - DNA, 22 bp, Artificial Sequence
  Synthetic
aggacatgguggacagugagat

SEQ ID NO: 1342 - DNA, 22 bp, Artificial Sequence
  Synthetic
ctctgccuccttctcttcucct

SEQ ID NO: 1343 - DNA, 23 bp, Artificial Sequence
  Synthetic
ccaagaaggaccutgtggaagut

SEQ ID NO: 1344 - DNA, 21 bp, Artificial Sequence
  Synthetic
cattgggcccutccccatauc

SEQ ID NO: 1345 - DNA, 24 bp, Artificial Sequence
  Synthetic
agattgaaaagaccucgggugaaa

SEQ ID NO: 1346 - DNA, 22 bp, Artificial Sequence
  Synthetic
gggtacagutcttcuacagcca

SEQ ID NO: 1347 - DNA, 24 bp, Artificial Sequence
  Synthetic
ccgtgugaggaaactgttuaacct

SEQ ID NO: 1348 - DNA, 21 bp, Artificial Sequence
  Synthetic
gcugttagtcacuggcagcaa

SEQ ID NO: 1349 - DNA, 23 bp, Artificial Sequence
  Synthetic
gagaaaatcccugttcccacuca

SEQ ID NO: 1350 - DNA, 26 bp, Artificial Sequence
  Synthetic
gctgaaacaugcagttgtaaactuga

SEQ ID NO: 1351 - DNA, 23 bp, Artificial Sequence
  Synthetic
tctgaaacuactcccctugagca

SEQ ID NO: 1352 - DNA, 26 bp, Artificial Sequence
  Synthetic
tgggtaagaaaacaugtcagaaugct

SEQ ID NO: 1353 - DNA, 32 bp, Artificial Sequence
  Synthetic
ccattttagcuccttcttgatgtaauaaaagg

SEQ ID NO: 1354 - DNA, 30 bp, Artificial Sequence
  Synthetic
ccccaagcuttagtaaatataaugaggacc

SEQ ID NO: 1355 - DNA, 26 bp, Artificial Sequence
  Synthetic
agaacugcagatgctauacacaagac

SEQ ID NO: 1356 - DNA, 22 bp, Artificial Sequence
  Synthetic
ccatctgtgcucttcgtcauct

SEQ ID NO: 1357 - DNA, 29 bp, Artificial Sequence
  Synthetic
ctgcaacaaagguaaattctacttugaca

SEQ ID NO: 1358 - DNA, 28 bp, Artificial Sequence
  Synthetic
cgcatggaagaaauagttgaaggttgua

SEQ ID NO: 1359 - DNA, 32 bp, Artificial Sequence
  Synthetic
tttatggacataaaaccuagaacacttcacut

SEQ ID NO: 1360 - DNA, 22 bp, Artificial Sequence
  Synthetic
gctgctgtuttgttccgaaugt

SEQ ID NO: 1361 - DNA, 22 bp, Artificial Sequence
  Synthetic
caagctgccauacctgctcuag

SEQ ID NO: 1362 - DNA, 23 bp, Artificial Sequence
  Synthetic
gcctggtttgauactgacctgua

SEQ ID NO: 1363 - DNA, 31 bp, Artificial Sequence
  Synthetic
caaagtatatacctguttttgtggcagatut

SEQ ID NO: 1364 - DNA, 21 bp, Artificial Sequence
  Synthetic
ccagaucaggcaacuggagaa

SEQ ID NO: 1365 - DNA, 20 bp, Artificial Sequence
  Synthetic
ccgaucagaggtgcaaugct

SEQ ID NO: 1366 - DNA, 21 bp, Artificial Sequence
  Synthetic
ctgaugacaggacccagauca

SEQ ID NO: 1367 - DNA, 19 bp, Artificial Sequence
  Synthetic
ccuatccgcucagccaacc

SEQ ID NO: 1368 - DNA, 21 bp, Artificial Sequence
  Synthetic
tgggauccgaagcaccuagaa

SEQ ID NO: 1369 - DNA, 22 bp, Artificial Sequence
  Synthetic
accccagcaguactcagaugat

SEQ ID NO: 1370 - DNA, 21 bp, Artificial Sequence
  Synthetic
gcuctgagguccacaagaggt

SEQ ID NO: 1371 - DNA, 22 bp, Artificial Sequence
  Synthetic
cccacaaguctcaagagucaca

SEQ ID NO: 1372 - DNA, 21 bp, Artificial Sequence
  Synthetic
gtcccucccaaagtagguaca

SEQ ID NO: 1373 - DNA, 25 bp, Artificial Sequence
  Synthetic
gattccttgtcutggtctccacuag

SEQ ID NO: 1374 - DNA, 20 bp, Artificial Sequence
  Synthetic
gatgaaggcacugcagccua

SEQ ID NO: 1375 - DNA, 27 bp, Artificial Sequence
  Synthetic
gtatgggtgacuattcttggttucaca

SEQ ID NO: 1376 - DNA, 17 bp, Artificial Sequence
  Synthetic
cggucccctccucacct

SEQ ID NO: 1377 - DNA, 21 bp, Artificial Sequence
  Synthetic
gttgtctgugtgtgggacuga

SEQ ID NO: 1378 - DNA, 21 bp, Artificial Sequence
  Synthetic
ggcaaattcucggaggaugct

SEQ ID NO: 1379 - DNA, 22 bp, Artificial Sequence
  Synthetic
gcggcatuggaaaatgtcgaug

SEQ ID NO: 1380 - DNA, 23 bp, Artificial Sequence
  Synthetic
ttctttggcutttccctccuacc

SEQ ID NO: 1381 - DNA, 20 bp, Artificial Sequence
  Synthetic
atgctttugatgcccuccct

SEQ ID NO: 1382 - DNA, 25 bp, Artificial Sequence
  Synthetic
agtacaauggcatgaaatttugcct

SEQ ID NO: 1383 - DNA, 23 bp, Artificial Sequence
  Synthetic
ggaacacauggtccatctucaga

SEQ ID NO: 1384 - DNA, 24 bp, Artificial Sequence
  Synthetic
ctgagaaccuctcaaaaccacuct

SEQ ID NO: 1385 - DNA, 28 bp, Artificial Sequence
  Synthetic
ccttggaagugaagaatatgatgtucct

SEQ ID NO: 1386 - DNA, 25 bp, Artificial Sequence
  Synthetic
acaagcugattagucccaaacacat

SEQ ID NO: 1387 - DNA, 23 bp, Artificial Sequence
  Synthetic
tcccttaagagaucctccuccac

SEQ ID NO: 1388 - DNA, 25 bp, Artificial Sequence
  Synthetic
ggtcacaucaccttaacuaaaccca

SEQ ID NO: 1389 - DNA, 23 bp, Artificial Sequence
  Synthetic
tgatccaagagaugaaggcucca

SEQ ID NO: 1390 - DNA, 26 bp, Artificial Sequence
  Synthetic
ttcatgaatcauaagcactccaacut

SEQ ID NO: 1391 - DNA, 21 bp, Artificial Sequence
  Synthetic
agttgcacucgatugggacag

SEQ ID NO: 1392 - DNA, 27 bp, Artificial Sequence
  Synthetic
agaagaagggaauggatagacuaagca

SEQ ID NO: 1393 - DNA, 22 bp, Artificial Sequence
  Synthetic
tgagguccaccagattagcuct

SEQ ID NO: 1394 - DNA, 29 bp, Artificial Sequence
  Synthetic
ctgaaatattcttcutacctgtcctguga

SEQ ID NO: 1395 - DNA, 23 bp, Artificial Sequence
  Synthetic
acttgcccaacucagtgagaaug

SEQ ID NO: 1396 - DNA, 21 bp, Artificial Sequence
  Synthetic
caagtcttcuccacggtccug

SEQ ID NO: 1397 - DNA, 27 bp, Artificial Sequence
  Synthetic
aattccagauggcaaactcaatgaaug

SEQ ID NO: 1398 - DNA, 30 bp, Artificial Sequence
  Synthetic
cccttccatttauagctaattcatctcugg

SEQ ID NO: 1399 - DNA, 21 bp, Artificial Sequence
  Synthetic
cgaccaugcagaugagcagaa

SEQ ID NO: 1400 - DNA, 23 bp, Artificial Sequence
  Synthetic
gaactgctagcuctagggttugg

SEQ ID NO: 1401 - DNA, 21 bp, Artificial Sequence
  Synthetic
cgcugacccacttugaagaca

SEQ ID NO: 1402 - DNA, 29 bp, Artificial Sequence
  Synthetic
acaaaaagccucaatggaaatcuaaacaa

SEQ ID NO: 1403 - DNA, 22 bp, Artificial Sequence
  Synthetic
cttcttgaugacccagccaaug

SEQ ID NO: 1404 - DNA, 27 bp, Artificial Sequence
  Synthetic
gcaaagaauagcacaatttgatgcuga

SEQ ID NO: 1405 - DNA, 26 bp, Artificial Sequence
  Synthetic
cccctcagggautcaaacaagaauac

SEQ ID NO: 1406 - DNA, 23 bp, Artificial Sequence
  Synthetic
acccacctcugttctgatggaua

SEQ ID NO: 1407 - DNA, 19 bp, Artificial Sequence
  Synthetic
ctggcccagutcaaggugt

SEQ ID NO: 1408 - DNA, 27 bp, Artificial Sequence
  Synthetic
caatagttguagaggcacttttcucca

SEQ ID NO: 1409 - DNA, 25 bp, Artificial Sequence
  Synthetic
ttctctctctautcccctctcaucc

SEQ ID NO: 1410 - DNA, 23 bp, Artificial Sequence
  Synthetic
caacagaaagugaaggcucaagt

SEQ ID NO: 1411 - DNA, 25 bp, Artificial Sequence
  Synthetic
gggttttatgaucagcaagtcccut

SEQ ID NO: 1412 - DNA, 28 bp, Artificial Sequence
  Synthetic
agtgatttcauattaagtcagugcccaa

SEQ ID NO: 1413 - DNA, 22 bp, Artificial Sequence
  Synthetic
gtgttctcutggtgttcugggt

SEQ ID NO: 1414 - DNA, 22 bp, Artificial Sequence
  Synthetic
ccaagauccaggaagccttcuc

SEQ ID NO: 1415 - DNA, 23 bp, Artificial Sequence
  Synthetic
agacatctctcugctttgtgguc

SEQ ID NO: 1416 - DNA, 22 bp, Artificial Sequence
  Synthetic
tgttcccaggguaccaccatua

SEQ ID NO: 1417 - DNA, 24 bp, Artificial Sequence
  Synthetic
ttctctgttccuctgtgtgtctug

SEQ ID NO: 1418 - DNA, 21 bp, Artificial Sequence
  Synthetic
guagaacccaaaucccgtcut

SEQ ID NO: 1419 - DNA, 26 bp, Artificial Sequence
  Synthetic
agatgcttgtcuttcctttcttguca

SEQ ID NO: 1420 - DNA, 27 bp, Artificial Sequence
  Synthetic
cactctgguagcacttgatactttugt

SEQ ID NO: 1421 - DNA, 22 bp, Artificial Sequence
  Synthetic
ggacatggutctgccatttucc

SEQ ID NO: 1422 - DNA, 23 bp, Artificial Sequence
  Synthetic
acatgaagcccaaugttccugaa

SEQ ID NO: 1423 - DNA, 21 bp, Artificial Sequence
  Synthetic
ctgcaagggauggacuacgac

SEQ ID NO: 1424 - DNA, 30 bp, Artificial Sequence
  Synthetic
ccagtgtgttuaggaataatggauagaacc

SEQ ID NO: 1425 - DNA, 20 bp, Artificial Sequence
  Synthetic
gctcggaauccccagtggua

SEQ ID NO: 1426 - DNA, 20 bp, Artificial Sequence
  Synthetic
gtcagagguctcgtgtcugg

SEQ ID NO: 1427 - DNA, 22 bp, Artificial Sequence
  Synthetic
cccttcucagccgattagcuat

SEQ ID NO: 1428 - DNA, 18 bp, Artificial Sequence
  Synthetic
acccaccgutctucaccc

SEQ ID NO: 1429 - DNA, 23 bp, Artificial Sequence
  Synthetic
gctgctgtauacacttgagugct

SEQ ID NO: 1430 - DNA, 23 bp, Artificial Sequence
  Synthetic
ggttgtggaucttgaagcttugg

SEQ ID NO: 1431 - DNA, 22 bp, Artificial Sequence
  Synthetic
aggcttcucaaaaccguaagca

SEQ ID NO: 1432 - DNA, 24 bp, Artificial Sequence
  Synthetic
aaaagctgtuggcagaccagatua

SEQ ID NO: 1433 - DNA, 21 bp, Artificial Sequence
  Synthetic
caatgcaggcaugacaagugg

SEQ ID NO: 1434 - DNA, 28 bp, Artificial Sequence
  Synthetic
gccgtggtttuaaggatcaaatctauga

SEQ ID NO: 1435 - DNA, 26 bp, Artificial Sequence
  Synthetic
ggaacgauaacaaaacacaucagtug

SEQ ID NO: 1436 - DNA, 28 bp, Artificial Sequence
  Synthetic
tgaccatuacacaggctgttattttuct

SEQ ID NO: 1437 - DNA, 27 bp, Artificial Sequence
  Synthetic
gcacttagcagcuatattgtagtcuga

SEQ ID NO: 1438 - DNA, 21 bp, Artificial Sequence
  Synthetic
agtaaacagcagcuggtggut

SEQ ID NO: 1439 - DNA, 30 bp, Artificial Sequence
  Synthetic
agaatcctctugtcttcttcaguaacaaag

SEQ ID NO: 1440 - DNA, 22 bp, Artificial Sequence
  Synthetic
agcatcaacacuccatgctuca

SEQ ID NO: 1441 - DNA, 25 bp, Artificial Sequence
  Synthetic
gtaaccugcatttccgucacaaaag

SEQ ID NO: 1442 - DNA, 19 bp, Artificial Sequence
  Synthetic
aaatctggcuccgcaggut

SEQ ID NO: 1443 - DNA, 27 bp, Artificial Sequence
  Synthetic
ggtaataggugagaaaccctatcgtug

SEQ ID NO: 1444 - DNA, 20 bp, Artificial Sequence
  Synthetic
gccttccutctcccugacaa

SEQ ID NO: 1445 - DNA, 18 bp, Artificial Sequence
  Synthetic
gtcctgcggcuctcaguc

SEQ ID NO: 1446 - DNA, 20 bp, Artificial Sequence
  Synthetic
cccctcuggtttggcatuct

SEQ ID NO: 1447 - DNA, 21 bp, Artificial Sequence
  Synthetic
cacagagtccugcagcaguaa

SEQ ID NO: 1448 - DNA, 20 bp, Artificial Sequence
  Synthetic
ggcugtacucaccagggact

SEQ ID NO: 1449 - DNA, 20 bp, Artificial Sequence
  Synthetic
acaccgccagccucttatuc

SEQ ID NO: 1450 - DNA, 21 bp, Artificial Sequence
  Synthetic
gccaucacagccatgatgtug

SEQ ID NO: 1451 - DNA, 25 bp, Artificial Sequence
  Synthetic
accagttgaaaugcaaccttagugt

SEQ ID NO: 1452 - DNA, 23 bp, Artificial Sequence
  Synthetic
acaccacacgautctguagaacc

SEQ ID NO: 1453 - DNA, 26 bp, Artificial Sequence
  Synthetic
aagacaccgatutttcgaccagatua

SEQ ID NO: 1454 - DNA, 23 bp, Artificial Sequence
  Synthetic
caatucagaccccaacaguacga

SEQ ID NO: 1455 - DNA, 26 bp, Artificial Sequence
  Synthetic
agcagcugcaaaacaaagttttcuaa

SEQ ID NO: 1456 - DNA, 26 bp, Artificial Sequence
  Synthetic
tcctcctcttccucatagatttcguc

SEQ ID NO: 1457 - DNA, 17 bp, Artificial Sequence
  Synthetic
gcgacuccccucagcct

SEQ ID NO: 1458 - DNA, 27 bp, Artificial Sequence
  Synthetic
tgcutcgaatuagagagaaggaaagac

SEQ ID NO: 1459 - DNA, 27 bp, Artificial Sequence
  Synthetic
gggttcaacautgtgataaaucaggac

SEQ ID NO: 1460 - DNA, 26 bp, Artificial Sequence
  Synthetic
gcaacatuagccacaatccaaagaug

SEQ ID NO: 1461 - DNA, 22 bp, Artificial Sequence
  Synthetic
cagctcttcggucacctttcut

SEQ ID NO: 1462 - DNA, 22 bp, Artificial Sequence
  Synthetic
tctcagacauttccaccuccct

SEQ ID NO: 1463 - DNA, 21 bp, Artificial Sequence
  Synthetic
ggtctgctgucgatagtccuc

SEQ ID NO: 1464 - DNA, 27 bp, Artificial Sequence
  Synthetic
agaaagaagaaauccaccttgtaucgt

SEQ ID NO: 1465 - DNA, 22 bp, Artificial Sequence
  Synthetic
aggaactguctgagtcacuggt

SEQ ID NO: 1466 - DNA, 25 bp, Artificial Sequence
  Synthetic
ggagcattcugaatccaaagaucct

SEQ ID NO: 1467 - DNA, 21 bp, Artificial Sequence
  Synthetic
ttccaacgguttgcctttgug

SEQ ID NO: 1468 - DNA, 24 bp, Artificial Sequence
  Synthetic
cuccagugagaagaagaagcacaa

SEQ ID NO: 1469 - DNA, 17 bp, Artificial Sequence
  Synthetic
gcccuggctctcaguca

SEQ ID NO: 1470 - DNA, 28 bp, Artificial Sequence
  Synthetic
tctgttttgtcugtacaattatgtuggt

SEQ ID NO: 1471 - DNA, 29 bp, Artificial Sequence
  Synthetic
aggatgaagaugaagatgactgtgattug

SEQ ID NO: 1472 - DNA, 22 bp, Artificial Sequence
  Synthetic
aaaagugccagcaguaccaaga

SEQ ID NO: 1473 - DNA, 21 bp, Artificial Sequence
  Synthetic
tgggaacguaaagguacagca

SEQ ID NO: 1474 - DNA, 26 bp, Artificial Sequence
  Synthetic
actaaatcaagguttgtctucagcct

SEQ ID NO: 1475 - DNA, 21 bp, Artificial Sequence
  Synthetic
actggcttucagactctgugg

SEQ ID NO: 1476 - DNA, 24 bp, Artificial Sequence
  Synthetic
attttgaacauggcgatgttucgt

SEQ ID NO: 1477 - DNA, 23 bp, Artificial Sequence
  Synthetic
agagttaccutgcaatgcaugga

SEQ ID NO: 1478 - DNA, 29 bp, Artificial Sequence
  Synthetic
cagctacaagaatuaaccaaaacacctua

SEQ ID NO: 1479 - DNA, 21 bp, Artificial Sequence
  Synthetic
ggacaaatgucctggccauct

SEQ ID NO: 1480 - DNA, 28 bp, Artificial Sequence
  Synthetic
cctttcttuaaaaacaagcagccacuaa

SEQ ID NO: 1481 - DNA, 27 bp, Artificial Sequence
  Synthetic
ctagctcttgucgaagatttgagtuct

SEQ ID NO: 1482 - DNA, 22 bp, Artificial Sequence
  Synthetic
cgggaaggauctgtaucaagcc

SEQ ID NO: 1483 - DNA, 25 bp, Artificial Sequence
  Synthetic
tggaguacacaaggcaatgttuact

SEQ ID NO: 1484 - DNA, 25 bp, Artificial Sequence
  Synthetic
tgacataacccugagcttttaagug

SEQ ID NO: 1485 - DNA, 26 bp, Artificial Sequence
  Synthetic
cttgggactguaaaagctgtcgtaua

SEQ ID NO: 1486 - DNA, 29 bp, Artificial Sequence
  Synthetic
gtttatcauacagacacttcattuggagt

SEQ ID NO: 1487 - DNA, 20 bp, Artificial Sequence
  Synthetic
gaggtgcagagugtgtgcua

SEQ ID NO: 1488 - DNA, 27 bp, Artificial Sequence
  Synthetic
caatgacaaagacuctgtattgtuggg

SEQ ID NO: 1489 - DNA, 23 bp, Artificial Sequence
  Synthetic
tttcacaguaagcgcgtatcugt

SEQ ID NO: 1490 - DNA, 32 bp, Artificial Sequence
  Synthetic
ggtaccagtttgtuttattttagatgattguc

SEQ ID NO: 1491 - DNA, 31 bp, Artificial Sequence
  Synthetic
tcgtcttagtgtaauactgtagtggtcatua

SEQ ID NO: 1492 - DNA, 25 bp, Artificial Sequence
  Synthetic
ttgtctuggcgagcagatgtaaaua

SEQ ID NO: 1493 - DNA, 22 bp, Artificial Sequence
  Synthetic
cucatggcuaaaagaaggcagc

SEQ ID NO: 1494 - DNA, 28 bp, Artificial Sequence
  Synthetic
ttgttactgcauacacattgtgacctua

SEQ ID NO: 1495 - DNA, 26 bp, Artificial Sequence
  Synthetic
tcttgctgagagautccacaaagtuc

SEQ ID NO: 1496 - DNA, 24 bp, Artificial Sequence
  Synthetic
gcatcucatcgtaguaagcagaga

SEQ ID NO: 1497 - DNA, 22 bp, Artificial Sequence
  Synthetic
agaggagcugggtaacactgua

SEQ ID NO: 1498 - DNA, 29 bp, Artificial Sequence
  Synthetic
gcccatacacatucaaacacttacaatut

SEQ ID NO: 1499 - DNA, 25 bp, Artificial Sequence
  Synthetic
tcaatcgaggguttcatttgaccuc

SEQ ID NO: 1500 - DNA, 27 bp, Artificial Sequence
  Synthetic
tcctgtttatacugagagcactgauga

SEQ ID NO: 1501 - DNA, 29 bp, Artificial Sequence
  Synthetic
gacacaaagacuggcttacattttgatua

SEQ ID NO: 1502 - DNA, 23 bp, Artificial Sequence
  Synthetic
cagtgagaauacgtccacaccut

SEQ ID NO: 1503 - DNA, 32 bp, Artificial Sequence
  Synthetic
attggagtatcttcuacacaataagtctguat

SEQ ID NO: 1504 - DNA, 22 bp, Artificial Sequence
  Synthetic
tctucaggagcgaaatcuccct

SEQ ID NO: 1505 - DNA, 21 bp, Artificial Sequence
  Synthetic
ctggcaaucgaacgactcuca

SEQ ID NO: 1506 - DNA, 29 bp, Artificial Sequence
  Synthetic
ggaaagtactccagauggattttcttgut

SEQ ID NO: 1507 - DNA, 26 bp, Artificial Sequence
  Synthetic
tgattctttaggcugctctgattcug

SEQ ID NO: 1508 - DNA, 22 bp, Artificial Sequence
  Synthetic
cgggtguattgtgtugaaggga

SEQ ID NO: 1509 - DNA, 27 bp, Artificial Sequence
  Synthetic
ccttctgtaggaauggtatctcgttut

SEQ ID NO: 1510 - DNA, 28 bp, Artificial Sequence
  Synthetic
aaccaactucaccagtaaaacctauacc

SEQ ID NO: 1511 - DNA, 32 bp, Artificial Sequence
  Synthetic
gcttatcattgaagaccutggaattattttuc

SEQ ID NO: 1512 - DNA, 23 bp, Artificial Sequence
  Synthetic
gccaataaaucgaggtcagccua

SEQ ID NO: 1513 - DNA, 29 bp, Artificial Sequence
  Synthetic
tgagagaacucagagaggaattaugagaa

SEQ ID NO: 1514 - DNA, 30 bp, Artificial Sequence
  Synthetic
ccttcaagacucaagggtgataaugaaaaa

SEQ ID NO: 1515 - DNA, 24 bp, Artificial Sequence
  Synthetic
gcaccttccugaatagcttuccaa

SEQ ID NO: 1516 - DNA, 32 bp, Artificial Sequence
  Synthetic
ttgattactggaaaagutcgatctaatucaga

SEQ ID NO: 1517 - DNA, 26 bp, Artificial Sequence
  Synthetic
caggacttgtacutgaggagctatut

SEQ ID NO: 1518 - DNA, 22 bp, Artificial Sequence
  Synthetic
tctccuggccgaaactcaatut

SEQ ID NO: 1519 - DNA, 22 bp, Artificial Sequence
  Synthetic
tggctcauctgtctaccuggag

SEQ ID NO: 1520 - DNA, 24 bp, Artificial Sequence
  Synthetic
catctagaccagcutctcccacua

SEQ ID NO: 1521 - DNA, 28 bp, Artificial Sequence
  Synthetic
ctttgctggtcutccatcattatacuct

SEQ ID NO: 1522 - DNA, 25 bp, Artificial Sequence
  Synthetic
ccacaaauagtacttcucagaccgt

SEQ ID NO: 1523 - DNA, 25 bp, Artificial Sequence
  Synthetic
attacctgugggagatctuccagat

SEQ ID NO: 1524 - DNA, 22 bp, Artificial Sequence
  Synthetic
cuagcagcucaagcaaacacag

SEQ ID NO: 1525 - DNA, 26 bp, Artificial Sequence
  Synthetic
tggaatctcgcutctttgtgttgtua

SEQ ID NO: 1526 - DNA, 24 bp, Artificial Sequence
  Synthetic
ggacaggaaaaggcucagtcauaa

SEQ ID NO: 1527 - DNA, 27 bp, Artificial Sequence
  Synthetic
gaagagctttacucaatctccatguga

SEQ ID NO: 1528 - DNA, 30 bp, Artificial Sequence
  Synthetic
gtggtaccataaaacautcagtaaccttuc

SEQ ID NO: 1529 - DNA, 20 bp, Artificial Sequence
  Synthetic
ttgtgccugaccctgaagut

SEQ ID NO: 1530 - DNA, 20 bp, Artificial Sequence
  Synthetic
agcuccgtggtuccaaacat

SEQ ID NO: 1531 - DNA, 24 bp, Artificial Sequence
  Synthetic
gaagccatgguttttgtcccauag

SEQ ID NO: 1532 - DNA, 21 bp, Artificial Sequence
  Synthetic
gcaaggucacccgttggauac

SEQ ID NO: 1533 - DNA, 21 bp, Artificial Sequence
  Synthetic
ggagttugcagcaaagcguaa

SEQ ID NO: 1534 - DNA, 20 bp, Artificial Sequence
  Synthetic
acagagtgugcctcccugat

SEQ ID NO: 1535 - DNA, 22 bp, Artificial Sequence
  Synthetic
gtaagacacccaccugacugac

SEQ ID NO: 1536 - DNA, 19 bp, Artificial Sequence
  Synthetic
ggugaccagccagcaguag

SEQ ID NO: 1537 - DNA, 23 bp, Artificial Sequence
  Synthetic
ctcaagctgaucatcctcaugga

SEQ ID NO: 1538 - DNA, 21 bp, Artificial Sequence
  Synthetic
ccctgagugccagatcugaat

SEQ ID NO: 1539 - DNA, 28 bp, Artificial Sequence
  Synthetic
gacacaaggcuttcttatctctcuacag

SEQ ID NO: 1540 - DNA, 20 bp, Artificial Sequence
  Synthetic
cccatacucacgaggguggt

SEQ ID NO: 1541 - DNA, 20 bp, Artificial Sequence
  Synthetic
ccgtcagguctcttgcctua

SEQ ID NO: 1542 - DNA, 27 bp, Artificial Sequence
  Synthetic
cccttgaagttuatccagaaaccuacc

SEQ ID NO: 1543 - DNA, 23 bp, Artificial Sequence
  Synthetic
gcttctgcaaguggttctucagt

SEQ ID NO: 1544 - DNA, 25 bp, Artificial Sequence
  Synthetic
gcagaggcuagaacacagaaaacuc

SEQ ID NO: 1545 - DNA, 31 bp, Artificial Sequence
  Synthetic
ggtgaagtattctguttgtcatttgtttgut

SEQ ID NO: 1546 - DNA, 23 bp, Artificial Sequence
  Synthetic
agtcttcccutcggtcttctuct

SEQ ID NO: 1547 - DNA, 21 bp, Artificial Sequence
  Synthetic
gctgggccugttcctucaaaa

SEQ ID NO: 1548 - DNA, 26 bp, Artificial Sequence
  Synthetic
gcttttcuggcacatttttctttucc

SEQ ID NO: 1549 - DNA, 23 bp, Artificial Sequence
  Synthetic
gaacttcttucacccctcaguga

SEQ ID NO: 1550 - DNA, 25 bp, Artificial Sequence
  Synthetic
ttctttttctcugctgtaggucgag

SEQ ID NO: 1551 - DNA, 24 bp, Artificial Sequence
  Synthetic
tggaggccugaagatagaaaguga

SEQ ID NO: 1552 - DNA, 24 bp, Artificial Sequence
  Synthetic
tgatgggatgutactgtccacuga

SEQ ID NO: 1553 - DNA, 29 bp, Artificial Sequence
  Synthetic
agcatacatauttctctgttttucagcct

SEQ ID NO: 1554 - DNA, 25 bp, Artificial Sequence
  Synthetic
catgatcagtcaautgcttcacgua

SEQ ID NO: 1555 - DNA, 20 bp, Artificial Sequence
  Synthetic
agcacuacagcagccaaucc

SEQ ID NO: 1556 - DNA, 26 bp, Artificial Sequence
  Synthetic
catgagaccuggaatgactagagtut

SEQ ID NO: 1557 - DNA, 23 bp, Artificial Sequence
  Synthetic
actaacaguagtggucagaggca

SEQ ID NO: 1558 - DNA, 28 bp, Artificial Sequence
  Synthetic
aagcaaaaaugtcatgctaaugggaaaa

SEQ ID NO: 1559 - DNA, 24 bp, Artificial Sequence
  Synthetic
gaaaggcggaaucaggaaatucag

SEQ ID NO: 1560 - DNA, 27 bp, Artificial Sequence
  Synthetic
cctgatttttccugtctttttctugct

SEQ ID NO: 1561 - DNA, 30 bp, Artificial Sequence
  Synthetic
tgacttacctauacacatctcatcatcugt

SEQ ID NO: 1562 - DNA, 26 bp, Artificial Sequence
  Synthetic
gctgcttttatucctgcaacgtgtua

SEQ ID NO: 1563 - DNA, 29 bp, Artificial Sequence
  Synthetic
gctgagautctttcttttuggaagacaaa

SEQ ID NO: 1564 - DNA, 26 bp, Artificial Sequence
  Synthetic
gacctttgccuttcttccttcatuac

SEQ ID NO: 1565 - DNA, 25 bp, Artificial Sequence
  Synthetic
agataaaagaagccugtccctaugc

SEQ ID NO: 1566 - DNA, 27 bp, Artificial Sequence
  Synthetic
cttgggtgaagcacuactgtacatauc

SEQ ID NO: 1567 - DNA, 27 bp, Artificial Sequence
  Synthetic
tgttagccaagcaaaucaaacaucaaa

SEQ ID NO: 1568 - DNA, 22 bp, Artificial Sequence
  Synthetic
cctgaggutgatttccauggct

SEQ ID NO: 1569 - DNA, 28 bp, Artificial Sequence
  Synthetic
ccttctatgagaacaaugccatctgtua

SEQ ID NO: 1570 - DNA, 26 bp, Artificial Sequence
  Synthetic
gtacacgattugtctcattgguacct

SEQ ID NO: 1571 - DNA, 26 bp, Artificial Sequence
  Synthetic
tctgaaatttgaugtccatgauggct

SEQ ID NO: 1572 - DNA, 24 bp, Artificial Sequence
  Synthetic
agcaatagacugtccctaugcaat

SEQ ID NO: 1573 - DNA, 21 bp, Artificial Sequence
  Synthetic
gctgtaagcugctgcuggaat

SEQ ID NO: 1574 - DNA, 19 bp, Artificial Sequence
  Synthetic
cagtgtucagcctccucgt

SEQ ID NO: 1575 - DNA, 23 bp, Artificial Sequence
  Synthetic
cagcuttggauaaacgggaacag

SEQ ID NO: 1576 - DNA, 22 bp, Artificial Sequence
  Synthetic
cctcaccutcccaagttucaga

SEQ ID NO: 1577 - DNA, 24 bp, Artificial Sequence
  Synthetic
cccaacaacuatcagttctgcuga

SEQ ID NO: 1578 - DNA, 20 bp, Artificial Sequence
  Synthetic
ccctgggaucccttcgctua

SEQ ID NO: 1579 - DNA, 24 bp, Artificial Sequence
  Synthetic
cctcttaccugatcttggccttug

SEQ ID NO: 1580 - DNA, 23 bp, Artificial Sequence
  Synthetic
gtcattcaugatgtcccuagcca

SEQ ID NO: 1581 - DNA, 22 bp, Artificial Sequence
  Synthetic
cctcaggcucagguaggagaag

SEQ ID NO: 1582 - DNA, 27 bp, Artificial Sequence
  Synthetic
tcttctcgagguggatgttcttauagt

SEQ ID NO: 1583 - DNA, 20 bp, Artificial Sequence
  Synthetic
cacaccctuggctgctcuag

SEQ ID NO: 1584 - DNA, 21 bp, Artificial Sequence
  Synthetic
ccctgtgauaggaagctgugg

SEQ ID NO: 1585 - DNA, 27 bp, Artificial Sequence
  Synthetic
gctatgaggguaacagutatacttuca

SEQ ID NO: 1586 - DNA, 19 bp, Artificial Sequence
  Synthetic
cgaaggcuccctcucacct

SEQ ID NO: 1587 - DNA, 20 bp, Artificial Sequence
  Synthetic
catacccugaggtccugagc

SEQ ID NO: 1588 - DNA, 22 bp, Artificial Sequence
  Synthetic
ctcccaguacctacttcccugt

SEQ ID NO: 1589 - DNA, 18 bp, Artificial Sequence
  Synthetic
ggccgcuactccttccug

SEQ ID NO: 1590 - DNA, 20 bp, Artificial Sequence
  Synthetic
gcaggauccctaccgacugt

SEQ ID NO: 1591 - DNA, 22 bp, Artificial Sequence
  Synthetic
tgacccucaacctcgaucaagt

SEQ ID NO: 1592 - DNA, 18 bp, Artificial Sequence
  Synthetic
cactctucaggccuggct

SEQ ID NO: 1593 - DNA, 17 bp, Artificial Sequence
  Synthetic
ccctggcauggctucac

SEQ ID NO: 1594 - DNA, 19 bp, Artificial Sequence
  Synthetic
gctcagugcagcgauaggt

SEQ ID NO: 1595 - DNA, 19 bp, Artificial Sequence
  Synthetic
cggtgaccutgcgatgugt

SEQ ID NO: 1596 - DNA, 19 bp, Artificial Sequence
  Synthetic
caggcaccaggguctcaug

SEQ ID NO: 1597 - DNA, 21 bp, Artificial Sequence
  Synthetic
ctcaaccugctgcttctcuct

SEQ ID NO: 1598 - DNA, 22 bp, Artificial Sequence
  Synthetic
gctaaagcucccactccctgua

SEQ ID NO: 1599 - DNA, 25 bp, Artificial Sequence
  Synthetic
tgacctccaccuctatccgtatuag

SEQ ID NO: 1600 - DNA, 21 bp, Artificial Sequence
  Synthetic
gatgcggguctctgagtugag

SEQ ID NO: 1601 - DNA, 20 bp, Artificial Sequence
  Synthetic
accgccuacttcctguacca

SEQ ID NO: 1602 - DNA, 28 bp, Artificial Sequence
  Synthetic
agtgaatgcacguaagtatttagctuca

SEQ ID NO: 1603 - DNA, 21 bp, Artificial Sequence
  Synthetic
ctggccagugctaactuggaa

SEQ ID NO: 1604 - DNA, 19 bp, Artificial Sequence
  Synthetic
ggtggugctgctatcugct

SEQ ID NO: 1605 - DNA, 27 bp, Artificial Sequence
  Synthetic
ggatgggauagcattgaatctcaucaa

SEQ ID NO: 1606 - DNA, 27 bp, Artificial Sequence
  Synthetic
acgaatacugacagcaatgctgttaut

SEQ ID NO: 1607 - DNA, 28 bp, Artificial Sequence
  Synthetic
gaatttcttaatgcauccaaagcctuct

SEQ ID NO: 1608 - DNA, 29 bp, Artificial Sequence
  Synthetic
aaccatcatttucacaaatttaggcacut

SEQ ID NO: 1609 - DNA, 21 bp, Artificial Sequence
  Synthetic
guctcatcguggaaggcaaga

SEQ ID NO: 1610 - DNA, 22 bp, Artificial Sequence
  Synthetic
gcatttcgggutctttcucgga

SEQ ID NO: 1611 - DNA, 17 bp, Artificial Sequence
  Synthetic
tcctgccugcgggagua

SEQ ID NO: 1612 - DNA, 25 bp, Artificial Sequence
  Synthetic
ctactttatgaauggagaggcugct

SEQ ID NO: 1613 - DNA, 21 bp, Artificial Sequence
  Synthetic
catguacccgccatccaugat

SEQ ID NO: 1614 - DNA, 26 bp, Artificial Sequence
  Synthetic
cctctgatatcucaagctttccttut

SEQ ID NO: 1615 - DNA, 22 bp, Artificial Sequence
  Synthetic
ccctgaccaucgaaaaactgug

SEQ ID NO: 1616 - DNA, 19 bp, Artificial Sequence
  Synthetic
gtacguagcgctccuccag

SEQ ID NO: 1617 - DNA, 18 bp, Artificial Sequence
  Synthetic
ctgttcgcugcccgagua

SEQ ID NO: 1618 - DNA, 18 bp, Artificial Sequence
  Synthetic
cgcacccacugcatcuct

SEQ ID NO: 1619 - DNA, 17 bp, Artificial Sequence
  Synthetic
gctgcuccgcgttguca

SEQ ID NO: 1620 - DNA, 25 bp, Artificial Sequence
  Synthetic
cctcttgaugttcttcucacacacc

SEQ ID NO: 1621 - DNA, 18 bp, Artificial Sequence
  Synthetic
gcugaccaaagccgcugt

SEQ ID NO: 1622 - DNA, 18 bp, Artificial Sequence
  Synthetic
ctcugcaccagcgtctug

SEQ ID NO: 1623 - DNA, 17 bp, Artificial Sequence
  Synthetic
tcugaccgccacccuct

SEQ ID NO: 1624 - DNA, 17 bp, Artificial Sequence
  Synthetic
agatcccugccccugct

SEQ ID NO: 1625 - DNA, 19 bp, Artificial Sequence
  Synthetic
tgaggcucctctctucgct

SEQ ID NO: 1626 - DNA, 17 bp, Artificial Sequence
  Synthetic
acgguggagggagguct

SEQ ID NO: 1627 - DNA, 20 bp, Artificial Sequence
  Synthetic
aaacgctguctctgctcucc

SEQ ID NO: 1628 - DNA, 25 bp, Artificial Sequence
  Synthetic
gagaacttccugaacatgaggtuga

SEQ ID NO: 1629 - DNA, 19 bp, Artificial Sequence
  Synthetic
gccaccccuggtactgaug

SEQ ID NO: 1630 - DNA, 18 bp, Artificial Sequence
  Synthetic
ccggcucacagacccuct

SEQ ID NO: 1631 - DNA, 20 bp, Artificial Sequence
  Synthetic
tucttccaccucggaggagt

SEQ ID NO: 1632 - DNA, 17 bp, Artificial Sequence
  Synthetic
cugaaggagccgguggt

SEQ ID NO: 1633 - DNA, 20 bp, Artificial Sequence
  Synthetic
gacccugggaaaggactgug

SEQ ID NO: 1634 - DNA, 20 bp, Artificial Sequence
  Synthetic
gutcatcgttucccccaacc

SEQ ID NO: 1635 - DNA, 22 bp, Artificial Sequence
  Synthetic
aacuggagcgggagaaugaaat

SEQ ID NO: 1636 - DNA, 20 bp, Artificial Sequence
  Synthetic
gcgtagcgcauggctaagut

SEQ ID NO: 1637 - DNA, 22 bp, Artificial Sequence
  Synthetic
agaagaagcagaugacgcugac

SEQ ID NO: 1638 - DNA, 23 bp, Artificial Sequence
  Synthetic
ttcccagucaccagtttguacag

SEQ ID NO: 1639 - DNA, 21 bp, Artificial Sequence
  Synthetic
ccacagagacutgcgtuccat

SEQ ID NO: 1640 - DNA, 22 bp, Artificial Sequence
  Synthetic
ggataacagaugccgaguacct

SEQ ID NO: 1641 - DNA, 24 bp, Artificial Sequence
  Synthetic
tcutccttttcagaucccaagcac

SEQ ID NO: 1642 - DNA, 30 bp, Artificial Sequence
  Synthetic
gtggcgtttaaaguatgatgttcagatuaa

SEQ ID NO: 1643 - DNA, 27 bp, Artificial Sequence
  Synthetic
caggccagcuatgaactatgauaaact

SEQ ID NO: 1644 - DNA, 29 bp, Artificial Sequence
  Synthetic
agcgaaggtaaucactccatcttuaaaaa

SEQ ID NO: 1645 - DNA, 24 bp, Artificial Sequence
  Synthetic
ccacaggcugtatgttugaaaagg

SEQ ID NO: 1646 - DNA, 22 bp, Artificial Sequence
  Synthetic
cttaaagccutgtggugggaag

SEQ ID NO: 1647 - DNA, 27 bp, Artificial Sequence
  Synthetic
ccgtttcatcugaaacacactctctua

SEQ ID NO: 1648 - DNA, 25 bp, Artificial Sequence
  Synthetic
ctttaccugacattguacaggcact

SEQ ID NO: 1649 - DNA, 19 bp, Artificial Sequence
  Synthetic
tttcatggccugccacuga

SEQ ID NO: 1650 - DNA, 26 bp, Artificial Sequence
  Synthetic
gacactugcacttaaatctugaagca

SEQ ID NO: 1651 - DNA, 23 bp, Artificial Sequence
  Synthetic
tgtaccuccagagacctccuaga

SEQ ID NO: 1652 - DNA, 22 bp, Artificial Sequence
  Synthetic
tggtgaccaugtaaggcactug

SEQ ID NO: 1653 - DNA, 24 bp, Artificial Sequence
  Synthetic
ctaaaagccaucttgttccccuct

SEQ ID NO: 1654 - DNA, 26 bp, Artificial Sequence
  Synthetic
ctccagaggaugttcaataactguga

SEQ ID NO: 1655 - DNA, 21 bp, Artificial Sequence
  Synthetic
tcaaguggaattcugcccagg

SEQ ID NO: 1656 - DNA, 20 bp, Artificial Sequence
  Synthetic
caguggcgggacatagucag

SEQ ID NO: 1657 - DNA, 21 bp, Artificial Sequence
  Synthetic
gctgtagagcugtcccccaua

SEQ ID NO: 1658 - DNA, 21 bp, Artificial Sequence
  Synthetic
gtgtggcgcugagtgtactua

SEQ ID NO: 1659 - DNA, 21 bp, Artificial Sequence
  Synthetic
cacatccauctggtacguggt

SEQ ID NO: 1660 - DNA, 28 bp, Artificial Sequence
  Synthetic
tccctagctatucttaatccaacaaaug

SEQ ID NO: 1661 - DNA, 28 bp, Artificial Sequence
  Synthetic
ggaggtgcaguttttgaagtgtttaaua

SEQ ID NO: 1662 - DNA, 24 bp, Artificial Sequence
  Synthetic
aaaagaaactccuacgtggtgugt

SEQ ID NO: 1663 - DNA, 22 bp, Artificial Sequence
  Synthetic
ggctttggcugtggtcaactua

SEQ ID NO: 1664 - DNA, 20 bp, Artificial Sequence
  Synthetic
ctgactgcugtgacccacuc

SEQ ID NO: 1665 - DNA, 20 bp, Artificial Sequence
  Synthetic
ttgcacttguccacgcatuc

SEQ ID NO: 1666 - DNA, 21 bp, Artificial Sequence
  Synthetic
cagtgugcccactacatugac

SEQ ID NO: 1667 - DNA, 25 bp, Artificial Sequence
  Synthetic
tgttctgttcuccttcacttuccac

SEQ ID NO: 1668 - DNA, 25 bp, Artificial Sequence
  Synthetic
cttaggatggaucccttctcttcug

SEQ ID NO: 1669 - DNA, 21 bp, Artificial Sequence
  Synthetic
aacagacacgugaaggcauga

SEQ ID NO: 1670 - DNA, 19 bp, Artificial Sequence
  Synthetic
atcggccucttcaugcgaa

SEQ ID NO: 1671 - DNA, 18 bp, Artificial Sequence
  Synthetic
gctggcccutgttccugt

SEQ ID NO: 1672 - DNA, 24 bp, Artificial Sequence
  Synthetic
aaaattcccgucgctaucaaggaa

SEQ ID NO: 1673 - DNA, 22 bp, Artificial Sequence
  Synthetic
ggagaugagcagggtcuagagc

SEQ ID NO: 1674 - DNA, 23 bp, Artificial Sequence
  Synthetic
aggaacguactggugaaaacacc

SEQ ID NO: 1675 - DNA, 22 bp, Artificial Sequence
  Synthetic
caggaaaatgcuggctgaccua

SEQ ID NO: 1676 - DNA, 26 bp, Artificial Sequence
  Synthetic
ttcttccagtgutctaattgcacugt

SEQ ID NO: 1677 - DNA, 24 bp, Artificial Sequence
  Synthetic
tggaagcacagacugcaatttgua

SEQ ID NO: 1678 - DNA, 19 bp, Artificial Sequence
  Synthetic
cccugaccggagtaaccut

SEQ ID NO: 1679 - DNA, 22 bp, Artificial Sequence
  Synthetic
tgttuccagacaagccacucac

SEQ ID NO: 1680 - DNA, 22 bp, Artificial Sequence
  Synthetic
gcaggacutcttucccaaggaa

SEQ ID NO: 1681 - DNA, 25 bp, Artificial Sequence
  Synthetic
ttttagggcucatactatccuccgt

SEQ ID NO: 1682 - DNA, 23 bp, Artificial Sequence
  Synthetic
ccagcctaauagttctggcucct

SEQ ID NO: 1683 - DNA, 26 bp, Artificial Sequence
  Synthetic
gtgtgtggaaguttcatgtacgtuac

SEQ ID NO: 1684 - DNA, 24 bp, Artificial Sequence
  Synthetic
agtcttcataggugtggtagcuca

SEQ ID NO: 1685 - DNA, 20 bp, Artificial Sequence
  Synthetic
gucccaaagagcaccacuca

SEQ ID NO: 1686 - DNA, 20 bp, Artificial Sequence
  Synthetic
gccttccuacactcacugct

SEQ ID NO: 1687 - DNA, 21 bp, Artificial Sequence
  Synthetic
ccagaagguggttggagaguc

SEQ ID NO: 1688 - DNA, 22 bp, Artificial Sequence
  Synthetic
cagtggugatgtcugcacagat

SEQ ID NO: 1689 - DNA, 22 bp, Artificial Sequence
  Synthetic
agtgacgugaggctttcctuac

SEQ ID NO: 1690 - DNA, 21 bp, Artificial Sequence
  Synthetic
tgcatucaggaccaactguca

SEQ ID NO: 1691 - DNA, 20 bp, Artificial Sequence
  Synthetic
ccugggacaccaactacucc

SEQ ID NO: 1692 - DNA, 21 bp, Artificial Sequence
  Synthetic
ccaatccaucagcatcccuca

SEQ ID NO: 1693 - DNA, 20 bp, Artificial Sequence
  Synthetic
cuccgacuccgacaccaaag

SEQ ID NO: 1694 - DNA, 24 bp, Artificial Sequence
  Synthetic
ctcaatctugcagggttagtucct

SEQ ID NO: 1695 - DNA, 18 bp, Artificial Sequence
  Synthetic
acuccaccagggccaaug

SEQ ID NO: 1696 - DNA, 20 bp, Artificial Sequence
  Synthetic
gcatcccuggacttggagut

SEQ ID NO: 1697 - DNA, 21 bp, Artificial Sequence
  Synthetic
ggagggauctccttcccugag

SEQ ID NO: 1698 - DNA, 22 bp, Artificial Sequence
  Synthetic
ctttcugaccagcggagtcuaa

SEQ ID NO: 1699 - DNA, 27 bp, Artificial Sequence
  Synthetic
actcactgattucagaacaactcucac

SEQ ID NO: 1700 - DNA, 22 bp, Artificial Sequence
  Synthetic
gggatuagagccgaaacugaga

SEQ ID NO: 1701 - DNA, 21 bp, Artificial Sequence
  Synthetic
cgttgatgaggucgtgaguca

SEQ ID NO: 1702 - DNA, 22 bp, Artificial Sequence
  Synthetic
ttcttagctugcccagttucga

SEQ ID NO: 1703 - DNA, 27 bp, Artificial Sequence
  Synthetic
caatattcaaaucatggtgtgcugaca

SEQ ID NO: 1704 - DNA, 28 bp, Artificial Sequence
  Synthetic
atctctctcccuaaggaatattgcuaat

SEQ ID NO: 1705 - DNA, 25 bp, Artificial Sequence
  Synthetic
gccaactcacuttccatcatctcua

SEQ ID NO: 1706 - DNA, 29 bp, Artificial Sequence
  Synthetic
cagctugaagaacaagaucacttatuaga

SEQ ID NO: 1707 - DNA, 25 bp, Artificial Sequence
  Synthetic
gcttctacaagutagctgactucct

SEQ ID NO: 1708 - DNA, 30 bp, Artificial Sequence
  Synthetic
ggagaaatggagaaugctttaaggtcauat

SEQ ID NO: 1709 - DNA, 27 bp, Artificial Sequence
  Synthetic
gtcctagttcutccttgagttttucct

SEQ ID NO: 1710 - DNA, 31 bp, Artificial Sequence
  Synthetic
aggaacuagaattaaaacaugaagcagaagt

SEQ ID NO: 1711 - DNA, 28 bp, Artificial Sequence
  Synthetic
tggaaagctctucttcgtgactaaauag

SEQ ID NO: 1712 - DNA, 29 bp, Artificial Sequence
  Synthetic
gaagaaaaagaaaaggguacactugaaca

SEQ ID NO: 1713 - DNA, 27 bp, Artificial Sequence
  Synthetic
ttctctgctucaagttgtgcaaattut

SEQ ID NO: 1714 - DNA, 26 bp, Artificial Sequence
  Synthetic
ccaaagacuctgtgugggaaaaagaa

SEQ ID NO: 1715 - DNA, 29 bp, Artificial Sequence
  Synthetic
agcatactcctcutgtaactcttgauagt

SEQ ID NO: 1716 - DNA, 29 bp, Artificial Sequence
  Synthetic
ccaactacagugaaaatgaaaagttcugt

SEQ ID NO: 1717 - DNA, 24 bp, Artificial Sequence
  Synthetic
tctcgcttggutacctcaagttut

SEQ ID NO: 1718 - DNA, 27 bp, Artificial Sequence
  Synthetic
gggcagaaaatguacagtcatgtgaua

SEQ ID NO: 1719 - DNA, 30 bp, Artificial Sequence
  Synthetic
cttccaccautatttttgattctucaccaa

SEQ ID NO: 1720 - DNA, 28 bp, Artificial Sequence
  Synthetic
gtggatcaggutcgtgaatatauggaaa

SEQ ID NO: 1721 - DNA, 30 bp, Artificial Sequence
  Synthetic
gtctgtagttcuaactggtgtattttcuga

SEQ ID NO: 1722 - DNA, 24 bp, Artificial Sequence
  Synthetic
cctcttugcagcaacagtugaaag

SEQ ID NO: 1723 - DNA, 29 bp, Artificial Sequence
  Synthetic
actgttgaaugaagctataagcagaugaa

SEQ ID NO: 1724 - DNA, 28 bp, Artificial Sequence
  Synthetic
tgtgtgucagcaagaauaacattattut

SEQ ID NO: 1725 - DNA, 31 bp, Artificial Sequence
  Synthetic
catgttctcctaacuctttactaagtggtut

SEQ ID NO: 1726 - DNA, 25 bp, Artificial Sequence
  Synthetic
catcaacagguaacggaautgtuaa

SEQ ID NO: 1727 - DNA, 21 bp, Artificial Sequence
  Synthetic
gggacuacaagaccctuacct

SEQ ID NO: 1728 - DNA, 25 bp, Artificial Sequence
  Synthetic
gccatgtcctugggattctagauag

SEQ ID NO: 1729 - DNA, 29 bp, Artificial Sequence
  Synthetic
aactcagcagatutgttgaaatgattgut

SEQ ID NO: 1730 - DNA, 25 bp, Artificial Sequence
  Synthetic
ctctttgttuagcttgaacaugcga

SEQ ID NO: 1731 - DNA, 20 bp, Artificial Sequence
  Synthetic
gcccuggactcctcaugaag

SEQ ID NO: 1732 - DNA, 26 bp, Artificial Sequence
  Synthetic
caatgtcaagcugaaaaagtacguga

SEQ ID NO: 1733 - DNA, 28 bp, Artificial Sequence
  Synthetic
gcttggttttgcugtcttaaatccatua

SEQ ID NO: 1734 - DNA, 28 bp, Artificial Sequence
  Synthetic
ttgcctctuatatttcaggtugaacagt

SEQ ID NO: 1735 - DNA, 30 bp, Artificial Sequence
  Synthetic
ttctcttactcugaactccagtttctcuat

SEQ ID NO: 1736 - DNA, 24 bp, Artificial Sequence
  Synthetic
gccaugtctacucaagaccaacat

SEQ ID NO: 1737 - DNA, 27 bp, Artificial Sequence
  Synthetic
ctgttgtaatttuaagttgctgcugga

SEQ ID NO: 1738 - DNA, 28 bp, Artificial Sequence
  Synthetic
atcagctaacacaggaautattcagcut

SEQ ID NO: 1739 - DNA, 27 bp, Artificial Sequence
  Synthetic
gagcatcctctguaaggactacttcua

SEQ ID NO: 1740 - DNA, 28 bp, Artificial Sequence
  Synthetic
gaaaatagtugaagaaaaagtggcugct

SEQ ID NO: 1741 - DNA, 26 bp, Artificial Sequence
  Synthetic
tgaccccaacucatcttctcttagut

SEQ ID NO: 1742 - DNA, 25 bp, Artificial Sequence
  Synthetic
agctatuggagggcaaugagaaaaa

SEQ ID NO: 1743 - DNA, 26 bp, Artificial Sequence
  Synthetic
attagcaaucagcttagtttctuggg

SEQ ID NO: 1744 - DNA, 28 bp, Artificial Sequence
  Synthetic
cagaggcaaaagagaaautgtccattut

SEQ ID NO: 1745 - DNA, 25 bp, Artificial Sequence
  Synthetic
aatttgtggaguctgattgctgcua

SEQ ID NO: 1746 - DNA, 25 bp, Artificial Sequence
  Synthetic
gggtcagggaauttatctuacacac

SEQ ID NO: 1747 - DNA, 27 bp, Artificial Sequence
  Synthetic
aacatagaaacaacacuggctgagtua

SEQ ID NO: 1748 - DNA, 23 bp, Artificial Sequence
  Synthetic
ctcatgagagcutctcagacugg

SEQ ID NO: 1749 - DNA, 26 bp, Artificial Sequence
  Synthetic
accaactgcauctgtagtaccuagag

SEQ ID NO: 1750 - DNA, 31 bp, Artificial Sequence
  Synthetic
tggaatataatauacagcagaagcagtcuca

SEQ ID NO: 1751 - DNA, 22 bp, Artificial Sequence
  Synthetic
tgtgcaagcucactcttcagut

SEQ ID NO: 1752 - DNA, 29 bp, Artificial Sequence
  Synthetic
aatttgattttcucgtaccaggatcugaa

SEQ ID NO: 1753 - DNA, 25 bp, Artificial Sequence
  Synthetic
ctgggcatcauatagcattctcugt

SEQ ID NO: 1754 - DNA, 25 bp, Artificial Sequence
  Synthetic
gcaaatggaaaaagauaggcaggut

SEQ ID NO: 1755 - DNA, 29 bp, Artificial Sequence
  Synthetic
gctgtcctucaaggtctaacttauaaact

SEQ ID NO: 1756 - DNA, 29 bp, Artificial Sequence
  Synthetic
gggttcutcaacagaaaauagaaggagaa

SEQ ID NO: 1757 - DNA, 26 bp, Artificial Sequence
  Synthetic
gctacacatugaagcttttgtcugat

SEQ ID NO: 1758 - DNA, 29 bp, Artificial Sequence
  Synthetic
gcattattcacauccatttgtgctuaagt

SEQ ID NO: 1759 - DNA, 23 bp, Artificial Sequence
  Synthetic
cctgtcagcucagcattttguct

SEQ ID NO: 1760 - DNA, 27 bp, Artificial Sequence
  Synthetic
ggaacagagaaaaautgactcuccaga

SEQ ID NO: 1761 - DNA, 25 bp, Artificial Sequence
  Synthetic
cagctgugatgtttagaugggagat

SEQ ID NO: 1762 - DNA, 28 bp, Artificial Sequence
  Synthetic
gggctgtgaaautttatcttggaatcut

SEQ ID NO: 1763 - DNA, 28 bp, Artificial Sequence
  Synthetic
ctattttgactucaccttgattcagucc

SEQ ID NO: 1764 - DNA, 26 bp, Artificial Sequence
  Synthetic
tgttctcagcutcagaattacgaucc

SEQ ID NO: 1765 - DNA, 21 bp, Artificial Sequence
  Synthetic
ggtgcugccaagatgtggtua

SEQ ID NO: 1766 - DNA, 21 bp, Artificial Sequence
  Synthetic
ctccgcaggaucagctuaagg

SEQ ID NO: 1767 - DNA, 25 bp, Artificial Sequence
  Synthetic
ccagccaaaagaauatctgccuaca

SEQ ID NO: 1768 - DNA, 29 bp, Artificial Sequence
  Synthetic
tgtcagaggaaagucactgtaaatgttut

SEQ ID NO: 1769 - DNA, 25 bp, Artificial Sequence
  Synthetic
ttcttttaggccuctttttcgugga

SEQ ID NO: 1770 - DNA, 28 bp, Artificial Sequence
  Synthetic
tttcauaaggaaagaaagucattgctua

SEQ ID NO: 1771 - DNA, 27 bp, Artificial Sequence
  Synthetic
gtttgaacatgucgatcaagactugac

SEQ ID NO: 1772 - DNA, 17 bp, Artificial Sequence
  Synthetic
tgguggagagcggcaug

SEQ ID NO: 1773 - DNA, 17 bp, Artificial Sequence
  Synthetic
cgcgcugaccagcagua

SEQ ID NO: 1774 - DNA, 29 bp, Artificial Sequence
  Synthetic
ttattttccttttgutgctactctccuga

SEQ ID NO: 1775 - DNA, 21 bp, Artificial Sequence
  Synthetic
gaatcgggcuggttuccaaac

SEQ ID NO: 1776 - DNA, 26 bp, Artificial Sequence
  Synthetic
actggagcctugtatatagacgguaa

SEQ ID NO: 1777 - DNA, 32 bp, Artificial Sequence
  Synthetic
gatgtatatgcattuggaattgttctgtauga

SEQ ID NO: 1778 - DNA, 32 bp, Artificial Sequence
  Synthetic
acataaugtgaagacaaaaugcagaagaaaaa

SEQ ID NO: 1779 - DNA, 25 bp, Artificial Sequence
  Synthetic
gagtccttuagccctactcaggtua

SEQ ID NO: 1780 - DNA, 27 bp, Artificial Sequence
  Synthetic
ctggaaaagaguaattcacacaagcuc

SEQ ID NO: 1781 - DNA, 28 bp, Artificial Sequence
  Synthetic
tgacacttggaguaacaattgcctttua

SEQ ID NO: 1782 - DNA, 25 bp, Artificial Sequence
  Synthetic
ggagatttcugtaaggcttucacgt

SEQ ID NO: 1783 - DNA, 27 bp, Artificial Sequence
  Synthetic
agtctaaataucccccaaccttcuacc

SEQ ID NO: 1784 - DNA, 24 bp, Artificial Sequence
  Synthetic
gauccaaaagaaagcggtucaagt

SEQ ID NO: 1785 - DNA, 24 bp, Artificial Sequence
  Synthetic
ttcttugaacaccacccaauacca

SEQ ID NO: 1786 - DNA, 30 bp, Artificial Sequence
  Synthetic
tgtaaagatacauacaaagttgtgtgtugt

SEQ ID NO: 1787 - DNA, 26 bp, Artificial Sequence
  Synthetic
ccaagaaaggcutgtgtctacattut

SEQ ID NO: 1788 - DNA, 28 bp, Artificial Sequence
  Synthetic
cacatctgugggattttgaaaaacugaa

SEQ ID NO: 1789 - DNA, 30 bp, Artificial Sequence
  Synthetic
ccaacaaagagaauaacagutattggaauc

SEQ ID NO: 1790 - DNA, 23 bp, Artificial Sequence
  Synthetic
ccaccaaauttgtccaauagggc

SEQ ID NO: 1791 - DNA, 25 bp, Artificial Sequence
  Synthetic
gaacactggcagutactgtgatgua

SEQ ID NO: 1792 - DNA, 23 bp, Artificial Sequence
  Synthetic
ggagguagcagatgucaagggat

SEQ ID NO: 1793 - DNA, 24 bp, Artificial Sequence
  Synthetic
gctttgttgugttaagtcucagca

SEQ ID NO: 1794 - DNA, 33 bp, Artificial Sequence
  Synthetic
taaagtaaagttagtauatacaatgccaccuga

SEQ ID NO: 1795 - DNA, 23 bp, Artificial Sequence
  Synthetic
catctattgcuggcaccatcuga

SEQ ID NO: 1796 - DNA, 26 bp, Artificial Sequence
  Synthetic
gcaattgcaucaaagcaacaaauact

SEQ ID NO: 1797 - DNA, 25 bp, Artificial Sequence
  Synthetic
cggctccuctaaccatgttuacaac

SEQ ID NO: 1798 - DNA, 28 bp, Artificial Sequence
  Synthetic
aagaautttctttgttuggacaacgagt

SEQ ID NO: 1799 - DNA, 26 bp, Artificial Sequence
  Synthetic
ctcaatgttuagagtcctcatuggca

SEQ ID NO: 1800 - DNA, 22 bp, Artificial Sequence
  Synthetic
ttattgggaagccgucctctuc

SEQ ID NO: 1801 - DNA, 26 bp, Artificial Sequence
  Synthetic
tgagttttagaacuttgccctgaugt

SEQ ID NO: 1802 - DNA, 25 bp, Artificial Sequence
  Synthetic
agcgtatgaaaggagugtaagctut

SEQ ID NO: 1803 - DNA, 29 bp, Artificial Sequence
  Synthetic
atgtcagauataaagaacucaccgaacag

SEQ ID NO: 1804 - DNA, 27 bp, Artificial Sequence
  Synthetic
ctccagatcttuctgcttttcttcuct

SEQ ID NO: 1805 - DNA, 23 bp, Artificial Sequence
  Synthetic
tgcttctccugtgtgtttcugac

SEQ ID NO: 1806 - DNA, 24 bp, Artificial Sequence
  Synthetic
ctgaggucaatgatttccucccaa

SEQ ID NO: 1807 - DNA, 25 bp, Artificial Sequence
  Synthetic
agaauggaaacagcgaaggauacag

SEQ ID NO: 1808 - DNA, 21 bp, Artificial Sequence
  Synthetic
ccccgcucctcactgtaaaut

SEQ ID NO: 1809 - DNA, 25 bp, Artificial Sequence
  Synthetic
ggtgcatgaguttcttcacattuca

SEQ ID NO: 1810 - DNA, 23 bp, Artificial Sequence
  Synthetic
gacagggaaaggugttccactua

SEQ ID NO: 1811 - DNA, 25 bp, Artificial Sequence
  Synthetic
tgtgggtacugactaatttuaggct

SEQ ID NO: 1812 - DNA, 22 bp, Artificial Sequence
  Synthetic
ttgtgagggacagucacctgua

SEQ ID NO: 1813 - DNA, 29 bp, Artificial Sequence
  Synthetic
aactacgatgucatgaaagatttugagga

SEQ ID NO: 1814 - DNA, 30 bp, Artificial Sequence
  Synthetic
ttttgtcattctgcucatctaagttttugg

SEQ ID NO: 1815 - DNA, 24 bp, Artificial Sequence
  Synthetic
aaataccgagacautgagcgacut

SEQ ID NO: 1816 - DNA, 26 bp, Artificial Sequence
  Synthetic
gttcatgagaaugtcctcacaatugg

SEQ ID NO: 1817 - DNA, 24 bp, Artificial Sequence
  Synthetic
ctgtctcagaaguccacttgucat

SEQ ID NO: 1818 - DNA, 22 bp, Artificial Sequence
  Synthetic
gctccacaguggttccacauat

SEQ ID NO: 1819 - DNA, 23 bp, Artificial Sequence
  Synthetic
ctaatgagccccaucccttucag

SEQ ID NO: 1820 - DNA, 29 bp, Artificial Sequence
  Synthetic
ctccaggatgttugttccatattaaacug

SEQ ID NO: 1821 - DNA, 23 bp, Artificial Sequence
  Synthetic
ctactctgacugccaccatctut

SEQ ID NO: 1822 - DNA, 20 bp, Artificial Sequence
  Synthetic
gcttcggucctcagcccuat

SEQ ID NO: 1823 - DNA, 28 bp, Artificial Sequence
  Synthetic
atttgctgtttacucctcttctcttuct

SEQ ID NO: 1824 - DNA, 23 bp, Artificial Sequence
  Synthetic
cctgtccugggatgatcctuaga

SEQ ID NO: 1825 - DNA, 20 bp, Artificial Sequence
  Synthetic
ggcactuggcctgacuacac

SEQ ID NO: 1826 - DNA, 23 bp, Artificial Sequence
  Synthetic
gtgaaaucgaagcaggacuccat

SEQ ID NO: 1827 - DNA, 20 bp, Artificial Sequence
  Synthetic
cccttcgtuccttgggauca

SEQ ID NO: 1828 - DNA, 30 bp, Artificial Sequence
  Synthetic
ggcaggacattuttaaaagctctatttuct

SEQ ID NO: 1829 - DNA, 18 bp, Artificial Sequence
  Synthetic
gccctcugcagacauccc

SEQ ID NO: 1830 - DNA, 16 bp, Artificial Sequence
  Synthetic
caucgcgcacguccag

SEQ ID NO: 1831 - DNA, 17 bp, Artificial Sequence
  Synthetic
agctgcugctgcuccac

SEQ ID NO: 1832 - DNA, 19 bp, Artificial Sequence
  Synthetic
ctcuacccacctggaucgg

SEQ ID NO: 1833 - DNA, 17 bp, Artificial Sequence
  Synthetic
ggagccutcggcugact

SEQ ID NO: 1834 - DNA, 21 bp, Artificial Sequence
  Synthetic
ccucagtagcaucagcacgag

SEQ ID NO: 1835 - DNA, 20 bp, Artificial Sequence
  Synthetic
tcttggugaccctccggaut

SEQ ID NO: 1836 - DNA, 20 bp, Artificial Sequence
  Synthetic
cagacaggcutgcaggctua

SEQ ID NO: 1837 - DNA, 18 bp, Artificial Sequence
  Synthetic
cgacgtugcaggguacct

SEQ ID NO: 1838 - DNA, 21 bp, Artificial Sequence
  Synthetic
gcctgtttuacgcgtggaaug

SEQ ID NO: 1839 - DNA, 17 bp, Artificial Sequence
  Synthetic
gcgcgauccagguagct

SEQ ID NO: 1840 - DNA, 20 bp, Artificial Sequence
  Synthetic
ggcgcacuctctccttccua

SEQ ID NO: 1841 - DNA, 22 bp, Artificial Sequence
  Synthetic
gcttttucccagaagcaaucca

SEQ ID NO: 1842 - DNA, 28 bp, Artificial Sequence
  Synthetic
tgcaaugaagaaaggttcucaacaaaaa

SEQ ID NO: 1843 - DNA, 24 bp, Artificial Sequence
  Synthetic
caccactgucctccagaaugaaaa

SEQ ID NO: 1844 - DNA, 31 bp, Artificial Sequence
  Synthetic
tgtcaagtcatcugttgtgtaaagtatucat

SEQ ID NO: 1845 - DNA, 28 bp, Artificial Sequence
  Synthetic
gttcacgtaatuttaacagcttguccaa

SEQ ID NO: 1846 - DNA, 29 bp, Artificial Sequence
  Synthetic
tcatttcagcuccaagatataagcaagut

SEQ ID NO: 1847 - DNA, 21 bp, Artificial Sequence
  Synthetic
gagtggttacuggctgaccut

SEQ ID NO: 1848 - DNA, 28 bp, Artificial Sequence
  Synthetic
attaaaagaggaggccaugtuacagaaa

SEQ ID NO: 1849 - DNA, 25 bp, Artificial Sequence
  Synthetic
cccaagggcaaagaautatctguct

SEQ ID NO: 1850 - DNA, 23 bp, Artificial Sequence
  Synthetic
tgauaaagccccagaugaaagcc

SEQ ID NO: 1851 - DNA, 22 bp, Artificial Sequence
  Synthetic
gtgtggccuctcaagttcaugt

SEQ ID NO: 1852 - DNA, 27 bp, Artificial Sequence
  Synthetic
agauggaaaaguaaaagcaggaaatug

SEQ ID NO: 1853 - DNA, 28 bp, Artificial Sequence
  Synthetic
actctgatgcuaacaatgatgagacaug

SEQ ID NO: 1854 - DNA, 23 bp, Artificial Sequence
  Synthetic
gcaaaugaagcccugaagaagga

SEQ ID NO: 1855 - DNA, 21 bp, Artificial Sequence
  Synthetic
ggtctctcucctgctcgacut

SEQ ID NO: 1856 - DNA, 27 bp, Artificial Sequence
  Synthetic
gctgttttacacuttcatgtcatugct

SEQ ID NO: 1857 - DNA, 26 bp, Artificial Sequence
  Synthetic
tcttgctccttutcttctgagaacug

SEQ ID NO: 1858 - DNA, 27 bp, Artificial Sequence
  Synthetic
cacatttataccauttttcccccucct

SEQ ID NO: 1859 - DNA, 27 bp, Artificial Sequence
  Synthetic
gccatttcttcutggagttttctcuct

SEQ ID NO: 1860 - DNA, 26 bp, Artificial Sequence
  Synthetic
gcttacatcugaattcattccugcca

SEQ ID NO: 1861 - DNA, 28 bp, Artificial Sequence
  Synthetic
acggctttcttuagtttcttcagttcut

SEQ ID NO: 1862 - DNA, 26 bp, Artificial Sequence
  Synthetic
tgaattcatuggcaactttgtatgug

SEQ ID NO: 1863 - DNA, 26 bp, Artificial Sequence
  Synthetic
ctttgtcgtuccattgtctcatucag

SEQ ID NO: 1864 - DNA, 22 bp, Artificial Sequence
  Synthetic
agtgtgctcugctgtcattugt

SEQ ID NO: 1865 - DNA, 21 bp, Artificial Sequence
  Synthetic
ttgactgccutccttcccauc

SEQ ID NO: 1866 - DNA, 22 bp, Artificial Sequence
  Synthetic
ccaaacaauagccgacctcuca

SEQ ID NO: 1867 - DNA, 25 bp, Artificial Sequence
  Synthetic
ctaagttatggugttcagggacgut

SEQ ID NO: 1868 - DNA, 21 bp, Artificial Sequence
  Synthetic
cggcagucggagaaagaaaug

SEQ ID NO: 1869 - DNA, 26 bp, Artificial Sequence
  Synthetic
attacttttgcugttgacgtttcugg

SEQ ID NO: 1870 - DNA, 28 bp, Artificial Sequence
  Synthetic
caagagaagtttautgcaaactgaguca

SEQ ID NO: 1871 - DNA, 27 bp, Artificial Sequence
  Synthetic
tcccctuagaagcaaacttttcatuca

SEQ ID NO: 1872 - DNA, 23 bp, Artificial Sequence
  Synthetic
atagagauggcagaacgcaauga

SEQ ID NO: 1873 - DNA, 27 bp, Artificial Sequence
  Synthetic
tttttcaaggugtctattgccauacct

SEQ ID NO: 1874 - DNA, 28 bp, Artificial Sequence
  Synthetic
aagaacugagtttucagaaaggagaact

SEQ ID NO: 1875 - DNA, 26 bp, Artificial Sequence
  Synthetic
ccggttttaugtttagacatcugcct

SEQ ID NO: 1876 - DNA, 25 bp, Artificial Sequence
  Synthetic
gtgugttgagtgttugagcaaagaa

SEQ ID NO: 1877 - DNA, 26 bp, Artificial Sequence
  Synthetic
agtgtgtttataaugctttggccuga

SEQ ID NO: 1878 - DNA, 27 bp, Artificial Sequence
  Synthetic
agaaaaacgagaagcaguaaacucact

SEQ ID NO: 1879 - DNA, 26 bp, Artificial Sequence
  Synthetic
atttaaaccaauggtctgcauaccct

SEQ ID NO: 1880 - DNA, 27 bp, Artificial Sequence
  Synthetic
acucuagaaagagagagaaagugaaga

SEQ ID NO: 1881 - DNA, 21 bp, Artificial Sequence
  Synthetic
gcaccttugagagcactuggt

SEQ ID NO: 1882 - DNA, 25 bp, Artificial Sequence
  Synthetic
cctgaaggaagcacutaagauccag

SEQ ID NO: 1883 - DNA, 22 bp, Artificial Sequence
  Synthetic
tctctgtgtugaagtggtgtug

SEQ ID NO: 1884 - DNA, 28 bp, Artificial Sequence
  Synthetic
gaagacaaauggaaatcagtgaugcaat

SEQ ID NO: 1885 - DNA, 26 bp, Artificial Sequence
  Synthetic
caagctttccaautctccttcuaggt

SEQ ID NO: 1886 - DNA, 25 bp, Artificial Sequence
  Synthetic
gaggagacaaguagatgcttuaggg

SEQ ID NO: 1887 - DNA, 24 bp, Artificial Sequence
  Synthetic
acaacctcaggcuattgttttgut

SEQ ID NO: 1888 - DNA, 26 bp, Artificial Sequence
  Synthetic
gaagatctugaaccctcttcuggaaa

SEQ ID NO: 1889 - DNA, 20 bp, Artificial Sequence
  Synthetic
cccatgccucgatgatucct

SEQ ID NO: 1890 - DNA, 24 bp, Artificial Sequence
  Synthetic
cgaagctggtutccaaagctgaua

SEQ ID NO: 1891 - DNA, 22 bp, Artificial Sequence
  Synthetic
tttctccagacugttgacuggc

SEQ ID NO: 1892 - DNA, 24 bp, Artificial Sequence
  Synthetic
ccgagttggutcatcatcatucaa

SEQ ID NO: 1893 - DNA, 20 bp, Artificial Sequence
  Synthetic
tgatgtccgugcgttccauc

SEQ ID NO: 1894 - DNA, 19 bp, Artificial Sequence
  Synthetic
aggugaacgccgtggugct

SEQ ID NO: 1895 - DNA, 21 bp, Artificial Sequence
  Synthetic
ctccacgcccugtgacuccat

SEQ ID NO: 1896 - DNA, 22 bp, Artificial Sequence
  Synthetic
gaattgacctgucccaggtgua

SEQ ID NO: 1897 - DNA, 23 bp, Artificial Sequence
  Synthetic
cacactccugcacagttgaatut

SEQ ID NO: 1898 - DNA, 21 bp, Artificial Sequence
  Synthetic
ctggagtugtcagctctuccc

SEQ ID NO: 1899 - DNA, 23 bp, Artificial Sequence
  Synthetic
gcgctgaacaagutggtctttut

SEQ ID NO: 1900 - DNA, 19 bp, Artificial Sequence
  Synthetic
ggtcuccccacctguggaa

SEQ ID NO: 1901 - DNA, 19 bp, Artificial Sequence
  Synthetic
cctccacuccgtgtcctug

SEQ ID NO: 1902 - DNA, 25 bp, Artificial Sequence
  Synthetic
tcttcaaagacaucatggaguccag

SEQ ID NO: 1903 - DNA, 19 bp, Artificial Sequence
  Synthetic
ccctaaggcacugccctut

SEQ ID NO: 1904 - DNA, 20 bp, Artificial Sequence
  Synthetic
agccacgaguctggttgaug

SEQ ID NO: 1905 - DNA, 19 bp, Artificial Sequence
  Synthetic
ggatgctgauggcaacgug

SEQ ID NO: 1906 - DNA, 24 bp, Artificial Sequence
  Synthetic
gtgagctaugtggattccauccag

SEQ ID NO: 1907 - DNA, 23 bp, Artificial Sequence
  Synthetic
atttcctucaccgaacugaggag

SEQ ID NO: 1908 - DNA, 22 bp, Artificial Sequence
  Synthetic
ttctguccgaagccagttcaut

SEQ ID NO: 1909 - DNA, 17 bp, Artificial Sequence
  Synthetic
ggtgugcgagcgcauct

SEQ ID NO: 1910 - DNA, 23 bp, Artificial Sequence
  Synthetic
gtggtggguttcagagtcucaaa

SEQ ID NO: 1911 - DNA, 22 bp, Artificial Sequence
  Synthetic
cccaugagctacgaugaaaagc

SEQ ID NO: 1912 - DNA, 17 bp, Artificial Sequence
  Synthetic
ccagcaaucccgccuca

SEQ ID NO: 1913 - DNA, 17 bp, Artificial Sequence
  Synthetic
cgcugagagcagccgua

SEQ ID NO: 1914 - DNA, 17 bp, Artificial Sequence
  Synthetic
cgcggccacguacttuc

SEQ ID NO: 1915 - DNA, 22 bp, Artificial Sequence
  Synthetic
gggagaugctauccaagaagca

SEQ ID NO: 1916 - DNA, 18 bp, Artificial Sequence
  Synthetic
ccacccauccggacucag

SEQ ID NO: 1917 - DNA, 20 bp, Artificial Sequence
  Synthetic
cacccctguaccaaccauca

SEQ ID NO: 1918 - DNA, 28 bp, Artificial Sequence
  Synthetic
caatttgtaaacauggtgttgaagucct

SEQ ID NO: 1919 - DNA, 28 bp, Artificial Sequence
  Synthetic
atcttctggtaaugcctctgaaaatcuc

SEQ ID NO: 1920 - DNA, 24 bp, Artificial Sequence
  Synthetic
gcatgutctgaaaataugggcaca

SEQ ID NO: 1921 - DNA, 27 bp, Artificial Sequence
  Synthetic
ccctgggaacuatgttgaatcaaucat

SEQ ID NO: 1922 - DNA, 23 bp, Artificial Sequence
  Synthetic
aggatccccauctgcatauggat

SEQ ID NO: 1923 - DNA, 20 bp, Artificial Sequence
  Synthetic
accaccuccaccagaugaca

SEQ ID NO: 1924 - DNA, 26 bp, Artificial Sequence
  Synthetic
gtaaagtgagtucaatggctccaaug

SEQ ID NO: 1925 - DNA, 29 bp, Artificial Sequence
  Synthetic
agttttcttttctugtactctgaccugaa

SEQ ID NO: 1926 - DNA, 22 bp, Artificial Sequence
  Synthetic
agcctagcaggacuggtcauat

SEQ ID NO: 1927 - DNA, 24 bp, Artificial Sequence
  Synthetic
aagggagacucacatattttuggg

SEQ ID NO: 1928 - DNA, 19 bp, Artificial Sequence
  Synthetic
tgacaccauggcccacauc

SEQ ID NO: 1929 - DNA, 28 bp, Artificial Sequence
  Synthetic
gatattcauaaggagaaaguggcacgaa

SEQ ID NO: 1930 - DNA, 18 bp, Artificial Sequence
  Synthetic
cagtgggcuggtcacucc

SEQ ID NO: 1931 - DNA, 24 bp, Artificial Sequence
  Synthetic
gcugatcgagagtuaccagaacct

SEQ ID NO: 1932 - DNA, 28 bp, Artificial Sequence
  Synthetic
ccaacttgaaatucagactaagctcaug

SEQ ID NO: 1933 - DNA, 21 bp, Artificial Sequence
  Synthetic
cuccatcucccaacacacaga

SEQ ID NO: 1934 - DNA, 22 bp, Artificial Sequence
  Synthetic
gtgccaggaaucagtcacugaa

SEQ ID NO: 1935 - DNA, 25 bp, Artificial Sequence
  Synthetic
atcgtttcctccuctctcctctuag

SEQ ID NO: 1936 - DNA, 29 bp, Artificial Sequence
  Synthetic
acgcatcatatttuctggagaatcaauct

SEQ ID NO: 1937 - DNA, 24 bp, Artificial Sequence
  Synthetic
cctgccagcuagtatgttgtttug

SEQ ID NO: 1938 - DNA, 26 bp, Artificial Sequence
  Synthetic
agggaagaugagggaguagaaaagat

SEQ ID NO: 1939 - DNA, 31 bp, Artificial Sequence
  Synthetic
agcaggaagaagaautcattagtaacactut

SEQ ID NO: 1940 - DNA, 23 bp, Artificial Sequence
  Synthetic
tcattgtcaagugcttgcgauct

SEQ ID NO: 1941 - DNA, 28 bp, Artificial Sequence
  Synthetic
aacaaataggcucccaataatctgaugt

SEQ ID NO: 1942 - DNA, 26 bp, Artificial Sequence
  Synthetic
gttcacattcagacucaaatttcgut

SEQ ID NO: 1943 - DNA, 23 bp, Artificial Sequence
  Synthetic
gtggtttcuccctggtcatctuc

SEQ ID NO: 1944 - DNA, 24 bp, Artificial Sequence
  Synthetic
agtaaccaggcuacctagaatuga

SEQ ID NO: 1945 - DNA, 27 bp, Artificial Sequence
  Synthetic
agcaattaugcagacagccauagaaat

SEQ ID NO: 1946 - DNA, 24 bp, Artificial Sequence
  Synthetic
tgggtacaccaugctttttgauga

SEQ ID NO: 1947 - DNA, 26 bp, Artificial Sequence
  Synthetic
catacttctccauatcggccttuacc

SEQ ID NO: 1948 - DNA, 27 bp, Artificial Sequence
  Synthetic
aactcatcaacuggacaggtttcauag

SEQ ID NO: 1949 - DNA, 22 bp, Artificial Sequence
  Synthetic
ccaattuaagcagggctcuggt

SEQ ID NO: 1950 - DNA, 18 bp, Artificial Sequence
  Synthetic
gcucccgaagtgcuggac

SEQ ID NO: 1951 - DNA, 21 bp, Artificial Sequence
  Synthetic
tcaaacucccacctcctguga

SEQ ID NO: 1952 - DNA, 27 bp, Artificial Sequence
  Synthetic
cagttttgaagcuaatgtcagaaugct

SEQ ID NO: 1953 - DNA, 27 bp, Artificial Sequence
  Synthetic
tctagagtttcucctccgatggttuaa

SEQ ID NO: 1954 - DNA, 25 bp, Artificial Sequence
  Synthetic
acacgaaccuacatgaacacaacuc

SEQ ID NO: 1955 - DNA, 20 bp, Artificial Sequence
  Synthetic
gauggcccagaauggaagct

SEQ ID NO: 1956 - DNA, 24 bp, Artificial Sequence
  Synthetic
ctcaccccuaaacaaaaugcatua

SEQ ID NO: 1957 - DNA, 22 bp, Artificial Sequence
  Synthetic
ctagaccuctcacuccgagaga

SEQ ID NO: 1958 - DNA, 18 bp, Artificial Sequence
  Synthetic
gcaggacccugcatgcua

SEQ ID NO: 1959 - DNA, 19 bp, Artificial Sequence
  Synthetic
catctugccgcagctucag

SEQ ID NO: 1960 - DNA, 21 bp, Artificial Sequence
  Synthetic
cacctaucaccacugcacaag

SEQ ID NO: 1961 - DNA, 21 bp, Artificial Sequence
  Synthetic
cttcctcaugcactcguggaa

SEQ ID NO: 1962 - DNA, 23 bp, Artificial Sequence
  Synthetic
ctgcagtaugaacactgtgcuct

SEQ ID NO: 1963 - DNA, 20 bp, Artificial Sequence
  Synthetic
cataucgagtgcucggccat

SEQ ID NO: 1964 - DNA, 21 bp, Artificial Sequence
  Synthetic
cagcttcccauaggagtgcut

SEQ ID NO: 1965 - DNA, 21 bp, Artificial Sequence
  Synthetic
actgtcaucctgcugacacac

SEQ ID NO: 1966 - DNA, 20 bp, Artificial Sequence
  Synthetic
gctgtcugggagatgtguga

SEQ ID NO: 1967 - DNA, 22 bp, Artificial Sequence
  Synthetic
accacggaucccgauaaaaagc

SEQ ID NO: 1968 - DNA, 21 bp, Artificial Sequence
  Synthetic
tggatcccaauggctcugact

SEQ ID NO: 1969 - DNA, 27 bp, Artificial Sequence
  Synthetic
cctaacaaaggaagugttcataccuca

SEQ ID NO: 1970 - DNA, 27 bp, Artificial Sequence
  Synthetic
ttggtttttctuatttctctcccuggt

SEQ ID NO: 1971 - DNA, 27 bp, Artificial Sequence
  Synthetic
aggacaauggagaagagggtgatauag

SEQ ID NO: 1972 - DNA, 25 bp, Artificial Sequence
  Synthetic
cgggagtataaugaactgctcaugg

SEQ ID NO: 1973 - DNA, 21 bp, Artificial Sequence
  Synthetic
cgcttgtgcugtctcctugat

SEQ ID NO: 1974 - DNA, 25 bp, Artificial Sequence
  Synthetic
gactcagtaatucctgttcctcucc

SEQ ID NO: 1975 - DNA, 26 bp, Artificial Sequence
  Synthetic
tggactauagacaggaatgcugacat

SEQ ID NO: 1976 - DNA, 27 bp, Artificial Sequence
  Synthetic
agtttgtaatctcutgcctctttgugt

SEQ ID NO: 1977 - DNA, 27 bp, Artificial Sequence
  Synthetic
agucaagaactucagagaaaggcaaaa

SEQ ID NO: 1978 - DNA, 21 bp, Artificial Sequence
  Synthetic
gtggttcugggaagcgtacut

SEQ ID NO: 1979 - DNA, 21 bp, Artificial Sequence
  Synthetic
ctcatguggctagcacuggaa

SEQ ID NO: 1980 - DNA, 24 bp, Artificial Sequence
  Synthetic
ccagattctcuctggcccaaaauc

SEQ ID NO: 1981 - DNA, 22 bp, Artificial Sequence
  Synthetic
gctcgucagaggtcagcauaat

SEQ ID NO: 1982 - DNA, 29 bp, Artificial Sequence
  Synthetic
tcagctaaagggaacugctattttugaat

SEQ ID NO: 1983 - DNA, 23 bp, Artificial Sequence
  Synthetic
ccaccaggaagutcatggcaaua

SEQ ID NO: 1984 - DNA, 21 bp, Artificial Sequence
  Synthetic
tccccaacautggcagctuat

SEQ ID NO: 1985 - DNA, 19 bp, Artificial Sequence
  Synthetic
gtgggtuaggtgggugcat

SEQ ID NO: 1986 - DNA, 25 bp, Artificial Sequence
  Synthetic
agcagaaaaaccuttcgtgagatug

SEQ ID NO: 1987 - DNA, 19 bp, Artificial Sequence
  Synthetic
gagggtccugacgatgcug

SEQ ID NO: 1988 - DNA, 22 bp, Artificial Sequence
  Synthetic
cttugacaggagggctacaucc

SEQ ID NO: 1989 - DNA, 21 bp, Artificial Sequence
  Synthetic
ttcttuagcacgaccuggcat

SEQ ID NO: 1990 - DNA, 21 bp, Artificial Sequence
  Synthetic
ctagtagccgaauggtgguca

SEQ ID NO: 1991 - DNA, 21 bp, Artificial Sequence
  Synthetic
cagagaagagcucggtucagg

SEQ ID NO: 1992 - DNA, 24 bp, Artificial Sequence
  Synthetic
cagaagagcgagauccgagttuac

SEQ ID NO: 1993 - DNA, 22 bp, Artificial Sequence
  Synthetic
cctcatgaucacagcctcctuc

SEQ ID NO: 1994 - DNA, 21 bp, Artificial Sequence
  Synthetic
cccaggcuctgagagatuggt

SEQ ID NO: 1995 - DNA, 27 bp, Artificial Sequence
  Synthetic
cacaccttcttuagtgtctctcactuc

SEQ ID NO: 1996 - DNA, 22 bp, Artificial Sequence
  Synthetic
gagatcttuggcacagagcuga

SEQ ID NO: 1997 - DNA, 24 bp, Artificial Sequence
  Synthetic
tgtgtgagugttgagguaaagcaa

SEQ ID NO: 1998 - DNA, 24 bp, Artificial Sequence
  Synthetic
gtcgaagaggguttctctauccag

SEQ ID NO: 1999 - DNA, 24 bp, Artificial Sequence
  Synthetic
acttctccaguttcctacccugat

SEQ ID NO: 2000 - DNA, 23 bp, Artificial Sequence
  Synthetic
gggaatguagggatgagcgtauc

SEQ ID NO: 2001 - DNA, 26 bp, Artificial Sequence
  Synthetic
gattatccucttgagacaugcccaaa

SEQ ID NO: 2002 - DNA, 27 bp, Artificial Sequence
  Synthetic
ggatatccggtucatggatctgaagua

SEQ ID NO: 2003 - DNA, 28 bp, Artificial Sequence
  Synthetic
actttctactaguccacagtttacuggt

SEQ ID NO: 2004 - DNA, 20 bp, Artificial Sequence
  Synthetic
cuggagcccgugaaaaagag

SEQ ID NO: 2005 - DNA, 17 bp, Artificial Sequence
  Synthetic
cgggccggauggagtug

SEQ ID NO: 2006 - DNA, 24 bp, Artificial Sequence
  Synthetic
ccaacaactucctgtcctacuacc

SEQ ID NO: 2007 - DNA, 20 bp, Artificial Sequence
  Synthetic
tttccguggcactaggtguc

SEQ ID NO: 2008 - DNA, 18 bp, Artificial Sequence
  Synthetic
gcgggacguggacatcug

SEQ ID NO: 2009 - DNA, 24 bp, Artificial Sequence
  Synthetic
aacaaggagaaugaagcttuccct

SEQ ID NO: 2010 - DNA, 24 bp, Artificial Sequence
  Synthetic
gacaaggtcaaaugcttctgtugt

SEQ ID NO: 2011 - DNA, 25 bp, Artificial Sequence
  Synthetic
ctgagaggtagcutccaagttgtua

SEQ ID NO: 2012 - DNA, 22 bp, Artificial Sequence
  Synthetic
gctttgccugtggtggaaaaut

SEQ ID NO: 2013 - DNA, 30 bp, Artificial Sequence
  Synthetic
gctcagatuagaaactgtgtatctugaagt

SEQ ID NO: 2014 - DNA, 25 bp, Artificial Sequence
  Synthetic
gttgggaatcuggagatgatccaug

SEQ ID NO: 2015 - DNA, 26 bp, Artificial Sequence
  Synthetic
aacaactgattucaggtgaacacaua

SEQ ID NO: 2016 - DNA, 27 bp, Artificial Sequence
  Synthetic
ttcagagaaaaaucctagcaacuggag

SEQ ID NO: 2017 - DNA, 28 bp, Artificial Sequence
  Synthetic
acttgattcttttucctcagttgctcut

SEQ ID NO: 2018 - DNA, 33 bp, Artificial Sequence
  Synthetic
aaccttatttgtcauagtaatgctttttcttut

SEQ ID NO: 2019 - DNA, 22 bp, Artificial Sequence
  Synthetic
aaaggcaguttgcttctucagt

SEQ ID NO: 2020 - DNA, 27 bp, Artificial Sequence
  Synthetic
gatagagcuacagaacgaaaggtagua

SEQ ID NO: 2021 - DNA, 31 bp, Artificial Sequence
  Synthetic
ctgaatgccgatcuagatgtttaattgttuc

SEQ ID NO: 2022 - DNA, 32 bp, Artificial Sequence
  Synthetic
atacagtgaaagatucatctaatggtgctaut

SEQ ID NO: 2023 - DNA, 28 bp, Artificial Sequence
  Synthetic
augaggaaaaatucacaaacaacaacct

SEQ ID NO: 2024 - DNA, 24 bp, Artificial Sequence
  Synthetic
gactttggcugtcaacttucgaat

SEQ ID NO: 2025 - DNA, 32 bp, Artificial Sequence
  Synthetic
cggatgatggatauaaatttgcagttgaaaua

SEQ ID NO: 2026 - DNA, 32 bp, Artificial Sequence
  Synthetic
tttacaggtttttaaugaagataccagaucct

SEQ ID NO: 2027 - DNA, 32 bp, Artificial Sequence
  Synthetic
attctgtgacttcugaaggtgatcttttatua

SEQ ID NO: 2028 - DNA, 24 bp, Artificial Sequence
  Synthetic
cttacggaagutgcattgtgucaa

SEQ ID NO: 2029 - DNA, 24 bp, Artificial Sequence
  Synthetic
ctacccugaattatggcuccaagt

SEQ ID NO: 2030 - DNA, 29 bp, Artificial Sequence
  Synthetic
gctcttattctaucagttagagggugact

SEQ ID NO: 2031 - DNA, 27 bp, Artificial Sequence
  Synthetic
aaataaguggagagagcctgauaaaac

SEQ ID NO: 2032 - DNA, 32 bp, Artificial Sequence
  Synthetic
aagaactttcattcucagaagtagaagaacua

SEQ ID NO: 2033 - DNA, 22 bp, Artificial Sequence
  Synthetic
cagaagacagcgauccagugat

SEQ ID NO: 2034 - DNA, 33 bp, Artificial Sequence
  Synthetic
taattttaactggaatutgcatttttccttcua

SEQ ID NO: 2035 - DNA, 28 bp, Artificial Sequence
  Synthetic
ctgcatcatattuctcaaggaaccaaut

SEQ ID NO: 2036 - DNA, 22 bp, Artificial Sequence
  Synthetic
aggtggaggaucagtcauccat

SEQ ID NO: 2037 - DNA, 23 bp, Artificial Sequence
  Synthetic
ggcctcttauactgccaaaucaa

SEQ ID NO: 2038 - DNA, 27 bp, Artificial Sequence
  Synthetic
ccatgtccutcatgtagugaaaaacct

SEQ ID NO: 2039 - DNA, 24 bp, Artificial Sequence
  Synthetic
acaaaactugcattcgtauccaca

SEQ ID NO: 2040 - DNA, 31 bp, Artificial Sequence
  Synthetic
ttcttaatgtaaugggaaaagactttccugt

SEQ ID NO: 2041 - DNA, 22 bp, Artificial Sequence
  Synthetic
ttctactgccauctgcagcaut

SEQ ID NO: 2042 - DNA, 24 bp, Artificial Sequence
  Synthetic
cctatcugcgaaaaacaggcttug

SEQ ID NO: 2043 - DNA, 25 bp, Artificial Sequence
  Synthetic
agtgccacucagaaaatctagctut

SEQ ID NO: 2044 - DNA, 29 bp, Artificial Sequence
  Synthetic
agatcttgttauaaggttttgatuccaca

SEQ ID NO: 2045 - DNA, 28 bp, Artificial Sequence
  Synthetic
caagaatcttuggaaagcagtctgtuag

SEQ ID NO: 2046 - DNA, 27 bp, Artificial Sequence
  Synthetic
cccttgcagatugatcacttattcaut

SEQ ID NO: 2047 - DNA, 31 bp, Artificial Sequence
  Synthetic
acttgtgaagtuagagctagttctctaagut

SEQ ID NO: 2048 - DNA, 28 bp, Artificial Sequence
  Synthetic
agcaagcagcugaaacaaataatgttua

SEQ ID NO: 2049 - DNA, 32 bp, Artificial Sequence
  Synthetic
caaaguataaataacgtcucgaagaacaaagg

SEQ ID NO: 2050 - DNA, 32 bp, Artificial Sequence
  Synthetic
acagtaagttttgtuggcttactttaaaatua

SEQ ID NO: 2051 - DNA, 28 bp, Artificial Sequence
  Synthetic
acaacatggucaggaaaaggatcuaaaa

SEQ ID NO: 2052 - DNA, 24 bp, Artificial Sequence
  Synthetic
cttcgaagacaacuggaacuacat

SEQ ID NO: 2053 - DNA, 26 bp, Artificial Sequence
  Synthetic
tgagagtcugaactaagtctgugaca

SEQ ID NO: 2054 - DNA, 30 bp, Artificial Sequence
  Synthetic
gaagataaagaactucagtggaccttcaua

SEQ ID NO: 2055 - DNA, 28 bp, Artificial Sequence
  Synthetic
tgtgtgaagtaucattctccatgaaugt

SEQ ID NO: 2056 - DNA, 21 bp, Artificial Sequence
  Synthetic
ccctttugaaggcctggauga

SEQ ID NO: 2057 - DNA, 30 bp, Artificial Sequence
  Synthetic
cttacttcacacautggctttaataatuga

SEQ ID NO: 2058 - DNA, 22 bp, Artificial Sequence
  Synthetic
gtgtaagcaagaaugccuggga

SEQ ID NO: 2059 - DNA, 30 bp, Artificial Sequence
  Synthetic
ctaaacguaagaagcaauactcattacaut

SEQ ID NO: 2060 - DNA, 27 bp, Artificial Sequence
  Synthetic
caggagctuccaaatagtatgttcuca

SEQ ID NO: 2061 - DNA, 32 bp, Artificial Sequence
  Synthetic
cctgtaaacttatuccagtttcttctttacut

SEQ ID NO: 2062 - DNA, 28 bp, Artificial Sequence
  Synthetic
attctgtttaugaaggagttatgtgugt

SEQ ID NO: 2063 - DNA, 27 bp, Artificial Sequence
  Synthetic
ctgtttcgaggucatatgttacuaggg

SEQ ID NO: 2064 - DNA, 29 bp, Artificial Sequence
  Synthetic
tuctttgacttatcucacagcaaagaagt

SEQ ID NO: 2065 - DNA, 32 bp, Artificial Sequence
  Synthetic
gtaactttgtctttucataatacctggcauat

SEQ ID NO: 2066 - DNA, 31 bp, Artificial Sequence
  Synthetic
tcatttctcttgctuacatgaactctatguc

SEQ ID NO: 2067 - DNA, 29 bp, Artificial Sequence
  Synthetic
gataggctccugaaaactaaaatcacugt

SEQ ID NO: 2068 - DNA, 24 bp, Artificial Sequence
  Synthetic
ctggaagaagcacaaguattcugg

SEQ ID NO: 2069 - DNA, 30 bp, Artificial Sequence
  Synthetic
taacagtaaaacacuaatccagccaauaaa

SEQ ID NO: 2070 - DNA, 29 bp, Artificial Sequence
  Synthetic
gagctaagaaauggaaaaatgaaggcaut

SEQ ID NO: 2071 - DNA, 30 bp, Artificial Sequence
  Synthetic
gaattttatgttcccuaaggagacctacut

SEQ ID NO: 2072 - DNA, 27 bp, Artificial Sequence
  Synthetic
atgatatgtggguattccgactttgut

SEQ ID NO: 2073 - DNA, 28 bp, Artificial Sequence
  Synthetic
gctuatgtctaagttttucaagcacagg

SEQ ID NO: 2074 - DNA, 29 bp, Artificial Sequence
  Synthetic
ccttagcaaaugcaaacagagatgaatut

SEQ ID NO: 2075 - DNA, 31 bp, Artificial Sequence
  Synthetic
ggaaagactgaauatcacacttcuaaaaggt

SEQ ID NO: 2076 - DNA, 31 bp, Artificial Sequence
  Synthetic
ttttctttaagugcaaatagtgtatcugacc

SEQ ID NO: 2077 - DNA, 25 bp, Artificial Sequence
  Synthetic
aatttacaccucctgcuaagcgaaa

SEQ ID NO: 2078 - DNA, 27 bp, Artificial Sequence
  Synthetic
gatcatcaaatgcuctttaatggccut

SEQ ID NO: 2079 - DNA, 30 bp, Artificial Sequence
  Synthetic
tgtatcttttaugagcaccatcttcatugt

SEQ ID NO: 2080 - DNA, 37 bp, Artificial Sequence
  Synthetic
tggutatatattagaaagagauggaatcagtgattuc

SEQ ID NO: 2081 - DNA, 31 bp, Artificial Sequence
  Synthetic
caagttctgcugactgctcatttaucaagat

SEQ ID NO: 2082 - DNA, 32 bp, Artificial Sequence
  Synthetic
tggtgtgtaacaaaauccgtatttataatgug

SEQ ID NO: 2083 - DNA, 29 bp, Artificial Sequence
  Synthetic
tgagatacacaguctacctgguaagaaaa

SEQ ID NO: 2084 - DNA, 28 bp, Artificial Sequence
  Synthetic
agtagctgaacgugtcttaatgagacua

SEQ ID NO: 2085 - DNA, 23 bp, Artificial Sequence
  Synthetic
agatcacacccaagcuttccauc

SEQ ID NO: 2086 - DNA, 29 bp, Artificial Sequence
  Synthetic
gaacaaaatttagucattacacgccucaa

SEQ ID NO: 2087 - DNA, 26 bp, Artificial Sequence
  Synthetic
ccgaggtatugatatacaagctguga

SEQ ID NO: 2088 - DNA, 25 bp, Artificial Sequence
  Synthetic
tcatctgtttuactgggacucgaga

SEQ ID NO: 2089 - DNA, 27 bp, Artificial Sequence
  Synthetic
ccctatgagautaacctgauggaggaa

SEQ ID NO: 2090 - DNA, 23 bp, Artificial Sequence
  Synthetic
aaacacaagcagcutttgctuca

SEQ ID NO: 2091 - DNA, 27 bp, Artificial Sequence
  Synthetic
ccctgggagaaucctggatcttatuaa

SEQ ID NO: 2092 - DNA, 25 bp, Artificial Sequence
  Synthetic
tccaaggcugaaactcccattttua

SEQ ID NO: 2093 - DNA, 28 bp, Artificial Sequence
  Synthetic
tggtagggauatcttagcuagagcaaaa

SEQ ID NO: 2094 - DNA, 28 bp, Artificial Sequence
  Synthetic
cacttctagtuccccaccattattcuac

SEQ ID NO: 2095 - DNA, 29 bp, Artificial Sequence
  Synthetic
gtttactgtattcuctctagacctgguga

SEQ ID NO: 2096 - DNA, 17 bp, Artificial Sequence
  Synthetic
tgttcuggccgtgcuca

SEQ ID NO: 2097 - DNA, 21 bp, Artificial Sequence
  Synthetic
gtgcttgccugcattgcaaua

SEQ ID NO: 2098 - DNA, 26 bp, Artificial Sequence
  Synthetic
aaaaagggagcugtccttaaaatuct

SEQ ID NO: 2099 - DNA, 22 bp, Artificial Sequence
  Synthetic
cggagatgcuggtaggtatcug

SEQ ID NO: 2100 - DNA, 27 bp, Artificial Sequence
  Synthetic
tggcagaacuaaaaggaatcttuccaa

SEQ ID NO: 2101 - DNA, 30 bp, Artificial Sequence
  Synthetic
actcgtaagctutagtttttcatagtucaa

SEQ ID NO: 2102 - DNA, 22 bp, Artificial Sequence
  Synthetic
ctcatcctggcuacatggctut

SEQ ID NO: 2103 - DNA, 26 bp, Artificial Sequence
  Synthetic
agcagaagtcucaagataacgaaaut

SEQ ID NO: 2104 - DNA, 32 bp, Artificial Sequence
  Synthetic
caaaggaacaataugaattatactgtgagaug

SEQ ID NO: 2105 - DNA, 23 bp, Artificial Sequence
  Synthetic
gccaggatguaagacaggatgug

SEQ ID NO: 2106 - DNA, 22 bp, Artificial Sequence
  Synthetic
agaugccattuccccaaacgaa

SEQ ID NO: 2107 - DNA, 22 bp, Artificial Sequence
  Synthetic
ctugagggaacacatacucgct

SEQ ID NO: 2108 - DNA, 22 bp, Artificial Sequence
  Synthetic
ctgtcccuccagagacaaacug

SEQ ID NO: 2109 - DNA, 24 bp, Artificial Sequence
  Synthetic
gggcaatgaaaauggaagtgagug

SEQ ID NO: 2110 - DNA, 30 bp, Artificial Sequence
  Synthetic
tacttcaaagttuactggtttgttactuct

SEQ ID NO: 2111 - DNA, 23 bp, Artificial Sequence
  Synthetic
cctggaagagggagucatguact

SEQ ID NO: 2112 - DNA, 22 bp, Artificial Sequence
  Synthetic
cccgaggagucagaaaaugagg

SEQ ID NO: 2113 - DNA, 23 bp, Artificial Sequence
  Synthetic
acccaaagtaguctggagacuca

SEQ ID NO: 2114 - DNA, 21 bp, Artificial Sequence
  Synthetic
tcctgcccaugtagctaccua

SEQ ID NO: 2115 - DNA, 27 bp, Artificial Sequence
  Synthetic
aatcttggaaccacugatgtgataucc

SEQ ID NO: 2116 - DNA, 21 bp, Artificial Sequence
  Synthetic
tgtggttctugtgcaggtcut

SEQ ID NO: 2117 - DNA, 27 bp, Artificial Sequence
  Synthetic
ttttaaaatgccutgccttcttugaca

SEQ ID NO: 2118 - DNA, 31 bp, Artificial Sequence
  Synthetic
attttagcttcattutgtctatactggtugt

SEQ ID NO: 2119 - DNA, 26 bp, Artificial Sequence
  Synthetic
cctgtaaacagcccuacttctcatut

SEQ ID NO: 2120 - DNA, 22 bp, Artificial Sequence
  Synthetic
ctcatctccutttggtgugcct

SEQ ID NO: 2121 - DNA, 28 bp, Artificial Sequence
  Synthetic
gcactatcattgcauggatttcatacuc

SEQ ID NO: 2122 - DNA, 31 bp, Artificial Sequence
  Synthetic
ctgtttccagagcautgaattactaaaauct

SEQ ID NO: 2123 - DNA, 25 bp, Artificial Sequence
  Synthetic
ggcacatgaaucaacagaagaacuc

SEQ ID NO: 2124 - DNA, 24 bp, Artificial Sequence
  Synthetic
gccaautgtatgtugcccagaaca

SEQ ID NO: 2125 - DNA, 29 bp, Artificial Sequence
  Synthetic
gatggactctttcutgcatagtttggaua

SEQ ID NO: 2126 - DNA, 24 bp, Artificial Sequence
  Synthetic
tttattcuaccaaccctccctuct

SEQ ID NO: 2127 - DNA, 21 bp, Artificial Sequence
  Synthetic
tgctccaaauttcgaggcuct

SEQ ID NO: 2128 - DNA, 23 bp, Artificial Sequence
  Synthetic
atgaaggaacagacgcuggauac

SEQ ID NO: 2129 - DNA, 31 bp, Artificial Sequence
  Synthetic
gttagtgtgttugttttaaaatcttgaugct

SEQ ID NO: 2130 - DNA, 29 bp, Artificial Sequence
  Synthetic
gagaaagtcaaagugaggatgaacaatut

SEQ ID NO: 2131 - DNA, 26 bp, Artificial Sequence
  Synthetic
cactcaccatuaatcacttcctguct

SEQ ID NO: 2132 - DNA, 28 bp, Artificial Sequence
  Synthetic
cttgtataagcucagtttcccattcuct

SEQ ID NO: 2133 - DNA, 21 bp, Artificial Sequence
  Synthetic
cattuccagggcgaaaggtug

SEQ ID NO: 2134 - DNA, 27 bp, Artificial Sequence
  Synthetic
tctttcccauatttagaauggccaaca

SEQ ID NO: 2135 - DNA, 26 bp, Artificial Sequence
  Synthetic
gtcatcctguaccttcttgtttucct

SEQ ID NO: 2136 - DNA, 23 bp, Artificial Sequence
  Synthetic
ctggcatcuacagctgauagcaa

SEQ ID NO: 2137 - DNA, 29 bp, Artificial Sequence
  Synthetic
agtatcttatgcaacutcacaatgaauct

SEQ ID NO: 2138 - DNA, 28 bp, Artificial Sequence
  Synthetic
ctacctuttctattccatuggacagaca

SEQ ID NO: 2139 - DNA, 23 bp, Artificial Sequence
  Synthetic
tctcucagccacaaacagaucac

SEQ ID NO: 2140 - DNA, 23 bp, Artificial Sequence
  Synthetic
cuaggtttgacugagaagagcgt

SEQ ID NO: 2141 - DNA, 26 bp, Artificial Sequence
  Synthetic
gcaatgtcaccagutccagttcuaaa

SEQ ID NO: 2142 - DNA, 25 bp, Artificial Sequence
  Synthetic
ttttctaauggcagcactggtctua

SEQ ID NO: 2143 - DNA, 21 bp, Artificial Sequence
  Synthetic
gcugcagggtaagugaggaag

SEQ ID NO: 2144 - DNA, 28 bp, Artificial Sequence
  Synthetic
ctatgggttttauttcacagaaggugga

SEQ ID NO: 2145 - DNA, 29 bp, Artificial Sequence
  Synthetic
gtaggatgatuagtctagagtcuggaact

SEQ ID NO: 2146 - DNA, 28 bp, Artificial Sequence
  Synthetic
gccgtagacugtccagaaaatatuaaga

SEQ ID NO: 2147 - DNA, 28 bp, Artificial Sequence
  Synthetic
catacctattcugtcaaaaagctcucct

SEQ ID NO: 2148 - DNA, 33 bp, Artificial Sequence
  Synthetic
agagtgaatacatuacattaccaaattctagug

SEQ ID NO: 2149 - DNA, 27 bp, Artificial Sequence
  Synthetic
cttacccctttcauccaacagaagaut

SEQ ID NO: 2150 - DNA, 25 bp, Artificial Sequence
  Synthetic
gaaaatgtguttcttaccucaagcc

SEQ ID NO: 2151 - DNA, 27 bp, Artificial Sequence
  Synthetic
tggaatggtaatucttgctgatggaut

SEQ ID NO: 2152 - DNA, 29 bp, Artificial Sequence
  Synthetic
tgtatgtttctttcugtcttaatgccuca

SEQ ID NO: 2153 - DNA, 20 bp, Artificial Sequence
  Synthetic
gacaugtgggcugggaaaag

SEQ ID NO: 2154 - DNA, 28 bp, Artificial Sequence
  Synthetic
gtttattatctacucacccatgtggcut

SEQ ID NO: 2155 - DNA, 29 bp, Artificial Sequence
  Synthetic
ccggaagucaaccaatattttatcaucca

SEQ ID NO: 2156 - DNA, 27 bp, Artificial Sequence
  Synthetic
gggaccttcutctgattaacctuaaac

SEQ ID NO: 2157 - DNA, 19 bp, Artificial Sequence
  Synthetic
agagcgggcacutccauac

SEQ ID NO: 2158 - DNA, 25 bp, Artificial Sequence
  Synthetic
ggtaguagccccaatatagcuagca

SEQ ID NO: 2159 - DNA, 22 bp, Artificial Sequence
  Synthetic
ccttcagctgugtctgcagauc

SEQ ID NO: 2160 - DNA, 22 bp, Artificial Sequence
  Synthetic
ctcuccaggatgaatugcggat

SEQ ID NO: 2161 - DNA, 26 bp, Artificial Sequence
  Synthetic
cttucgaagaagaaauagctcttugg

SEQ ID NO: 2162 - DNA, 24 bp, Artificial Sequence
  Synthetic
ggctgtagugatcttttgcauaca

SEQ ID NO: 2163 - DNA, 23 bp, Artificial Sequence
  Synthetic
gttttggcagaaucaggagcaut

SEQ ID NO: 2164 - DNA, 28 bp, Artificial Sequence
  Synthetic
gacaagaagaagaccuaagtugacacat

SEQ ID NO: 2165 - DNA, 27 bp, Artificial Sequence
  Synthetic
caaagagguaaatctuacggcaaagac

SEQ ID NO: 2166 - DNA, 25 bp, Artificial Sequence
  Synthetic
actcctacatucttaggtggaugct

SEQ ID NO: 2167 - DNA, 21 bp, Artificial Sequence
  Synthetic
aaccttccgcuccttcacauc

SEQ ID NO: 2168 - DNA, 22 bp, Artificial Sequence
  Synthetic
tgccutgacaacttuggaggag

SEQ ID NO: 2169 - DNA, 21 bp, Artificial Sequence
  Synthetic
ttgugcccacagggatttcut

SEQ ID NO: 2170 - DNA, 26 bp, Artificial Sequence
  Synthetic
cttcacutttggatcugaaagagcat

SEQ ID NO: 2171 - DNA, 28 bp, Artificial Sequence
  Synthetic
caattgtgattccautttcagacacucc

SEQ ID NO: 2172 - DNA, 27 bp, Artificial Sequence
  Synthetic
gtgaaagaccagaauaagaagguagca

SEQ ID NO: 2173 - DNA, 25 bp, Artificial Sequence
  Synthetic
cttcacccgaucctttcagattcuc

SEQ ID NO: 2174 - DNA, 24 bp, Artificial Sequence
  Synthetic
ctcuggcagaaaaggaaacucact

SEQ ID NO: 2175 - DNA, 24 bp, Artificial Sequence
  Synthetic
gguaaaacacagagucagaagaug

SEQ ID NO: 2176 - DNA, 21 bp, Artificial Sequence
  Synthetic
gctaauggccgacaacuacga

SEQ ID NO: 2177 - DNA, 27 bp, Artificial Sequence
  Synthetic
tctcagaattugcaacatgctaguaca

SEQ ID NO: 2178 - DNA, 28 bp, Artificial Sequence
  Synthetic
ctttcagctucaggatgagtuagagaaa

SEQ ID NO: 2179 - DNA, 21 bp, Artificial Sequence
  Synthetic
ctcaggcutccccauaaagca

SEQ ID NO: 2180 - DNA, 17 bp, Artificial Sequence
  Synthetic
tgugccacgagguggac

SEQ ID NO: 2181 - DNA, 19 bp, Artificial Sequence
  Synthetic
tgcgcaugtagggtuggat

SEQ ID NO: 2182 - DNA, 22 bp, Artificial Sequence
  Synthetic
ccaggtcagccugtggaattua

SEQ ID NO: 2183 - DNA, 20 bp, Artificial Sequence
  Synthetic
ttgcgcaagaugtgcucaat

SEQ ID NO: 2184 - DNA, 23 bp, Artificial Sequence
  Synthetic
ctccgtaggaugctctatgucct

SEQ ID NO: 2185 - DNA, 22 bp, Artificial Sequence
  Synthetic
cagttcaucctccgactuggat

SEQ ID NO: 2186 - DNA, 21 bp, Artificial Sequence
  Synthetic
ccaccccgagauggtctcaua

SEQ ID NO: 2187 - DNA, 21 bp, Artificial Sequence
  Synthetic
aggcacuggaacatgaagugg

SEQ ID NO: 2188 - DNA, 21 bp, Artificial Sequence
  Synthetic
cttagctgcugctccguagat

SEQ ID NO: 2189 - DNA, 22 bp, Artificial Sequence
  Synthetic
tttccaggguggaagaatggug

SEQ ID NO: 2190 - DNA, 17 bp, Artificial Sequence
  Synthetic
ccggcugagagagcuca

SEQ ID NO: 2191 - DNA, 17 bp, Artificial Sequence
  Synthetic
gggcuggatggctucgg

SEQ ID NO: 2192 - DNA, 24 bp, Artificial Sequence
  Synthetic
ctggutagtgccucaacaagaaac

SEQ ID NO: 2193 - DNA, 28 bp, Artificial Sequence
  Synthetic
ggatccactauccggaatattttggaut

SEQ ID NO: 2194 - DNA, 26 bp, Artificial Sequence
  Synthetic
gaaaatggaatcucttacctccucca

SEQ ID NO: 2195 - DNA, 21 bp, Artificial Sequence
  Synthetic
ggtggacugttggttcctuca

SEQ ID NO: 2196 - DNA, 33 bp, Artificial Sequence
  Synthetic
aaaattatttttgugaagtcattcacatuacca

SEQ ID NO: 2197 - DNA, 26 bp, Artificial Sequence
  Synthetic
tccagaattttcuccgtctcctttuc

SEQ ID NO: 2198 - DNA, 28 bp, Artificial Sequence
  Synthetic
ggtacaacuattcttcagtaugcacaga

SEQ ID NO: 2199 - DNA, 29 bp, Artificial Sequence
  Synthetic
ggtaaacaagagugaatgagttagtuagt

SEQ ID NO: 2200 - DNA, 28 bp, Artificial Sequence
  Synthetic
gagttgcagtccuggaaaatcaaaauaa

SEQ ID NO: 2201 - DNA, 33 bp, Artificial Sequence
  Synthetic
ccactaggaaauccatttaatttttatgcaugt

SEQ ID NO: 2202 - DNA, 20 bp, Artificial Sequence
  Synthetic
cttcaugcgctgcttuccag

SEQ ID NO: 2203 - DNA, 19 bp, Artificial Sequence
  Synthetic
gucacaagcaccucccaga

SEQ ID NO: 2204 - DNA, 24 bp, Artificial Sequence
  Synthetic
ggaaugtcatuaaggcagcaaagt

SEQ ID NO: 2205 - DNA, 23 bp, Artificial Sequence
  Synthetic
aggatgaagguaatccggaguga

SEQ ID NO: 2206 - DNA, 22 bp, Artificial Sequence
  Synthetic
ggtucagcagaaagaggacuca

SEQ ID NO: 2207 - DNA, 28 bp, Artificial Sequence
  Synthetic
tgctaccttataucccttctcacctuag

SEQ ID NO: 2208 - DNA, 23 bp, Artificial Sequence
  Synthetic
ggaaacuaggcaccataccugaa

SEQ ID NO: 2209 - DNA, 23 bp, Artificial Sequence
  Synthetic
ctggtgtutgagcatguagacca

SEQ ID NO: 2210 - DNA, 22 bp, Artificial Sequence
  Synthetic
ggccttguacactgtcccauag

SEQ ID NO: 2211 - DNA, 25 bp, Artificial Sequence
  Synthetic
caggctcauaccatcctaactcugt

SEQ ID NO: 2212 - DNA, 25 bp, Artificial Sequence
  Synthetic
tcctctccaatuctgtaggacacut

SEQ ID NO: 2213 - DNA, 20 bp, Artificial Sequence
  Synthetic
caagggaucgggttaccgut

SEQ ID NO: 2214 - DNA, 18 bp, Artificial Sequence
  Synthetic
cggcgauctcgcctauca

SEQ ID NO: 2215 - DNA, 21 bp, Artificial Sequence
  Synthetic
ctctcttccuctcagcctucc

SEQ ID NO: 2216 - DNA, 20 bp, Artificial Sequence
  Synthetic
gggatgaagaguccccggua

SEQ ID NO: 2217 - DNA, 20 bp, Artificial Sequence
  Synthetic
ggaccagcccuccatacuca

SEQ ID NO: 2218 - DNA, 22 bp, Artificial Sequence
  Synthetic
tgaaaacagcucctgtcgtcut

SEQ ID NO: 2219 - DNA, 23 bp, Artificial Sequence
  Synthetic
gaggtaccugagagatugcagac

SEQ ID NO: 2220 - DNA, 21 bp, Artificial Sequence
  Synthetic
ctcctggcucccattttucct

SEQ ID NO: 2221 - DNA, 17 bp, Artificial Sequence
  Synthetic
ccaccgucacccaguga

SEQ ID NO: 2222 - DNA, 25 bp, Artificial Sequence
  Synthetic
ctgcagccagautttctaactcuca

SEQ ID NO: 2223 - DNA, 22 bp, Artificial Sequence
  Synthetic
ctggagcuggagaaggagttuc

SEQ ID NO: 2224 - DNA, 19 bp, Artificial Sequence
  Synthetic
ggutgagcgttugcagcag

SEQ ID NO: 2225 - DNA, 17 bp, Artificial Sequence
  Synthetic
cucacggccucaacggt

SEQ ID NO: 2226 - DNA, 20 bp, Artificial Sequence
  Synthetic
catgcucacgtccttgucca

SEQ ID NO: 2227 - DNA, 17 bp, Artificial Sequence
  Synthetic
agtccccucgcccctut

SEQ ID NO: 2228 - DNA, 28 bp, Artificial Sequence
  Synthetic
ctttcttcagaagcuccaccctataaut

SEQ ID NO: 2229 - DNA, 27 bp, Artificial Sequence
  Synthetic
ggagtugaagccagctgattauaagat

SEQ ID NO: 2230 - DNA, 30 bp, Artificial Sequence
  Synthetic
atccttaatgaucagggcatttctauaaaa

SEQ ID NO: 2231 - DNA, 29 bp, Artificial Sequence
  Synthetic
gctaaagaactugaccaagacataucagg

SEQ ID NO: 2232 - DNA, 30 bp, Artificial Sequence
  Synthetic
aaactgtttctaugagaaaggttgugagaa

SEQ ID NO: 2233 - DNA, 26 bp, Artificial Sequence
  Synthetic
tctaggacattuggcattgacttucc

SEQ ID NO: 2234 - DNA, 29 bp, Artificial Sequence
  Synthetic
gtggaaccaaaugatactgatccatuaga

SEQ ID NO: 2235 - DNA, 27 bp, Artificial Sequence
  Synthetic
ctccatttagaccugaaagggttagut

SEQ ID NO: 2236 - DNA, 25 bp, Artificial Sequence
  Synthetic
caguaaagcaggcaatatcuggaac

SEQ ID NO: 2237 - DNA, 27 bp, Artificial Sequence
  Synthetic
cactttcagaggcutcagtttctttut

SEQ ID NO: 2238 - DNA, 30 bp, Artificial Sequence
  Synthetic
tgcaggttuaatatccacttugaaaaagaa

SEQ ID NO: 2239 - DNA, 26 bp, Artificial Sequence
  Synthetic
ttgcaaatguaagtggtgctucaaaa

SEQ ID NO: 2240 - DNA, 29 bp, Artificial Sequence
  Synthetic
cagugtgaaaatgauccaaaaagcaaaaa

SEQ ID NO: 2241 - DNA, 30 bp, Artificial Sequence
  Synthetic
agtgctggcautttcatgatcatauaaaag

SEQ ID NO: 2242 - DNA, 28 bp, Artificial Sequence
  Synthetic
gcatcacctucaagaaaggtacaatuca

SEQ ID NO: 2243 - DNA, 30 bp, Artificial Sequence
  Synthetic
tagctactuggaagacaaaattattcucat

SEQ ID NO: 2244 - DNA, 32 bp, Artificial Sequence
  Synthetic
cggacatctccutgaatatagataaaauacca

SEQ ID NO: 2245 - DNA, 32 bp, Artificial Sequence
  Synthetic
ttcttaatgttatgtucagagagcttgattuc

SEQ ID NO: 2246 - DNA, 28 bp, Artificial Sequence
  Synthetic
gccaaaaggcagaaautacagaacttuc

SEQ ID NO: 2247 - DNA, 23 bp, Artificial Sequence
  Synthetic
ctgcattccucagaagtggtcut

SEQ ID NO: 2248 - DNA, 27 bp, Artificial Sequence
  Synthetic
cttctgcagagguacatccaataagut

SEQ ID NO: 2249 - DNA, 30 bp, Artificial Sequence
  Synthetic
gtgccagtagucatttcaatattatttugt

SEQ ID NO: 2250 - DNA, 30 bp, Artificial Sequence
  Synthetic
ttactgaucagcacaacatatgtctuaaat

SEQ ID NO: 2251 - DNA, 32 bp, Artificial Sequence
  Synthetic
gttctttatttgaaguattaccatgacaugct

SEQ ID NO: 2252 - DNA, 32 bp, Artificial Sequence
  Synthetic
ggaaacagacatagutaaacacaaaatacuga

SEQ ID NO: 2253 - DNA, 24 bp, Artificial Sequence
  Synthetic
ccgcuagctgtaugaaaacccaat

SEQ ID NO: 2254 - DNA, 21 bp, Artificial Sequence
  Synthetic
gagactguggtgccaccuaag

SEQ ID NO: 2255 - DNA, 30 bp, Artificial Sequence
  Synthetic
aggactttttgcugtttctttttctacaut

SEQ ID NO: 2256 - DNA, 29 bp, Artificial Sequence
  Synthetic
gacaaaaaucatctcuccgaaaaacaaga

SEQ ID NO: 2257 - DNA, 30 bp, Artificial Sequence
  Synthetic
actggctcaauaccagaatcaagtttatut

SEQ ID NO: 2258 - DNA, 21 bp, Artificial Sequence
  Synthetic
ggtagggccaccugcattuag

SEQ ID NO: 2259 - DNA, 25 bp, Artificial Sequence
  Synthetic
acaacctgccauaattttcgttugg

SEQ ID NO: 2260 - DNA, 32 bp, Artificial Sequence
  Synthetic
atgtaaatgtagtauagggaagcttcauaagt

SEQ ID NO: 2261 - DNA, 26 bp, Artificial Sequence
  Synthetic
tttcagaaaacacutgtcttgcgtut

SEQ ID NO: 2262 - DNA, 32 bp, Artificial Sequence
  Synthetic
agaggaatttgattuaatcagaactgagcaua

SEQ ID NO: 2263 - DNA, 26 bp, Artificial Sequence
  Synthetic
ttccatttcugagtttacacagugct

SEQ ID NO: 2264 - DNA, 32 bp, Artificial Sequence
  Synthetic
gatgttcctgugaaaacaaatatagaagttug

SEQ ID NO: 2265 - DNA, 23 bp, Artificial Sequence
  Synthetic
agagaatgtguggcatgactugg

SEQ ID NO: 2266 - DNA, 32 bp, Artificial Sequence
  Synthetic
gtcaataaacttatauattttctccccatugc

SEQ ID NO: 2267 - DNA, 27 bp, Artificial Sequence
  Synthetic
cctgaaacugctaaattgctugaagat

SEQ ID NO: 2268 - DNA, 28 bp, Artificial Sequence
  Synthetic
gatggacatggcuctgatgataguaaaa

SEQ ID NO: 2269 - DNA, 29 bp, Artificial Sequence
  Synthetic
ctaacugaaaggcaaaaattcaucacaca

SEQ ID NO: 2270 - DNA, 28 bp, Artificial Sequence
  Synthetic
aaggaaaguttatggacuggaaaaggaa

SEQ ID NO: 2271 - DNA, 28 bp, Artificial Sequence
  Synthetic
agacagtuaagagaagaaagagggauga

SEQ ID NO: 2272 - DNA, 29 bp, Artificial Sequence
  Synthetic
ttaaacagtggaatuctagagtcacacut

SEQ ID NO: 2273 - DNA, 28 bp, Artificial Sequence
  Synthetic
gctgtgtcatcccuttccattatcttut

SEQ ID NO: 2274 - DNA, 31 bp, Artificial Sequence
  Synthetic
aggcagttcuagaagaatgaaaactcttaug

SEQ ID NO: 2275 - DNA, 24 bp, Artificial Sequence
  Synthetic
aggaaaagguctagggucaggaaa

SEQ ID NO: 2276 - DNA, 32 bp, Artificial Sequence
  Synthetic
atctggattauacatatttcgcaaugaaagag

SEQ ID NO: 2277 - DNA, 27 bp, Artificial Sequence
  Synthetic
accttcatgttcutcaaattcctccug

SEQ ID NO: 2278 - DNA, 28 bp, Artificial Sequence
  Synthetic
aagagcagtuaagagccttgaataauca

SEQ ID NO: 2279 - DNA, 28 bp, Artificial Sequence
  Synthetic
acatcccttgauaaaccttgttccttut

SEQ ID NO: 2280 - DNA, 31 bp, Artificial Sequence
  Synthetic
gcttgttagtttauggaatctccatatgtug

SEQ ID NO: 2281 - DNA, 27 bp, Artificial Sequence
  Synthetic
acaaatcctatuaggtccaccucagaa

SEQ ID NO: 2282 - DNA, 28 bp, Artificial Sequence
  Synthetic
tgcaatttauaaagcagcttttccacut

SEQ ID NO: 2283 - DNA, 25 bp, Artificial Sequence
  Synthetic
ggccctgaaguacagtctttagtug

SEQ ID NO: 2284 - DNA, 23 bp, Artificial Sequence
  Synthetic
ctccacctgutagtcccattugt

SEQ ID NO: 2285 - DNA, 30 bp, Artificial Sequence
  Synthetic
gagtcatutgaggagaautcagttctttut

SEQ ID NO: 2286 - DNA, 28 bp, Artificial Sequence
  Synthetic
gccagtacggaagaaugtgagaaaaaua

SEQ ID NO: 2287 - DNA, 28 bp, Artificial Sequence
  Synthetic
tgtgcaacataaguactaatgtgtggut

SEQ ID NO: 2288 - DNA, 28 bp, Artificial Sequence
  Synthetic
ccatgggaacucaatagaaaatccucat

SEQ ID NO: 2289 - DNA, 26 bp, Artificial Sequence
  Synthetic
acgacactuaccaaagtctgtttcut

SEQ ID NO: 2290 - DNA, 23 bp, Artificial Sequence
  Synthetic
cgacctctaugttttgcctccut

SEQ ID NO: 2291 - DNA, 27 bp, Artificial Sequence
  Synthetic
aaatgttcacaugccttatcatguaga

SEQ ID NO: 2292 - DNA, 24 bp, Artificial Sequence
  Synthetic
caattgttcttugttccctgtugg

SEQ ID NO: 2293 - DNA, 23 bp, Artificial Sequence
  Synthetic
caagccttugagttggtactgug

SEQ ID NO: 2294 - DNA, 28 bp, Artificial Sequence
  Synthetic
catcttacuagaagcgtattgucacact

SEQ ID NO: 2295 - DNA, 25 bp, Artificial Sequence
  Synthetic
acatggagaugacttcacgucaaaa

SEQ ID NO: 2296 - DNA, 28 bp, Artificial Sequence
  Synthetic
gtgatgaaggacutaaagtgagagaugg

SEQ ID NO: 2297 - DNA, 21 bp, Artificial Sequence
  Synthetic
ccccacgugaacaagugacat

SEQ ID NO: 2298 - DNA, 25 bp, Artificial Sequence
  Synthetic
cgaattctgcutctgaagtcatugg

SEQ ID NO: 2299 - DNA, 24 bp, Artificial Sequence
  Synthetic
agattcagtgguctgctgttctug

SEQ ID NO: 2300 - DNA, 19 bp, Artificial Sequence
  Synthetic
ggacgacguggatggugag

SEQ ID NO: 2301 - DNA, 27 bp, Artificial Sequence
  Synthetic
ctcatccaccaacuccttaaaacucaa

SEQ ID NO: 2302 - DNA, 21 bp, Artificial Sequence
  Synthetic
agactuccggaaccatcacug

SEQ ID NO: 2303 - DNA, 28 bp, Artificial Sequence
  Synthetic
cccaattgattgugaaagtccacataut

SEQ ID NO: 2304 - DNA, 30 bp, Artificial Sequence
  Synthetic
ctcattgctgtguaagtaattgtttcctut

SEQ ID NO: 2305 - DNA, 18 bp, Artificial Sequence
  Synthetic
gguaggccucggcaacag

SEQ ID NO: 2306 - DNA, 27 bp, Artificial Sequence
  Synthetic
aggttgagctugttgatttggttuaga

SEQ ID NO: 2307 - DNA, 25 bp, Artificial Sequence
  Synthetic
agctctgtttaguctctggctctua

SEQ ID NO: 2308 - DNA, 25 bp, Artificial Sequence
  Synthetic
tgcctcucagaatcatctgauggat

SEQ ID NO: 2309 - DNA, 22 bp, Artificial Sequence
  Synthetic
cattctucacgggagcttccut

SEQ ID NO: 2310 - DNA, 28 bp, Artificial Sequence
  Synthetic
ctatgcgtggcucaaattctttttacut

SEQ ID NO: 2311 - DNA, 26 bp, Artificial Sequence
  Synthetic
gagatggagautttcagtucagacca

SEQ ID NO: 2312 - DNA, 24 bp, Artificial Sequence
  Synthetic
gatactgacgautgcgctccauaa

SEQ ID NO: 2313 - DNA, 31 bp, Artificial Sequence
  Synthetic
gaaacagauggagaagatatatacucagcaa

SEQ ID NO: 2314 - DNA, 24 bp, Artificial Sequence
  Synthetic
gactgagttcugtgcggacaauat

SEQ ID NO: 2315 - DNA, 23 bp, Artificial Sequence
  Synthetic
cgaaagtgucgcatcaaactcuc

SEQ ID NO: 2316 - DNA, 23 bp, Artificial Sequence
  Synthetic
ggtttcagcuattgggaaccuga

SEQ ID NO: 2317 - DNA, 25 bp, Artificial Sequence
  Synthetic
agagtcacugtggaagtaguaggaa

SEQ ID NO: 2318 - DNA, 23 bp, Artificial Sequence
  Synthetic
gtctccagugacatcccactauc

SEQ ID NO: 2319 - DNA, 27 bp, Artificial Sequence
  Synthetic
gtaaaaguggcctttttgctuacaagt

SEQ ID NO: 2320 - DNA, 24 bp, Artificial Sequence
  Synthetic
actttuacaaggccaacacgauga

SEQ ID NO: 2321 - DNA, 25 bp, Artificial Sequence
  Synthetic
gcttaccttcuccaggctttuacac

SEQ ID NO: 2322 - DNA, 24 bp, Artificial Sequence
  Synthetic
ccagugaacagaggaaaagcugag

SEQ ID NO: 2323 - DNA, 25 bp, Artificial Sequence
  Synthetic
tcagaagaaaacugtggtgtugaca

SEQ ID NO: 2324 - DNA, 26 bp, Artificial Sequence
  Synthetic
tcatcttcatagucagcctcttccut

SEQ ID NO: 2325 - DNA, 21 bp, Artificial Sequence
  Synthetic
gcagctatguttcccctccut

SEQ ID NO: 2326 - DNA, 23 bp, Artificial Sequence
  Synthetic
cuttaaaaaggagucgccaagca

SEQ ID NO: 2327 - DNA, 21 bp, Artificial Sequence
  Synthetic
ctcaagggcaggauggatuct

SEQ ID NO: 2328 - DNA, 28 bp, Artificial Sequence
  Synthetic
ccattggcgagautttgattguaagaaa

SEQ ID NO: 2329 - DNA, 25 bp, Artificial Sequence
  Synthetic
caaggtgctaauagaacctcctcuc

SEQ ID NO: 2330 - DNA, 24 bp, Artificial Sequence
  Synthetic
tcttagcucctctgcagucaaaag

SEQ ID NO: 2331 - DNA, 28 bp, Artificial Sequence
  Synthetic
tgcgctttgtatutatctgtccatttut

SEQ ID NO: 2332 - DNA, 30 bp, Artificial Sequence
  Synthetic
tggttaggtcaaggutgtactttgtttuat

SEQ ID NO: 2333 - DNA, 25 bp, Artificial Sequence
  Synthetic
gcaattttgaucagcctcatcgaut

SEQ ID NO: 2334 - DNA, 29 bp, Artificial Sequence
  Synthetic
tgatacagataaguttcataccaaagcug

SEQ ID NO: 2335 - DNA, 22 bp, Artificial Sequence
  Synthetic
tcggctugaaaaacctgcacua

SEQ ID NO: 2336 - DNA, 23 bp, Artificial Sequence
  Synthetic
gagcttccgccutctaaagtuga

SEQ ID NO: 2337 - DNA, 25 bp, Artificial Sequence
  Synthetic
agaggctaataugcttgagcaugac

SEQ ID NO: 2338 - DNA, 28 bp, Artificial Sequence
  Synthetic
ttcttctaaacutacaacaauggaggct

SEQ ID NO: 2339 - DNA, 28 bp, Artificial Sequence
  Synthetic
gattaccaagtgauccgtttactcauct

SEQ ID NO: 2340 - DNA, 21 bp, Artificial Sequence
  Synthetic
caatcugccggcacatgtuaa

SEQ ID NO: 2341 - DNA, 27 bp, Artificial Sequence
  Synthetic
cccacagaataucgatcctatgtucaa

SEQ ID NO: 2342 - DNA, 23 bp, Artificial Sequence
  Synthetic
cccaatgccaugtccagttauga

SEQ ID NO: 2343 - DNA, 26 bp, Artificial Sequence
  Synthetic
gcatguacttccatttuaaaggaggc

SEQ ID NO: 2344 - DNA, 28 bp, Artificial Sequence
  Synthetic
agtgcatgtattutccttaggaaagugt

SEQ ID NO: 2345 - DNA, 22 bp, Artificial Sequence
  Synthetic
cgtgccguattggtagttcugg

SEQ ID NO: 2346 - DNA, 32 bp, Artificial Sequence
  Synthetic
ctaatctcatuaaagctgagtcaaucagaagt

SEQ ID NO: 2347 - DNA, 28 bp, Artificial Sequence
  Synthetic
cattttgggacuaactgcttccatttua

SEQ ID NO: 2348 - DNA, 25 bp, Artificial Sequence
  Synthetic
cttggttccauctctcttttgucca

SEQ ID NO: 2349 - DNA, 24 bp, Artificial Sequence
  Synthetic
agagccaacuaggcaagatttcuc

SEQ ID NO: 2350 - DNA, 22 bp, Artificial Sequence
  Synthetic
gaaaggacccautggugaggaa

SEQ ID NO: 2351 - DNA, 26 bp, Artificial Sequence
  Synthetic
aaccctgcaugattgtgtaatgguat

SEQ ID NO: 2352 - DNA, 18 bp, Artificial Sequence
  Synthetic
gcgtgagcutgctgcuct

SEQ ID NO: 2353 - DNA, 18 bp, Artificial Sequence
  Synthetic
cagcgacacgugcgagua

SEQ ID NO: 2354 - DNA, 20 bp, Artificial Sequence
  Synthetic
ccactgcgaguacacgtuct

SEQ ID NO: 2355 - DNA, 17 bp, Artificial Sequence
  Synthetic
cctuccccgggctctuc

SEQ ID NO: 2356 - DNA, 17 bp, Artificial Sequence
  Synthetic
gccttgugcatgugcgt

SEQ ID NO: 2357 - DNA, 23 bp, Artificial Sequence
  Synthetic
ggcaagaccutcaagtuccagag

SEQ ID NO: 2358 - DNA, 18 bp, Artificial Sequence
  Synthetic
cgagtcgauggccauggg

SEQ ID NO: 2359 - DNA, 17 bp, Artificial Sequence
  Synthetic
cgccgccuctctucagt

SEQ ID NO: 2360 - DNA, 18 bp, Artificial Sequence
  Synthetic
gaagccgugcgtgttcug

SEQ ID NO: 2361 - DNA, 19 bp, Artificial Sequence
  Synthetic
ctcacgcugtctctgccut

SEQ ID NO: 2362 - DNA, 19 bp, Artificial Sequence
  Synthetic
gcaagcgcagcaucccaua

SEQ ID NO: 2363 - DNA, 20 bp, Artificial Sequence
  Synthetic
gagcucaggaaagtguccga

SEQ ID NO: 2364 - DNA, 18 bp, Artificial Sequence
  Synthetic
gcucgagaggacagcgug

SEQ ID NO: 2365 - DNA, 19 bp, Artificial Sequence
  Synthetic
ccccactucccccagtuct

SEQ ID NO: 2366 - DNA, 17 bp, Artificial Sequence
  Synthetic
catgcgugcgcgugaat

SEQ ID NO: 2367 - DNA, 20 bp, Artificial Sequence
  Synthetic
cactgtggccutgtttccug

SEQ ID NO: 2368 - DNA, 20 bp, Artificial Sequence
  Synthetic
cttgaucccctcctugcaca

SEQ ID NO: 2369 - DNA, 19 bp, Artificial Sequence
  Synthetic
tggtguaccgggaccucaa

SEQ ID NO: 2370 - DNA, 21 bp, Artificial Sequence
  Synthetic
aagacaggacaucgtccccua

SEQ ID NO: 2371 - DNA, 19 bp, Artificial Sequence
  Synthetic
cacccagcccugcttuaca

SEQ ID NO: 2372 - DNA, 21 bp, Artificial Sequence
  Synthetic
cctgagttgucactgggugag

SEQ ID NO: 2373 - DNA, 21 bp, Artificial Sequence
  Synthetic
ggtggagcucctgatctggua

SEQ ID NO: 2374 - DNA, 26 bp, Artificial Sequence
  Synthetic
ctgtgtgatcugatctttacctuccc

SEQ ID NO: 2375 - DNA, 24 bp, Artificial Sequence
  Synthetic
agacttaccuccatcugaagccat

SEQ ID NO: 2376 - DNA, 25 bp, Artificial Sequence
  Synthetic
ccatcatgccutcagtattctcucc

SEQ ID NO: 2377 - DNA, 20 bp, Artificial Sequence
  Synthetic
tttgagagggcucagcugac

SEQ ID NO: 2378 - DNA, 22 bp, Artificial Sequence
  Synthetic
gaccgcuccaaaattuccaagg

SEQ ID NO: 2379 - DNA, 27 bp, Artificial Sequence
  Synthetic
agccctagaauaattaatctccgguct

SEQ ID NO: 2380 - DNA, 23 bp, Artificial Sequence
  Synthetic
gctgaggagaugcagatucagaa

SEQ ID NO: 2381 - DNA, 21 bp, Artificial Sequence
  Synthetic
ccacggcucctgtcaaaatug

SEQ ID NO: 2382 - DNA, 27 bp, Artificial Sequence
  Synthetic
cttagtttcttcugtaaagcccctugt

SEQ ID NO: 2383 - DNA, 25 bp, Artificial Sequence
  Synthetic
caattaaggucaagggauctctcug

SEQ ID NO: 2384 - DNA, 24 bp, Artificial Sequence
  Synthetic
tgccttggaaagguttcttctuca

SEQ ID NO: 2385 - DNA, 20 bp, Artificial Sequence
  Synthetic
cctgtggagcugcaagtuct

SEQ ID NO: 2386 - DNA, 22 bp, Artificial Sequence
  Synthetic
gcaagucctgggatugcagaaa

SEQ ID NO: 2387 - DNA, 26 bp, Artificial Sequence
  Synthetic
gggaaggattcugatcataactcuga

SEQ ID NO: 2388 - DNA, 21 bp, Artificial Sequence
  Synthetic
gcagtgugattccctguggag

SEQ ID NO: 2389 - DNA, 22 bp, Artificial Sequence
  Synthetic
cctacggttucacagctctgut

SEQ ID NO: 2390 - DNA, 20 bp, Artificial Sequence
  Synthetic
ctccaacuaagggucagcga

SEQ ID NO: 2391 - DNA, 23 bp, Artificial Sequence
  Synthetic
ctttgggagucccagttgtguaa

SEQ ID NO: 2392 - DNA, 19 bp, Artificial Sequence
  Synthetic
gcuccctgcuggagcaaaa

SEQ ID NO: 2393 - DNA, 22 bp, Artificial Sequence
  Synthetic
ggtcgaactacucccagagcua

SEQ ID NO: 2394 - DNA, 20 bp, Artificial Sequence
  Synthetic
cugagccaggaaugcaggat

SEQ ID NO: 2395 - DNA, 21 bp, Artificial Sequence
  Synthetic
tccgagcggagccutctatua

SEQ ID NO: 2396 - DNA, 23 bp, Artificial Sequence
  Synthetic
cagaaugggtctuggagcaagaa

SEQ ID NO: 2397 - DNA, 26 bp, Artificial Sequence
  Synthetic
acatattactcuccttcccacctuga

SEQ ID NO: 2398 - DNA, 26 bp, Artificial Sequence
  Synthetic
tgggcagaagaauatgaagcuagaga

SEQ ID NO: 2399 - DNA, 30 bp, Artificial Sequence
  Synthetic
ttagagttaagacaagcuccaaagaaagut

SEQ ID NO: 2400 - DNA, 22 bp, Artificial Sequence
  Synthetic
gctgaugaggcttcuacagcag

SEQ ID NO: 2401 - DNA, 23 bp, Artificial Sequence
  Synthetic
tgtcagcaaagcacuggatcuaa

SEQ ID NO: 2402 - DNA, 25 bp, Artificial Sequence
  Synthetic
ggagatccuctacaaagggtucaga

SEQ ID NO: 2403 - DNA, 24 bp, Artificial Sequence
  Synthetic
cttcagcccgaauttctucaaagg

SEQ ID NO: 2404 - DNA, 22 bp, Artificial Sequence
  Synthetic
cautttctggaugggagggaca

SEQ ID NO: 2405 - DNA, 25 bp, Artificial Sequence
  Synthetic
agaactggauagagtcattccuggt

SEQ ID NO: 2406 - DNA, 24 bp, Artificial Sequence
  Synthetic
ccttgcagutctcaaaaccucaga

SEQ ID NO: 2407 - DNA, 29 bp, Artificial Sequence
  Synthetic
agcttttgtggutttgaataaacaaucca

SEQ ID NO: 2408 - DNA, 26 bp, Artificial Sequence
  Synthetic
gcccaattatugaagacagtcgugaa

SEQ ID NO: 2409 - DNA, 30 bp, Artificial Sequence
  Synthetic
gtggtatgtataucctacctgaagtcucat

SEQ ID NO: 2410 - DNA, 26 bp, Artificial Sequence
  Synthetic
ccttaaaccaggagguaaaagcuaca

SEQ ID NO: 2411 - DNA, 30 bp, Artificial Sequence
  Synthetic
ccacccagaataacutgtaatcttcacaua

SEQ ID NO: 2412 - DNA, 27 bp, Artificial Sequence
  Synthetic
agctgttatcaauatcaagatggcugt

SEQ ID NO: 2413 - DNA, 28 bp, Artificial Sequence
  Synthetic
ctaaattccuttgctaaauggagcacaa

SEQ ID NO: 2414 - DNA, 27 bp, Artificial Sequence
  Synthetic
gatagtggactuttcctacagtgtuga

SEQ ID NO: 2415 - DNA, 26 bp, Artificial Sequence
  Synthetic
aagaaaccctcuccatatttgcucag

SEQ ID NO: 2416 - DNA, 27 bp, Artificial Sequence
  Synthetic
ggaaggtagggaagutaactagtccug

SEQ ID NO: 2417 - DNA, 26 bp, Artificial Sequence
  Synthetic
acagcaatgguagtgcatctaaaugt

SEQ ID NO: 2418 - DNA, 23 bp, Artificial Sequence
  Synthetic
ggatgaacacautgctttcugct

SEQ ID NO: 2419 - DNA, 29 bp, Artificial Sequence
  Synthetic
atgccattatcatugaattgtgttttcug

SEQ ID NO: 2420 - DNA, 29 bp, Artificial Sequence
  Synthetic
cgtggatcaaaacacutcttcagaaaaua

SEQ ID NO: 2421 - DNA, 25 bp, Artificial Sequence
  Synthetic
gcauttgatgtguagaagaggcact

SEQ ID NO: 2422 - DNA, 28 bp, Artificial Sequence
  Synthetic
catttaaccacacuttgcagatctuacc

SEQ ID NO: 2423 - DNA, 29 bp, Artificial Sequence
  Synthetic
ggaaaggtctugaaaagcagtattttgut

SEQ ID NO: 2424 - DNA, 30 bp, Artificial Sequence
  Synthetic
ggagaaaaatttgcuaaagcatgacaguaa

SEQ ID NO: 2425 - DNA, 28 bp, Artificial Sequence
  Synthetic
tgtatgactctuggtaatgtccatgtuc

SEQ ID NO: 2426 - DNA, 25 bp, Artificial Sequence
  Synthetic
cuaaggaaagaauacagcagagcct

SEQ ID NO: 2427 - DNA, 21 bp, Artificial Sequence
  Synthetic
tggtactcuccggtgcuagat

SEQ ID NO: 2428 - DNA, 28 bp, Artificial Sequence
  Synthetic
tcatgggaacaauctttgttttcuacca

SEQ ID NO: 2429 - DNA, 26 bp, Artificial Sequence
  Synthetic
tgggattgcutaaacttttccucagt

SEQ ID NO: 2430 - DNA, 30 bp, Artificial Sequence
  Synthetic
agttgaaaaatguggtaaaagtcccauaga

SEQ ID NO: 2431 - DNA, 22 bp, Artificial Sequence
  Synthetic
tggtccaccaacacutttccut

SEQ ID NO: 2432 - DNA, 28 bp, Artificial Sequence
  Synthetic
agtcacacaacugccttagaatguaaaa

SEQ ID NO: 2433 - DNA, 29 bp, Artificial Sequence
  Synthetic
tgttctttcctttucttggtagtcaauga

SEQ ID NO: 2434 - DNA, 25 bp, Artificial Sequence
  Synthetic
aatcagccacutgcaaaaacaucaa

SEQ ID NO: 2435 - DNA, 30 bp, Artificial Sequence
  Synthetic
accatacaactcugggtaatatccatauca

SEQ ID NO: 2436 - DNA, 23 bp, Artificial Sequence
  Synthetic
tctggaagucaccgattcccaua

SEQ ID NO: 2437 - DNA, 24 bp, Artificial Sequence
  Synthetic
cagtgcttgtutttcagcgattuc

SEQ ID NO: 2438 - DNA, 26 bp, Artificial Sequence
  Synthetic
tgctgtttgtggauccagtgataaut

SEQ ID NO: 2439 - DNA, 26 bp, Artificial Sequence
  Synthetic
ctggcaaaaucatttgcauaagcaag

SEQ ID NO: 2440 - DNA, 29 bp, Artificial Sequence
  Synthetic
ttgatgacatutatgttattccucagcct

SEQ ID NO: 2441 - DNA, 28 bp, Artificial Sequence
  Synthetic
cacatatgggugcagaggaattttcuat

SEQ ID NO: 2442 - DNA, 24 bp, Artificial Sequence
  Synthetic
ggagaagcaccagaucctgtaaut

SEQ ID NO: 2443 - DNA, 29 bp, Artificial Sequence
  Synthetic
cattgtgtgccutatttcctaatucaagt

SEQ ID NO: 2444 - DNA, 28 bp, Artificial Sequence
  Synthetic
cagatuccagcagauacaactgatauaa

SEQ ID NO: 2445 - DNA, 28 bp, Artificial Sequence
  Synthetic
agagtctgaagaautgatctcaucagga

SEQ ID NO: 2446 - DNA, 27 bp, Artificial Sequence
  Synthetic
cagtttagtttugacttgttcgucacc

SEQ ID NO: 2447 - DNA, 28 bp, Artificial Sequence
  Synthetic
agaattttaacataccuccctcaagcuc

SEQ ID NO: 2448 - DNA, 26 bp, Artificial Sequence
  Synthetic
agattaaagcuttctgcaucgaacca

SEQ ID NO: 2449 - DNA, 28 bp, Artificial Sequence
  Synthetic
cgttcagaatgucttcactgattcucat

SEQ ID NO: 2450 - DNA, 29 bp, Artificial Sequence
  Synthetic
caaaaaccttatcuctctgaataccugct

SEQ ID NO: 2451 - DNA, 23 bp, Artificial Sequence
  Synthetic
atgcctgcauttccttaccucaa

SEQ ID NO: 2452 - DNA, 27 bp, Artificial Sequence
  Synthetic
gtgagccacuaagcattgaaatgttut

SEQ ID NO: 2453 - DNA, 30 bp, Artificial Sequence
  Synthetic
gttcattaggttauaatttggtccccauct

SEQ ID NO: 2454 - DNA, 24 bp, Artificial Sequence
  Synthetic
tcaggactgccauttctaccacua

SEQ ID NO: 2455 - DNA, 29 bp, Artificial Sequence
  Synthetic
acatcatcagaaggaautttactcagcut

SEQ ID NO: 2456 - DNA, 22 bp, Artificial Sequence
  Synthetic
cttgcagacuccgaaggaagut

SEQ ID NO: 2457 - DNA, 30 bp, Artificial Sequence
  Synthetic
gtatcaaagtcauccatatcatcccaauca

SEQ ID NO: 2458 - DNA, 28 bp, Artificial Sequence
  Synthetic
cccattgcugaagtgcatataaaugaag

SEQ ID NO: 2459 - DNA, 26 bp, Artificial Sequence
  Synthetic
catgactattcccaauggctagctut

SEQ ID NO: 2460 - DNA, 28 bp, Artificial Sequence
  Synthetic
acctcugauagaaaagaggatgttctua

SEQ ID NO: 2461 - DNA, 28 bp, Artificial Sequence
  Synthetic
tgtctaaaatatugcttgtaccgucaca

SEQ ID NO: 2462 - DNA, 21 bp, Artificial Sequence
  Synthetic
gtgatgccagucttctuggct

SEQ ID NO: 2463 - DNA, 23 bp, Artificial Sequence
  Synthetic
gggtggtagucagtaaacagucc

SEQ ID NO: 2464 - DNA, 31 bp, Artificial Sequence
  Synthetic
aattttgacatagaugactttgatgatgaug

SEQ ID NO: 2465 - DNA, 22 bp, Artificial Sequence
  Synthetic
ctgtcttggcugaggaaaguct

SEQ ID NO: 2466 - DNA, 26 bp, Artificial Sequence
  Synthetic
gaactaatcagcuagaggcgaucaat

SEQ ID NO: 2467 - DNA, 26 bp, Artificial Sequence
  Synthetic
tgatagaaatacugtgtaggtgguct

SEQ ID NO: 2468 - DNA, 28 bp, Artificial Sequence
  Synthetic
tctactcuggagaatctctaugagagga

SEQ ID NO: 2469 - DNA, 22 bp, Artificial Sequence
  Synthetic
ctcgttcacucagtgtgggtut

SEQ ID NO: 2470 - DNA, 25 bp, Artificial Sequence
  Synthetic
ttctcagtacucttggtttctuggc

SEQ ID NO: 2471 - DNA, 22 bp, Artificial Sequence
  Synthetic
aatccacttcugctgcactuca

SEQ ID NO: 2472 - DNA, 33 bp, Artificial Sequence
  Synthetic
ttctatgatatgcuctatttttcccctauaagt

SEQ ID NO: 2473 - DNA, 28 bp, Artificial Sequence
  Synthetic
tcctgcattccgutatattttcacagua

SEQ ID NO: 2474 - DNA, 28 bp, Artificial Sequence
  Synthetic
gactttttagccucttctattugagggt

SEQ ID NO: 2475 - DNA, 27 bp, Artificial Sequence
  Synthetic
tcgtgaauaagcagatcctttuccaaa

SEQ ID NO: 2476 - DNA, 23 bp, Artificial Sequence
  Synthetic
agtgtcucagagggaagagaugg

SEQ ID NO: 2477 - DNA, 24 bp, Artificial Sequence
  Synthetic
tgtgccacguaacaaaggauacat

SEQ ID NO: 2478 - DNA, 23 bp, Artificial Sequence
  Synthetic
gaagacagtuccccagggauaag

SEQ ID NO: 2479 - DNA, 25 bp, Artificial Sequence
  Synthetic
tggcatcttttucctcttccttuca

SEQ ID NO: 2480 - DNA, 28 bp, Artificial Sequence
  Synthetic
ccgaagcctauaaatagaccgtttctua

SEQ ID NO: 2481 - DNA, 30 bp, Artificial Sequence
  Synthetic
caagaataacagcuttatagtcacagaugg

SEQ ID NO: 2482 - DNA, 18 bp, Artificial Sequence
  Synthetic
tgctuctgagcugggcat

SEQ ID NO: 2483 - DNA, 20 bp, Artificial Sequence
  Synthetic
gcuctgacagguaggaccca

SEQ ID NO: 2484 - DNA, 25 bp, Artificial Sequence
  Synthetic
cttcttcauccaagggactttucct

SEQ ID NO: 2485 - DNA, 24 bp, Artificial Sequence
  Synthetic
tcttgccctugattgtcctttuct

SEQ ID NO: 2486 - DNA, 23 bp, Artificial Sequence
  Synthetic
cagtctcuaacacagcccactuc

SEQ ID NO: 2487 - DNA, 20 bp, Artificial Sequence
  Synthetic
ggttttcuccaggcgcauct

SEQ ID NO: 2488 - DNA, 25 bp, Artificial Sequence
  Synthetic
acccaagugcatttctggaaucaat

SEQ ID NO: 2489 - DNA, 19 bp, Artificial Sequence
  Synthetic
ggccgguctggagatgtug

SEQ ID NO: 2490 - DNA, 20 bp, Artificial Sequence
  Synthetic
cacugcaggacacgtauggt

SEQ ID NO: 2491 - DNA, 17 bp, Artificial Sequence
  Synthetic
gccgttcugcccagucc

SEQ ID NO: 2492 - DNA, 19 bp, Artificial Sequence
  Synthetic
tgaccgcgutctgctcauc

SEQ ID NO: 2493 - DNA, 19 bp, Artificial Sequence
  Synthetic
gugaggaggagggugcaac

SEQ ID NO: 2494 - DNA, 19 bp, Artificial Sequence
  Synthetic
cacgcucacgggactcuat

SEQ ID NO: 2495 - DNA, 18 bp, Artificial Sequence
  Synthetic
gcccaggucctcacguct

SEQ ID NO: 2496 - DNA, 17 bp, Artificial Sequence
  Synthetic
ctgccucgguggacagg

SEQ ID NO: 2497 - DNA, 20 bp, Artificial Sequence
  Synthetic
tgtaccacgugcugccaaat

SEQ ID NO: 2498 - DNA, 21 bp, Artificial Sequence
  Synthetic
gagaccaagcuactucaggca

SEQ ID NO: 2499 - DNA, 22 bp, Artificial Sequence
  Synthetic
cctacatgucctcaaccugcat

SEQ ID NO: 2500 - DNA, 22 bp, Artificial Sequence
  Synthetic
augcgctgagugagaacaagat

SEQ ID NO: 2501 - DNA, 19 bp, Artificial Sequence
  Synthetic
aagucagccggacttuggg

SEQ ID NO: 2502 - DNA, 22 bp, Artificial Sequence
  Synthetic
ctctctccuctaacctggcuct

SEQ ID NO: 2503 - DNA, 21 bp, Artificial Sequence
  Synthetic
cacagcugggatcatcucagg

SEQ ID NO: 2504 - DNA, 22 bp, Artificial Sequence
  Synthetic
ggctcctcuaccactttcucca

SEQ ID NO: 2505 - DNA, 19 bp, Artificial Sequence
  Synthetic
aggaggcccucaacacuct

SEQ ID NO: 2506 - DNA, 27 bp, Artificial Sequence
  Synthetic
aatgaatggcaautacctacctgtuct

SEQ ID NO: 2507 - DNA, 24 bp, Artificial Sequence
  Synthetic
cguttgtttttcuggcgaaagagg

SEQ ID NO: 2508 - DNA, 29 bp, Artificial Sequence
  Synthetic
aggttccatguagcagtaaactcatttut

SEQ ID NO: 2509 - DNA, 28 bp, Artificial Sequence
  Synthetic
ggcattttagtucctttagacatgcaut

SEQ ID NO: 2510 - DNA, 23 bp, Artificial Sequence
  Synthetic
ggatgacagccagutacgtaugt

SEQ ID NO: 2511 - DNA, 26 bp, Artificial Sequence
  Synthetic
gcatttataaacaucgaggtgcugga

SEQ ID NO: 2512 - DNA, 29 bp, Artificial Sequence
  Synthetic
ctaggaggacaagugaggtaataguaaca

SEQ ID NO: 2513 - DNA, 27 bp, Artificial Sequence
  Synthetic
gctatccttcucaaaggttttcctgua

SEQ ID NO: 2514 - DNA, 27 bp, Artificial Sequence
  Synthetic
cccggaagaaautaagcatgaagaaut

SEQ ID NO: 2515 - DNA, 21 bp, Artificial Sequence
  Synthetic
aaccacguatcttggcuccac

SEQ ID NO: 2516 - DNA, 26 bp, Artificial Sequence
  Synthetic
agaagtgtugacaatgttttcuccca

SEQ ID NO: 2517 - DNA, 21 bp, Artificial Sequence
  Synthetic
cctgacaaagugcaggacuca

SEQ ID NO: 2518 - DNA, 22 bp, Artificial Sequence
  Synthetic
cctagcaagccuttctctcuca

SEQ ID NO: 2519 - DNA, 23 bp, Artificial Sequence
  Synthetic
gtttcagcucctcaaacaacucc

SEQ ID NO: 2520 - DNA, 27 bp, Artificial Sequence
  Synthetic
agaagucgtaucaaaaggaaaagggaa

SEQ ID NO: 2521 - DNA, 26 bp, Artificial Sequence
  Synthetic
ttctggtccaccguacaatcatuaag

SEQ ID NO: 2522 - DNA, 27 bp, Artificial Sequence
  Synthetic
gccttcauaaccgtagatttgaaugga

SEQ ID NO: 2523 - DNA, 21 bp, Artificial Sequence
  Synthetic
cccgcaaagacaucaaaccug

SEQ ID NO: 2524 - DNA, 18 bp, Artificial Sequence
  Synthetic
gcgaggauggcgaucagg

SEQ ID NO: 2525 - DNA, 21 bp, Artificial Sequence
  Synthetic
tgcccatagugatcagcgaug

SEQ ID NO: 2526 - DNA, 26 bp, Artificial Sequence
  Synthetic
acacactctatutccaagtgcatugt

SEQ ID NO: 2527 - DNA, 22 bp, Artificial Sequence
  Synthetic
ggccattaggguccttgatguc

SEQ ID NO: 2528 - DNA, 22 bp, Artificial Sequence
  Synthetic
ggcttucccagaacctctugac

SEQ ID NO: 2529 - DNA, 21 bp, Artificial Sequence
  Synthetic
gccccaagutacauccacgaa

SEQ ID NO: 2530 - DNA, 22 bp, Artificial Sequence
  Synthetic
tcacccccucctgtgtttcaua

SEQ ID NO: 2531 - DNA, 22 bp, Artificial Sequence
  Synthetic
ccagaugtctgtgucagaagca

SEQ ID NO: 2532 - DNA, 21 bp, Artificial Sequence
  Synthetic
ggtcaggccugggacttctua

SEQ ID NO: 2533 - DNA, 21 bp, Artificial Sequence
  Synthetic
gcagaugaccccacttaugga

SEQ ID NO: 2534 - DNA, 28 bp, Artificial Sequence
  Synthetic
catgaatgtuccctgatttgtcaucaat

SEQ ID NO: 2535 - DNA, 22 bp, Artificial Sequence
  Synthetic
gtaagtgaguttccccacugct

SEQ ID NO: 2536 - DNA, 17 bp, Artificial Sequence
  Synthetic
ggcggucagtcggucag

SEQ ID NO: 2537 - DNA, 17 bp, Artificial Sequence
  Synthetic
ctcacacucgcggcuca

SEQ ID NO: 2538 - DNA, 27 bp, Artificial Sequence
  Synthetic
tgtcttaggtauatttgaaggcuccca

SEQ ID NO: 2539 - DNA, 26 bp, Artificial Sequence
  Synthetic
accatgctcaauaaagcctgatgtua

SEQ ID NO: 2540 - DNA, 25 bp, Artificial Sequence
  Synthetic
gtggtgatgaccucaaacttcgtua

SEQ ID NO: 2541 - DNA, 27 bp, Artificial Sequence
  Synthetic
gtgatgtctatuactgcctaaggtuga

SEQ ID NO: 2542 - DNA, 23 bp, Artificial Sequence
  Synthetic
ccacaagutcgctcttuggagaa

SEQ ID NO: 2543 - DNA, 22 bp, Artificial Sequence
  Synthetic
gtaaucacaccatctgugccca

SEQ ID NO: 2544 - DNA, 24 bp, Artificial Sequence
  Synthetic
ccucagaagauagaagagagacug

SEQ ID NO: 2545 - DNA, 23 bp, Artificial Sequence
  Synthetic
ctccttgguacttctcugccaaa

SEQ ID NO: 2546 - DNA, 26 bp, Artificial Sequence
  Synthetic
attttgatcacgguaaccgaucagaa

SEQ ID NO: 2547 - DNA, 22 bp, Artificial Sequence
  Synthetic
tttgggctuggacaacacttug

SEQ ID NO: 2548 - DNA, 24 bp, Artificial Sequence
  Synthetic
ctacgtauaccctggtggtucaag

SEQ ID NO: 2549 - DNA, 30 bp, Artificial Sequence
  Synthetic
ttctttggaaacccuctaaggagttauaga

SEQ ID NO: 2550 - DNA, 23 bp, Artificial Sequence
  Synthetic
ccttttgagguctctcucaccac

SEQ ID NO: 2551 - DNA, 23 bp, Artificial Sequence
  Synthetic
ctgggcagugtaggatgtgatut

SEQ ID NO: 2552 - DNA, 23 bp, Artificial Sequence
  Synthetic
caagctgccacautttctgtgua

SEQ ID NO: 2553 - DNA, 29 bp, Artificial Sequence
  Synthetic
tctcacagaagaauatagttcgaggtuct

SEQ ID NO: 2554 - DNA, 25 bp, Artificial Sequence
  Synthetic
ccagaauaaagaccaagugaccacc

SEQ ID NO: 2555 - DNA, 21 bp, Artificial Sequence
  Synthetic
tcacttgccagcuggactuac

SEQ ID NO: 2556 - DNA, 22 bp, Artificial Sequence
  Synthetic
gcctgaagugactcguaacgac

SEQ ID NO: 2557 - DNA, 22 bp, Artificial Sequence
  Synthetic
cacaactccucctgagctuaga

SEQ ID NO: 2558 - DNA, 18 bp, Artificial Sequence
  Synthetic
gccacacacguggtgaug

SEQ ID NO: 2559 - DNA, 17 bp, Artificial Sequence
  Synthetic
cctgacuggcccctcug

SEQ ID NO: 2560 - DNA, 17 bp, Artificial Sequence
  Synthetic
ccucccacagctcugct

SEQ ID NO: 2561 - DNA, 18 bp, Artificial Sequence
  Synthetic
cgtggcccaucctgtgug

SEQ ID NO: 2562 - DNA, 20 bp, Artificial Sequence
  Synthetic
gcgcatgugtgctcctguaa

SEQ ID NO: 2563 - DNA, 21 bp, Artificial Sequence
  Synthetic
actaccgccuggaggacauag

SEQ ID NO: 2564 - DNA, 20 bp, Artificial Sequence
  Synthetic
tcatgcugggccaagtacug

SEQ ID NO: 2565 - DNA, 18 bp, Artificial Sequence
  Synthetic
ccctctgcucggaccuga

SEQ ID NO: 2566 - DNA, 18 bp, Artificial Sequence
  Synthetic
gccaaacugctgcagugt

SEQ ID NO: 2567 - DNA, 20 bp, Artificial Sequence
  Synthetic
accaacagccaucaatggug

SEQ ID NO: 2568 - DNA, 19 bp, Artificial Sequence
  Synthetic
tgtgugtggcgugaaggag

SEQ ID NO: 2569 - DNA, 22 bp, Artificial Sequence
  Synthetic
cccaguggacaggaaagcuaag

SEQ ID NO: 2570 - DNA, 25 bp, Artificial Sequence
  Synthetic
aggttcaagtgauggagacatgtut

SEQ ID NO: 2571 - DNA, 21 bp, Artificial Sequence
  Synthetic
aacucttcaugccggaagagg

SEQ ID NO: 2572 - DNA, 21 bp, Artificial Sequence
  Synthetic
ccggtccuttctttgacugga

SEQ ID NO: 2573 - DNA, 19 bp, Artificial Sequence
  Synthetic
gtccugagtggtugcccat

SEQ ID NO: 2574 - DNA, 22 bp, Artificial Sequence
  Synthetic
cacucccactccuacgaaacac

SEQ ID NO: 2575 - DNA, 29 bp, Artificial Sequence
  Synthetic
ttgtatttcuttagttcactucgaagcct

SEQ ID NO: 2576 - DNA, 21 bp, Artificial Sequence
  Synthetic
gcagcugcccaacatccauaa

SEQ ID NO: 2577 - DNA, 21 bp, Artificial Sequence
  Synthetic
cuggcgacaaagaagcttugg

SEQ ID NO: 2578 - DNA, 23 bp, Artificial Sequence
  Synthetic
ccuttcatcagcaucgagagagg

SEQ ID NO: 2579 - DNA, 20 bp, Artificial Sequence
  Synthetic
tcttucaaagcggccctgut

SEQ ID NO: 2580 - DNA, 22 bp, Artificial Sequence
  Synthetic
cagagagcugcgaagtucaaga

SEQ ID NO: 2581 - DNA, 25 bp, Artificial Sequence
  Synthetic
accagtaaagagcugtctcttcuca

SEQ ID NO: 2582 - DNA, 26 bp, Artificial Sequence
  Synthetic
cataaggatgggcuctgacatttuca

SEQ ID NO: 2583 - DNA, 20 bp, Artificial Sequence
  Synthetic
aaccgggcautcttctccuc

SEQ ID NO: 2584 - DNA, 25 bp, Artificial Sequence
  Synthetic
gggatgtccuccatcttttcaauct

SEQ ID NO: 2585 - DNA, 21 bp, Artificial Sequence
  Synthetic
agtgactuaacggtggtugcc

SEQ ID NO: 2586 - DNA, 23 bp, Artificial Sequence
  Synthetic
agagctgcutctttgggaaugag

SEQ ID NO: 2587 - DNA, 21 bp, Artificial Sequence
  Synthetic
gaagcacucagcagtcttgug

SEQ ID NO: 2588 - DNA, 22 bp, Artificial Sequence
  Synthetic
gacaucaccaattucagcagca

SEQ ID NO: 2589 - DNA, 24 bp, Artificial Sequence
  Synthetic
aggactccugcatttctuagagga

SEQ ID NO: 2590 - DNA, 28 bp, Artificial Sequence
  Synthetic
cccaaatctacaaguactttgagacgua

SEQ ID NO: 2591 - DNA, 22 bp, Artificial Sequence
  Synthetic
tgttgguccacttggatugagc

SEQ ID NO: 2592 - DNA, 20 bp, Artificial Sequence
  Synthetic
tgcucatcgcucacaaccaa

SEQ ID NO: 2593 - DNA, 21 bp, Artificial Sequence
  Synthetic
gtggtattgutcagcggguct

SEQ ID NO: 2594 - DNA, 21 bp, Artificial Sequence
  Synthetic
tctcactgccugtctctggut

SEQ ID NO: 2595 - DNA, 22 bp, Artificial Sequence
  Synthetic
tgtatgacaccugcatuccacc

SEQ ID NO: 2596 - DNA, 21 bp, Artificial Sequence
  Synthetic
cccuggtcaccuacaacacag

SEQ ID NO: 2597 - DNA, 22 bp, Artificial Sequence
  Synthetic
acaaaccuccccaccaaaauga

SEQ ID NO: 2598 - DNA, 23 bp, Artificial Sequence
  Synthetic
cagtgccaauatccaggagttug

SEQ ID NO: 2599 - DNA, 23 bp, Artificial Sequence
  Synthetic
tctggatccucaggactctguct

SEQ ID NO: 2600 - DNA, 18 bp, Artificial Sequence
  Synthetic
ggacuggccctcauccac

SEQ ID NO: 2601 - DNA, 20 bp, Artificial Sequence
  Synthetic
acactgggcuccctgtctua

SEQ ID NO: 2602 - DNA, 23 bp, Artificial Sequence
  Synthetic
cccactauaaggaccctccctuc

SEQ ID NO: 2603 - DNA, 22 bp, Artificial Sequence
  Synthetic
gcagaaaagaccgutggacuca

SEQ ID NO: 2604 - DNA, 18 bp, Artificial Sequence
  Synthetic
ggugaagtccucccagcc

SEQ ID NO: 2605 - DNA, 22 bp, Artificial Sequence
  Synthetic
agatccaagcaccutcacctuc

SEQ ID NO: 2606 - DNA, 23 bp, Artificial Sequence
  Synthetic
ggtgacacagcutatgccctaug

SEQ ID NO: 2607 - DNA, 20 bp, Artificial Sequence
  Synthetic
gtttgcuccggagagaccug

SEQ ID NO: 2608 - DNA, 21 bp, Artificial Sequence
  Synthetic
cctgacccugtctctgcctua

SEQ ID NO: 2609 - DNA, 22 bp, Artificial Sequence
  Synthetic
agacatcaauggtgcagauggg

SEQ ID NO: 2610 - DNA, 19 bp, Artificial Sequence
  Synthetic
ccaccaucctgcctcucct

SEQ ID NO: 2611 - DNA, 22 bp, Artificial Sequence
  Synthetic
agatacucctcagcauccacca

SEQ ID NO: 2612 - DNA, 20 bp, Artificial Sequence
  Synthetic
gccctcuacagcgguacagt

SEQ ID NO: 2613 - DNA, 22 bp, Artificial Sequence
  Synthetic
tgcccatcaguctctctgctua

SEQ ID NO: 2614 - DNA, 18 bp, Artificial Sequence
  Synthetic
tctggacgugccagtgug

SEQ ID NO: 2615 - DNA, 19 bp, Artificial Sequence
  Synthetic
caggtucccctggaagugg

SEQ ID NO: 2616 - DNA, 23 bp, Artificial Sequence
  Synthetic
augcaaaaggaccccatauagca

SEQ ID NO: 2617 - DNA, 27 bp, Artificial Sequence
  Synthetic
tttgacactttgaaugctctttcctuc

SEQ ID NO: 2618 - DNA, 22 bp, Artificial Sequence
  Synthetic
aggaaaguggtgcattgaugga

SEQ ID NO: 2619 - DNA, 31 bp, Artificial Sequence
  Synthetic
ctgtatgtaaccugtcttttctatgatcuct

SEQ ID NO: 2620 - DNA, 22 bp, Artificial Sequence
  Synthetic
agctgtcaautctggcttcucc

SEQ ID NO: 2621 - DNA, 22 bp, Artificial Sequence
  Synthetic
tcgtgtuggcaacataccauct

SEQ ID NO: 2622 - DNA, 27 bp, Artificial Sequence
  Synthetic
aaataaagaugtcagauaccacagcat

SEQ ID NO: 2623 - DNA, 24 bp, Artificial Sequence
  Synthetic
ccctauaagccagaauccagaagg

SEQ ID NO: 2624 - DNA, 25 bp, Artificial Sequence
  Synthetic
aagggcagaagagucacttatgaug

SEQ ID NO: 2625 - DNA, 30 bp, Artificial Sequence
  Synthetic
gtatttcattttcutggtgccatttaucgt

SEQ ID NO: 2626 - DNA, 21 bp, Artificial Sequence
  Synthetic
tgtcacucagaccaacuccct

SEQ ID NO: 2627 - DNA, 27 bp, Artificial Sequence
  Synthetic
ggaacaucaccttagugaggaaacaaa

SEQ ID NO: 2628 - DNA, 22 bp, Artificial Sequence
  Synthetic
gctctccttuctggacgcttut

SEQ ID NO: 2629 - DNA, 24 bp, Artificial Sequence
  Synthetic
cctatgggaaguagtcatgcauct

SEQ ID NO: 2630 - DNA, 25 bp, Artificial Sequence
  Synthetic
tgcttgagcuggcttcttuaaaaac

SEQ ID NO: 2631 - DNA, 27 bp, Artificial Sequence
  Synthetic
tgctagaggaaaacuttgaggaacaut

SEQ ID NO: 2632 - DNA, 31 bp, Artificial Sequence
  Synthetic
gactcattctttccutgattttcttccttut

SEQ ID NO: 2633 - DNA, 21 bp, Artificial Sequence
  Synthetic
caaggttucaaagcgccaguc

SEQ ID NO: 2634 - DNA, 29 bp, Artificial Sequence
  Synthetic
actgctactctcuacagatctttcagtut

SEQ ID NO: 2635 - DNA, 30 bp, Artificial Sequence
  Synthetic
gtgaacttaaagaauttgtcaatccuagcc

SEQ ID NO: 2636 - DNA, 25 bp, Artificial Sequence
  Synthetic
ctacugactactagtucaagcgcat

SEQ ID NO: 2637 - DNA, 29 bp, Artificial Sequence
  Synthetic
tcactcgaaaaagaauctgcttucaaaac

SEQ ID NO: 2638 - DNA, 24 bp, Artificial Sequence
  Synthetic
gtggctcaguaacaaatgctccua

SEQ ID NO: 2639 - DNA, 32 bp, Artificial Sequence
  Synthetic
gaggctttaatatguaaaagtgaaagagtuca

SEQ ID NO: 2640 - DNA, 28 bp, Artificial Sequence
  Synthetic
ggcagtttctgcutattccattctttuc

SEQ ID NO: 2641 - DNA, 24 bp, Artificial Sequence
  Synthetic
gctuagcaaggagccaacauaaca

SEQ ID NO: 2642 - DNA, 28 bp, Artificial Sequence
  Synthetic
agtactgtatcuacccactctctttuca

SEQ ID NO: 2643 - DNA, 29 bp, Artificial Sequence
  Synthetic
gtttcttatuaggactctgtctttuccct

SEQ ID NO: 2644 - DNA, 28 bp, Artificial Sequence
  Synthetic
gcccatacttuggatgatagaaactuca

SEQ ID NO: 2645 - DNA, 30 bp, Artificial Sequence
  Synthetic
ttttctctaacugcaaacataatgtttucc

SEQ ID NO: 2646 - DNA, 28 bp, Artificial Sequence
  Synthetic
tgcataggagauaatcataggaauccca

SEQ ID NO: 2647 - DNA, 24 bp, Artificial Sequence
  Synthetic
gatttatctgcucttcgcgtugaa

SEQ ID NO: 2648 - DNA, 18 bp, Artificial Sequence
  Synthetic
agccagcuctgggaggua

SEQ ID NO: 2649 - DNA, 21 bp, Artificial Sequence
  Synthetic
gccctcttcuctttggcctuc

SEQ ID NO: 2650 - DNA, 23 bp, Artificial Sequence
  Synthetic
catttgutgggtcauccagcaag

SEQ ID NO: 2651 - DNA, 21 bp, Artificial Sequence
  Synthetic
ccccacaccucctatttucgt

SEQ ID NO: 2652 - DNA, 18 bp, Artificial Sequence
  Synthetic
ctggcccgccugttcaua

SEQ ID NO: 2653 - DNA, 19 bp, Artificial Sequence
  Synthetic
agcagccccuggacattug

SEQ ID NO: 2654 - DNA, 20 bp, Artificial Sequence
  Synthetic
ctaccctucaccagguccag

SEQ ID NO: 2655 - DNA, 21 bp, Artificial Sequence
  Synthetic
ccccacaguagcttuccacag

SEQ ID NO: 2656 - DNA, 22 bp, Artificial Sequence
  Synthetic
gcggtttgtcuctcttgctcut

SEQ ID NO: 2657 - DNA, 19 bp, Artificial Sequence
  Synthetic
agacuaagcgccucagggt

SEQ ID NO: 2658 - DNA, 23 bp, Artificial Sequence
  Synthetic
gggauggagggagttuacaggaa

SEQ ID NO: 2659 - DNA, 27 bp, Artificial Sequence
  Synthetic
gattgaauacaaaaccaucaagaccuc

SEQ ID NO: 2660 - DNA, 22 bp, Artificial Sequence
  Synthetic
agtggtaggugatgttcuggga

SEQ ID NO: 2661 - DNA, 22 bp, Artificial Sequence
  Synthetic
aggactagaggutcccgcauag

SEQ ID NO: 2662 - DNA, 19 bp, Artificial Sequence
  Synthetic
tggcauggcaggaguagga

SEQ ID NO: 2663 - DNA, 19 bp, Artificial Sequence
  Synthetic
cacccucaagagccugagc

SEQ ID NO: 2664 - DNA, 23 bp, Artificial Sequence
  Synthetic
acauacaacaggaccagcaucac

SEQ ID NO: 2665 - DNA, 22 bp, Artificial Sequence
  Synthetic
cttcuggcagcctttcucaaac

SEQ ID NO: 2666 - DNA, 22 bp, Artificial Sequence
  Synthetic
gcactgtcugcatctguagagt

SEQ ID NO: 2667 - DNA, 22 bp, Artificial Sequence
  Synthetic
caagagctcaugctttcctugc

SEQ ID NO: 2668 - DNA, 21 bp, Artificial Sequence
  Synthetic
cactccaagucctgtgauggt

SEQ ID NO: 2669 - DNA, 21 bp, Artificial Sequence
  Synthetic
gcctcaagguattgcuggaca

SEQ ID NO: 2670 - DNA, 21 bp, Artificial Sequence
  Synthetic
cccaaccuagagcaguggact

SEQ ID NO: 2671 - DNA, 24 bp, Artificial Sequence
  Synthetic
gttctccctcugactgttcctaug

SEQ ID NO: 2672 - DNA, 21 bp, Artificial Sequence
  Synthetic
ggtcccagucggtgaugaaaa

SEQ ID NO: 2673 - DNA, 22 bp, Artificial Sequence
  Synthetic
cgcatctcuccaatctgacucc

SEQ ID NO: 2674 - DNA, 24 bp, Artificial Sequence
  Synthetic
aaggagagaugctgagagatucaa

SEQ ID NO: 2675 - DNA, 21 bp, Artificial Sequence
  Synthetic
cttcagggaaugcctggugaa

SEQ ID NO: 2676 - DNA, 20 bp, Artificial Sequence
  Synthetic
ccctctggautccctgcauc

SEQ ID NO: 2677 - DNA, 26 bp, Artificial Sequence
  Synthetic
gattctaaacctuccctcccttctuc

SEQ ID NO: 2678 - DNA, 22 bp, Artificial Sequence
  Synthetic
ggctcttcauggatcctcacut

SEQ ID NO: 2679 - DNA, 22 bp, Artificial Sequence
  Synthetic
ctttcgtgccucccatcctuag

SEQ ID NO: 2680 - DNA, 21 bp, Artificial Sequence
  Synthetic
cgcaaggagaggutacctugg

SEQ ID NO: 2681 - DNA, 17 bp, Artificial Sequence
  Synthetic
tcccgcuccacccucat

SEQ ID NO: 2682 - DNA, 23 bp, Artificial Sequence
  Synthetic
cagaagggagaguttggtacuca

SEQ ID NO: 2683 - DNA, 20 bp, Artificial Sequence
  Synthetic
tttcccuctgctccuaggct

SEQ ID NO: 2684 - DNA, 19 bp, Artificial Sequence
  Synthetic
cucccattgucagccccaa

SEQ ID NO: 2685 - DNA, 21 bp, Artificial Sequence
  Synthetic
agtgcucagtggactuaacgg

SEQ ID NO: 2686 - DNA, 23 bp, Artificial Sequence
  Synthetic
gggagcutaaatgacucaaaggt

SEQ ID NO: 2687 - DNA, 23 bp, Artificial Sequence
  Synthetic
tgatgtgttcuaatggccctucc

SEQ ID NO: 2688 - DNA, 23 bp, Artificial Sequence
  Synthetic
catcccagucttcccuccaaaag

SEQ ID NO: 2689 - DNA, 24 bp, Artificial Sequence
  Synthetic
tttcctacagagggaucaccauga

SEQ ID NO: 2690 - DNA, 23 bp, Artificial Sequence
  Synthetic
ccaggtuagagaagggaggacug

SEQ ID NO: 2691 - DNA, 22 bp, Artificial Sequence
  Synthetic
ggagcagcautagcaaacctug

SEQ ID NO: 2692 - DNA, 21 bp, Artificial Sequence
  Synthetic
ggagguccacaaagcugaaca

SEQ ID NO: 2693 - DNA, 20 bp, Artificial Sequence
  Synthetic
gcagacgggaguttctccuc

SEQ ID NO: 2694 - DNA, 24 bp, Artificial Sequence
  Synthetic
ggcccagguggtaatcattgauat

SEQ ID NO: 2695 - DNA, 28 bp, Artificial Sequence
  Synthetic
ggaagagtttuaaggaaaacccacatuc

SEQ ID NO: 2696 - DNA, 28 bp, Artificial Sequence
  Synthetic
tgggtctucaaacgttattctcttugat

SEQ ID NO: 2697 - DNA, 27 bp, Artificial Sequence
  Synthetic
tctgcatttccutccatcttaaacugt

SEQ ID NO: 2698 - DNA, 29 bp, Artificial Sequence
  Synthetic
gcatctacaugaatagaatcaguggagaa

SEQ ID NO: 2699 - DNA, 22 bp, Artificial Sequence
  Synthetic
ggacaggatugttcccaacuca

SEQ ID NO: 2700 - DNA, 27 bp, Artificial Sequence
  Synthetic
cactttcgaagagcguttaacattuct

SEQ ID NO: 2701 - DNA, 24 bp, Artificial Sequence
  Synthetic
attcgtattugttgagctguccct

SEQ ID NO: 2702 - DNA, 28 bp, Artificial Sequence
  Synthetic
cuataaaattgaaactuaggagcagcgt

SEQ ID NO: 2703 - DNA, 22 bp, Artificial Sequence
  Synthetic
aacattugggcaaactgctguc

SEQ ID NO: 2704 - DNA, 21 bp, Artificial Sequence
  Synthetic
tgtgaaaaggcuggcctacug

SEQ ID NO: 2705 - DNA, 26 bp, Artificial Sequence
  Synthetic
accacaaacacautttcagtguacct

SEQ ID NO: 2706 - DNA, 27 bp, Artificial Sequence
  Synthetic
tcattctcaaaagugtgcctatgctua

SEQ ID NO: 2707 - DNA, 26 bp, Artificial Sequence
  Synthetic
ctacttctttgauttgcccagtctug

SEQ ID NO: 2708 - DNA, 30 bp, Artificial Sequence
  Synthetic
attacttgatgtugactgttctgaagaugt

SEQ ID NO: 2709 - DNA, 28 bp, Artificial Sequence
  Synthetic
ccctgttaaaatgguactacacctgtut

SEQ ID NO: 2710 - DNA, 23 bp, Artificial Sequence
  Synthetic
ctaaugagaggccaactuacgct

SEQ ID NO: 2711 - DNA, 24 bp, Artificial Sequence
  Synthetic
gagttcatuaggaaggtcugcagt

SEQ ID NO: 2712 - DNA, 24 bp, Artificial Sequence
  Synthetic
ccatcagcaaugagctgttugaag

SEQ ID NO: 2713 - DNA, 21 bp, Artificial Sequence
  Synthetic
ctcuattgccguagcaaccaa

SEQ ID NO: 2714 - DNA, 30 bp, Artificial Sequence
  Synthetic
ttgggtgaaagauaaactaggatgttagug

SEQ ID NO: 2715 - DNA, 26 bp, Artificial Sequence
  Synthetic
ttttagccagugcgaatatcagtuct

SEQ ID NO: 2716 - DNA, 23 bp, Artificial Sequence
  Synthetic
atgggaaagaautccgtctugct

SEQ ID NO: 2717 - DNA, 29 bp, Artificial Sequence
  Synthetic
cctgaacaagagaaaugtgcagtuaaaga

SEQ ID NO: 2718 - DNA, 29 bp, Artificial Sequence
  Synthetic
cagaactggtguttttgtatgacaaguat

SEQ ID NO: 2719 - DNA, 28 bp, Artificial Sequence
  Synthetic
gagctttctccutctgaatcctttauct

SEQ ID NO: 2720 - DNA, 25 bp, Artificial Sequence
  Synthetic
gttaaacagcuaccactggugaaac

SEQ ID NO: 2721 - DNA, 27 bp, Artificial Sequence
  Synthetic
gtgcaagaaucaaaaggttttaccuga

SEQ ID NO: 2722 - DNA, 27 bp, Artificial Sequence
  Synthetic
gcttgtctgttuacctgttacgatcut

SEQ ID NO: 2723 - DNA, 28 bp, Artificial Sequence
  Synthetic
catgcaaggaaacuagttctgaauacac

SEQ ID NO: 2724 - DNA, 21 bp, Artificial Sequence
  Synthetic
agutgatgcugacagcaggac

SEQ ID NO: 2725 - DNA, 21 bp, Artificial Sequence
  Synthetic
gtgactacaggaucagcgcut

SEQ ID NO: 2726 - DNA, 31 bp, Artificial Sequence
  Synthetic
cagttccagttcauttatccaagttgtttut

SEQ ID NO: 2727 - DNA, 28 bp, Artificial Sequence
  Synthetic
aaaagaagtagatucagccagagaagug

SEQ ID NO: 2728 - DNA, 32 bp, Artificial Sequence
  Synthetic
ctatttgaagtggacugtttatcttctucact

SEQ ID NO: 2729 - DNA, 22 bp, Artificial Sequence
  Synthetic
tcgtttggaucatgcccucaat

SEQ ID NO: 2730 - DNA, 22 bp, Artificial Sequence
  Synthetic
ggcttguggatctggaaaucac

SEQ ID NO: 2731 - DNA, 33 bp, Artificial Sequence
  Synthetic
attattttaaccuagcaattatgttagcuagga

SEQ ID NO: 2732 - DNA, 25 bp, Artificial Sequence
  Synthetic
ctttcaaaggutgaatggtgcugaa

SEQ ID NO: 2733 - DNA, 27 bp, Artificial Sequence
  Synthetic
aaaagcaagtguattaccttagcaugt

SEQ ID NO: 2734 - DNA, 26 bp, Artificial Sequence
  Synthetic
tcaccgaccaugaaataattuccagt

SEQ ID NO: 2735 - DNA, 27 bp, Artificial Sequence
  Synthetic
tttatggcataauctggagttggugaa

SEQ ID NO: 2736 - DNA, 26 bp, Artificial Sequence
  Synthetic
ctcccactucatcttggaacucaaat

SEQ ID NO: 2737 - DNA, 28 bp, Artificial Sequence
  Synthetic
ctaatttccatgccuttttcaggcauaa

SEQ ID NO: 2738 - DNA, 26 bp, Artificial Sequence
  Synthetic
cagttttctgucgtgaacgtttctua

SEQ ID NO: 2739 - DNA, 32 bp, Artificial Sequence
  Synthetic
gttttaaaagtttugccacttaattagcacut

SEQ ID NO: 2740 - DNA, 32 bp, Artificial Sequence
  Synthetic
ttccactccatattutacaagctgattcauaa

SEQ ID NO: 2741 - DNA, 28 bp, Artificial Sequence
  Synthetic
acagatcaacgcaugacaataatgauga

SEQ ID NO: 2742 - DNA, 28 bp, Artificial Sequence
  Synthetic
gtagggacaaaauatgatgtcagcauct

SEQ ID NO: 2743 - DNA, 30 bp, Artificial Sequence
  Synthetic
ggagttcauaaaattagtgaucagcacaca

SEQ ID NO: 2744 - DNA, 32 bp, Artificial Sequence
  Synthetic
gatttccctgtatgauccttcttaatggtaut

SEQ ID NO: 2745 - DNA, 28 bp, Artificial Sequence
  Synthetic
tgattccatgugaggtttgataacgtut

SEQ ID NO: 2746 - DNA, 28 bp, Artificial Sequence
  Synthetic
gggtcgaattcutttcttctctactuga

SEQ ID NO: 2747 - DNA, 29 bp, Artificial Sequence
  Synthetic
tgcctacctguaagttatttatgctgtut

SEQ ID NO: 2748 - DNA, 25 bp, Artificial Sequence
  Synthetic
taaggctaagcuttttccactucct

SEQ ID NO: 2749 - DNA, 30 bp, Artificial Sequence
  Synthetic
tgttctatutaaacttcagauggagagaga

SEQ ID NO: 2750 - DNA, 20 bp, Artificial Sequence
  Synthetic
tggagacccugcataugcct

SEQ ID NO: 2751 - DNA, 21 bp, Artificial Sequence
  Synthetic
catgauccagacgctgcugat

SEQ ID NO: 2752 - DNA, 23 bp, Artificial Sequence
  Synthetic
gattcgttcugggactctuccat

SEQ ID NO: 2753 - DNA, 22 bp, Artificial Sequence
  Synthetic
cccacguttcauagccaggaaa

SEQ ID NO: 2754 - DNA, 22 bp, Artificial Sequence
  Synthetic
gutctgtaccugagagcagcag

SEQ ID NO: 2755 - DNA, 17 bp, Artificial Sequence
  Synthetic
tgcagccggugcagtua

SEQ ID NO: 2756 - DNA, 26 bp, Artificial Sequence
  Synthetic
cttccgtattgcugagtgctatcaua

SEQ ID NO: 2757 - DNA, 23 bp, Artificial Sequence
  Synthetic
gaatggtguttacagtgcugcaa

SEQ ID NO: 2758 - DNA, 27 bp, Artificial Sequence
  Synthetic
gtcgctcacutgctttatgttatuagg

SEQ ID NO: 2759 - DNA, 21 bp, Artificial Sequence
  Synthetic
ccacacugcaacacctuacag

SEQ ID NO: 2760 - DNA, 22 bp, Artificial Sequence
  Synthetic
aaaatccacugctcgtgaucca

SEQ ID NO: 2761 - DNA, 30 bp, Artificial Sequence
  Synthetic
atgagtgagaaggagaauaaaaccattgut

SEQ ID NO: 2762 - DNA, 27 bp, Artificial Sequence
  Synthetic
tcttcagcaagcugtcttacttcttut

SEQ ID NO: 2763 - DNA, 29 bp, Artificial Sequence
  Synthetic
gtgatcaaactgaautgtgttttcacuct

SEQ ID NO: 2764 - DNA, 30 bp, Artificial Sequence
  Synthetic
caatacctaggauatttagcaccaaugaca

SEQ ID NO: 2765 - DNA, 23 bp, Artificial Sequence
  Synthetic
ttgtagagcaugtcgctugaagt

SEQ ID NO: 2766 - DNA, 23 bp, Artificial Sequence
  Synthetic
ctgagcttgaauagcagtgggut

SEQ ID NO: 2767 - DNA, 25 bp, Artificial Sequence
  Synthetic
gtgctactttucagttctaccuacc

SEQ ID NO: 2768 - DNA, 18 bp, Artificial Sequence
  Synthetic
agctcggcucccaaacuc

SEQ ID NO: 2769 - DNA, 19 bp, Artificial Sequence
  Synthetic
gccattuccagcgactugt

SEQ ID NO: 2770 - DNA, 22 bp, Artificial Sequence
  Synthetic
ctcccagauctccucaaacacc

SEQ ID NO: 2771 - DNA, 24 bp, Artificial Sequence
  Synthetic
tcctccatgutggtatgctttuct

SEQ ID NO: 2772 - DNA, 22 bp, Artificial Sequence
  Synthetic
gcttggatuggagaagggtgug

SEQ ID NO: 2773 - DNA, 28 bp, Artificial Sequence
  Synthetic
aggccaaataguaattttctgtctgcut

SEQ ID NO: 2774 - DNA, 25 bp, Artificial Sequence
  Synthetic
caaaaacagccautcccacaauacc

SEQ ID NO: 2775 - DNA, 19 bp, Artificial Sequence
  Synthetic
gagacaggucgcaggaugt

SEQ ID NO: 2776 - DNA, 28 bp, Artificial Sequence
  Synthetic
cttttgcattucgagtagcagtaauact

SEQ ID NO: 2777 - DNA, 20 bp, Artificial Sequence
  Synthetic
ggcaaaggcuttgugaccaa

SEQ ID NO: 2778 - DNA, 20 bp, Artificial Sequence
  Synthetic
ggtctugaggacccuggaca

SEQ ID NO: 2779 - DNA, 22 bp, Artificial Sequence
  Synthetic
ccttctgacgucttcccttuca

SEQ ID NO: 2780 - DNA, 23 bp, Artificial Sequence
  Synthetic
gatgacagacgautctggcuaag

SEQ ID NO: 2781 - DNA, 23 bp, Artificial Sequence
  Synthetic
ccaacgacagugagatauccagt

SEQ ID NO: 2782 - DNA, 25 bp, Artificial Sequence
  Synthetic
cccactccucacatattcgagguat

SEQ ID NO: 2783 - DNA, 21 bp, Artificial Sequence
  Synthetic
agauggcaucaagaagcagca

SEQ ID NO: 2784 - DNA, 20 bp, Artificial Sequence
  Synthetic
ccccaacccaucttcgtucc

SEQ ID NO: 2785 - DNA, 18 bp, Artificial Sequence
  Synthetic
agcttccgugaggaugcc

SEQ ID NO: 2786 - DNA, 29 bp, Artificial Sequence
  Synthetic
cagtgtttccgutttgagttaaaugaact

SEQ ID NO: 2787 - DNA, 21 bp, Artificial Sequence
  Synthetic
accgacgaccagaucattgug

SEQ ID NO: 2788 - DNA, 19 bp, Artificial Sequence
  Synthetic
gctguggaagccacacugt

SEQ ID NO: 2789 - DNA, 21 bp, Artificial Sequence
  Synthetic
tgaugtggugaacgagaaccc

SEQ ID NO: 2790 - DNA, 20 bp, Artificial Sequence
  Synthetic
accttguccccactgtcuga

SEQ ID NO: 2791 - DNA, 21 bp, Artificial Sequence
  Synthetic
acaatgacaccuacccccugt

SEQ ID NO: 2792 - DNA, 19 bp, Artificial Sequence
  Synthetic
attccgggugcucagacag

SEQ ID NO: 2793 - DNA, 22 bp, Artificial Sequence
  Synthetic
cttctggaaaagucagccucca

SEQ ID NO: 2794 - DNA, 24 bp, Artificial Sequence
  Synthetic
tttcttaaacagccugcagcttug

SEQ ID NO: 2795 - DNA, 20 bp, Artificial Sequence
  Synthetic
cctatcugggccacaaguga

SEQ ID NO: 2796 - DNA, 22 bp, Artificial Sequence
  Synthetic
gattttattucgccggcuccac

SEQ ID NO: 2797 - DNA, 21 bp, Artificial Sequence
  Synthetic
ggauccaggauaacggaggct

SEQ ID NO: 2798 - DNA, 17 bp, Artificial Sequence
  Synthetic
gcggagggucaggugga

SEQ ID NO: 2799 - DNA, 19 bp, Artificial Sequence
  Synthetic
cgggcaucttctccuccca

SEQ ID NO: 2800 - DNA, 31 bp, Artificial Sequence
  Synthetic
agagaaagaagaggagutataatccagcuat

SEQ ID NO: 2801 - DNA, 27 bp, Artificial Sequence
  Synthetic
gcctcaugaaataaagauccgaaagga

SEQ ID NO: 2802 - DNA, 17 bp, Artificial Sequence
  Synthetic
gccgctgaucccaccuc

SEQ ID NO: 2803 - DNA, 27 bp, Artificial Sequence
  Synthetic
accattgacaugaatttccagagugat

SEQ ID NO: 2804 - DNA, 17 bp, Artificial Sequence
  Synthetic
ggagctcugggcctgug

SEQ ID NO: 2805 - DNA, 17 bp, Artificial Sequence
  Synthetic
acgaggaugcgcuggag

SEQ ID NO: 2806 - DNA, 23 bp, Artificial Sequence
  Synthetic
ggctcctgtutctgtttgtccut

SEQ ID NO: 2807 - DNA, 19 bp, Artificial Sequence
  Synthetic
gcccaccggcugtttaugt

SEQ ID NO: 2808 - DNA, 22 bp, Artificial Sequence
  Synthetic
gctctggaacugtgacatcugg

SEQ ID NO: 2809 - DNA, 21 bp, Artificial Sequence
  Synthetic
cacgutttcctucccgacaat

SEQ ID NO: 2810 - DNA, 18 bp, Artificial Sequence
  Synthetic
ggacugcacctucacgga

SEQ ID NO: 2811 - DNA, 18 bp, Artificial Sequence
  Synthetic
ccccaagugctgcuggag

SEQ ID NO: 2812 - DNA, 18 bp, Artificial Sequence
  Synthetic
tggagugctgtgcucagg

SEQ ID NO: 2813 - DNA, 18 bp, Artificial Sequence
  Synthetic
cgcccccacccutcatug

SEQ ID NO: 2814 - DNA, 24 bp, Artificial Sequence
  Synthetic
ggagggaaaagutactcugagggt

SEQ ID NO: 2815 - DNA, 23 bp, Artificial Sequence
  Synthetic
cccgacgagautgaaatcgacut

SEQ ID NO: 2816 - DNA, 18 bp, Artificial Sequence
  Synthetic
tgctgucgctggaugagg

SEQ ID NO: 2817 - DNA, 18 bp, Artificial Sequence
  Synthetic
agccgucacagcatguct

SEQ ID NO: 2818 - DNA, 19 bp, Artificial Sequence
  Synthetic
tguagaagggccaggcgua

SEQ ID NO: 2819 - DNA, 20 bp, Artificial Sequence
  Synthetic
cggccugtgaaaccuccaaa

SEQ ID NO: 2820 - DNA, 18 bp, Artificial Sequence
  Synthetic
tgggtggguggctctgua

SEQ ID NO: 2821 - DNA, 19 bp, Artificial Sequence
  Synthetic
ggaccucatcguccagacc

SEQ ID NO: 2822 - DNA, 27 bp, Artificial Sequence
  Synthetic
actatcatgatcucggtttcttctgug

SEQ ID NO: 2823 - DNA, 21 bp, Artificial Sequence
  Synthetic
cctctgacuctacccctgugt

SEQ ID NO: 2824 - DNA, 21 bp, Artificial Sequence
  Synthetic
cagttggtuggtctgcctcut

SEQ ID NO: 2825 - DNA, 24 bp, Artificial Sequence
  Synthetic
gacgagautgagaaatcugccagt

SEQ ID NO: 2826 - DNA, 19 bp, Artificial Sequence
  Synthetic
agctcccauggctcactug

SEQ ID NO: 2827 - DNA, 25 bp, Artificial Sequence
  Synthetic
accactcaattugggtttcctguag

SEQ ID NO: 2828 - DNA, 19 bp, Artificial Sequence
  Synthetic
agtagucaggcgtcuccga

SEQ ID NO: 2829 - DNA, 26 bp, Artificial Sequence
  Synthetic
gcaaagtguacagttttcatgcaugt

SEQ ID NO: 2830 - DNA, 17 bp, Artificial Sequence
  Synthetic
gagcugagggtguccgt

SEQ ID NO: 2831 - DNA, 19 bp, Artificial Sequence
  Synthetic
tcaucgacccccuagccaa

SEQ ID NO: 2832 - DNA, 20 bp, Artificial Sequence
  Synthetic
tctgcggagaccacugguaa

SEQ ID NO: 2833 - DNA, 18 bp, Artificial Sequence
  Synthetic
ctggcacuacggcccuac

SEQ ID NO: 2834 - DNA, 20 bp, Artificial Sequence
  Synthetic
ttctgguaggagtcgucggt

SEQ ID NO: 2835 - DNA, 20 bp, Artificial Sequence
  Synthetic
cggatccuccctgcattguc

SEQ ID NO: 2836 - DNA, 17 bp, Artificial Sequence
  Synthetic
ccggacgutccccacug

SEQ ID NO: 2837 - DNA, 17 bp, Artificial Sequence
  Synthetic
agctacgggcugtcgug

SEQ ID NO: 2838 - DNA, 18 bp, Artificial Sequence
  Synthetic
gcagtugcccatggccut

SEQ ID NO: 2839 - DNA, 17 bp, Artificial Sequence
  Synthetic
ggtgcuggagcugacca

SEQ ID NO: 2840 - DNA, 18 bp, Artificial Sequence
  Synthetic
agugcgcgatcuggaact

SEQ ID NO: 2841 - DNA, 18 bp, Artificial Sequence
  Synthetic
gccgcuggtgaucaagca

SEQ ID NO: 2842 - DNA, 19 bp, Artificial Sequence
  Synthetic
gggccugaagaagaacugg

SEQ ID NO: 2843 - DNA, 17 bp, Artificial Sequence
  Synthetic
ccagcauccgcgaguga

SEQ ID NO: 2844 - DNA, 17 bp, Artificial Sequence
  Synthetic
tcccugagggtccugct

SEQ ID NO: 2845 - DNA, 19 bp, Artificial Sequence
  Synthetic
gtctcugcacaggctuggt

SEQ ID NO: 2846 - DNA, 23 bp, Artificial Sequence
  Synthetic
gtcccacagaaggutttcauggt

SEQ ID NO: 2847 - DNA, 20 bp, Artificial Sequence
  Synthetic
gcatgcaccugagatccgut

SEQ ID NO: 2848 - DNA, 25 bp, Artificial Sequence
  Synthetic
tgtaccagaagautagggctctcuc

SEQ ID NO: 2849 - DNA, 18 bp, Artificial Sequence
  Synthetic
ctcacccgcaguctguct

SEQ ID NO: 2850 - DNA, 21 bp, Artificial Sequence
  Synthetic
gccacacutgtagtccauggg

SEQ ID NO: 2851 - DNA, 20 bp, Artificial Sequence
  Synthetic
gcactcagcugttcgacuct

SEQ ID NO: 2852 - DNA, 23 bp, Artificial Sequence
  Synthetic
gcctctccutgtacccaaugaag

SEQ ID NO: 2853 - DNA, 22 bp, Artificial Sequence
  Synthetic
cctgggacaucactcaacctug

SEQ ID NO: 2854 - DNA, 24 bp, Artificial Sequence
  Synthetic
gcaacucaaacuaaccaacccact

SEQ ID NO: 2855 - DNA, 19 bp, Artificial Sequence
  Synthetic
cctgcccuttggccacaua

SEQ ID NO: 2856 - DNA, 22 bp, Artificial Sequence
  Synthetic
gaatgugaacaagagccauggg

SEQ ID NO: 2857 - DNA, 24 bp, Artificial Sequence
  Synthetic
ccccacutcaaagauaaaccgagt

SEQ ID NO: 2858 - DNA, 20 bp, Artificial Sequence
  Synthetic
ctgatgtucgctgcctcaut

SEQ ID NO: 2859 - DNA, 19 bp, Artificial Sequence
  Synthetic
ggtgucacggcttcuccag

SEQ ID NO: 2860 - DNA, 20 bp, Artificial Sequence
  Synthetic
ccttaguccccttccuggca

SEQ ID NO: 2861 - DNA, 18 bp, Artificial Sequence
  Synthetic
gctccuaggccaccugga

SEQ ID NO: 2862 - DNA, 20 bp, Artificial Sequence
  Synthetic
gagacauggccctcactguc

SEQ ID NO: 2863 - DNA, 22 bp, Artificial Sequence
  Synthetic
gcgtccauccttcucagaagat

SEQ ID NO: 2864 - DNA, 19 bp, Artificial Sequence
  Synthetic
ggtgggugagtgaagggut

SEQ ID NO: 2865 - DNA, 19 bp, Artificial Sequence
  Synthetic
gtctccttgugccctccug

SEQ ID NO: 2866 - DNA, 21 bp, Artificial Sequence
  Synthetic
agaacggcuacacacagtugg

SEQ ID NO: 2867 - DNA, 17 bp, Artificial Sequence
  Synthetic
ccugcccacccccacua

SEQ ID NO: 2868 - DNA, 20 bp, Artificial Sequence
  Synthetic
ccccatacugttcccuccac

SEQ ID NO: 2869 - DNA, 18 bp, Artificial Sequence
  Synthetic
gaugggacagcaccguga

SEQ ID NO: 2870 - DNA, 19 bp, Artificial Sequence
  Synthetic
ccggtucctcccaauggat

SEQ ID NO: 2871 - DNA, 22 bp, Artificial Sequence
  Synthetic
cctcttgcucctccttgttugg

SEQ ID NO: 2872 - DNA, 21 bp, Artificial Sequence
  Synthetic
gctgggtgucagcttagtgua

SEQ ID NO: 2873 - DNA, 23 bp, Artificial Sequence
  Synthetic
caccagtaggutagtgacagugg

SEQ ID NO: 2874 - DNA, 24 bp, Artificial Sequence
  Synthetic
aatcacccagguacagtacaucct

SEQ ID NO: 2875 - DNA, 20 bp, Artificial Sequence
  Synthetic
acttugccgttgguggaagt

SEQ ID NO: 2876 - DNA, 20 bp, Artificial Sequence
  Synthetic
cctatgggugcccttcucca

SEQ ID NO: 2877 - DNA, 23 bp, Artificial Sequence
  Synthetic
agtatgggcucagctgcaatuac

SEQ ID NO: 2878 - DNA, 19 bp, Artificial Sequence
  Synthetic
cgggcccuaacttggtcuc

SEQ ID NO: 2879 - DNA, 21 bp, Artificial Sequence
  Synthetic
gggcugccagagtaaaaugct

SEQ ID NO: 2880 - DNA, 18 bp, Artificial Sequence
  Synthetic
cagccaucgccagcatuc

SEQ ID NO: 2881 - DNA, 20 bp, Artificial Sequence
  Synthetic
gccccucaagctcagacuct

SEQ ID NO: 2882 - DNA, 18 bp, Artificial Sequence
  Synthetic
cagctguagcccctggug

SEQ ID NO: 2883 - DNA, 24 bp, Artificial Sequence
  Synthetic
cttgtccacagagucaaaggtcut

SEQ ID NO: 2884 - DNA, 22 bp, Artificial Sequence
  Synthetic
gcactgaguctgcttctgttug

SEQ ID NO: 2885 - DNA, 24 bp, Artificial Sequence
  Synthetic
cctgtacggucaaaggtgaagaug

SEQ ID NO: 2886 - DNA, 21 bp, Artificial Sequence
  Synthetic
ggtcacucgggtgggactuat

SEQ ID NO: 2887 - DNA, 22 bp, Artificial Sequence
  Synthetic
caacugcagacaaacctuggag

SEQ ID NO: 2888 - DNA, 22 bp, Artificial Sequence
  Synthetic
tgtcccttcuctgtcctccaut

SEQ ID NO: 2889 - DNA, 21 bp, Artificial Sequence
  Synthetic
cauggcgatgucagcagaaag

SEQ ID NO: 2890 - DNA, 18 bp, Artificial Sequence
  Synthetic
ctcctggugacagcuggt

SEQ ID NO: 2891 - DNA, 20 bp, Artificial Sequence
  Synthetic
tcataatugcgggccuccag

SEQ ID NO: 2892 - DNA, 20 bp, Artificial Sequence
  Synthetic
gctctatggucacgcccauc

SEQ ID NO: 2893 - DNA, 21 bp, Artificial Sequence
  Synthetic
ggaggtugggaacggtttcuc

SEQ ID NO: 2894 - DNA, 18 bp, Artificial Sequence
  Synthetic
ccccuccccggttctcua

SEQ ID NO: 2895 - DNA, 18 bp, Artificial Sequence
  Synthetic
gggcctcutcccactguc

SEQ ID NO: 2896 - DNA, 19 bp, Artificial Sequence
  Synthetic
cttcgagagguggcccaut

SEQ ID NO: 2897 - DNA, 18 bp, Artificial Sequence
  Synthetic
tcgtuggcactcctucgg

SEQ ID NO: 2898 - DNA, 21 bp, Artificial Sequence
  Synthetic
gaccctcccaucataggcuct

SEQ ID NO: 2899 - DNA, 20 bp, Artificial Sequence
  Synthetic
aggtgaggucaatggtggug

SEQ ID NO: 2900 - DNA, 23 bp, Artificial Sequence
  Synthetic
gggacuggaagtucacaaaaggg

SEQ ID NO: 2901 - DNA, 20 bp, Artificial Sequence
  Synthetic
cagggatgguctgcaggaug

SEQ ID NO: 2902 - DNA, 23 bp, Artificial Sequence
  Synthetic
aagauctgtgcugagagcaacaa

SEQ ID NO: 2903 - DNA, 22 bp, Artificial Sequence
  Synthetic
tgaggcauggagatcctttugg

SEQ ID NO: 2904 - DNA, 22 bp, Artificial Sequence
  Synthetic
ggaaagautggaugccgggaat

SEQ ID NO: 2905 - DNA, 22 bp, Artificial Sequence
  Synthetic
ggttagggaauggactcaccug

SEQ ID NO: 2906 - DNA, 22 bp, Artificial Sequence
  Synthetic
gactttcuggaggagaagcuca

SEQ ID NO: 2907 - DNA, 19 bp, Artificial Sequence
  Synthetic
ccaaccucaaccugaccgt

SEQ ID NO: 2908 - DNA, 23 bp, Artificial Sequence
  Synthetic
tcctccctugatcctaacacugt

SEQ ID NO: 2909 - DNA, 20 bp, Artificial Sequence
  Synthetic
ccagccacacutguaacccc

SEQ ID NO: 2910 - DNA, 19 bp, Artificial Sequence
  Synthetic
agctgacauagcggugcag

SEQ ID NO: 2911 - DNA, 20 bp, Artificial Sequence
  Synthetic
atcguggccttctucaccag

SEQ ID NO: 2912 - DNA, 19 bp, Artificial Sequence
  Synthetic
ggagggaggucagggacua

SEQ ID NO: 2913 - DNA, 21 bp, Artificial Sequence
  Synthetic
actgcccucatctctcuccag

SEQ ID NO: 2914 - DNA, 19 bp, Artificial Sequence
  Synthetic
ctctccugcaccacaugct

SEQ ID NO: 2915 - DNA, 17 bp, Artificial Sequence
  Synthetic
cgccgcugatagcguct

SEQ ID NO: 2916 - DNA, 20 bp, Artificial Sequence
  Synthetic
gggtccaggagguagtggua

SEQ ID NO: 2917 - DNA, 17 bp, Artificial Sequence
  Synthetic
agugacgggccagtgug

SEQ ID NO: 2918 - DNA, 21 bp, Artificial Sequence
  Synthetic
aggacutgtggtuggacgaaa

SEQ ID NO: 2919 - DNA, 25 bp, Artificial Sequence
  Synthetic
gcucaacttctaugagaagcaggag

SEQ ID NO: 2920 - DNA, 23 bp, Artificial Sequence
  Synthetic
gacgtccugcaatctgtctuagg

SEQ ID NO: 2921 - DNA, 21 bp, Artificial Sequence
  Synthetic
acatcuaccccgagcagtuct

SEQ ID NO: 2922 - DNA, 29 bp, Artificial Sequence
  Synthetic
tggatggauataaatggaaatugcacact

SEQ ID NO: 2923 - DNA, 28 bp, Artificial Sequence
  Synthetic
cctcatgtuaagcaacaagaacaauaca

SEQ ID NO: 2924 - DNA, 23 bp, Artificial Sequence
  Synthetic
agttgactugggctctctttugt

SEQ ID NO: 2925 - DNA, 27 bp, Artificial Sequence
  Synthetic
agcatcacaaccaugagtttacacaua

SEQ ID NO: 2926 - DNA, 22 bp, Artificial Sequence
  Synthetic
ggucaaaugaagcgcaacagag

SEQ ID NO: 2927 - DNA, 22 bp, Artificial Sequence
  Synthetic
tguctactucaggcaggaggaa

SEQ ID NO: 2928 - DNA, 24 bp, Artificial Sequence
  Synthetic
cccgaaugcacttacuagaagagg

SEQ ID NO: 2929 - DNA, 23 bp, Artificial Sequence
  Synthetic
gactcatagcuccaactgcctua

SEQ ID NO: 2930 - DNA, 23 bp, Artificial Sequence
  Synthetic
caaaatctguggcctcagatgut

SEQ ID NO: 2931 - DNA, 20 bp, Artificial Sequence
  Synthetic
ctcagccuggauccgagaag

SEQ ID NO: 2932 - DNA, 26 bp, Artificial Sequence
  Synthetic
ctagttttgcuttacagtcccuaggt

SEQ ID NO: 2933 - DNA, 18 bp, Artificial Sequence
  Synthetic
caggaggacuccgtggug

SEQ ID NO: 2934 - DNA, 22 bp, Artificial Sequence
  Synthetic
caactacugccgccttatccuc

SEQ ID NO: 2935 - DNA, 21 bp, Artificial Sequence
  Synthetic
tgagtccaacugtagcccuct

SEQ ID NO: 2936 - DNA, 28 bp, Artificial Sequence
  Synthetic
cactatgaaggaucctgtaaatgugacc

SEQ ID NO: 2937 - DNA, 22 bp, Artificial Sequence
  Synthetic
acgagagccutggtttucaagt

SEQ ID NO: 2938 - DNA, 24 bp, Artificial Sequence
  Synthetic
caggtggacautgaaaagcugaaa

SEQ ID NO: 2939 - DNA, 22 bp, Artificial Sequence
  Synthetic
ccaccgaagauccctttgucac

SEQ ID NO: 2940 - DNA, 20 bp, Artificial Sequence
  Synthetic
agttgcugcagggtagctug

SEQ ID NO: 2941 - DNA, 22 bp, Artificial Sequence
  Synthetic
tccatcaaccaugccactgtut

SEQ ID NO: 2942 - DNA, 24 bp, Artificial Sequence
  Synthetic
gacagtaatucaaatgctgcucca

SEQ ID NO: 2943 - DNA, 23 bp, Artificial Sequence
  Synthetic
agagccaaaaagcutcttcccut

SEQ ID NO: 2944 - DNA, 21 bp, Artificial Sequence
  Synthetic
acttggaagggaugcccttug

SEQ ID NO: 2945 - DNA, 21 bp, Artificial Sequence
  Synthetic
ctgguggaactcagtuggagt

SEQ ID NO: 2946 - DNA, 25 bp, Artificial Sequence
  Synthetic
gtgtattgtgccutgtggtgagaua

SEQ ID NO: 2947 - DNA, 18 bp, Artificial Sequence
  Synthetic
gcaagagugctccugcct

SEQ ID NO: 2948 - DNA, 18 bp, Artificial Sequence
  Synthetic
cttccccggcutcctucc

SEQ ID NO: 2949 - DNA, 20 bp, Artificial Sequence
  Synthetic
gccttctcauctgggcacut

SEQ ID NO: 2950 - DNA, 23 bp, Artificial Sequence
  Synthetic
catggacctuggtcatgatgtuc

SEQ ID NO: 2951 - DNA, 18 bp, Artificial Sequence
  Synthetic
gcaucaccugggaaggca

SEQ ID NO: 2952 - DNA, 21 bp, Artificial Sequence
  Synthetic
tgctgcugagcctgaatctuc

SEQ ID NO: 2953 - DNA, 28 bp, Artificial Sequence
  Synthetic
tgaccaaatcugttatagctaatugcct

SEQ ID NO: 2954 - DNA, 24 bp, Artificial Sequence
  Synthetic
cctctgaagcucaggtcauaagaa

SEQ ID NO: 2955 - DNA, 22 bp, Artificial Sequence
  Synthetic
gaugggaaggaactgugcaaga

SEQ ID NO: 2956 - DNA, 22 bp, Artificial Sequence
  Synthetic
aaugggaggucagggagagaaa

SEQ ID NO: 2957 - DNA, 20 bp, Artificial Sequence
  Synthetic
tccuccagcgactauggaca

SEQ ID NO: 2958 - DNA, 25 bp, Artificial Sequence
  Synthetic
tgttgacugacccctaattaacuga

SEQ ID NO: 2959 - DNA, 20 bp, Artificial Sequence
  Synthetic
gggcuggcttacugaaggac

SEQ ID NO: 2960 - DNA, 19 bp, Artificial Sequence
  Synthetic
cctggccuggcuagaggat

SEQ ID NO: 2961 - DNA, 24 bp, Artificial Sequence
  Synthetic
ctgagtgtguccttccaccatuaa

SEQ ID NO: 2962 - DNA, 21 bp, Artificial Sequence
  Synthetic
ggugaagagacaagcugcgaa

SEQ ID NO: 2963 - DNA, 21 bp, Artificial Sequence
  Synthetic
ggaugcccaagcaagcattug

SEQ ID NO: 2964 - DNA, 23 bp, Artificial Sequence
  Synthetic
ctgatagtccucctcctctguca

SEQ ID NO: 2965 - DNA, 22 bp, Artificial Sequence
  Synthetic
cctagtguccccauaacaagct

SEQ ID NO: 2966 - DNA, 23 bp, Artificial Sequence
  Synthetic
cacagcatugtcatactccucgt

SEQ ID NO: 2967 - DNA, 21 bp, Artificial Sequence
  Synthetic
tcccaaagguaccgtgtacuc

SEQ ID NO: 2968 - DNA, 22 bp, Artificial Sequence
  Synthetic
cctccagcucatctgcaugaat

SEQ ID NO: 2969 - DNA, 22 bp, Artificial Sequence
  Synthetic
gcaactgtgugccttgtaaguc

SEQ ID NO: 2970 - DNA, 17 bp, Artificial Sequence
  Synthetic
ggcauggcctaccugct

SEQ ID NO: 2971 - DNA, 21 bp, Artificial Sequence
  Synthetic
auttctgcagauggccaggaa

SEQ ID NO: 2972 - DNA, 22 bp, Artificial Sequence
  Synthetic
catgatguggcagaaggtgcua

SEQ ID NO: 2973 - DNA, 20 bp, Artificial Sequence
  Synthetic
gccgccuggacaactaugac

SEQ ID NO: 2974 - DNA, 22 bp, Artificial Sequence
  Synthetic
aaccagucactugagccacaat

SEQ ID NO: 2975 - DNA, 23 bp, Artificial Sequence
  Synthetic
gcuacctggtaugcagaaaggat

SEQ ID NO: 2976 - DNA, 25 bp, Artificial Sequence
  Synthetic
gattttagccagugcattgtgagug

SEQ ID NO: 2977 - DNA, 21 bp, Artificial Sequence
  Synthetic
ctggagtugccctcaagacut

SEQ ID NO: 2978 - DNA, 28 bp, Artificial Sequence
  Synthetic
cggtataaatauaggacaaggtcaugga

SEQ ID NO: 2979 - DNA, 21 bp, Artificial Sequence
  Synthetic
ccatgtgugcaatgaguccga

SEQ ID NO: 2980 - DNA, 21 bp, Artificial Sequence
  Synthetic
gtggtactuagaggccaccug

SEQ ID NO: 2981 - DNA, 23 bp, Artificial Sequence
  Synthetic
ctttagagtggugcatcgttgug

SEQ ID NO: 2982 - DNA, 21 bp, Artificial Sequence
  Synthetic
ccctcagcugggcgattatuc

SEQ ID NO: 2983 - DNA, 28 bp, Artificial Sequence
  Synthetic
gaaaacatactgagugaaaatgtggcut

SEQ ID NO: 2984 - DNA, 17 bp, Artificial Sequence
  Synthetic
gcgcagtucccggacuc

SEQ ID NO: 2985 - DNA, 22 bp, Artificial Sequence
  Synthetic
gcaacgtcugcaggtagaucat

SEQ ID NO: 2986 - DNA, 23 bp, Artificial Sequence
  Synthetic
ccttctacgugaacgtcgagtut

SEQ ID NO: 2987 - DNA, 19 bp, Artificial Sequence
  Synthetic
ccgtgcugggacttttugc

SEQ ID NO: 2988 - DNA, 17 bp, Artificial Sequence
  Synthetic
cccgcaggucctacucc

SEQ ID NO: 2989 - DNA, 19 bp, Artificial Sequence
  Synthetic
ggaacaugcggtagguggt

SEQ ID NO: 2990 - DNA, 23 bp, Artificial Sequence
  Synthetic
agtatggatgcucccttctcugt

SEQ ID NO: 2991 - DNA, 19 bp, Artificial Sequence
  Synthetic
atgaggagggcgagucauc

SEQ ID NO: 2992 - DNA, 23 bp, Artificial Sequence
  Synthetic
cagcagaucgagaccatcttcut

SEQ ID NO: 2993 - DNA, 18 bp, Artificial Sequence
  Synthetic
cggcccugggttacucac

SEQ ID NO: 2994 - DNA, 17 bp, Artificial Sequence
  Synthetic
gcccuccgcatcucaca

SEQ ID NO: 2995 - DNA, 18 bp, Artificial Sequence
  Synthetic
ccagcucagcaggauggg

SEQ ID NO: 2996 - DNA, 19 bp, Artificial Sequence
  Synthetic
ttgtguggagcgcuggaat

SEQ ID NO: 2997 - DNA, 22 bp, Artificial Sequence
  Synthetic
agacauaagcagcagcagugac

SEQ ID NO: 2998 - DNA, 23 bp, Artificial Sequence
  Synthetic
ggacaacagaagcugacctctut

SEQ ID NO: 2999 - DNA, 23 bp, Artificial Sequence
  Synthetic
ctccuccccaaaccagtactuac

SEQ ID NO: 3000 - DNA, 19 bp, Artificial Sequence
  Synthetic
actgtgccccutctcccua

SEQ ID NO: 3001 - DNA, 17 bp, Artificial Sequence
  Synthetic
caagccccuccccacuc

SEQ ID NO: 3002 - DNA, 19 bp, Artificial Sequence
  Synthetic
ggcacgcugaagctguact

SEQ ID NO: 3003 - DNA, 18 bp, Artificial Sequence
  Synthetic
agugcacguggaggagac

SEQ ID NO: 3004 - DNA, 21 bp, Artificial Sequence
  Synthetic
tgagccacucttctctuccct

SEQ ID NO: 3005 - DNA, 20 bp, Artificial Sequence
  Synthetic
caggagauggacugggacct

SEQ ID NO: 3006 - DNA, 20 bp, Artificial Sequence
  Synthetic
aagccacgggugtctuaagg

SEQ ID NO: 3007 - DNA, 25 bp, Artificial Sequence
  Synthetic
tctgaatgguggcctgttaattcug

SEQ ID NO: 3008 - DNA, 21 bp, Artificial Sequence
  Synthetic
agaactucaggcgccaaguag

SEQ ID NO: 3009 - DNA, 30 bp, Artificial Sequence
  Synthetic
attttatggcaagtucaacattattcccut

SEQ ID NO: 3010 - DNA, 27 bp, Artificial Sequence
  Synthetic
tattttgggaagutatgaagacgtgut

SEQ ID NO: 3011 - DNA, 29 bp, Artificial Sequence
  Synthetic
gagaggaaaacaugtaagaaaguagccat

SEQ ID NO: 3012 - DNA, 27 bp, Artificial Sequence
  Synthetic
caggacaaautttcctcctaugagaga

SEQ ID NO: 3013 - DNA, 27 bp, Artificial Sequence
  Synthetic
ggcaauggaacctttgtaaauacagag

SEQ ID NO: 3014 - DNA, 30 bp, Artificial Sequence
  Synthetic
tttctgaacaaaacgugatactauacaaca

SEQ ID NO: 3015 - DNA, 25 bp, Artificial Sequence
  Synthetic
agtgtccacucaggaactctatuct

SEQ ID NO: 3016 - DNA, 27 bp, Artificial Sequence
  Synthetic
ggagccttcuataattgtagagguggt

SEQ ID NO: 3017 - DNA, 28 bp, Artificial Sequence
  Synthetic
tggaggtgcagcuacatgtaattattut

SEQ ID NO: 3018 - DNA, 28 bp, Artificial Sequence
  Synthetic
tgttctgauaatgagtgtcuaggcagat

SEQ ID NO: 3019 - DNA, 20 bp, Artificial Sequence
  Synthetic
tggtggtgacugtagcagug

SEQ ID NO: 3020 - DNA, 21 bp, Artificial Sequence
  Synthetic
agtcactgcaccuccatccua

SEQ ID NO: 3021 - DNA, 28 bp, Artificial Sequence
  Synthetic
agataacataccutagctgaagaaguca

SEQ ID NO: 3022 - DNA, 23 bp, Artificial Sequence
  Synthetic
ccatggctuacagatgtgacuct

SEQ ID NO: 3023 - DNA, 22 bp, Artificial Sequence
  Synthetic
cacgatcaaauccccctctucc

SEQ ID NO: 3024 - DNA, 25 bp, Artificial Sequence
  Synthetic
ggcagcataaugaaaagtgggacua

SEQ ID NO: 3025 - DNA, 24 bp, Artificial Sequence
  Synthetic
cctcctcuggttcatuaccaaaca

SEQ ID NO: 3026 - DNA, 23 bp, Artificial Sequence
  Synthetic
gcccaccugtagatccagaugaa

SEQ ID NO: 3027 - DNA, 24 bp, Artificial Sequence
  Synthetic
gctctgtgguttaaagttcugcca

SEQ ID NO: 3028 - DNA, 23 bp, Artificial Sequence
  Synthetic
cttaaagtcucccttgcucggaa

SEQ ID NO: 3029 - DNA, 28 bp, Artificial Sequence
  Synthetic
caagtttcucaagggtatgaagtguact

SEQ ID NO: 3030 - DNA, 20 bp, Artificial Sequence
  Synthetic
cgccctgcuattctcaccut

SEQ ID NO: 3031 - DNA, 17 bp, Artificial Sequence
  Synthetic
ccaccucggtccaugcc

SEQ ID NO: 3032 - DNA, 22 bp, Artificial Sequence
  Synthetic
gggccgaagaagagauttccug

SEQ ID NO: 3033 - DNA, 21 bp, Artificial Sequence
  Synthetic
agggccggagaugagagttua

SEQ ID NO: 3034 - DNA, 23 bp, Artificial Sequence
  Synthetic
agaattgcugcgatctggtagut

SEQ ID NO: 3035 - DNA, 22 bp, Artificial Sequence
  Synthetic
catgtugggagaagucaagcct

SEQ ID NO: 3036 - DNA, 25 bp, Artificial Sequence
  Synthetic
ttgaaactguctttgtgaactugga

SEQ ID NO: 3037 - DNA, 23 bp, Artificial Sequence
  Synthetic
caatctgctguccaggattcuga

SEQ ID NO: 3038 - DNA, 23 bp, Artificial Sequence
  Synthetic
gcacauacagctgauccagagaa

SEQ ID NO: 3039 - DNA, 22 bp, Artificial Sequence
  Synthetic
ggcagtgtgucatgtggttuag

SEQ ID NO: 3040 - DNA, 29 bp, Artificial Sequence
  Synthetic
cttttgtcttctcuagcaattttgacugg

SEQ ID NO: 3041 - DNA, 26 bp, Artificial Sequence
  Synthetic
ctttctatggagcugggatcaatcug

SEQ ID NO: 3042 - DNA, 27 bp, Artificial Sequence
  Synthetic
tcagtgtcagcutgaattaaaugaggt

SEQ ID NO: 3043 - DNA, 25 bp, Artificial Sequence
  Synthetic
tgtttccgaatuccagtagtggaug

SEQ ID NO: 3044 - DNA, 23 bp, Artificial Sequence
  Synthetic
tctgttaccuggtggtagtucct

SEQ ID NO: 3045 - DNA, 27 bp, Artificial Sequence
  Synthetic
tctggtccttcguttttcttctagtuc

SEQ ID NO: 3046 - DNA, 30 bp, Artificial Sequence
  Synthetic
caatttcacaaaggcautcagatcuaacat

SEQ ID NO: 3047 - DNA, 22 bp, Artificial Sequence
  Synthetic
caactguccatggtgcugaaga

SEQ ID NO: 3048 - DNA, 28 bp, Artificial Sequence
  Synthetic
tccttaattctgutctgaattgctguct

SEQ ID NO: 3049 - DNA, 25 bp, Artificial Sequence
  Synthetic
ggtgaattctgaugaagagctggut

SEQ ID NO: 3050 - DNA, 19 bp, Artificial Sequence
  Synthetic
agcagcguctgttccuacc

SEQ ID NO: 3051 - DNA, 24 bp, Artificial Sequence
  Synthetic
aaaagagaauggaaauggcccaga

SEQ ID NO: 3052 - DNA, 29 bp, Artificial Sequence
  Synthetic
aacagaagagagaaguacugagtuaaaaa

SEQ ID NO: 3053 - DNA, 24 bp, Artificial Sequence
  Synthetic
ctgggtcttuggtttcttcagcua

SEQ ID NO: 3054 - DNA, 20 bp, Artificial Sequence
  Synthetic
gccctggcaguatgtcgaug

SEQ ID NO: 3055 - DNA, 24 bp, Artificial Sequence
  Synthetic
cctttcugccacaacagtauccaa

SEQ ID NO: 3056 - DNA, 24 bp, Artificial Sequence
  Synthetic
cctttggtuagaacagcagucaga

SEQ ID NO: 3057 - DNA, 25 bp, Artificial Sequence
  Synthetic
ccaaagcguactgactatucaaggg

SEQ ID NO: 3058 - DNA, 24 bp, Artificial Sequence
  Synthetic
agtcaggagaggucactgtuagag

SEQ ID NO: 3059 - DNA, 28 bp, Artificial Sequence
  Synthetic
acaacataactcautcagactggaauca

SEQ ID NO: 3060 - DNA, 25 bp, Artificial Sequence
  Synthetic
cctcgatagugttcatttctuccgt

SEQ ID NO: 3061 - DNA, 25 bp, Artificial Sequence
  Synthetic
ctatatcucaccagaatgccaugct

SEQ ID NO: 3062 - DNA, 31 bp, Artificial Sequence
  Synthetic
actgaagauagattaacaagugcaaaggaat

SEQ ID NO: 3063 - DNA, 25 bp, Artificial Sequence
  Synthetic
ctggtgtttucctctcgttttcuct

SEQ ID NO: 3064 - DNA, 28 bp, Artificial Sequence
  Synthetic
aaaagagactgtcugtttttcaggtcut

SEQ ID NO: 3065 - DNA, 19 bp, Artificial Sequence
  Synthetic
cctugccagcgugagaaac

SEQ ID NO: 3066 - DNA, 21 bp, Artificial Sequence
  Synthetic
ggagaaacuaggccttggcut

SEQ ID NO: 3067 - DNA, 20 bp, Artificial Sequence
  Synthetic
ggatggcagugagcaatugg

SEQ ID NO: 3068 - DNA, 18 bp, Artificial Sequence
  Synthetic
ctccugccacuccaacga

SEQ ID NO: 3069 - DNA, 19 bp, Artificial Sequence
  Synthetic
gccagcagcutgagtccug

SEQ ID NO: 3070 - DNA, 20 bp, Artificial Sequence
  Synthetic
gccaaggaggautgccucag

SEQ ID NO: 3071 - DNA, 24 bp, Artificial Sequence
  Synthetic
ttguaaggcttgtugagacacagt

SEQ ID NO: 3072 - DNA, 20 bp, Artificial Sequence
  Synthetic
gtccacuccaauccagccat

SEQ ID NO: 3073 - DNA, 21 bp, Artificial Sequence
  Synthetic
tgaaggcauggtgttgtggut

SEQ ID NO: 3074 - DNA, 22 bp, Artificial Sequence
  Synthetic
ccagtcuacaggcctaucagca

SEQ ID NO: 3075 - DNA, 21 bp, Artificial Sequence
  Synthetic
gagagcgcacutgatuggaga

SEQ ID NO: 3076 - DNA, 29 bp, Artificial Sequence
  Synthetic
ctctcacagaguacactagacatacacua

SEQ ID NO: 3077 - DNA, 21 bp, Artificial Sequence
  Synthetic
aacggctacugcacagttcut

SEQ ID NO: 3078 - DNA, 21 bp, Artificial Sequence
  Synthetic
aggagutttcctuggcccaaa

SEQ ID NO: 3079 - DNA, 26 bp, Artificial Sequence
  Synthetic
ccatgaatggaaaccuagccaaguag

SEQ ID NO: 3080 - DNA, 22 bp, Artificial Sequence
  Synthetic
tgtggcuggaggttauagcaag

SEQ ID NO: 3081 - DNA, 24 bp, Artificial Sequence
  Synthetic
ctgttgcauacctcctaugaccat

SEQ ID NO: 3082 - DNA, 21 bp, Artificial Sequence
  Synthetic
gtcuctgcagtgucgagagag

SEQ ID NO: 3083 - DNA, 28 bp, Artificial Sequence
  Synthetic
actatcacaaacaugccttcaacaacua

SEQ ID NO: 3084 - DNA, 23 bp, Artificial Sequence
  Synthetic
ctcaaccucctcttcctcuggat

SEQ ID NO: 3085 - DNA, 25 bp, Artificial Sequence
  Synthetic
ttatgaaggaaccugcuccaagaaa

SEQ ID NO: 3086 - DNA, 18 bp, Artificial Sequence
  Synthetic
cctggcauaggctuccct

SEQ ID NO: 3087 - DNA, 22 bp, Artificial Sequence
  Synthetic
ggaagaacggcuagtgaccauc

SEQ ID NO: 3088 - DNA, 24 bp, Artificial Sequence
  Synthetic
cactctgaggagucaaaagtuccc

SEQ ID NO: 3089 - DNA, 23 bp, Artificial Sequence
  Synthetic
ggaaacugcccaaatgtauccac

SEQ ID NO: 3090 - DNA, 25 bp, Artificial Sequence
  Synthetic
gctattatgucaccacaacctguca

SEQ ID NO: 3091 - DNA, 21 bp, Artificial Sequence
  Synthetic
tagccuagaggagccccauag

SEQ ID NO: 3092 - DNA, 20 bp, Artificial Sequence
  Synthetic
ccccagugaccttgctctuc

SEQ ID NO: 3093 - DNA, 24 bp, Artificial Sequence
  Synthetic
agacaggcuccagatguaagacat

SEQ ID NO: 3094 - DNA, 23 bp, Artificial Sequence
  Synthetic
gauacccttctugccaccaaaga

SEQ ID NO: 3095 - DNA, 21 bp, Artificial Sequence
  Synthetic
guacccgugaacaaacagcag

SEQ ID NO: 3096 - DNA, 25 bp, Artificial Sequence
  Synthetic
cctgaccccuttgcttatatgucat

SEQ ID NO: 3097 - DNA, 22 bp, Artificial Sequence
  Synthetic
gctgaactugagctctccucag

SEQ ID NO: 3098 - DNA, 17 bp, Artificial Sequence
  Synthetic
gggcugctgtagugcca

SEQ ID NO: 3099 - DNA, 18 bp, Artificial Sequence
  Synthetic
ctcccccaacutcuggct

SEQ ID NO: 3100 - DNA, 24 bp, Artificial Sequence
  Synthetic
ctatgtgaagacucatgcugacct

SEQ ID NO: 3101 - DNA, 22 bp, Artificial Sequence
  Synthetic
aaattcagcaugtcggtcucca

SEQ ID NO: 3102 - DNA, 23 bp, Artificial Sequence
  Synthetic
cgaggaggacuccttggactuaa

SEQ ID NO: 3103 - DNA, 21 bp, Artificial Sequence
  Synthetic
ggtggacuccaaagctgtguc

SEQ ID NO: 3104 - DNA, 24 bp, Artificial Sequence
  Synthetic
catacactcacuctcccccactua

SEQ ID NO: 3105 - DNA, 22 bp, Artificial Sequence
  Synthetic
aactacctgtutcctgcctcug

SEQ ID NO: 3106 - DNA, 23 bp, Artificial Sequence
  Synthetic
cacaaggucccgtctgttaugat

SEQ ID NO: 3107 - DNA, 21 bp, Artificial Sequence
  Synthetic
ctgggugggtcttgaaucaca

SEQ ID NO: 3108 - DNA, 20 bp, Artificial Sequence
  Synthetic
ccucggagcugaagaaagcc

SEQ ID NO: 3109 - DNA, 18 bp, Artificial Sequence
  Synthetic
tcctgcagcuccttuccc

SEQ ID NO: 3110 - DNA, 17 bp, Artificial Sequence
  Synthetic
ggctucgggcaacccua

SEQ ID NO: 3111 - DNA, 20 bp, Artificial Sequence
  Synthetic
tggtcgugagagttctgcug

SEQ ID NO: 3112 - DNA, 17 bp, Artificial Sequence
  Synthetic
tggccucgcagtgtugg

SEQ ID NO: 3113 - DNA, 18 bp, Artificial Sequence
  Synthetic
ccctccccacucagcugt

SEQ ID NO: 3114 - DNA, 30 bp, Artificial Sequence
  Synthetic
ggagagtcagugctaaaagtatatttucct

SEQ ID NO: 3115 - DNA, 18 bp, Artificial Sequence
  Synthetic
ggtcugggacggtggtug

SEQ ID NO: 3116 - DNA, 21 bp, Artificial Sequence
  Synthetic
gtgaagtaagccugcctggut

SEQ ID NO: 3117 - DNA, 24 bp, Artificial Sequence
  Synthetic
ctcaggtucatatcttctugccct

SEQ ID NO: 3118 - DNA, 22 bp, Artificial Sequence
  Synthetic
tctctcctcauacctccccuca

SEQ ID NO: 3119 - DNA, 22 bp, Artificial Sequence
  Synthetic
agtcaccttuccctctcccuaa

SEQ ID NO: 3120 - DNA, 25 bp, Artificial Sequence
  Synthetic
gctagtgagugactaaccaagtcut

SEQ ID NO: 3121 - DNA, 20 bp, Artificial Sequence
  Synthetic
gtccatgcauttgaccuccg

SEQ ID NO: 3122 - DNA, 22 bp, Artificial Sequence
  Synthetic
ggaccuccttauggacaaggga

SEQ ID NO: 3123 - DNA, 25 bp, Artificial Sequence
  Synthetic
aagtccagtaaguttagctgtgaug

SEQ ID NO: 3124 - DNA, 21 bp, Artificial Sequence
  Synthetic
gaagatgtggguggaccgtua

SEQ ID NO: 3125 - DNA, 18 bp, Artificial Sequence
  Synthetic
gcagucaagtgucaggcg

SEQ ID NO: 3126 - DNA, 21 bp, Artificial Sequence
  Synthetic
ccagucaaccagcagtuccat

SEQ ID NO: 3127 - DNA, 21 bp, Artificial Sequence
  Synthetic
gcaaggagtucccatgcacut

SEQ ID NO: 3128 - DNA, 19 bp, Artificial Sequence
  Synthetic
gggugacccctacagucgt

SEQ ID NO: 3129 - DNA, 21 bp, Artificial Sequence
  Synthetic
aggcagatugagcccactaua

SEQ ID NO: 3130 - DNA, 22 bp, Artificial Sequence
  Synthetic
gctttatguccctgagugcaga

SEQ ID NO: 3131 - DNA, 18 bp, Artificial Sequence
  Synthetic
caactgcugctgcugagg

SEQ ID NO: 3132 - DNA, 22 bp, Artificial Sequence
  Synthetic
catacaggcaucagctgaggut

SEQ ID NO: 3133 - DNA, 20 bp, Artificial Sequence
  Synthetic
ttggcccuctgatctgtgug

SEQ ID NO: 3134 - DNA, 21 bp, Artificial Sequence
  Synthetic
cagtaccugcctcgcacauag

SEQ ID NO: 3135 - DNA, 24 bp, Artificial Sequence
  Synthetic
caaccgaaugaggaagatctccut

SEQ ID NO: 3136 - DNA, 28 bp, Artificial Sequence
  Synthetic
ctagagctccutgtagaatattuccgac

SEQ ID NO: 3137 - DNA, 22 bp, Artificial Sequence
  Synthetic
ggacuagacaccttgcugaacc

SEQ ID NO: 3138 - DNA, 22 bp, Artificial Sequence
  Synthetic
gacaccacugagcatauccaga

SEQ ID NO: 3139 - DNA, 21 bp, Artificial Sequence
  Synthetic
tggtctgttguccctggtgua

SEQ ID NO: 3140 - DNA, 22 bp, Artificial Sequence
  Synthetic
attcgaagccugtcatttgugc

SEQ ID NO: 3141 - DNA, 25 bp, Artificial Sequence
  Synthetic
tttcataagttaguggtgcctgcut

SEQ ID NO: 3142 - DNA, 22 bp, Artificial Sequence
  Synthetic
ggtctuggaaacccucagcaaa

SEQ ID NO: 3143 - DNA, 22 bp, Artificial Sequence
  Synthetic
ggttcttucggtcacugaggaa

SEQ ID NO: 3144 - DNA, 22 bp, Artificial Sequence
  Synthetic
ctctgtacgaaucacggctgut

SEQ ID NO: 3145 - DNA, 22 bp, Artificial Sequence
  Synthetic
tcuaagttcuccacacacgcac

SEQ ID NO: 3146 - DNA, 25 bp, Artificial Sequence
  Synthetic
ctctgtagcauatgcactugaagga

SEQ ID NO: 3147 - DNA, 22 bp, Artificial Sequence
  Synthetic
ccagttcgguctttcaaaucgg

SEQ ID NO: 3148 - DNA, 23 bp, Artificial Sequence
  Synthetic
aatgaggttgutagcctgaugca

SEQ ID NO: 3149 - DNA, 28 bp, Artificial Sequence
  Synthetic
acattaaaagucaggagagctacucagt

SEQ ID NO: 3150 - DNA, 27 bp, Artificial Sequence
  Synthetic
agttaaaatgaugcaaactuggcagac

SEQ ID NO: 3151 - DNA, 26 bp, Artificial Sequence
  Synthetic
tgatccattcacutctgctacuacca

SEQ ID NO: 3152 - DNA, 28 bp, Artificial Sequence
  Synthetic
acttttgaccgaugtttcctcaaauaca

SEQ ID NO: 3153 - DNA, 28 bp, Artificial Sequence
  Synthetic
tctgaatgctacaugactaccacaatut

SEQ ID NO: 3154 - DNA, 23 bp, Artificial Sequence
  Synthetic
cttgaaguggcaaaaggaucagt

SEQ ID NO: 3155 - DNA, 26 bp, Artificial Sequence
  Synthetic
ctgatcataccutcaagtgaugggaa

SEQ ID NO: 3156 - DNA, 27 bp, Artificial Sequence
  Synthetic
gtcgagtucagaacaaacttttucagt

SEQ ID NO: 3157 - DNA, 28 bp, Artificial Sequence
  Synthetic
ggttatctttagucagttttctcugcca

SEQ ID NO: 3158 - DNA, 26 bp, Artificial Sequence
  Synthetic
ctaaaggauacagaggauccattuga

SEQ ID NO: 3159 - DNA, 20 bp, Artificial Sequence
  Synthetic
gcugagccgtcuacagcaag

SEQ ID NO: 3160 - DNA, 28 bp, Artificial Sequence
  Synthetic
tcagcaguggaacactaaattttauggt

SEQ ID NO: 3161 - DNA, 27 bp, Artificial Sequence
  Synthetic
cataccagctguagctgatgttcuaaa

SEQ ID NO: 3162 - DNA, 30 bp, Artificial Sequence
  Synthetic
cattcaggtttccutttaagctttctuacc

SEQ ID NO: 3163 - DNA, 23 bp, Artificial Sequence
  Synthetic
tgggaagcuttcaaaggaucagt

SEQ ID NO: 3164 - DNA, 22 bp, Artificial Sequence
  Synthetic
cgcacagagccugatatacuga

SEQ ID NO: 3165 - DNA, 29 bp, Artificial Sequence
  Synthetic
agtgggtggaugttaagtgcttttaauat

SEQ ID NO: 3166 - DNA, 28 bp, Artificial Sequence
  Synthetic
ccaaggatauccacaggtaactuagagt

SEQ ID NO: 3167 - DNA, 28 bp, Artificial Sequence
  Synthetic
ttttattguagcctgaagauaaggccaa

SEQ ID NO: 3168 - DNA, 28 bp, Artificial Sequence
  Synthetic
cttacttgtttgutcaggataccttugc

SEQ ID NO: 3169 - DNA, 22 bp, Artificial Sequence
  Synthetic
accagagagccugaggttguaa

SEQ ID NO: 3170 - DNA, 17 bp, Artificial Sequence
  Synthetic
agucggcgaagcugagg

SEQ ID NO: 3171 - DNA, 19 bp, Artificial Sequence
  Synthetic
tccttccccuccctugcat

SEQ ID NO: 3172 - DNA, 24 bp, Artificial Sequence
  Synthetic
tctccttcuggatggtacaugaca

SEQ ID NO: 3173 - DNA, 30 bp, Artificial Sequence
  Synthetic
attgtaggactaaaaugtagcagttgugaa

SEQ ID NO: 3174 - DNA, 25 bp, Artificial Sequence
  Synthetic
gttactcacguccttcttcactuca

SEQ ID NO: 3175 - DNA, 22 bp, Artificial Sequence
  Synthetic
ctctcctucttccccatuaccc

SEQ ID NO: 3176 - DNA, 27 bp, Artificial Sequence
  Synthetic
cgatacagtgtuagagaacagctuaca

SEQ ID NO: 3177 - DNA, 23 bp, Artificial Sequence
  Synthetic
gagctgugaaatcatgcugaacc

SEQ ID NO: 3178 - DNA, 25 bp, Artificial Sequence
  Synthetic
acatggcaugcagatctcttuacag

SEQ ID NO: 3179 - DNA, 25 bp, Artificial Sequence
  Synthetic
cactctgaguaagatcatccaggug

SEQ ID NO: 3180 - DNA, 23 bp, Artificial Sequence
  Synthetic
acccctagcucttaccaaaccut

SEQ ID NO: 3181 - DNA, 23 bp, Artificial Sequence
  Synthetic
tgagaauaagccccuggaaacag

SEQ ID NO: 3182 - DNA, 20 bp, Artificial Sequence
  Synthetic
cugagtugagccaggcagag

SEQ ID NO: 3183 - DNA, 17 bp, Artificial Sequence
  Synthetic
cccugagcccagcagug

SEQ ID NO: 3184 - DNA, 18 bp, Artificial Sequence
  Synthetic
cggcctucccttggugag

SEQ ID NO: 3185 - DNA, 17 bp, Artificial Sequence
  Synthetic
cgcugctacgugggcaa

SEQ ID NO: 3186 - DNA, 17 bp, Artificial Sequence
  Synthetic
gtccucgctgcucagga

SEQ ID NO: 3187 - DNA, 17 bp, Artificial Sequence
  Synthetic
ctggcauggcctggugt

SEQ ID NO: 3188 - DNA, 29 bp, Artificial Sequence
  Synthetic
catgtatagacacaucttgataggcauct

SEQ ID NO: 3189 - DNA, 23 bp, Artificial Sequence
  Synthetic
aatutgcaagcctucccagaaac

SEQ ID NO: 3190 - DNA, 26 bp, Artificial Sequence
  Synthetic
ctgtatctggtguctgatcttcctut

SEQ ID NO: 3191 - DNA, 26 bp, Artificial Sequence
  Synthetic
ccctgatuggagaatttggaauccag

SEQ ID NO: 3192 - DNA, 27 bp, Artificial Sequence
  Synthetic
tatgcugguagaagaaaggaaatttua

SEQ ID NO: 3193 - DNA, 20 bp, Artificial Sequence
  Synthetic
gggctguagcatttgauggg

SEQ ID NO: 3194 - DNA, 26 bp, Artificial Sequence
  Synthetic
gaaactatcguctctttccacaucca

SEQ ID NO: 3195 - DNA, 22 bp, Artificial Sequence
  Synthetic
cctttccttugcagtcactgua

SEQ ID NO: 3196 - DNA, 24 bp, Artificial Sequence
  Synthetic
cccaactcaacucccaacaauagg

SEQ ID NO: 3197 - DNA, 21 bp, Artificial Sequence
  Synthetic
ctccagcugctcctgagauag

SEQ ID NO: 3198 - DNA, 23 bp, Artificial Sequence
  Synthetic
ggcccucaaggacatagagaugt

SEQ ID NO: 3199 - DNA, 20 bp, Artificial Sequence
  Synthetic
ttcagccacgcuatctgcuc

SEQ ID NO: 3200 - DNA, 23 bp, Artificial Sequence
  Synthetic
ccctggattugcaggcatgauaa

SEQ ID NO: 3201 - DNA, 21 bp, Artificial Sequence
  Synthetic
cuggccaggaggaaaattucg

SEQ ID NO: 3202 - DNA, 24 bp, Artificial Sequence
  Synthetic
ggtgacttuccaaaaggaatuccc

SEQ ID NO: 3203 - DNA, 25 bp, Artificial Sequence
  Synthetic
agcctctctcaucttctgaggtauc

SEQ ID NO: 3204 - DNA, 21 bp, Artificial Sequence
  Synthetic
ctcaacacagcucctccagut

SEQ ID NO: 3205 - DNA, 20 bp, Artificial Sequence
  Synthetic
cccagcautggtgacuggac

SEQ ID NO: 3206 - DNA, 28 bp, Artificial Sequence
  Synthetic
aataccctucaaaaggaatctaatuccc

SEQ ID NO: 3207 - DNA, 23 bp, Artificial Sequence
  Synthetic
gctcuggaggcatggtauaaggt

SEQ ID NO: 3208 - DNA, 23 bp, Artificial Sequence
  Synthetic
ccaatcagaugccctcuccaaat

SEQ ID NO: 3209 - DNA, 20 bp, Artificial Sequence
  Synthetic
cgtcctugaggtaccaucgg

SEQ ID NO: 3210 - DNA, 21 bp, Artificial Sequence
  Synthetic
ccagatcugcaggaggtcauc

SEQ ID NO: 3211 - DNA, 21 bp, Artificial Sequence
  Synthetic
gcatgtgugaaaacccagguc

SEQ ID NO: 3212 - DNA, 20 bp, Artificial Sequence
  Synthetic
ggctcuccaggcatgaugat

SEQ ID NO: 3213 - DNA, 21 bp, Artificial Sequence
  Synthetic
ttgccagguccttggcuaaat

SEQ ID NO: 3214 - DNA, 28 bp, Artificial Sequence
  Synthetic
gggaaacatagtuagatcagggaatuct

SEQ ID NO: 3215 - DNA, 27 bp, Artificial Sequence
  Synthetic
aacttggtaagugtaagagaucaaggt

SEQ ID NO: 3216 - DNA, 22 bp, Artificial Sequence
  Synthetic
aggaggauggagtcugaaagct

SEQ ID NO: 3217 - DNA, 25 bp, Artificial Sequence
  Synthetic
tggtatgugcaatgatgttaaugct

SEQ ID NO: 3218 - DNA, 25 bp, Artificial Sequence
  Synthetic
catgcccaucagtaagtgatcuaaa

SEQ ID NO: 3219 - DNA, 27 bp, Artificial Sequence
  Synthetic
cttgagaagucagatggtttattugcc

SEQ ID NO: 3220 - DNA, 19 bp, Artificial Sequence
  Synthetic
gtccugagcccatcuccag

SEQ ID NO: 3221 - DNA, 20 bp, Artificial Sequence
  Synthetic
ccctcuccaccccctcttua

SEQ ID NO: 3222 - DNA, 24 bp, Artificial Sequence
  Synthetic
gcggtgauccacaaaagugaagat

SEQ ID NO: 3223 - DNA, 28 bp, Artificial Sequence
  Synthetic
cctcatttttauctcttcactcucaggt

SEQ ID NO: 3224 - DNA, 28 bp, Artificial Sequence
  Synthetic
tccttcctauaccaaatcacaatccuca

SEQ ID NO: 3225 - DNA, 24 bp, Artificial Sequence
  Synthetic
actgctctucacatcttcctucag

SEQ ID NO: 3226 - DNA, 24 bp, Artificial Sequence
  Synthetic
agagatucacccagatuccagact

SEQ ID NO: 3227 - DNA, 25 bp, Artificial Sequence
  Synthetic
cgaaaaccagacaagcuaaccauct

SEQ ID NO: 3228 - DNA, 19 bp, Artificial Sequence
  Synthetic
cttuagaggcgccccaguc

SEQ ID NO: 3229 - DNA, 20 bp, Artificial Sequence
  Synthetic
gggaguggcctttctttucc

SEQ ID NO: 3230 - DNA, 24 bp, Artificial Sequence
  Synthetic
ccagtaaacagcuctgtggttuca

SEQ ID NO: 3231 - DNA, 25 bp, Artificial Sequence
  Synthetic
aagtcaatcugcagaaactcctuca

SEQ ID NO: 3232 - DNA, 21 bp, Artificial Sequence
  Synthetic
tucattccagucaccgaccac

SEQ ID NO: 3233 - DNA, 24 bp, Artificial Sequence
  Synthetic
aggagtaactgaucccatccctut

SEQ ID NO: 3234 - DNA, 20 bp, Artificial Sequence
  Synthetic
cagggccaaccuatcacuca

SEQ ID NO: 3235 - DNA, 22 bp, Artificial Sequence
  Synthetic
ggutgacgtcauccaggacaag

SEQ ID NO: 3236 - DNA, 27 bp, Artificial Sequence
  Synthetic
ccagttcaguccctcatacttttacut

SEQ ID NO: 3237 - DNA, 23 bp, Artificial Sequence
  Synthetic
aggatgaugacaatgauggccag

SEQ ID NO: 3238 - DNA, 24 bp, Artificial Sequence
  Synthetic
tccugaagagatcuccaaagacac

SEQ ID NO: 3239 - DNA, 22 bp, Artificial Sequence
  Synthetic
ctgtcacuccttggaggtucac

SEQ ID NO: 3240 - DNA, 27 bp, Artificial Sequence
  Synthetic
ggagggaauggaaaaatucaaagacaa

SEQ ID NO: 3241 - DNA, 32 bp, Artificial Sequence
  Synthetic
cctaaaggaaaautcaaaatguagaccacaga

SEQ ID NO: 3242 - DNA, 22 bp, Artificial Sequence
  Synthetic
ccaaattgccuctggcaugaag

SEQ ID NO: 3243 - DNA, 24 bp, Artificial Sequence
  Synthetic
cggtaatagucaccactguacagg

SEQ ID NO: 3244 - DNA, 28 bp, Artificial Sequence
  Synthetic
ccgtctttgtaauattctctctctcuct

SEQ ID NO: 3245 - DNA, 22 bp, Artificial Sequence
  Synthetic
gtatctcttcuccagcagcuga

SEQ ID NO: 3246 - DNA, 24 bp, Artificial Sequence
  Synthetic
cctcagaaaugtgtgcatttuccc

SEQ ID NO: 3247 - DNA, 21 bp, Artificial Sequence
  Synthetic
gagcaaacuggaacucagcct

SEQ ID NO: 3248 - DNA, 22 bp, Artificial Sequence
  Synthetic
gagauggaagatgugggcagag

SEQ ID NO: 3249 - DNA, 22 bp, Artificial Sequence
  Synthetic
gacccuacagaagagccaacug

SEQ ID NO: 3250 - DNA, 20 bp, Artificial Sequence
  Synthetic
aactccagccaucccaaguc

SEQ ID NO: 3251 - DNA, 23 bp, Artificial Sequence
  Synthetic
cacagcucttcctcucagaacac

SEQ ID NO: 3252 - DNA, 23 bp, Artificial Sequence
  Synthetic
gctcguaagcccagtgtctttut

SEQ ID NO: 3253 - DNA, 19 bp, Artificial Sequence
  Synthetic
ggugccacccaagtgcuat

SEQ ID NO: 3254 - DNA, 25 bp, Artificial Sequence
  Synthetic
tgaaagtggacauaaaagccucaca

SEQ ID NO: 3255 - DNA, 24 bp, Artificial Sequence
  Synthetic
cacugaagaaacagguggagaaca

SEQ ID NO: 3256 - DNA, 27 bp, Artificial Sequence
  Synthetic
gaactgctagcutatgccttcaaaaut

SEQ ID NO: 3257 - DNA, 24 bp, Artificial Sequence
  Synthetic
cctgtctcagguctatgaccuact

SEQ ID NO: 3258 - DNA, 21 bp, Artificial Sequence
  Synthetic
ggcttcauggttggucagagg

SEQ ID NO: 3259 - DNA, 22 bp, Artificial Sequence
  Synthetic
catgccauacgggaatttgcug

SEQ ID NO: 3260 - DNA, 23 bp, Artificial Sequence
  Synthetic
cugtatttctuccagacgccaac

SEQ ID NO: 3261 - DNA, 22 bp, Artificial Sequence
  Synthetic
cuacccaguacccaagtguaat

SEQ ID NO: 3262 - DNA, 21 bp, Artificial Sequence
  Synthetic
tgaugtagttgctuggcaccc

SEQ ID NO: 3263 - DNA, 28 bp, Artificial Sequence
  Synthetic
ttgacagtacacugcttcagttgaaaua

SEQ ID NO: 3264 - DNA, 28 bp, Artificial Sequence
  Synthetic
gatctctgccauaactattagguggaag

SEQ ID NO: 3265 - DNA, 22 bp, Artificial Sequence
  Synthetic
ctctggccacugagtacaugag

SEQ ID NO: 3266 - DNA, 17 bp, Artificial Sequence
  Synthetic
aagauggcggacgugct

SEQ ID NO: 3267 - DNA, 19 bp, Artificial Sequence
  Synthetic
cacagccaugccggactua

SEQ ID NO: 3268 - DNA, 28 bp, Artificial Sequence
  Synthetic
gcaatcaaagccaaaautatggcuaaga

SEQ ID NO: 3269 - DNA, 28 bp, Artificial Sequence
  Synthetic
gtaagatagttgtucgtgtcctccauac

SEQ ID NO: 3270 - DNA, 24 bp, Artificial Sequence
  Synthetic
ccagctgccuataacagauacgat

SEQ ID NO: 3271 - DNA, 23 bp, Artificial Sequence
  Synthetic
tuacccttaaacaucaggccaca

SEQ ID NO: 3272 - DNA, 29 bp, Artificial Sequence
  Synthetic
gcactgcaattagugttacagtacctuat

SEQ ID NO: 3273 - DNA, 23 bp, Artificial Sequence
  Synthetic
aacgtcaucaacggcaauaacaa

SEQ ID NO: 3274 - DNA, 28 bp, Artificial Sequence
  Synthetic
caaatgttcagaaaugggatguaacagt

SEQ ID NO: 3275 - DNA, 28 bp, Artificial Sequence
  Synthetic
acacacacaagcauattttagaaucgga

SEQ ID NO: 3276 - DNA, 25 bp, Artificial Sequence
  Synthetic
ggttctctcatuccacaagtgcaua

SEQ ID NO: 3277 - DNA, 28 bp, Artificial Sequence
  Synthetic
gggttgagtaauaggatgataatgtgut

SEQ ID NO: 3278 - DNA, 29 bp, Artificial Sequence
  Synthetic
gagtgtgugtactttcttuaggaggaaat

SEQ ID NO: 3279 - DNA, 27 bp, Artificial Sequence
  Synthetic
agaaaggttatgugtgactgtcatgug

SEQ ID NO: 3280 - DNA, 24 bp, Artificial Sequence
  Synthetic
agactgaaucctggtcttuaggct

SEQ ID NO: 3281 - DNA, 21 bp, Artificial Sequence
  Synthetic
aaccucccagaacacctucac

SEQ ID NO: 3282 - DNA, 28 bp, Artificial Sequence
  Synthetic
cggctggattcucagtctttatcaatut

SEQ ID NO: 3283 - DNA, 23 bp, Artificial Sequence
  Synthetic
caaagaugtggagaauggaggga

SEQ ID NO: 3284 - DNA, 28 bp, Artificial Sequence
  Synthetic
cggctgagttugtcataattcatgtuag

SEQ ID NO: 3285 - DNA, 25 bp, Artificial Sequence
  Synthetic
ctcagaacaagcacaugatctgtug

SEQ ID NO: 3286 - DNA, 24 bp, Artificial Sequence
  Synthetic
ccctuacacacacgcaaaatacuc

SEQ ID NO: 3287 - DNA, 20 bp, Artificial Sequence
  Synthetic
gccctctcugccttttcucc

SEQ ID NO: 3288 - DNA, 22 bp, Artificial Sequence
  Synthetic
gaugagacaggaugaagcagca

SEQ ID NO: 3289 - DNA, 21 bp, Artificial Sequence
  Synthetic
gatgaucgccccttcttcugg

SEQ ID NO: 3290 - DNA, 26 bp, Artificial Sequence
  Synthetic
aaugaacaaaaugaaaggaggcaagg

SEQ ID NO: 3291 - DNA, 18 bp, Artificial Sequence
  Synthetic
ctccaucacggugggcat

SEQ ID NO: 3292 - DNA, 19 bp, Artificial Sequence
  Synthetic
agcccguaggtaccctugt

SEQ ID NO: 3293 - DNA, 22 bp, Artificial Sequence
  Synthetic
ctgagagtcucctctgcucact

SEQ ID NO: 3294 - DNA, 20 bp, Artificial Sequence
  Synthetic
cuccagaaguaggccaacua

SEQ ID NO: 3295 - DNA, 20 bp, Artificial Sequence
  Synthetic
gacatgtggguggaaccuga

SEQ ID NO: 3296 - DNA, 18 bp, Artificial Sequence
  Synthetic
cucccagcagggacacuc

SEQ ID NO: 3297 - DNA, 21 bp, Artificial Sequence
  Synthetic
agugtaagccucggcaaacaa

SEQ ID NO: 3298 - DNA, 19 bp, Artificial Sequence
  Synthetic
ttcttguccccagcaucgg

SEQ ID NO: 3299 - DNA, 20 bp, Artificial Sequence
  Synthetic
aagccaaggucatugcagga

SEQ ID NO: 3300 - DNA, 22 bp, Artificial Sequence
  Synthetic
gaaacugaggcccatcactuct

SEQ ID NO: 3301 - DNA, 22 bp, Artificial Sequence
  Synthetic
gggaccccuactacaucagcaa

SEQ ID NO: 3302 - DNA, 19 bp, Artificial Sequence
  Synthetic
gagccaaguccctgacuct

SEQ ID NO: 3303 - DNA, 19 bp, Artificial Sequence
  Synthetic
gagagggugcagcugagac

SEQ ID NO: 3304 - DNA, 17 bp, Artificial Sequence
  Synthetic
gcccgcugctcacctut

SEQ ID NO: 3305 - DNA, 25 bp, Artificial Sequence
  Synthetic
ccaaagaccacgauaattcctuccc

SEQ ID NO: 3306 - DNA, 22 bp, Artificial Sequence
  Synthetic
cctgttgcuggtagccgtaaut

SEQ ID NO: 3307 - DNA, 21 bp, Artificial Sequence
  Synthetic
ctggagggaagcugtactguc

SEQ ID NO: 3308 - DNA, 21 bp, Artificial Sequence
  Synthetic
ctgcagctgugggtttcttug

SEQ ID NO: 3309 - DNA, 23 bp, Artificial Sequence
  Synthetic
gaggaagagaaagugcctgugag

SEQ ID NO: 3310 - DNA, 28 bp, Artificial Sequence
  Synthetic
aactgcttagtaacuagcagaagtgtuc

SEQ ID NO: 3311 - DNA, 25 bp, Artificial Sequence
  Synthetic
ggauatatgccauaccccagcaaaa

SEQ ID NO: 3312 - DNA, 23 bp, Artificial Sequence
  Synthetic
acaggaagagcacagucacttug

SEQ ID NO: 3313 - DNA, 20 bp, Artificial Sequence
  Synthetic
ctgacaagcucctcgucagt

SEQ ID NO: 3314 - DNA, 20 bp, Artificial Sequence
  Synthetic
cuacagaguccgcaagccaa

SEQ ID NO: 3315 - DNA, 23 bp, Artificial Sequence
  Synthetic
cctcttgucttctccttugcaca

SEQ ID NO: 3316 - DNA, 23 bp, Artificial Sequence
  Synthetic
accaaucatgaugccggagaaag

SEQ ID NO: 3317 - DNA, 22 bp, Artificial Sequence
  Synthetic
ccaacucaaaggagacctggug

SEQ ID NO: 3318 - DNA, 23 bp, Artificial Sequence
  Synthetic
ggagugacacctugaacacgaat

SEQ ID NO: 3319 - DNA, 22 bp, Artificial Sequence
  Synthetic
gaaaatcttugcaggagggugc

SEQ ID NO: 3320 - DNA, 21 bp, Artificial Sequence
  Synthetic
tgaggcuctgacatugcagat

SEQ ID NO: 3321 - DNA, 29 bp, Artificial Sequence
  Synthetic
agaacaatgtgauagaagaagaaauccgt

SEQ ID NO: 3322 - DNA, 20 bp, Artificial Sequence
  Synthetic
agacuccaggcttctucgga

SEQ ID NO: 3323 - DNA, 20 bp, Artificial Sequence
  Synthetic
cacagugcaacaacgccuac

SEQ ID NO: 3324 - DNA, 20 bp, Artificial Sequence
  Synthetic
agtcaggcutaggcugagga

SEQ ID NO: 3325 - DNA, 18 bp, Artificial Sequence
  Synthetic
cagatggucgcatggugg

SEQ ID NO: 3326 - DNA, 29 bp, Artificial Sequence
  Synthetic
tgggaggagaaautagagaacuagagaaa

SEQ ID NO: 3327 - DNA, 26 bp, Artificial Sequence
  Synthetic
gcttgtgattctuttcctctctccua

SEQ ID NO: 3328 - DNA, 21 bp, Artificial Sequence
  Synthetic
cacagtccuggtggaagucac

SEQ ID NO: 3329 - DNA, 20 bp, Artificial Sequence
  Synthetic
gggccaugcaaactuaccat

SEQ ID NO: 3330 - DNA, 21 bp, Artificial Sequence
  Synthetic
gatctctctugcagcctcgut

SEQ ID NO: 3331 - DNA, 21 bp, Artificial Sequence
  Synthetic
gctgacuccaagcacaccauc

SEQ ID NO: 3332 - DNA, 27 bp, Artificial Sequence
  Synthetic
gcactatgaaucccaaactgaaacuca

SEQ ID NO: 3333 - DNA, 32 bp, Artificial Sequence
  Synthetic
ccttctcctgatuattttacatggaatcucac

SEQ ID NO: 3334 - DNA, 19 bp, Artificial Sequence
  Synthetic
catcaggcggauccucagt

SEQ ID NO: 3335 - DNA, 19 bp, Artificial Sequence
  Synthetic
ccaagcagutggtgcugga

SEQ ID NO: 3336 - DNA, 21 bp, Artificial Sequence
  Synthetic
gtcaacugccagactctucct

SEQ ID NO: 3337 - DNA, 18 bp, Artificial Sequence
  Synthetic
gcttuccacggcagcugt

SEQ ID NO: 3338 - DNA, 29 bp, Artificial Sequence
  Synthetic
ttgtaagtcttatgugggatggttttuct

SEQ ID NO: 3339 - DNA, 22 bp, Artificial Sequence
  Synthetic
tgttgctgaacucgtgacucaa

SEQ ID NO: 3340 - DNA, 25 bp, Artificial Sequence
  Synthetic
tgatcaaaguccacaaatucgagca

SEQ ID NO: 3341 - DNA, 24 bp, Artificial Sequence
  Synthetic
acaaccatuccctagctctguact

SEQ ID NO: 3342 - DNA, 28 bp, Artificial Sequence
  Synthetic
tctaggcauaaagatgtcatcaucaacc

SEQ ID NO: 3343 - DNA, 27 bp, Artificial Sequence
  Synthetic
tgaactgataaagugcactggaugaaa

SEQ ID NO: 3344 - DNA, 26 bp, Artificial Sequence
  Synthetic
tggttaucgaggaaaggactguagag

SEQ ID NO: 3345 - DNA, 25 bp, Artificial Sequence
  Synthetic
caaccattucacacagtctgtaugg

SEQ ID NO: 3346 - DNA, 25 bp, Artificial Sequence
  Synthetic
tccacactgcagautattggactug

SEQ ID NO: 3347 - DNA, 25 bp, Artificial Sequence
  Synthetic
caggautatcacttcauggccacat

SEQ ID NO: 3348 - DNA, 25 bp, Artificial Sequence
  Synthetic
caaatgaagtugttttggctgugga

SEQ ID NO: 3349 - DNA, 27 bp, Artificial Sequence
  Synthetic
tgattcttaccccaaaaautccctgut

SEQ ID NO: 3350 - DNA, 28 bp, Artificial Sequence
  Synthetic
aatcagcaaacaaaucaaagctcaugat

SEQ ID NO: 3351 - DNA, 30 bp, Artificial Sequence
  Synthetic
ccttacctctatutctctttcaggatucag

SEQ ID NO: 3352 - DNA, 26 bp, Artificial Sequence
  Synthetic
caaatagaaguacaggtaagctgugt

SEQ ID NO: 3353 - DNA, 24 bp, Artificial Sequence
  Synthetic
tgagcacatgucaagagcaaauct

SEQ ID NO: 3354 - DNA, 28 bp, Artificial Sequence
  Synthetic
agtattggctagcugttgaactgttuat

SEQ ID NO: 3355 - DNA, 29 bp, Artificial Sequence
  Synthetic
cagtacaatatttcauagtctcccgagut

SEQ ID NO: 3356 - DNA, 22 bp, Artificial Sequence
  Synthetic
gtgatagcugttgccgaugact

SEQ ID NO: 3357 - DNA, 28 bp, Artificial Sequence
  Synthetic
tcatggagaggaaucagtaacctataut

SEQ ID NO: 3358 - DNA, 27 bp, Artificial Sequence
  Synthetic
gtagaataagcagutctcccacactuc

SEQ ID NO: 3359 - DNA, 21 bp, Artificial Sequence
  Synthetic
tgcttatcucgttgcauggct

SEQ ID NO: 3360 - DNA, 23 bp, Artificial Sequence
  Synthetic
caaacuagcaggaugacagacca

SEQ ID NO: 3361 - DNA, 21 bp, Artificial Sequence
  Synthetic
cccagagagcucaagatgugt

SEQ ID NO: 3362 - DNA, 20 bp, Artificial Sequence
  Synthetic
ttcatgtgccuggtgagcut

SEQ ID NO: 3363 - DNA, 26 bp, Artificial Sequence
  Synthetic
tgtgggaaagucttcaagaactguag

SEQ ID NO: 3364 - DNA, 22 bp, Artificial Sequence
  Synthetic
tgtctggaguctccgaagcuaa

SEQ ID NO: 3365 - DNA, 22 bp, Artificial Sequence
  Synthetic
cttctcuaagcgcatcaagcuc

SEQ ID NO: 3366 - DNA, 18 bp, Artificial Sequence
  Synthetic
caccaugccctgcaugac

SEQ ID NO: 3367 - DNA, 20 bp, Artificial Sequence
  Synthetic
gagagcgagaggguggacua

SEQ ID NO: 3368 - DNA, 20 bp, Artificial Sequence
  Synthetic
caccaccaggutgctcugaa

SEQ ID NO: 3369 - DNA, 23 bp, Artificial Sequence
  Synthetic
caaaggttacugcaaccatucca

SEQ ID NO: 3370 - DNA, 21 bp, Artificial Sequence
  Synthetic
gtctcgguggtggacuaaaca

SEQ ID NO: 3371 - DNA, 23 bp, Artificial Sequence
  Synthetic
aggactaggugcagaatgtccut

SEQ ID NO: 3372 - DNA, 24 bp, Artificial Sequence
  Synthetic
acatgcaaacagcutttctcctug

SEQ ID NO: 3373 - DNA, 22 bp, Artificial Sequence
  Synthetic
ttcccctucaccaatcgagaug

SEQ ID NO: 3374 - DNA, 17 bp, Artificial Sequence
  Synthetic
cutgctugcggcgagac

SEQ ID NO: 3375 - DNA, 23 bp, Artificial Sequence
  Synthetic
tggatgucaaaaggcactgauga

SEQ ID NO: 3376 - DNA, 17 bp, Artificial Sequence
  Synthetic
gggtgugcgctcaccuc

SEQ ID NO: 3377 - DNA, 19 bp, Artificial Sequence
  Synthetic
gaccaucgtcagcauccca

SEQ ID NO: 3378 - DNA, 22 bp, Artificial Sequence
  Synthetic
ggcugctattcuaagcggagat

SEQ ID NO: 3379 - DNA, 22 bp, Artificial Sequence
  Synthetic
ctattcctccuccccgctttut

SEQ ID NO: 3380 - DNA, 22 bp, Artificial Sequence
  Synthetic
cctgagcagcutctgttctguc

SEQ ID NO: 3381 - DNA, 22 bp, Artificial Sequence
  Synthetic
aacattccccuccacaagucac

SEQ ID NO: 3382 - DNA, 22 bp, Artificial Sequence
  Synthetic
tctctccagcucacttccacut

SEQ ID NO: 3383 - DNA, 22 bp, Artificial Sequence
  Synthetic
acagggagaucaagaaguccca

SEQ ID NO: 3384 - DNA, 23 bp, Artificial Sequence
  Synthetic
cccagagagaccugatctcauca

SEQ ID NO: 3385 - DNA, 20 bp, Artificial Sequence
  Synthetic
cccctguaggctccaucaac

SEQ ID NO: 3386 - DNA, 17 bp, Artificial Sequence
  Synthetic
cccggcugaggtccuct

SEQ ID NO: 3387 - DNA, 22 bp, Artificial Sequence
  Synthetic
aguaaaggcgugaagcagaagt

SEQ ID NO: 3388 - DNA, 28 bp, Artificial Sequence
  Synthetic
tggctttcatuttggatcagaauaggag

SEQ ID NO: 3389 - DNA, 24 bp, Artificial Sequence
  Synthetic
ccccttttaagugagcctgtaaug

SEQ ID NO: 3390 - DNA, 23 bp, Artificial Sequence
  Synthetic
cccactagaaaugcctgcaugag

SEQ ID NO: 3391 - DNA, 30 bp, Artificial Sequence
  Synthetic
aatattgtttgtttutatcccgtcctucag

SEQ ID NO: 3392 - DNA, 21 bp, Artificial Sequence
  Synthetic
ccaggcugggttttgaagcua

SEQ ID NO: 3393 - DNA, 20 bp, Artificial Sequence
  Synthetic
ggagauggtgtuggcagaca

SEQ ID NO: 3394 - DNA, 20 bp, Artificial Sequence
  Synthetic
aaccccagguttgggaacuc

SEQ ID NO: 3395 - DNA, 26 bp, Artificial Sequence
  Synthetic
gttgtctctaacaauagcgtggaugt

SEQ ID NO: 3396 - DNA, 19 bp, Artificial Sequence
  Synthetic
acagtgacucgagguccca

SEQ ID NO: 3397 - DNA, 17 bp, Artificial Sequence
  Synthetic
ggcgccuttcgtugcag

SEQ ID NO: 3398 - DNA, 21 bp, Artificial Sequence
  Synthetic
ctggaaccucctcacccatut

SEQ ID NO: 3399 - DNA, 21 bp, Artificial Sequence
  Synthetic
aggaagacutggcgtttucga

SEQ ID NO: 3400 - DNA, 19 bp, Artificial Sequence
  Synthetic
gcagctcucacccctaucg

SEQ ID NO: 3401 - DNA, 24 bp, Artificial Sequence
  Synthetic
ctcattcagauctcatcccauggt

SEQ ID NO: 3402 - DNA, 23 bp, Artificial Sequence
  Synthetic
ttgatcagaaacuggcaagcuct

SEQ ID NO: 3403 - DNA, 26 bp, Artificial Sequence
  Synthetic
aaacttgtaaaaugacccctggtuct

SEQ ID NO: 3404 - DNA, 20 bp, Artificial Sequence
  Synthetic
ccaggaccutttggtggugt

SEQ ID NO: 3405 - DNA, 20 bp, Artificial Sequence
  Synthetic
agcaguggaaagcccagtuc

SEQ ID NO: 3406 - DNA, 23 bp, Artificial Sequence
  Synthetic
ctagcttcuaacagcagcucagt

SEQ ID NO: 3407 - DNA, 23 bp, Artificial Sequence
  Synthetic
ccacaggguaaatctgacauccc

SEQ ID NO: 3408 - DNA, 23 bp, Artificial Sequence
  Synthetic
tcaggtcctucccatatccctut

SEQ ID NO: 3409 - DNA, 27 bp, Artificial Sequence
  Synthetic
acctgttggaugttatctgtattugca

SEQ ID NO: 3410 - DNA, 22 bp, Artificial Sequence
  Synthetic
gcatttgcagccugtagtccut

SEQ ID NO: 3411 - DNA, 21 bp, Artificial Sequence
  Synthetic
gaaauccaggaagcggcacua

SEQ ID NO: 3412 - DNA, 30 bp, Artificial Sequence
  Synthetic
ccttcacttuaatctggttataugcccaaa

SEQ ID NO: 3413 - DNA, 24 bp, Artificial Sequence
  Synthetic
gtggagcugcttaucaaaaacgaa

SEQ ID NO: 3414 - DNA, 28 bp, Artificial Sequence
  Synthetic
tttggatgcaauacaagtgtaagacuca

SEQ ID NO: 3415 - DNA, 24 bp, Artificial Sequence
  Synthetic
gatgagcaatuggaaaccctucat

SEQ ID NO: 3416 - DNA, 28 bp, Artificial Sequence
  Synthetic
tggaacattgugaaaaacatacctcugt

SEQ ID NO: 3417 - DNA, 28 bp, Artificial Sequence
  Synthetic
tgaggagutaaaatcugaagaaaaggca

SEQ ID NO: 3418 - DNA, 26 bp, Artificial Sequence
  Synthetic
ggaatttgcucgttttcttucagagt

SEQ ID NO: 3419 - DNA, 22 bp, Artificial Sequence
  Synthetic
gcagcctugggaatgaaacugg

SEQ ID NO: 3420 - DNA, 25 bp, Artificial Sequence
  Synthetic
gtaaucaagccatcagucaccagat

SEQ ID NO: 3421 - DNA, 25 bp, Artificial Sequence
  Synthetic
acatcttucccatttcatugaggca

SEQ ID NO: 3422 - DNA, 23 bp, Artificial Sequence
  Synthetic
ccaagccacugaagaaggugaaa

SEQ ID NO: 3423 - DNA, 28 bp, Artificial Sequence
  Synthetic
tgacactttttguttctaccttcucaca

SEQ ID NO: 3424 - DNA, 22 bp, Artificial Sequence
  Synthetic
cagagtggagaugcagctguaa

SEQ ID NO: 3425 - DNA, 30 bp, Artificial Sequence
  Synthetic
acaactaaattcucttggaaacgtatucct

SEQ ID NO: 3426 - DNA, 32 bp, Artificial Sequence
  Synthetic
atttcagatttcaacuattgcagaaagugaag

SEQ ID NO: 3427 - DNA, 25 bp, Artificial Sequence
  Synthetic
caactaccuaagacttccuccacat

SEQ ID NO: 3428 - DNA, 20 bp, Artificial Sequence
  Synthetic
acucagccgggtacuaccat

SEQ ID NO: 3429 - DNA, 30 bp, Artificial Sequence
  Synthetic
agtattttgaagaauttaccacacctguga

SEQ ID NO: 3430 - DNA, 23 bp, Artificial Sequence
  Synthetic
cagagtggcagugcttgaaaauc

SEQ ID NO: 3431 - DNA, 25 bp, Artificial Sequence
  Synthetic
cagtccatuttccacctuaacaggt

SEQ ID NO: 3432 - DNA, 25 bp, Artificial Sequence
  Synthetic
cagggagaacucagagaggtatuca

SEQ ID NO: 3433 - DNA, 22 bp, Artificial Sequence
  Synthetic
caacccugactacuggaaccac

SEQ ID NO: 3434 - DNA, 21 bp, Artificial Sequence
  Synthetic
tcgaatggcgaucgtttcuga

SEQ ID NO: 3435 - DNA, 22 bp, Artificial Sequence
  Synthetic
catguccaagaggacaguagca

SEQ ID NO: 3436 - DNA, 33 bp, Artificial Sequence
  Synthetic
taattatttcttacccuattcgagtcaattcut

SEQ ID NO: 3437 - DNA, 22 bp, Artificial Sequence
  Synthetic
aagctucccagtccaaaugaca

SEQ ID NO: 3438 - DNA, 32 bp, Artificial Sequence
  Synthetic
tctgctattacttuactaagaatgatgauggt

SEQ ID NO: 3439 - DNA, 21 bp, Artificial Sequence
  Synthetic
atuccaacgcgagaaauccct

SEQ ID NO: 3440 - DNA, 30 bp, Artificial Sequence
  Synthetic
atactatatttucaagcaagattgctcuca

SEQ ID NO: 3441 - DNA, 28 bp, Artificial Sequence
  Synthetic
tcttagtgaaatcuccaaaccatgugaa

SEQ ID NO: 3442 - DNA, 25 bp, Artificial Sequence
  Synthetic
gcataagtugagtaaccagcuggat

SEQ ID NO: 3443 - DNA, 30 bp, Artificial Sequence
  Synthetic
gaaaatttgagtugaaatcatggtatugca

SEQ ID NO: 3444 - DNA, 24 bp, Artificial Sequence
  Synthetic
accctcttcagcucagtttcttuc

SEQ ID NO: 3445 - DNA, 23 bp, Artificial Sequence
  Synthetic
gagagaggacugactaucggact

SEQ ID NO: 3446 - DNA, 28 bp, Artificial Sequence
  Synthetic
ggtaccagggauaaagatacatguggat

SEQ ID NO: 3447 - DNA, 25 bp, Artificial Sequence
  Synthetic
gaaaaatguccagatggctuacagg

SEQ ID NO: 3448 - DNA, 27 bp, Artificial Sequence
  Synthetic
ctctatgcagauccttcctctacugaa

SEQ ID NO: 3449 - DNA, 31 bp, Artificial Sequence
  Synthetic
aagttttgacacaaucctctgttttattucc

SEQ ID NO: 3450 - DNA, 20 bp, Artificial Sequence
  Synthetic
tgcacacacaaugctccuct

SEQ ID NO: 3451 - DNA, 23 bp, Artificial Sequence
  Synthetic
gccaccaaacaugactgactuca

SEQ ID NO: 3452 - DNA, 29 bp, Artificial Sequence
  Synthetic
ccagtgactagaaagaucaaattcccaut

SEQ ID NO: 3453 - DNA, 28 bp, Artificial Sequence
  Synthetic
ggccaaaaataaguttctcaatccccua

SEQ ID NO: 3454 - DNA, 26 bp, Artificial Sequence
  Synthetic
attgaaattgugctccagtugaaagg

SEQ ID NO: 3455 - DNA, 25 bp, Artificial Sequence
  Synthetic
ttttggcagcguttcatuaacaagt

SEQ ID NO: 3456 - DNA, 21 bp, Artificial Sequence
  Synthetic
ctcattcaucgccacauaggg

SEQ ID NO: 3457 - DNA, 28 bp, Artificial Sequence
  Synthetic
caaattcctttgtuatgcagacaccaut

SEQ ID NO: 3458 - DNA, 22 bp, Artificial Sequence
  Synthetic
cugtatgcatcaugacgccact

SEQ ID NO: 3459 - DNA, 27 bp, Artificial Sequence
  Synthetic
cgcaagtactaugaaaactgtgaggut

SEQ ID NO: 3460 - DNA, 24 bp, Artificial Sequence
  Synthetic
aaacagtacaaugactgggctcuc

SEQ ID NO: 3461 - DNA, 18 bp, Artificial Sequence
  Synthetic
gtucggcagggcaaaguc

SEQ ID NO: 3462 - DNA, 23 bp, Artificial Sequence
  Synthetic
aagggcagaagutcttcctgaug

SEQ ID NO: 3463 - DNA, 29 bp, Artificial Sequence
  Synthetic
catgtcuacgaagaaaagtatgugaacag

SEQ ID NO: 3464 - DNA, 26 bp, Artificial Sequence
  Synthetic
cactgagcatuttctgttgttcugaa

SEQ ID NO: 3465 - DNA, 30 bp, Artificial Sequence
  Synthetic
atgtctttgtctagucgtctaatgttttua

SEQ ID NO: 3466 - DNA, 20 bp, Artificial Sequence
  Synthetic
cccattctuggctgcaucgt

SEQ ID NO: 3467 - DNA, 30 bp, Artificial Sequence
  Synthetic
ttgctctttcttaucacttctttcactuct

SEQ ID NO: 3468 - DNA, 25 bp, Artificial Sequence
  Synthetic
ccaccaactutacgtttgcaugaag

SEQ ID NO: 3469 - DNA, 23 bp, Artificial Sequence
  Synthetic
tggaaaacguggccatcacaaua

SEQ ID NO: 3470 - DNA, 28 bp, Artificial Sequence
  Synthetic
aattcaccatctuctttttctgcctcua

SEQ ID NO: 3471 - DNA, 29 bp, Artificial Sequence
  Synthetic
ctcagcaagacucatatgaatttgttucc

SEQ ID NO: 3472 - DNA, 25 bp, Artificial Sequence
  Synthetic
aaagttgaatcaugctgtccagtug

SEQ ID NO: 3473 - DNA, 27 bp, Artificial Sequence
  Synthetic
ttttggaattaaautctgctgaauggg

SEQ ID NO: 3474 - DNA, 19 bp, Artificial Sequence
  Synthetic
cctcggcugccgattaucc

SEQ ID NO: 3475 - DNA, 19 bp, Artificial Sequence
  Synthetic
gaagagctuggccggttuc

SEQ ID NO: 3476 - DNA, 21 bp, Artificial Sequence
  Synthetic
tctaaccaggugctgctgtug

SEQ ID NO: 3477 - DNA, 26 bp, Artificial Sequence
  Synthetic
ccaaatcaaaaagcccuatgagtcug

SEQ ID NO: 3478 - DNA, 21 bp, Artificial Sequence
  Synthetic
aggccccaugcaattuaccat

SEQ ID NO: 3479 - DNA, 21 bp, Artificial Sequence
  Synthetic
cgaguccaacagcccactuac

SEQ ID NO: 3480 - DNA, 25 bp, Artificial Sequence
  Synthetic
gutactcacugaggcagagaagaag

SEQ ID NO: 3481 - DNA, 28 bp, Artificial Sequence
  Synthetic
ttctgaaacagtutctacataatgcuca

SEQ ID NO: 3482 - DNA, 27 bp, Artificial Sequence
  Synthetic
tgaactaacgccuttctttttctucct

SEQ ID NO: 3483 - DNA, 29 bp, Artificial Sequence
  Synthetic
ggttgatggtatgutttagcttcatggua

SEQ ID NO: 3484 - DNA, 29 bp, Artificial Sequence
  Synthetic
ggcttcagtattauaccctggatgtgaua

SEQ ID NO: 3485 - DNA, 28 bp, Artificial Sequence
  Synthetic
tttccatttggutgtacttcatctucct

SEQ ID NO: 3486 - DNA, 28 bp, Artificial Sequence
  Synthetic
ttcatgcattaaaugaaacagaggugac

SEQ ID NO: 3487 - DNA, 23 bp, Artificial Sequence
  Synthetic
gggctcaugacactgaaaatuct

SEQ ID NO: 3488 - DNA, 31 bp, Artificial Sequence
  Synthetic
ctcagatatugcagtaatcatguacacaagt

SEQ ID NO: 3489 - DNA, 26 bp, Artificial Sequence
  Synthetic
tgacatacccuagttctggaatccut

SEQ ID NO: 3490 - DNA, 28 bp, Artificial Sequence
  Synthetic
tggatcggatcuacaaaaatgtcaugaa

SEQ ID NO: 3491 - DNA, 25 bp, Artificial Sequence
  Synthetic
aggagaaagaaggagguagagaguc

SEQ ID NO: 3492 - DNA, 20 bp, Artificial Sequence
  Synthetic
ggccaaagugtgacaauggg

SEQ ID NO: 3493 - DNA, 25 bp, Artificial Sequence
  Synthetic
tctttaagcauccatcgggtucaaa

SEQ ID NO: 3494 - DNA, 22 bp, Artificial Sequence
  Synthetic
aactgcagucaacacagtucac

SEQ ID NO: 3495 - DNA, 21 bp, Artificial Sequence
  Synthetic
agctccucccaagtcccttua

SEQ ID NO: 3496 - DNA, 28 bp, Artificial Sequence
  Synthetic
gacatugagcgaatgtauggaagaaaat

SEQ ID NO: 3497 - DNA, 28 bp, Artificial Sequence
  Synthetic
cagttaaaaauggtgacgtcaugagaag

SEQ ID NO: 3498 - DNA, 21 bp, Artificial Sequence
  Synthetic
acagatucccaaggtggugac

SEQ ID NO: 3499 - DNA, 21 bp, Artificial Sequence
  Synthetic
ggaucgaaacagcuggcaaga

SEQ ID NO: 3500 - DNA, 32 bp, Artificial Sequence
  Synthetic
aatgaaacatttgutagtaagggaacuagagt

SEQ ID NO: 3501 - DNA, 24 bp, Artificial Sequence
  Synthetic
gctgautttggactugcaaagcat

SEQ ID NO: 3502 - DNA, 23 bp, Artificial Sequence
  Synthetic
tgagagaggcuctggatgaucaa

SEQ ID NO: 3503 - DNA, 20 bp, Artificial Sequence
  Synthetic
cautatgagacuggccgggt

SEQ ID NO: 3504 - DNA, 20 bp, Artificial Sequence
  Synthetic
ccccucctctgugacaggaa

SEQ ID NO: 3505 - DNA, 22 bp, Artificial Sequence
  Synthetic
aggaatcccacucaagagcuga

SEQ ID NO: 3506 - DNA, 27 bp, Artificial Sequence
  Synthetic
atctgataattucacccgaggtcttut

SEQ ID NO: 3507 - DNA, 24 bp, Artificial Sequence
  Synthetic
gcuttcactagaugacagagcgag

SEQ ID NO: 3508 - DNA, 20 bp, Artificial Sequence
  Synthetic
tgtcaguggttcttugccca

SEQ ID NO: 3509 - DNA, 21 bp, Artificial Sequence
  Synthetic
agacgtucgagcagctctuag

SEQ ID NO: 3510 - DNA, 21 bp, Artificial Sequence
  Synthetic
tggataccucccaagtccugt

SEQ ID NO: 3511 - DNA, 28 bp, Artificial Sequence
  Synthetic
ttttagttcucaaaactgcattcugact

SEQ ID NO: 3512 - DNA, 26 bp, Artificial Sequence
  Synthetic
gaatgtctacccaauaccagtactug

SEQ ID NO: 3513 - DNA, 24 bp, Artificial Sequence
  Synthetic
caauagcagacaccatcugaggag

SEQ ID NO: 3514 - DNA, 27 bp, Artificial Sequence
  Synthetic
tgttttatgccautacaactcuccaca

SEQ ID NO: 3515 - DNA, 29 bp, Artificial Sequence
  Synthetic
gcagtctgtcguaatagccaagaattuaa

SEQ ID NO: 3516 - DNA, 29 bp, Artificial Sequence
  Synthetic
gctaatgacuagggccttatatcctttut

SEQ ID NO: 3517 - DNA, 27 bp, Artificial Sequence
  Synthetic
catggcaccaguttactcagaattuac

SEQ ID NO: 3518 - DNA, 29 bp, Artificial Sequence
  Synthetic
aaaatgattttgutgagttgtaugccagt

SEQ ID NO: 3519 - DNA, 23 bp, Artificial Sequence
  Synthetic
guatcctgatgugcacgaacaag

SEQ ID NO: 3520 - DNA, 21 bp, Artificial Sequence
  Synthetic
gaatgttugcaccacaguggg

SEQ ID NO: 3521 - DNA, 23 bp, Artificial Sequence
  Synthetic
caatagcttcugcagcttcctug

SEQ ID NO: 3522 - DNA, 30 bp, Artificial Sequence
  Synthetic
ttttcattttgctutctattcttcctugct

SEQ ID NO: 3523 - DNA, 32 bp, Artificial Sequence
  Synthetic
ctggagttaaucgagaaatatgagauacauac

SEQ ID NO: 3524 - DNA, 18 bp, Artificial Sequence
  Synthetic
catucccagggccuggac

SEQ ID NO: 3525 - DNA, 18 bp, Artificial Sequence
  Synthetic
aaacgctcucgccccuac

SEQ ID NO: 3526 - DNA, 22 bp, Artificial Sequence
  Synthetic
gccttacccuctgccaggatua

SEQ ID NO: 3527 - DNA, 20 bp, Artificial Sequence
  Synthetic
tggagaaggaggucguggaa

SEQ ID NO: 3528 - DNA, 23 bp, Artificial Sequence
  Synthetic
caaaaagcaccutggagatgugg

SEQ ID NO: 3529 - DNA, 22 bp, Artificial Sequence
  Synthetic
cccagcaaugagaguacagaca

SEQ ID NO: 3530 - DNA, 21 bp, Artificial Sequence
  Synthetic
agttggtgutctgcacgucat

SEQ ID NO: 3531 - DNA, 22 bp, Artificial Sequence
  Synthetic
ccgagcagcacutgtttguaac

SEQ ID NO: 3532 - DNA, 21 bp, Artificial Sequence
  Synthetic
gacttgttgcuggctgactug

SEQ ID NO: 3533 - DNA, 23 bp, Artificial Sequence
  Synthetic
tttaagguagaagcccgggtcua

SEQ ID NO: 3534 - DNA, 20 bp, Artificial Sequence
  Synthetic
ccccagcuccctaggaggua

SEQ ID NO: 3535 - DNA, 23 bp, Artificial Sequence
  Synthetic
cgttccacttugtcagctatgug

SEQ ID NO: 3536 - DNA, 20 bp, Artificial Sequence
  Synthetic
gcaucccacccuccaaacaa

SEQ ID NO: 3537 - DNA, 26 bp, Artificial Sequence
  Synthetic
tcttcctgutcaaatggaucgaagag

SEQ ID NO: 3538 - DNA, 20 bp, Artificial Sequence
  Synthetic
ctccagccagcccutatuca

SEQ ID NO: 3539 - DNA, 17 bp, Artificial Sequence
  Synthetic
cgacugggcccgttguc

SEQ ID NO: 3540 - DNA, 26 bp, Artificial Sequence
  Synthetic
cctctcccaugagttttgcaatttut

SEQ ID NO: 3541 - DNA, 22 bp, Artificial Sequence
  Synthetic
ctacacagauggtucacaggca

SEQ ID NO: 3542 - DNA, 28 bp, Artificial Sequence
  Synthetic
aggaggttttgaaugttcaatgagacua

SEQ ID NO: 3543 - DNA, 28 bp, Artificial Sequence
  Synthetic
attaatgaagttcugctgctgataucga

SEQ ID NO: 3544 - DNA, 28 bp, Artificial Sequence
  Synthetic
tgcttaagtcagggaugtttgatttcut

SEQ ID NO: 3545 - DNA, 25 bp, Artificial Sequence
  Synthetic
tactagttcccuctacctcucaagt

SEQ ID NO: 3546 - DNA, 21 bp, Artificial Sequence
  Synthetic
gcuagggaggagggtgguaac

SEQ ID NO: 3547 - DNA, 23 bp, Artificial Sequence
  Synthetic
gaatgguagagcagctatggcut

SEQ ID NO: 3548 - DNA, 22 bp, Artificial Sequence
  Synthetic
gattgguggaggtcttucaggt

SEQ ID NO: 3549 - DNA, 22 bp, Artificial Sequence
  Synthetic
tgtcagtgcauggtacaaccut

SEQ ID NO: 3550 - DNA, 21 bp, Artificial Sequence
  Synthetic
gggtcaaugatgcugcaacac

SEQ ID NO: 3551 - DNA, 27 bp, Artificial Sequence
  Synthetic
tgaacaaaaccaauccatgcatttuct

SEQ ID NO: 3552 - DNA, 22 bp, Artificial Sequence
  Synthetic
catccccagucacauagccaat

SEQ ID NO: 3553 - DNA, 27 bp, Artificial Sequence
  Synthetic
gcttggaagaaaccuaacaaattgtut

SEQ ID NO: 3554 - DNA, 26 bp, Artificial Sequence
  Synthetic
gttgatttuagagccattgctuccag

SEQ ID NO: 3555 - DNA, 23 bp, Artificial Sequence
  Synthetic
ttttgctgctucaaagggaggua

SEQ ID NO: 3556 - DNA, 27 bp, Artificial Sequence
  Synthetic
cccgttttgacuttttcataaggcuat

SEQ ID NO: 3557 - DNA, 28 bp, Artificial Sequence
  Synthetic
tttgcctgauacatatcagcattuacga

SEQ ID NO: 3558 - DNA, 19 bp, Artificial Sequence
  Synthetic
ccucgaccaccagggttuc

SEQ ID NO: 3559 - DNA, 26 bp, Artificial Sequence
  Synthetic
agttagtctcuagttttctggugggt

SEQ ID NO: 3560 - DNA, 24 bp, Artificial Sequence
  Synthetic
gctatacacagutgcatgtgcuca

SEQ ID NO: 3561 - DNA, 23 bp, Artificial Sequence
  Synthetic
aggtttccaguttgtttccucgt

SEQ ID NO: 3562 - DNA, 20 bp, Artificial Sequence
  Synthetic
cggtccatguccaggaggua

SEQ ID NO: 3563 - DNA, 21 bp, Artificial Sequence
  Synthetic
cctcttcuccatggcttuccc

SEQ ID NO: 3564 - DNA, 21 bp, Artificial Sequence
  Synthetic
cctguccaggcaatgaagugg

SEQ ID NO: 3565 - DNA, 27 bp, Artificial Sequence
  Synthetic
actaagctattgugtgatgtgtcctug

SEQ ID NO: 3566 - DNA, 22 bp, Artificial Sequence
  Synthetic
gggaccccaugttcatagagug

SEQ ID NO: 3567 - DNA, 23 bp, Artificial Sequence
  Synthetic
agccaggagutcctggagauaat

SEQ ID NO: 3568 - DNA, 20 bp, Artificial Sequence
  Synthetic
ccaggctcuggaagcgaaug

SEQ ID NO: 3569 - DNA, 23 bp, Artificial Sequence
  Synthetic
caagccatuaacccctccuacaa

SEQ ID NO: 3570 - DNA, 22 bp, Artificial Sequence
  Synthetic
gtgccaucaccagaaagguact

SEQ ID NO: 3571 - DNA, 28 bp, Artificial Sequence
  Synthetic
gcaagtttcauggatgtcctatttucca

SEQ ID NO: 3572 - DNA, 25 bp, Artificial Sequence
  Synthetic
acataaacttaccccugggaccaua

SEQ ID NO: 3573 - DNA, 25 bp, Artificial Sequence
  Synthetic
ccccctcutagttaaaatcucccaa

SEQ ID NO: 3574 - DNA, 21 bp, Artificial Sequence
  Synthetic
tgutgggugacaaagaggcat

SEQ ID NO: 3575 - DNA, 23 bp, Artificial Sequence
  Synthetic
actacttttgcugtctcgctcug

SEQ ID NO: 3576 - DNA, 21 bp, Artificial Sequence
  Synthetic
gcaggugaaaggcctctgtuc

SEQ ID NO: 3577 - DNA, 24 bp, Artificial Sequence
  Synthetic
caccaaggatcugctttgtctcut

SEQ ID NO: 3578 - DNA, 19 bp, Artificial Sequence
  Synthetic
ccctcucagcccatgctua

SEQ ID NO: 3579 - DNA, 23 bp, Artificial Sequence
  Synthetic
tttggcctutcttcttctuccca

SEQ ID NO: 3580 - DNA, 24 bp, Artificial Sequence
  Synthetic
atgtgaatgtcugaaagctgccua

SEQ ID NO: 3581 - DNA, 25 bp, Artificial Sequence
  Synthetic
caccgcaaaugtgaattaucaacgt

SEQ ID NO: 3582 - DNA, 22 bp, Artificial Sequence
  Synthetic
tggatgaggcaugcaguagaac

SEQ ID NO: 3583 - DNA, 22 bp, Artificial Sequence
  Synthetic
caagcaccugccttgactttut

SEQ ID NO: 3584 - DNA, 25 bp, Artificial Sequence
  Synthetic
gacccautcctguagagacacaaag

SEQ ID NO: 3585 - DNA, 27 bp, Artificial Sequence
  Synthetic
cacaaaccagauaatgcaagaugaaca

SEQ ID NO: 3586 - DNA, 23 bp, Artificial Sequence
  Synthetic
gtagcacacaacaucctucaggt

SEQ ID NO: 3587 - DNA, 28 bp, Artificial Sequence
  Synthetic
aatgtccttggaugttttccttttgtuc

SEQ ID NO: 3588 - DNA, 26 bp, Artificial Sequence
  Synthetic
ggagtcuccaagagggaaacaaatua

SEQ ID NO: 3589 - DNA, 30 bp, Artificial Sequence
  Synthetic
tgtctcttcagatucctccaagaagauaaa

SEQ ID NO: 3590 - DNA, 25 bp, Artificial Sequence
  Synthetic
ggatcacaautttgtagcugaccga

SEQ ID NO: 3591 - DNA, 21 bp, Artificial Sequence
  Synthetic
cugttataauccgcggagcca

SEQ ID NO: 3592 - DNA, 21 bp, Artificial Sequence
  Synthetic
agtctctccutcgtggcauct

SEQ ID NO: 3593 - DNA, 22 bp, Artificial Sequence
  Synthetic
gctagucccccagaggttacut

SEQ ID NO: 3594 - DNA, 23 bp, Artificial Sequence
  Synthetic
tggcactuggagactatauggga

SEQ ID NO: 3595 - DNA, 21 bp, Artificial Sequence
  Synthetic
tcaaacactcucccgggtgua

SEQ ID NO: 3596 - DNA, 29 bp, Artificial Sequence
  Synthetic
tgggtattaatgugtaagttgtgcuacaa

SEQ ID NO: 3597 - DNA, 25 bp, Artificial Sequence
  Synthetic
actgtttgatuccttcaagggucaa

SEQ ID NO: 3598 - DNA, 23 bp, Artificial Sequence
  Synthetic
gacgcttgguctcatacatgtug

SEQ ID NO: 3599 - DNA, 25 bp, Artificial Sequence
  Synthetic
cagtagtgaucagaacacgactuga

SEQ ID NO: 3600 - DNA, 23 bp, Artificial Sequence
  Synthetic
tgggaggaaaggugtggctauaa

SEQ ID NO: 3601 - DNA, 24 bp, Artificial Sequence
  Synthetic
catccaaaacuctcaucccaggaa

SEQ ID NO: 3602 - DNA, 22 bp, Artificial Sequence
  Synthetic
ggtattgcaccutggtgtuggt

SEQ ID NO: 3603 - DNA, 23 bp, Artificial Sequence
  Synthetic
gagcaaugacatctttctugggt

SEQ ID NO: 3604 - DNA, 23 bp, Artificial Sequence
  Synthetic
aattcgagugtgggtttucaggt

SEQ ID NO: 3605 - DNA, 23 bp, Artificial Sequence
  Synthetic
ggactgcagagaccutccttaut

SEQ ID NO: 3606 - DNA, 20 bp, Artificial Sequence
  Synthetic
gtggaggcacauctcugcat

SEQ ID NO: 3607 - DNA, 22 bp, Artificial Sequence
  Synthetic
ccaggtgcugaggctgttttua

SEQ ID NO: 3608 - DNA, 19 bp, Artificial Sequence
  Synthetic
cctggaggaugcaggcaut

SEQ ID NO: 3609 - DNA, 21 bp, Artificial Sequence
  Synthetic
agagacccucctcggaagaug

SEQ ID NO: 3610 - DNA, 20 bp, Artificial Sequence
  Synthetic
acagggagguggctguacat

SEQ ID NO: 3611 - DNA, 22 bp, Artificial Sequence
  Synthetic
cccaagacaucatggcctaucg

SEQ ID NO: 3612 - DNA, 27 bp, Artificial Sequence
  Synthetic
agggttgatcucaggatctagatugat

SEQ ID NO: 3613 - DNA, 28 bp, Artificial Sequence
  Synthetic
actgtaagggaucacagattcgataugt

SEQ ID NO: 3614 - DNA, 24 bp, Artificial Sequence
  Synthetic
aaugttatgucaccaccaggagag

SEQ ID NO: 3615 - DNA, 26 bp, Artificial Sequence
  Synthetic
tcttctcctttuacaggtcatccuca

SEQ ID NO: 3616 - DNA, 25 bp, Artificial Sequence
  Synthetic
gcaagacttgcutgtccacttcuaa

SEQ ID NO: 3617 - DNA, 23 bp, Artificial Sequence
  Synthetic
ctactttgtggcugcctttgtug

SEQ ID NO: 3618 - DNA, 20 bp, Artificial Sequence
  Synthetic
cgagagcagguagtcccgua

SEQ ID NO: 3619 - DNA, 18 bp, Artificial Sequence
  Synthetic
ccttgacugggcugccat

SEQ ID NO: 3620 - DNA, 22 bp, Artificial Sequence
  Synthetic
gacagcaaaaggugatgagcug

SEQ ID NO: 3621 - DNA, 25 bp, Artificial Sequence
  Synthetic
cggcttucccaacctatttucagaa

SEQ ID NO: 3622 - DNA, 20 bp, Artificial Sequence
  Synthetic
gggttcggcuctagtcauca

SEQ ID NO: 3623 - DNA, 23 bp, Artificial Sequence
  Synthetic
gaagagtttgcuggttggaaugt

SEQ ID NO: 3624 - DNA, 22 bp, Artificial Sequence
  Synthetic
atcccctgaacugaaaccacug

SEQ ID NO: 3625 - DNA, 24 bp, Artificial Sequence
  Synthetic
cgtctucgaattggaatuccccaa

SEQ ID NO: 3626 - DNA, 22 bp, Artificial Sequence
  Synthetic
ccagcagugcagagucagaaag

SEQ ID NO: 3627 - DNA, 24 bp, Artificial Sequence
  Synthetic
caaaggacagaaugctgccatcua

SEQ ID NO: 3628 - DNA, 20 bp, Artificial Sequence
  Synthetic
gucagaagtcuccggcacag

SEQ ID NO: 3629 - DNA, 19 bp, Artificial Sequence
  Synthetic
tctggtcucgggagccaua

SEQ ID NO: 3630 - DNA, 22 bp, Artificial Sequence
  Synthetic
cctgagcacuttgctcttgtuc

SEQ ID NO: 3631 - DNA, 20 bp, Artificial Sequence
  Synthetic
gagagcagcutggtgtcuct

SEQ ID NO: 3632 - DNA, 30 bp, Artificial Sequence
  Synthetic
ataacaagaaaaucagacuggagaaggaaa

SEQ ID NO: 3633 - DNA, 22 bp, Artificial Sequence
  Synthetic
tgucaagauccaagaagtgtug

SEQ ID NO: 3634 - DNA, 29 bp, Artificial Sequence
  Synthetic
aggacagtggtcutaaatgttagagtgua

SEQ ID NO: 3635 - DNA, 23 bp, Artificial Sequence
  Synthetic
ggcttcccuggtttagagtuacc

SEQ ID NO: 3636 - DNA, 23 bp, Artificial Sequence
  Synthetic
tgtccttcatugagtgcggaaut

SEQ ID NO: 3637 - DNA, 29 bp, Artificial Sequence
  Synthetic
aacaauaaaggugaggaaagaaaaggact

SEQ ID NO: 3638 - DNA, 24 bp, Artificial Sequence
  Synthetic
ttatctcttcucttccaccuccca

SEQ ID NO: 3639 - DNA, 27 bp, Artificial Sequence
  Synthetic
gaagatgtcauattctggatggugact

SEQ ID NO: 3640 - DNA, 22 bp, Artificial Sequence
  Synthetic
gcaagtugaggcactgaagaug

SEQ ID NO: 3641 - DNA, 29 bp, Artificial Sequence
  Synthetic
acaagagggaauactgaataaaaauggat

SEQ ID NO: 3642 - DNA, 27 bp, Artificial Sequence
  Synthetic
ctcttctgcaguctttattagcatugt

SEQ ID NO: 3643 - DNA, 26 bp, Artificial Sequence
  Synthetic
ttctgaagtugagcgtaataccaguc

SEQ ID NO: 3644 - DNA, 26 bp, Artificial Sequence
  Synthetic
cgaagaauagccagaatucagcaaat

SEQ ID NO: 3645 - DNA, 30 bp, Artificial Sequence
  Synthetic
aacuacctatttttauacccacaaacaaga

SEQ ID NO: 3646 - DNA, 26 bp, Artificial Sequence
  Synthetic
tgaaacagccagugttttgagttcua

SEQ ID NO: 3647 - DNA, 26 bp, Artificial Sequence
  Synthetic
aatgtctuagcaaagtagtcauggca

SEQ ID NO: 3648 - DNA, 26 bp, Artificial Sequence
  Synthetic
tgaaatccgaguccttcatctttugg

SEQ ID NO: 3649 - DNA, 26 bp, Artificial Sequence
  Synthetic
atttgcttugaaacatgcacuacgat

SEQ ID NO: 3650 - DNA, 25 bp, Artificial Sequence
  Synthetic
gtggactgtgaaaugtatgggctua

SEQ ID NO: 3651 - DNA, 32 bp, Artificial Sequence
  Synthetic
atgaaagtaaattaacucatacctgagctauc

SEQ ID NO: 3652 - DNA, 29 bp, Artificial Sequence
  Synthetic
gaagttaaugagagacaaattccaacuct

SEQ ID NO: 3653 - DNA, 31 bp, Artificial Sequence
  Synthetic
catatatcagctttautctcagtgcaatgug

SEQ ID NO: 3654 - DNA, 31 bp, Artificial Sequence
  Synthetic
tcatagtttgacaauagtcagtaatgcaugt

SEQ ID NO: 3655 - DNA, 21 bp, Artificial Sequence
  Synthetic
tgcagcacutcccauagcaat

SEQ ID NO: 3656 - DNA, 30 bp, Artificial Sequence
  Synthetic
acatgactgtccuttcaccatatttgaaua

SEQ ID NO: 3657 - DNA, 24 bp, Artificial Sequence
  Synthetic
ttcctggatuttctgttgcuggat

SEQ ID NO: 3658 - DNA, 30 bp, Artificial Sequence
  Synthetic
agtgtcagtaguagtgatggttatgguaaa

SEQ ID NO: 3659 - DNA, 32 bp, Artificial Sequence
  Synthetic
tagttctccatcatuatcatccatatgattug

SEQ ID NO: 3660 - DNA, 27 bp, Artificial Sequence
  Synthetic
caaatcgagugggttctaatcauggaa

SEQ ID NO: 3661 - DNA, 30 bp, Artificial Sequence
  Synthetic
tttatgctataattugttggtctctctuct

SEQ ID NO: 3662 - DNA, 32 bp, Artificial Sequence
  Synthetic
gccacttgcaaaguttcttctatuaaccaaga

SEQ ID NO: 3663 - DNA, 26 bp, Artificial Sequence
  Synthetic
cagaatctgctucctgtgtcgtcuga

SEQ ID NO: 3664 - DNA, 30 bp, Artificial Sequence
  Synthetic
gatgtacttctgucagttcacttgatagut

SEQ ID NO: 3665 - DNA, 24 bp, Artificial Sequence
  Synthetic
gtggaggtgutttacttctgctug

SEQ ID NO: 3666 - DNA, 27 bp, Artificial Sequence
  Synthetic
gttcaggaaaaugacaatgggaaugaa

SEQ ID NO: 3667 - DNA, 30 bp, Artificial Sequence
  Synthetic
ggcatggcagaaauaatacattcttcuagt

SEQ ID NO: 3668 - DNA, 21 bp, Artificial Sequence
  Synthetic
gggcacagucaggtgaattug

SEQ ID NO: 3669 - DNA, 27 bp, Artificial Sequence
  Synthetic
gcaagaatatcaccutcctctgcttua

SEQ ID NO: 3670 - DNA, 31 bp, Artificial Sequence
  Synthetic
cucagacaacaaagatucaaagaaacagaat

SEQ ID NO: 3671 - DNA, 30 bp, Artificial Sequence
  Synthetic
gaatcatttcgugaaaaacagtaaggagut

SEQ ID NO: 3672 - DNA, 26 bp, Artificial Sequence
  Synthetic
tgctattgaaaauactccggttugct

SEQ ID NO: 3673 - DNA, 25 bp, Artificial Sequence
  Synthetic
gtttacttggtuctccctgtgaguc

SEQ ID NO: 3674 - DNA, 29 bp, Artificial Sequence
  Synthetic
tggtctatccccugattcagaaaatttug

SEQ ID NO: 3675 - DNA, 27 bp, Artificial Sequence
  Synthetic
cagagagautcctgattucagggaaag

SEQ ID NO: 3676 - DNA, 28 bp, Artificial Sequence
  Synthetic
aggacaatgattcauattccaggagtuc

SEQ ID NO: 3677 - DNA, 22 bp, Artificial Sequence
  Synthetic
ctaggagaaguggtggctgtut

SEQ ID NO: 3678 - DNA, 29 bp, Artificial Sequence
  Synthetic
cctcaggttcuggaaaaatgtcatauaca

SEQ ID NO: 3679 - DNA, 31 bp, Artificial Sequence
  Synthetic
acctttttattggcuccattaccattatuca

SEQ ID NO: 3680 - DNA, 23 bp, Artificial Sequence
  Synthetic
cccacctaatcucagtcccacua

SEQ ID NO: 3681 - DNA, 24 bp, Artificial Sequence
  Synthetic
aggaagggaugatgaatgttugct

SEQ ID NO: 3682 - DNA, 28 bp, Artificial Sequence
  Synthetic
agaattgaggacugtcccattaacaauc

SEQ ID NO: 3683 - DNA, 21 bp, Artificial Sequence
  Synthetic
cgcatgggaacacugccatua

SEQ ID NO: 3684 - DNA, 23 bp, Artificial Sequence
  Synthetic
atctcagaucccaactccaguga

SEQ ID NO: 3685 - DNA, 32 bp, Artificial Sequence
  Synthetic
tagtttcattcttccuctcttttaaacagaug

SEQ ID NO: 3686 - DNA, 29 bp, Artificial Sequence
  Synthetic
ttcattacacugagaagaactttcctuga

SEQ ID NO: 3687 - DNA, 22 bp, Artificial Sequence
  Synthetic
aaaauggcttgcugacaccaac

SEQ ID NO: 3688 - DNA, 27 bp, Artificial Sequence
  Synthetic
tctgcatatgtuccttcaattcctcuc

SEQ ID NO: 3689 - DNA, 24 bp, Artificial Sequence
  Synthetic
aatgcatttgucatgactgtgtuc

SEQ ID NO: 3690 - DNA, 23 bp, Artificial Sequence
  Synthetic
ccacaggcaugaatggctaaauc

SEQ ID NO: 3691 - DNA, 26 bp, Artificial Sequence
  Synthetic
gaacactaacaaaugccatcttgcuc

SEQ ID NO: 3692 - DNA, 21 bp, Artificial Sequence
  Synthetic
gatgattccacuccggaccuc

SEQ ID NO: 3693 - DNA, 25 bp, Artificial Sequence
  Synthetic
gaaatgagacautcaggctcugaca

SEQ ID NO: 3694 - DNA, 22 bp, Artificial Sequence
  Synthetic
ggtcagtcaggugggtgtctua

SEQ ID NO: 3695 - DNA, 26 bp, Artificial Sequence
  Synthetic
tcagtgtttctutcctttctgtcucc

SEQ ID NO: 3696 - DNA, 23 bp, Artificial Sequence
  Synthetic
tctttcagggcutcttcgaaugg

SEQ ID NO: 3697 - DNA, 21 bp, Artificial Sequence
  Synthetic
catggccugactctcctugat

SEQ ID NO: 3698 - DNA, 17 bp, Artificial Sequence
  Synthetic
cuccaccccugccacac

SEQ ID NO: 3699 - DNA, 20 bp, Artificial Sequence
  Synthetic
ggcccucagctactuaccca

SEQ ID NO: 3700 - DNA, 26 bp, Artificial Sequence
  Synthetic
cacaugaaccaaugaggagaaaacua

SEQ ID NO: 3701 - DNA, 25 bp, Artificial Sequence
  Synthetic
ccaggaugccaagttgatatctuga

SEQ ID NO: 3702 - DNA, 22 bp, Artificial Sequence
  Synthetic
ggtggatcutctgtggaauggt

SEQ ID NO: 3703 - DNA, 25 bp, Artificial Sequence
  Synthetic
ccatgtccauatgaacaagctucct

SEQ ID NO: 3704 - DNA, 26 bp, Artificial Sequence
  Synthetic
tccttgauggaccagagaaataaugt

SEQ ID NO: 3705 - DNA, 28 bp, Artificial Sequence
  Synthetic
tcattgaatgugggaatgcatuagagaa

SEQ ID NO: 3706 - DNA, 23 bp, Artificial Sequence
  Synthetic
agagccaugctctgttttuggat

SEQ ID NO: 3707 - DNA, 24 bp, Artificial Sequence
  Synthetic
acccctguattactgtguggagaa

SEQ ID NO: 3708 - DNA, 26 bp, Artificial Sequence
  Synthetic
cacaataagugggtacctgtcaucag

SEQ ID NO: 3709 - DNA, 22 bp, Artificial Sequence
  Synthetic
aaguaccccgagagcaauagga

SEQ ID NO: 3710 - DNA, 22 bp, Artificial Sequence
  Synthetic
atgctgcuagccaagtcuacag

SEQ ID NO: 3711 - DNA, 23 bp, Artificial Sequence
  Synthetic
aaatctccugcacagagugacag

SEQ ID NO: 3712 - DNA, 20 bp, Artificial Sequence
  Synthetic
gacaucaccaaggacccuga

SEQ ID NO: 3713 - DNA, 25 bp, Artificial Sequence
  Synthetic
ctagtagccacaguggatcugaaag

SEQ ID NO: 3714 - DNA, 22 bp, Artificial Sequence
  Synthetic
gcttcagcucagtcatgctgut

SEQ ID NO: 3715 - DNA, 23 bp, Artificial Sequence
  Synthetic
ctttcccacccucattgatguca

SEQ ID NO: 3716 - DNA, 27 bp, Artificial Sequence
  Synthetic
tcccactatugttatatgacucacggt

SEQ ID NO: 3717 - DNA, 24 bp, Artificial Sequence
  Synthetic
agtagcaaauggactccaguagga

SEQ ID NO: 3718 - DNA, 25 bp, Artificial Sequence
  Synthetic
aactttguatggctcugcaaagaga

SEQ ID NO: 3719 - DNA, 24 bp, Artificial Sequence
  Synthetic
catagcaacaugaaccgugaagac

SEQ ID NO: 3720 - DNA, 29 bp, Artificial Sequence
  Synthetic
cggaagtttgcagautccttaaatgaaut

SEQ ID NO: 3721 - DNA, 24 bp, Artificial Sequence
  Synthetic
ggacacugaaggctaugacaaaca

SEQ ID NO: 3722 - DNA, 31 bp, Artificial Sequence
  Synthetic
agacagaaaaguattgtggcatctuagaaaa

SEQ ID NO: 3723 - DNA, 27 bp, Artificial Sequence
  Synthetic
ccacagcaucatgtacaaatugaacac

SEQ ID NO: 3724 - DNA, 28 bp, Artificial Sequence
  Synthetic
tttcatccuagacaagaaatcgcttuga

SEQ ID NO: 3725 - DNA, 22 bp, Artificial Sequence
  Synthetic
gcacguagaggtatcccuccat

SEQ ID NO: 3726 - DNA, 21 bp, Artificial Sequence
  Synthetic
cccattcuggcctcatctuga

SEQ ID NO: 3727 - DNA, 23 bp, Artificial Sequence
  Synthetic
ttgctccugagaaaagcatgcua

SEQ ID NO: 3728 - DNA, 21 bp, Artificial Sequence
  Synthetic
cttgtgttcugacgtgccuct

SEQ ID NO: 3729 - DNA, 19 bp, Artificial Sequence
  Synthetic
ccatccagggaccugccua

SEQ ID NO: 3730 - DNA, 23 bp, Artificial Sequence
  Synthetic
gaggccucaggaagaaacaguag

SEQ ID NO: 3731 - DNA, 22 bp, Artificial Sequence
  Synthetic
cccccagguacattcttcacug

SEQ ID NO: 3732 - DNA, 26 bp, Artificial Sequence
  Synthetic
tctcatcaaauccaaacagcatccut

SEQ ID NO: 3733 - DNA, 22 bp, Artificial Sequence
  Synthetic
attctagguggaatggcugacc

SEQ ID NO: 3734 - DNA, 22 bp, Artificial Sequence
  Synthetic
acucctgtttucacacagcaca

SEQ ID NO: 3735 - DNA, 21 bp, Artificial Sequence
  Synthetic
ccccgcccauatctttgugag

SEQ ID NO: 3736 - DNA, 26 bp, Artificial Sequence
  Synthetic
ccccatccauggaggagttgaagtut

SEQ ID NO: 3737 - DNA, 20 bp, Artificial Sequence
  Synthetic
accugacctgcugcgagcaa

SEQ ID NO: 3738 - DNA, 20 bp, Artificial Sequence
  Synthetic
cugggcacuaaacagcttug

SEQ ID NO: 3739 - DNA, 23 bp, Artificial Sequence
  Synthetic
ccagagagcauctttgactgugt

SEQ ID NO: 3740 - DNA, 18 bp, Artificial Sequence
  Synthetic
cacagaccugggtggcua

SEQ ID NO: 3741 - DNA, 17 bp, Artificial Sequence
  Synthetic
tgcccugacgcctctuc

SEQ ID NO: 3742 - DNA, 19 bp, Artificial Sequence
  Synthetic
ggcccugagatuccccaga

SEQ ID NO: 3743 - DNA, 23 bp, Artificial Sequence
  Synthetic
atgtccgagcugaagatcaugag

SEQ ID NO: 3744 - DNA, 23 bp, Artificial Sequence
  Synthetic
aactcccacutctcgttguaagg

SEQ ID NO: 3745 - DNA, 23 bp, Artificial Sequence
  Synthetic
tcagaaacaagguccaggaacug

SEQ ID NO: 3746 - DNA, 23 bp, Artificial Sequence
  Synthetic
ctctaagguctcaacagucagca

SEQ ID NO: 3747 - DNA, 22 bp, Artificial Sequence
  Synthetic
cctgaagctcugagccacatuc

SEQ ID NO: 3748 - DNA, 22 bp, Artificial Sequence
  Synthetic
ctcaaacgucagagctcuccag

SEQ ID NO: 3749 - DNA, 21 bp, Artificial Sequence
  Synthetic
gcucaccaauaccacctgaut

SEQ ID NO: 3750 - DNA, 20 bp, Artificial Sequence
  Synthetic
ttgccggcaugttggaaauc

SEQ ID NO: 3751 - DNA, 29 bp, Artificial Sequence
  Synthetic
tccctaaactaccutggtataacatcucc

SEQ ID NO: 3752 - DNA, 21 bp, Artificial Sequence
  Synthetic
aatgaactuggccctguggat

SEQ ID NO: 3753 - DNA, 19 bp, Artificial Sequence
  Synthetic
ggucgtgtucgaggaccag

SEQ ID NO: 3754 - DNA, 19 bp, Artificial Sequence
  Synthetic
ccattccacgcugccatug

SEQ ID NO: 3755 - DNA, 21 bp, Artificial Sequence
  Synthetic
cgcatccuagacctcactuct

SEQ ID NO: 3756 - DNA, 19 bp, Artificial Sequence
  Synthetic
gggatgagcugctggugac

SEQ ID NO: 3757 - DNA, 22 bp, Artificial Sequence
  Synthetic
tcaagugacaaacggactugct

SEQ ID NO: 3758 - DNA, 21 bp, Artificial Sequence
  Synthetic
gagagutcccaugcagggaaa

SEQ ID NO: 3759 - DNA, 24 bp, Artificial Sequence
  Synthetic
gctcttctugaaccatccttccug

SEQ ID NO: 3760 - DNA, 22 bp, Artificial Sequence
  Synthetic
gaggtgacugtcagtttgucca

SEQ ID NO: 3761 - DNA, 22 bp, Artificial Sequence
  Synthetic
ctgtggatccucctctgaccua

SEQ ID NO: 3762 - DNA, 28 bp, Artificial Sequence
  Synthetic
acctttttgcaaauctgtttcattguga

SEQ ID NO: 3763 - DNA, 28 bp, Artificial Sequence
  Synthetic
ctgaggatagtucagatgatgaacctut

SEQ ID NO: 3764 - DNA, 28 bp, Artificial Sequence
  Synthetic
gcagaaatattuaactctccccauggaa

SEQ ID NO: 3765 - DNA, 31 bp, Artificial Sequence
  Synthetic
ttctgtcagaugaatctagtagtgaugaaga

SEQ ID NO: 3766 - DNA, 22 bp, Artificial Sequence
  Synthetic
tgaucctcacttugccagaagg

SEQ ID NO: 3767 - DNA, 27 bp, Artificial Sequence
  Synthetic
ccttggtttctuccattttctgttuca

SEQ ID NO: 3768 - DNA, 25 bp, Artificial Sequence
  Synthetic
gacttgcattgucaacctctcuact

SEQ ID NO: 3769 - DNA, 30 bp, Artificial Sequence
  Synthetic
gggactttgttcuacatgtgtatctaauaa

SEQ ID NO: 3770 - DNA, 19 bp, Artificial Sequence
  Synthetic
gaccagaucccttgggcut

SEQ ID NO: 3771 - DNA, 24 bp, Artificial Sequence
  Synthetic
ctcctacagaugtcacagccauac

SEQ ID NO: 3772 - DNA, 20 bp, Artificial Sequence
  Synthetic
cagctctgugagctcauccc

SEQ ID NO: 3773 - DNA, 20 bp, Artificial Sequence
  Synthetic
atgctggccgutatcctuca

SEQ ID NO: 3774 - DNA, 19 bp, Artificial Sequence
  Synthetic
cagcguggtcggtguagat

SEQ ID NO: 3775 - DNA, 21 bp, Artificial Sequence
  Synthetic
acctggaucgctacctgtcut

SEQ ID NO: 3776 - DNA, 18 bp, Artificial Sequence
  Synthetic
gctccucgccgatctugt

SEQ ID NO: 3777 - DNA, 20 bp, Artificial Sequence
  Synthetic
cugagauggaggaggagtuc

SEQ ID NO: 3778 - DNA, 20 bp, Artificial Sequence
  Synthetic
gatcaucacggagggtccug

SEQ ID NO: 3779 - DNA, 25 bp, Artificial Sequence
  Synthetic
ccaucatctacucccgagagaagaa

SEQ ID NO: 3780 - DNA, 19 bp, Artificial Sequence
  Synthetic
gtgagggugaggcatgugt

SEQ ID NO: 3781 - DNA, 18 bp, Artificial Sequence
  Synthetic
gcggguccgcatcatcuc

SEQ ID NO: 3782 - DNA, 21 bp, Artificial Sequence
  Synthetic
gcctggtccuccatagacuca

SEQ ID NO: 3783 - DNA, 22 bp, Artificial Sequence
  Synthetic
gugacaccatguaccaggacag

SEQ ID NO: 3784 - DNA, 17 bp, Artificial Sequence
  Synthetic
gtugcagccaccuccct

SEQ ID NO: 3785 - DNA, 19 bp, Artificial Sequence
  Synthetic
tgaauggcgacagccucac

SEQ ID NO: 3786 - DNA, 19 bp, Artificial Sequence
  Synthetic
ccctctgugacccgtccua

SEQ ID NO: 3787 - DNA, 21 bp, Artificial Sequence
  Synthetic
cactcacaugcatgcttuccc

SEQ ID NO: 3788 - DNA, 23 bp, Artificial Sequence
  Synthetic
ggaagtacutgctgtctucaggt

SEQ ID NO: 3789 - DNA, 22 bp, Artificial Sequence
  Synthetic
caccacuaacgccagcttttuc

SEQ ID NO: 3790 - DNA, 22 bp, Artificial Sequence
  Synthetic
gttcatgcggugcttgtacaut

SEQ ID NO: 3791 - DNA, 23 bp, Artificial Sequence
  Synthetic
cgagcagagaacagcuttcaguc

SEQ ID NO: 3792 - DNA, 23 bp, Artificial Sequence
  Synthetic
agctcctgguttttggtctucag

SEQ ID NO: 3793 - DNA, 26 bp, Artificial Sequence
  Synthetic
cggttgaataagauggaggaggaaug

SEQ ID NO: 3794 - DNA, 21 bp, Artificial Sequence
  Synthetic
gtaccgcucctggaaggtuag

SEQ ID NO: 3795 - DNA, 23 bp, Artificial Sequence
  Synthetic
cacttcctgaugaacgaggucat

SEQ ID NO: 3796 - DNA, 21 bp, Artificial Sequence
  Synthetic
ctcccgcaaagagguccuaag

SEQ ID NO: 3797 - DNA, 20 bp, Artificial Sequence
  Synthetic
tggagtguaaccggcacaug

SEQ ID NO: 3798 - DNA, 27 bp, Artificial Sequence
  Synthetic
gattcagcaautctctgtatctugcag

SEQ ID NO: 3799 - DNA, 24 bp, Artificial Sequence
  Synthetic
ctttgaugagagcatggccuacat

SEQ ID NO: 3800 - DNA, 27 bp, Artificial Sequence
  Synthetic
gtttatcatagtucatagctggccugt

SEQ ID NO: 3801 - DNA, 24 bp, Artificial Sequence
  Synthetic
ggacatttutgtgggttuggaagt

SEQ ID NO: 3802 - DNA, 26 bp, Artificial Sequence
  Synthetic
ttgggatguctgattattcugaacgg

SEQ ID NO: 3803 - DNA, 28 bp, Artificial Sequence
  Synthetic
ctccagactctutttgaccaatattgut

SEQ ID NO: 3804 - DNA, 25 bp, Artificial Sequence
  Synthetic
ttctagaaaacuggtatcugcaggt

SEQ ID NO: 3805 - DNA, 25 bp, Artificial Sequence
  Synthetic
catcatgcatcuccaaactcaacuc

SEQ ID NO: 3806 - DNA, 23 bp, Artificial Sequence
  Synthetic
taagacaagacacuggacgugaa

SEQ ID NO: 3807 - DNA, 23 bp, Artificial Sequence
  Synthetic
ggtaccugacaatgaugagcagt

SEQ ID NO: 3808 - DNA, 26 bp, Artificial Sequence
  Synthetic
actgaagtgcuccttttctttuagca

SEQ ID NO: 3809 - DNA, 26 bp, Artificial Sequence
  Synthetic
guaacgagaaaucaacaaatgucagg

SEQ ID NO: 3810 - DNA, 18 bp, Artificial Sequence
  Synthetic
ccccugactccguccagt

SEQ ID NO: 3811 - DNA, 22 bp, Artificial Sequence
  Synthetic
acgccctuacctttctttucct

SEQ ID NO: 3812 - DNA, 26 bp, Artificial Sequence
  Synthetic
gttcctcaaaagagaaaucacgcaut

SEQ ID NO: 3813 - DNA, 27 bp, Artificial Sequence
  Synthetic
actgctaaggcauaggaattttcguag

SEQ ID NO: 3814 - DNA, 21 bp, Artificial Sequence
  Synthetic
agggcgucatcagtttcucat

SEQ ID NO: 3815 - DNA, 24 bp, Artificial Sequence
  Synthetic
gtctgaggcugttcactgactuac

SEQ ID NO: 3816 - DNA, 23 bp, Artificial Sequence
  Synthetic
cccccacucatgctcuacaaccc

SEQ ID NO: 3817 - DNA, 24 bp, Artificial Sequence
  Synthetic
gggacaaggaugcctgaccagtua

SEQ ID NO: 3818 - DNA, 26 bp, Artificial Sequence
  Synthetic
agactcactcuccataaatgcuacga

SEQ ID NO: 3819 - DNA, 29 bp, Artificial Sequence
  Synthetic
tgatcaccaauctctaccagtuaaaaagg

SEQ ID NO: 3820 - DNA, 25 bp, Artificial Sequence
  Synthetic
ttgtagtcaaucaaaggtggtcugg

SEQ ID NO: 3821 - DNA, 25 bp, Artificial Sequence
  Synthetic
acttatctcctugagggagcguaat

SEQ ID NO: 3822 - DNA, 19 bp, Artificial Sequence
  Synthetic
ccagggacugcgtctctug

SEQ ID NO: 3823 - DNA, 23 bp, Artificial Sequence
  Synthetic
aacaacaaccuggagccttatut

SEQ ID NO: 3824 - DNA, 30 bp, Artificial Sequence
  Synthetic
tgttagtggtcauttttctaatgtcttuct

SEQ ID NO: 3825 - DNA, 27 bp, Artificial Sequence
  Synthetic
gtgucaggactttattugaagcaaagg

SEQ ID NO: 3826 - DNA, 17 bp, Artificial Sequence
  Synthetic
gcctccucctgccacug

SEQ ID NO: 3827 - DNA, 24 bp, Artificial Sequence
  Synthetic
aaagggaguggaaggaaggaaaug

SEQ ID NO: 3828 - DNA, 21 bp, Artificial Sequence
  Synthetic
tgaggtgacccutgtctcugt

SEQ ID NO: 3829 - DNA, 23 bp, Artificial Sequence
  Synthetic
gcccagcacuttgatcttttuga

SEQ ID NO: 3830 - DNA, 19 bp, Artificial Sequence
  Synthetic
ccacacugacgtgcctcuc

SEQ ID NO: 3831 - DNA, 23 bp, Artificial Sequence
  Synthetic
tctttgtgtucccggacataguc

SEQ ID NO: 3832 - DNA, 28 bp, Artificial Sequence
  Synthetic
ttccaauagagggaaacuaatagttguc

SEQ ID NO: 3833 - DNA, 28 bp, Artificial Sequence
  Synthetic
ctcagtacaaacucattagcaucaggat

SEQ ID NO: 3834 - DNA, 22 bp, Artificial Sequence
  Synthetic
gccaagaaguggaatagcauct

SEQ ID NO: 3835 - DNA, 23 bp, Artificial Sequence
  Synthetic
cacgtcguccatgtcttctucat

SEQ ID NO: 3836 - DNA, 23 bp, Artificial Sequence
  Synthetic
gtctccttgutgaggacatucac

SEQ ID NO: 3837 - DNA, 25 bp, Artificial Sequence
  Synthetic
ggctgattgugatagacaggatuct

SEQ ID NO: 3838 - DNA, 27 bp, Artificial Sequence
  Synthetic
acaaagcagtgaauttattggagcaug

SEQ ID NO: 3839 - DNA, 24 bp, Artificial Sequence
  Synthetic
ctagtcggugtaaacgtugcaaaa

SEQ ID NO: 3840 - DNA, 19 bp, Artificial Sequence
  Synthetic
gccuggcagaaguaccgat

SEQ ID NO: 3841 - DNA, 22 bp, Artificial Sequence
  Synthetic
ctcaggtcugaggatgcatgug

SEQ ID NO: 3842 - DNA, 20 bp, Artificial Sequence
  Synthetic
gcctccccacugttcctuac

SEQ ID NO: 3843 - DNA, 20 bp, Artificial Sequence
  Synthetic
tgcatcagagutggcuccac

SEQ ID NO: 3844 - DNA, 24 bp, Artificial Sequence
  Synthetic
cagggctguagtgacagcttttua

SEQ ID NO: 3845 - DNA, 21 bp, Artificial Sequence
  Synthetic
gcaggctuggatgggatctug

SEQ ID NO: 3846 - DNA, 22 bp, Artificial Sequence
  Synthetic
ggagcactguttcaaggtcuct

SEQ ID NO: 3847 - DNA, 24 bp, Artificial Sequence
  Synthetic
agtaatgggaauggagaggcuagg

SEQ ID NO: 3848 - DNA, 19 bp, Artificial Sequence
  Synthetic
gagctgcugcaggctuagt

SEQ ID NO: 3849 - DNA, 18 bp, Artificial Sequence
  Synthetic
cccagcucaccuggaacc

SEQ ID NO: 3850 - DNA, 23 bp, Artificial Sequence
  Synthetic
gttggaggcautcctactuacgg

SEQ ID NO: 3851 - DNA, 20 bp, Artificial Sequence
  Synthetic
ccaggtgugactaaggcuca

SEQ ID NO: 3852 - DNA, 19 bp, Artificial Sequence
  Synthetic
ggctccuggagttggtgug

SEQ ID NO: 3853 - DNA, 17 bp, Artificial Sequence
  Synthetic
ttgcugcagcugaggga

SEQ ID NO: 3854 - DNA, 22 bp, Artificial Sequence
  Synthetic
cctgaccacuccccaactttuc

SEQ ID NO: 3855 - DNA, 24 bp, Artificial Sequence
  Synthetic
tutttctattgugaccaccccagt

SEQ ID NO: 3856 - DNA, 19 bp, Artificial Sequence
  Synthetic
ggcattccugagccgucat

SEQ ID NO: 3857 - DNA, 17 bp, Artificial Sequence
  Synthetic
gagggaggccugagcug

SEQ ID NO: 3858 - DNA, 22 bp, Artificial Sequence
  Synthetic
cttguggccggaagagaaaaug

SEQ ID NO: 3859 - DNA, 17 bp, Artificial Sequence
  Synthetic
ctgcccgutccctccug

SEQ ID NO: 3860 - DNA, 21 bp, Artificial Sequence
  Synthetic
agaaaagcucagtcggauggg

SEQ ID NO: 3861 - DNA, 28 bp, Artificial Sequence
  Synthetic
tcacagttgautctactctcugagaact

SEQ ID NO: 3862 - DNA, 21 bp, Artificial Sequence
  Synthetic
gcacaagacaguccgacucat

SEQ ID NO: 3863 - DNA, 24 bp, Artificial Sequence
  Synthetic
gugagtagcaaaucaaaagccaca

SEQ ID NO: 3864 - DNA, 21 bp, Artificial Sequence
  Synthetic
gggacagucgaagaactucag

SEQ ID NO: 3865 - DNA, 24 bp, Artificial Sequence
  Synthetic
ctatctgcugcccatacatcucat

SEQ ID NO: 3866 - DNA, 30 bp, Artificial Sequence
  Synthetic
actaactcucaaaaggaaaaacucaaggaa

SEQ ID NO: 3867 - DNA, 25 bp, Artificial Sequence
  Synthetic
tgtctgtctagcuctctgaatcugt

SEQ ID NO: 3868 - DNA, 25 bp, Artificial Sequence
  Synthetic
ctgaatuagagaggcugagaacaca

SEQ ID NO: 3869 - DNA, 29 bp, Artificial Sequence
  Synthetic
ccatctatctgcugtttatagtgaaugcc

SEQ ID NO: 3870 - DNA, 28 bp, Artificial Sequence
  Synthetic
agaaaagggtacacutgaacaagaagut

SEQ ID NO: 3871 - DNA, 29 bp, Artificial Sequence
  Synthetic
aacatgtctucaagggttttcttttcauc

SEQ ID NO: 3872 - DNA, 30 bp, Artificial Sequence
  Synthetic
cctcaaacaacaaugtattcagctaaauga

SEQ ID NO: 3873 - DNA, 27 bp, Artificial Sequence
  Synthetic
tcaucttttacttugagaaggcaagca

SEQ ID NO: 3874 - DNA, 26 bp, Artificial Sequence
  Synthetic
aatgggtgaggutgttgaaaaggaua

SEQ ID NO: 3875 - DNA, 29 bp, Artificial Sequence
  Synthetic
atctcaccatgtutctgtttcaattgtuc

SEQ ID NO: 3876 - DNA, 28 bp, Artificial Sequence
  Synthetic
ggtgctgaaggaucagtttctaaaguaa

SEQ ID NO: 3877 - DNA, 28 bp, Artificial Sequence
  Synthetic
cctttgttacagauggtaagtgauccaa

SEQ ID NO: 3878 - DNA, 26 bp, Artificial Sequence
  Synthetic
tgcucaagaggaaaagaucaaggaac

SEQ ID NO: 3879 - DNA, 22 bp, Artificial Sequence
  Synthetic
tggtgggcuctatccaatacut

SEQ ID NO: 3880 - DNA, 31 bp, Artificial Sequence
  Synthetic
gcatgaacacuaaagcacatatacaactcua

SEQ ID NO: 3881 - DNA, 24 bp, Artificial Sequence
  Synthetic
ttttcacacaacutccaggguaca

SEQ ID NO: 3882 - DNA, 28 bp, Artificial Sequence
  Synthetic
agacttttgagacaguggatgtgaaaut

SEQ ID NO: 3883 - DNA, 28 bp, Artificial Sequence
  Synthetic
cagtcctttgautctggtatatcauggg

SEQ ID NO: 3884 - DNA, 27 bp, Artificial Sequence
  Synthetic
aaugaaaacctggttucagagagagag

SEQ ID NO: 3885 - DNA, 22 bp, Artificial Sequence
  Synthetic
tggtgatccautgctccuaggt

SEQ ID NO: 3886 - DNA, 29 bp, Artificial Sequence
  Synthetic
ttctagttacagaugaatccattcccuct

SEQ ID NO: 3887 - DNA, 22 bp, Artificial Sequence
  Synthetic
gcaaaaccacucctcacaaguc

SEQ ID NO: 3888 - DNA, 23 bp, Artificial Sequence
  Synthetic
cccttaagugccaagaggaacut

SEQ ID NO: 3889 - DNA, 29 bp, Artificial Sequence
  Synthetic
gactgaaatttcuctacccttagttguca

SEQ ID NO: 3890 - DNA, 30 bp, Artificial Sequence
  Synthetic
cagtagguttatagagcuggaacaagaaaa

SEQ ID NO: 3891 - DNA, 28 bp, Artificial Sequence
  Synthetic
agtatacuagcaaagaacattccacuga

SEQ ID NO: 3892 - DNA, 29 bp, Artificial Sequence
  Synthetic
cagcutcaaagggatauacaagaaaggaa

SEQ ID NO: 3893 - DNA, 24 bp, Artificial Sequence
  Synthetic
ttagcccaaauaaaaugccacacc

SEQ ID NO: 3894 - DNA, 26 bp, Artificial Sequence
  Synthetic
gaactgauaagggatctugaaaccca

SEQ ID NO: 3895 - DNA, 26 bp, Artificial Sequence
  Synthetic
agcattcatugatgtcttctguccaa

SEQ ID NO: 3896 - DNA, 25 bp, Artificial Sequence
  Synthetic
tcatcugagcaaagacaaaccugaa

SEQ ID NO: 3897 - DNA, 29 bp, Artificial Sequence
  Synthetic
caagttgtagcaaccutgtttccaaatua

SEQ ID NO: 3898 - DNA, 29 bp, Artificial Sequence
  Synthetic
gttcaggaataugcaaaattctgucaaga

SEQ ID NO: 3899 - DNA, 26 bp, Artificial Sequence
  Synthetic
gcatttcaacaaccuggctttcuaat

SEQ ID NO: 3900 - DNA, 22 bp, Artificial Sequence
  Synthetic
gtgtttcttgugtttccgcugt

SEQ ID NO: 3901 - DNA, 22 bp, Artificial Sequence
  Synthetic
actggcaagutctgctttggua

SEQ ID NO: 3902 - DNA, 24 bp, Artificial Sequence
  Synthetic
agacagaugggactctgaagauca

SEQ ID NO: 3903 - DNA, 29 bp, Artificial Sequence
  Synthetic
gcatgtagttctugcatcttctcaattut

SEQ ID NO: 3904 - DNA, 27 bp, Artificial Sequence
  Synthetic
tgtgaagaagutgtcataattcuggct

SEQ ID NO: 3905 - DNA, 28 bp, Artificial Sequence
  Synthetic
tgaatagaatggucctctccatcacuat

SEQ ID NO: 3906 - DNA, 27 bp, Artificial Sequence
  Synthetic
tgccctucaacaagttttctuagaaga

SEQ ID NO: 3907 - DNA, 28 bp, Artificial Sequence
  Synthetic
acctgttctugtattctctgtuccaaac

SEQ ID NO: 3908 - DNA, 24 bp, Artificial Sequence
  Synthetic
agttctgagaaaauggtggtugct

SEQ ID NO: 3909 - DNA, 28 bp, Artificial Sequence
  Synthetic
acaaaattacucccactccttgtuacat

SEQ ID NO: 3910 - DNA, 25 bp, Artificial Sequence
  Synthetic
acuactgaacgaaucccagcaaaaa

SEQ ID NO: 3911 - DNA, 20 bp, Artificial Sequence
  Synthetic
gtgcaatucccgctcccuat

SEQ ID NO: 3912 - DNA, 22 bp, Artificial Sequence
  Synthetic
gctccaguccaaaguggaagat

SEQ ID NO: 3913 - DNA, 29 bp, Artificial Sequence
  Synthetic
tttctcgtttttcutctcgttctagtuct

SEQ ID NO: 3914 - DNA, 29 bp, Artificial Sequence
  Synthetic
ggaaccggcugtaatcatgaatuagaaat

SEQ ID NO: 3915 - DNA, 22 bp, Artificial Sequence
  Synthetic
gggtcuacccagcctaagaaua

SEQ ID NO: 3916 - DNA, 25 bp, Artificial Sequence
  Synthetic
tgtggctcatugactgaaagacuac

SEQ ID NO: 3917 - DNA, 22 bp, Artificial Sequence
  Synthetic
tcgataccaccugatctgcuct

SEQ ID NO: 3918 - DNA, 27 bp, Artificial Sequence
  Synthetic
ctagagagcagggugaatgttttctua

SEQ ID NO: 3919 - DNA, 26 bp, Artificial Sequence
  Synthetic
agcagcagguatttcttctgguaaat

SEQ ID NO: 3920 - DNA, 18 bp, Artificial Sequence
  Synthetic
ttggtucgacgguggcat

SEQ ID NO: 3921 - DNA, 25 bp, Artificial Sequence
  Synthetic
gggacctctgauttagagagtcaua

SEQ ID NO: 3922 - DNA, 28 bp, Artificial Sequence
  Synthetic
gtctgatacagguagcaatgtaattuga

SEQ ID NO: 3923 - DNA, 30 bp, Artificial Sequence
  Synthetic
gcacaaaagaaccautgattuacaaaagga

SEQ ID NO: 3924 - DNA, 22 bp, Artificial Sequence
  Synthetic
ctggaaguatgggugagacagg

SEQ ID NO: 3925 - DNA, 25 bp, Artificial Sequence
  Synthetic
atgcgctuaacatatgacagugaat

SEQ ID NO: 3926 - DNA, 27 bp, Artificial Sequence
  Synthetic
tcaaggaaagcagagugaaacaaaaug

SEQ ID NO: 3927 - DNA, 20 bp, Artificial Sequence
  Synthetic
cttggauccgcttgccatug

SEQ ID NO: 3928 - DNA, 26 bp, Artificial Sequence
  Synthetic
ggctctggaacuttatccaaguaagt

SEQ ID NO: 3929 - DNA, 28 bp, Artificial Sequence
  Synthetic
catacaggttacutctttgcttatugcc

SEQ ID NO: 3930 - DNA, 18 bp, Artificial Sequence
  Synthetic
ccgccacgcautcguact

SEQ ID NO: 3931 - DNA, 24 bp, Artificial Sequence
  Synthetic
caagtaaagcuagaccgatcuccg

SEQ ID NO: 3932 - DNA, 30 bp, Artificial Sequence
  Synthetic
gagaagcacaagcauatagactaaaaucct

SEQ ID NO: 3933 - DNA, 26 bp, Artificial Sequence
  Synthetic
tttgtagattcucgcctctatugagc

SEQ ID NO: 3934 - DNA, 29 bp, Artificial Sequence
  Synthetic
gtttgaataagguaactgtccagtcauca

SEQ ID NO: 3935 - DNA, 26 bp, Artificial Sequence
  Synthetic
tuctttgtatgttcuaacaggcacca

SEQ ID NO: 3936 - DNA, 23 bp, Artificial Sequence
  Synthetic
gcaauccaaaagaauagcagcca

SEQ ID NO: 3937 - DNA, 27 bp, Artificial Sequence
  Synthetic
caccatcuccatatcatugagaccaaa

SEQ ID NO: 3938 - DNA, 30 bp, Artificial Sequence
  Synthetic
aacatatcctattaugacttgtcacaaugt

SEQ ID NO: 3939 - DNA, 25 bp, Artificial Sequence
  Synthetic
gagtgatgatugggagattccugat

SEQ ID NO: 3940 - DNA, 31 bp, Artificial Sequence
  Synthetic
caaguataaaggaaauaagcagcaaagcaat

SEQ ID NO: 3941 - DNA, 28 bp, Artificial Sequence
  Synthetic
gctactctctgautatatgcttgctugg

SEQ ID NO: 3942 - DNA, 22 bp, Artificial Sequence
  Synthetic
gttagggcaguctctgcuaagg

SEQ ID NO: 3943 - DNA, 26 bp, Artificial Sequence
  Synthetic
ttttggtataugaagcttctgggtut

SEQ ID NO: 3944 - DNA, 28 bp, Artificial Sequence
  Synthetic
tcaattccctaggutttggtaaagaucc

SEQ ID NO: 3945 - DNA, 28 bp, Artificial Sequence
  Synthetic
cagtcuaaagaaagcactgatgaugaga

SEQ ID NO: 3946 - DNA, 28 bp, Artificial Sequence
  Synthetic
gcagagcuagaaacagaaaaatcagtuc

SEQ ID NO: 3947 - DNA, 25 bp, Artificial Sequence
  Synthetic
gtcaggacaaaguccggattgaaua

SEQ ID NO: 3948 - DNA, 25 bp, Artificial Sequence
  Synthetic
cuctttccaaaauaaacaccagcca

SEQ ID NO: 3949 - DNA, 18 bp, Artificial Sequence
  Synthetic
ggccaggcuctgtucaac

SEQ ID NO: 3950 - DNA, 26 bp, Artificial Sequence
  Synthetic
ttcacaatccaguagaaaaagcccut

SEQ ID NO: 3951 - DNA, 22 bp, Artificial Sequence
  Synthetic
acaccagugtgtctcttugcag

SEQ ID NO: 3952 - DNA, 27 bp, Artificial Sequence
  Synthetic
ctgcacaggauctttgataaaaauccc

SEQ ID NO: 3953 - DNA, 23 bp, Artificial Sequence
  Synthetic
agtctacttugtccccaguccat

SEQ ID NO: 3954 - DNA, 22 bp, Artificial Sequence
  Synthetic
cgtggatgaucacagggtugat

SEQ ID NO: 3955 - DNA, 29 bp, Artificial Sequence
  Synthetic
aagaatgtactcgugttaattgtgtauga

SEQ ID NO: 3956 - DNA, 27 bp, Artificial Sequence
  Synthetic
gcaatggcacagaaautgtcataguaa

SEQ ID NO: 3957 - DNA, 24 bp, Artificial Sequence
  Synthetic
tcttgaccagugcttacattuggt

SEQ ID NO: 3958 - DNA, 22 bp, Artificial Sequence
  Synthetic
ctgactugatcaccuccaccaa

SEQ ID NO: 3959 - DNA, 25 bp, Artificial Sequence
  Synthetic
caugcaacacucaacacttauaagc

SEQ ID NO: 3960 - DNA, 22 bp, Artificial Sequence
  Synthetic
tggctcauccgctacattgaut

SEQ ID NO: 3961 - DNA, 31 bp, Artificial Sequence
  Synthetic
ccttctgataaaauttttgaagccattucct

SEQ ID NO: 3962 - DNA, 26 bp, Artificial Sequence
  Synthetic
gtgtctctcaatuctttagcccctut

SEQ ID NO: 3963 - DNA, 30 bp, Artificial Sequence
  Synthetic
tgaagttttagaucaggatggtacttucat

SEQ ID NO: 3964 - DNA, 22 bp, Artificial Sequence
  Synthetic
acagaagucaggatgugcacag

SEQ ID NO: 3965 - DNA, 28 bp, Artificial Sequence
  Synthetic
aatgaacaatttcucctttcctctccut

SEQ ID NO: 3966 - DNA, 29 bp, Artificial Sequence
  Synthetic
tugtatttagaauccggaaggaaaaggaa

SEQ ID NO: 3967 - DNA, 26 bp, Artificial Sequence
  Synthetic
gtttcgtgccutacatgaaagtaucc

SEQ ID NO: 3968 - DNA, 26 bp, Artificial Sequence
  Synthetic
gcaaattacuggcaaatgatuagcat

SEQ ID NO: 3969 - DNA, 27 bp, Artificial Sequence
  Synthetic
ctctcaagattucatctctttctgcug

SEQ ID NO: 3970 - DNA, 25 bp, Artificial Sequence
  Synthetic
tctgaaagauaccagccttccucat

SEQ ID NO: 3971 - DNA, 31 bp, Artificial Sequence
  Synthetic
ctgaaaaataaactcuaatggatggttgcut

SEQ ID NO: 3972 - DNA, 19 bp, Artificial Sequence
  Synthetic
ccacucagccggattccuc

SEQ ID NO: 3973 - DNA, 20 bp, Artificial Sequence
  Synthetic
gccagcuggtttggcuacat

SEQ ID NO: 3974 - DNA, 28 bp, Artificial Sequence
  Synthetic
tgcagcagccaauataaaaagctatgua

SEQ ID NO: 3975 - DNA, 21 bp, Artificial Sequence
  Synthetic
cgcagccacutctgggauaac

SEQ ID NO: 3976 - DNA, 20 bp, Artificial Sequence
  Synthetic
ctctgtcaacutcccgcuca

SEQ ID NO: 3977 - DNA, 28 bp, Artificial Sequence
  Synthetic
ggctctactcucctttttatttcaggut

SEQ ID NO: 3978 - DNA, 23 bp, Artificial Sequence
  Synthetic
caagagccaaguggtctcactua

SEQ ID NO: 3979 - DNA, 26 bp, Artificial Sequence
  Synthetic
tcctatgtgtucaccttgtgtuacag

SEQ ID NO: 3980 - DNA, 21 bp, Artificial Sequence
  Synthetic
ccaacutcacaccuggaccaa

SEQ ID NO: 3981 - DNA, 21 bp, Artificial Sequence
  Synthetic
auggcaaagacuggcaaaagc

SEQ ID NO: 3982 - DNA, 20 bp, Artificial Sequence
  Synthetic
atgucaaaccccacgtccuc

SEQ ID NO: 3983 - DNA, 22 bp, Artificial Sequence
  Synthetic
gacagagaccagutgtcaccuc

SEQ ID NO: 3984 - DNA, 22 bp, Artificial Sequence
  Synthetic
cgctggaaucctcgtttuccaa

SEQ ID NO: 3985 - DNA, 21 bp, Artificial Sequence
  Synthetic
gcaguttagggcaucgaggag

SEQ ID NO: 3986 - DNA, 24 bp, Artificial Sequence
  Synthetic
gaccttcggugactgatgatcuaa

SEQ ID NO: 3987 - DNA, 19 bp, Artificial Sequence
  Synthetic
ttcaaugccgguagggacg

SEQ ID NO: 3988 - DNA, 19 bp, Artificial Sequence
  Synthetic
gtgcacgggucgggugaga

SEQ ID NO: 3989 - DNA, 23 bp, Artificial Sequence
  Synthetic
caccctggcuctgaccattcugt

SEQ ID NO: 3990 - DNA, 18 bp, Artificial Sequence
  Synthetic
gucagccgaaggcuccat

SEQ ID NO: 3991 - DNA, 17 bp, Artificial Sequence
  Synthetic
gcuggctggucaccaga

SEQ ID NO: 3992 - DNA, 22 bp, Artificial Sequence
  Synthetic
atgugaaccacgaaaacccuca

SEQ ID NO: 3993 - DNA, 19 bp, Artificial Sequence
  Synthetic
gctcaccuctggugccaaa

SEQ ID NO: 3994 - DNA, 17 bp, Artificial Sequence
  Synthetic
gggaaccuggcgucagt

SEQ ID NO: 3995 - DNA, 17 bp, Artificial Sequence
  Synthetic
tggacacgcuggtggug

SEQ ID NO: 3996 - DNA, 19 bp, Artificial Sequence
  Synthetic
gcgauctaggtuccagccc

SEQ ID NO: 3997 - DNA, 21 bp, Artificial Sequence
  Synthetic
ggactaguggagaaggugcga

SEQ ID NO: 3998 - DNA, 21 bp, Artificial Sequence
  Synthetic
cctgggcucagcttcatuacc

SEQ ID NO: 3999 - DNA, 18 bp, Artificial Sequence
  Synthetic
cgcgcuaggcgcttttuc

SEQ ID NO: 4000 - DNA, 27 bp, Artificial Sequence
  Synthetic
cacctttgatuggatcagagactcuac

SEQ ID NO: 4001 - DNA, 27 bp, Artificial Sequence
  Synthetic
tccatctctacutgaagtatgtgguca

SEQ ID NO: 4002 - DNA, 31 bp, Artificial Sequence
  Synthetic
tctaatagggaagautgaaaagtuggacaag

SEQ ID NO: 4003 - DNA, 27 bp, Artificial Sequence
  Synthetic
acctctcuaacaaagctatctgcaaug

SEQ ID NO: 4004 - DNA, 23 bp, Artificial Sequence
  Synthetic
cacctccgtucattggaaagtut

SEQ ID NO: 4005 - DNA, 28 bp, Artificial Sequence
  Synthetic
acttctgaaaauaaattcctcccucacc

SEQ ID NO: 4006 - DNA, 27 bp, Artificial Sequence
  Synthetic
atgagaactuaccatatcaucacacct

SEQ ID NO: 4007 - DNA, 25 bp, Artificial Sequence
  Synthetic
aattcctgtuccagctcatatugct

SEQ ID NO: 4008 - DNA, 28 bp, Artificial Sequence
  Synthetic
ggagccagaugaacaacttagaaaugat

SEQ ID NO: 4009 - DNA, 29 bp, Artificial Sequence
  Synthetic
aacaaaattggccuacatattcaatgtut

SEQ ID NO: 4010 - DNA, 28 bp, Artificial Sequence
  Synthetic
ggagtttaaggaacutggagttttgtug

SEQ ID NO: 4011 - DNA, 28 bp, Artificial Sequence
  Synthetic
ttccgtttccutagcaattcuagaaagt

SEQ ID NO: 4012 - DNA, 25 bp, Artificial Sequence
  Synthetic
agagacattgutgcagagatugaca

SEQ ID NO: 4013 - DNA, 24 bp, Artificial Sequence
  Synthetic
actgttaccucctccaactaacut

SEQ ID NO: 4014 - DNA, 23 bp, Artificial Sequence
  Synthetic
ctcaagaaugccctuggaaaagc

SEQ ID NO: 4015 - DNA, 24 bp, Artificial Sequence
  Synthetic
ggttgctaagugcctgacuaaaga

SEQ ID NO: 4016 - DNA, 25 bp, Artificial Sequence
  Synthetic
tgggaaagagaugaagcacaagtua

SEQ ID NO: 4017 - DNA, 21 bp, Artificial Sequence
  Synthetic
ccaaacactuccctccaggug

SEQ ID NO: 4018 - DNA, 27 bp, Artificial Sequence
  Synthetic
tctcaggagcaaguttttggttuagat

SEQ ID NO: 4019 - DNA, 22 bp, Artificial Sequence
  Synthetic
ctctgctcgcucctggttaaut

SEQ ID NO: 4020 - DNA, 28 bp, Artificial Sequence
  Synthetic
caaactcacaggucctagaaatugagaa

SEQ ID NO: 4021 - DNA, 29 bp, Artificial Sequence
  Synthetic
ttatgactacaaaaccacugccaaaaauc

SEQ ID NO: 4022 - DNA, 24 bp, Artificial Sequence
  Synthetic
gcctcaacucctgtuagaaaacca

SEQ ID NO: 4023 - DNA, 29 bp, Artificial Sequence
  Synthetic
gagaaatgcaacuttcctatgtgattuga

SEQ ID NO: 4024 - DNA, 24 bp, Artificial Sequence
  Synthetic
cttctccauccccttcatcccuat

SEQ ID NO: 4025 - DNA, 30 bp, Artificial Sequence
  Synthetic
agtatataaccttaucagtcacccauggaa

SEQ ID NO: 4026 - DNA, 27 bp, Artificial Sequence
  Synthetic
gggacttcatugatggaaatgtugaga

SEQ ID NO: 4027 - DNA, 22 bp, Artificial Sequence
  Synthetic
ctcugagcgacgttucagaaga

SEQ ID NO: 4028 - DNA, 23 bp, Artificial Sequence
  Synthetic
gcaatgtgcuttagatcgcucca

SEQ ID NO: 4029 - DNA, 27 bp, Artificial Sequence
  Synthetic
tctgtcagttttuccttcttcttgcut

SEQ ID NO: 4030 - DNA, 28 bp, Artificial Sequence
  Synthetic
cacaactaaatuatctccaggtuagcac

SEQ ID NO: 4031 - DNA, 23 bp, Artificial Sequence
  Synthetic
gaccatgcutccttggaguagat

SEQ ID NO: 4032 - DNA, 24 bp, Artificial Sequence
  Synthetic
tggaccaugctttgtttctauccc

SEQ ID NO: 4033 - DNA, 25 bp, Artificial Sequence
  Synthetic
agggtacacuggctttgttcatuac

SEQ ID NO: 4034 - DNA, 25 bp, Artificial Sequence
  Synthetic
tgtgaaaggauaacactgttccuca

SEQ ID NO: 4035 - DNA, 26 bp, Artificial Sequence
  Synthetic
ctgcagtttuctgacattcaatucca

SEQ ID NO: 4036 - DNA, 30 bp, Artificial Sequence
  Synthetic
atggctttattaguagtttccacttgtuct

SEQ ID NO: 4037 - DNA, 28 bp, Artificial Sequence
  Synthetic
tgttgttgttttguctcctcttcttuct

SEQ ID NO: 4038 - DNA, 28 bp, Artificial Sequence
  Synthetic
ggaatuaacagaucagaaaagcaaacug

SEQ ID NO: 4039 - DNA, 22 bp, Artificial Sequence
  Synthetic
ataccccauctcccagugagaa

SEQ ID NO: 4040 - DNA, 23 bp, Artificial Sequence
  Synthetic
gcaaaccacaccuccatgtgtua

SEQ ID NO: 4041 - DNA, 19 bp, Artificial Sequence
  Synthetic
cccgctcauggttgtccug

SEQ ID NO: 4042 - DNA, 31 bp, Artificial Sequence
  Synthetic
agauctagaagctatttuggaaagaaacgaa

SEQ ID NO: 4043 - DNA, 23 bp, Artificial Sequence
  Synthetic
tccuacgaacccagagaauagca

SEQ ID NO: 4044 - DNA, 22 bp, Artificial Sequence
  Synthetic
agccatcaugccatcactuagt

SEQ ID NO: 4045 - DNA, 29 bp, Artificial Sequence
  Synthetic
aggtagtggaggugttttccttgaataua

SEQ ID NO: 4046 - DNA, 25 bp, Artificial Sequence
  Synthetic
gcautttaucaaaggaguagggaag

SEQ ID NO: 4047 - DNA, 24 bp, Artificial Sequence
  Synthetic
tgaaggccuaagatgaatgcauga

SEQ ID NO: 4048 - DNA, 21 bp, Artificial Sequence
  Synthetic
gggucccaagcaactacauca

SEQ ID NO: 4049 - DNA, 21 bp, Artificial Sequence
  Synthetic
cucactcucacgcaccaagaa

SEQ ID NO: 4050 - DNA, 24 bp, Artificial Sequence
  Synthetic
ctatggtgtgucccccaacuacga

SEQ ID NO: 4051 - DNA, 19 bp, Artificial Sequence
  Synthetic
cccggcagucccagccuac

SEQ ID NO: 4052 - DNA, 21 bp, Artificial Sequence
  Synthetic
gctcagcaguggtggattugt

SEQ ID NO: 4053 - DNA, 20 bp, Artificial Sequence
  Synthetic
tgtgtaggugtcccctguca

SEQ ID NO: 4054 - DNA, 25 bp, Artificial Sequence
  Synthetic
gatctcatggaugatctgactuggg

SEQ ID NO: 4055 - DNA, 20 bp, Artificial Sequence
  Synthetic
ctttcaccccacugcaggua

SEQ ID NO: 4056 - DNA, 20 bp, Artificial Sequence
  Synthetic
ggcggccugaatgaagauga

SEQ ID NO: 4057 - DNA, 19 bp, Artificial Sequence
  Synthetic
cguccatcucccggaagga

SEQ ID NO: 4058 - DNA, 18 bp, Artificial Sequence
  Synthetic
ctcttgcuccgcctccug

SEQ ID NO: 4059 - DNA, 20 bp, Artificial Sequence
  Synthetic
gccggctuctcacttttgug

SEQ ID NO: 4060 - DNA, 20 bp, Artificial Sequence
  Synthetic
agaagcuggaaagggcagug

SEQ ID NO: 4061 - DNA, 21 bp, Artificial Sequence
  Synthetic
cgactcagaggagugcttgug

SEQ ID NO: 4062 - DNA, 20 bp, Artificial Sequence
  Synthetic
ccacuccaaagccacagucc

SEQ ID NO: 4063 - DNA, 21 bp, Artificial Sequence
  Synthetic
cgaagagacacucgggtugat

SEQ ID NO: 4064 - DNA, 20 bp, Artificial Sequence
  Synthetic
gccacucaggactucagcaa

SEQ ID NO: 4065 - DNA, 19 bp, Artificial Sequence
  Synthetic
agccactgucacgggtaug

SEQ ID NO: 4066 - DNA, 20 bp, Artificial Sequence
  Synthetic
gcctgcucgatgcucaaacc

SEQ ID NO: 4067 - DNA, 21 bp, Artificial Sequence
  Synthetic
gaaaagcgtcugcaggatguc

SEQ ID NO: 4068 - DNA, 21 bp, Artificial Sequence
  Synthetic
ggttgatguccaggcuaagct

SEQ ID NO: 4069 - DNA, 20 bp, Artificial Sequence
  Synthetic
ggcagguagacggagacuca

SEQ ID NO: 4070 - DNA, 20 bp, Artificial Sequence
  Synthetic
ccgaagagcuctcctcacug

SEQ ID NO: 4071 - DNA, 19 bp, Artificial Sequence
  Synthetic
cttcagggcagccuctgut

SEQ ID NO: 4072 - DNA, 21 bp, Artificial Sequence
  Synthetic
ggcatccacuggcttguagaa

SEQ ID NO: 4073 - DNA, 21 bp, Artificial Sequence
  Synthetic
caucaagccucccaagaagga

SEQ ID NO: 4074 - DNA, 18 bp, Artificial Sequence
  Synthetic
gaccgacgugacgttugc

SEQ ID NO: 4075 - DNA, 22 bp, Artificial Sequence
  Synthetic
ggtgtgtugaacatccctucct

SEQ ID NO: 4076 - DNA, 19 bp, Artificial Sequence
  Synthetic
agcagaacguggctctugg

SEQ ID NO: 4077 - DNA, 21 bp, Artificial Sequence
  Synthetic
caagaccaaccagcugcagua

SEQ ID NO: 4078 - DNA, 28 bp, Artificial Sequence
  Synthetic
gttctgtuaaccataatagucccacagt

SEQ ID NO: 4079 - DNA, 27 bp, Artificial Sequence
  Synthetic
agaagaatgaugatggctggtaugaag

SEQ ID NO: 4080 - DNA, 23 bp, Artificial Sequence
  Synthetic
catgctauaaggagacagccuct

SEQ ID NO: 4081 - DNA, 23 bp, Artificial Sequence
  Synthetic
cccatactgugttgttgcuacca

SEQ ID NO: 4082 - DNA, 27 bp, Artificial Sequence
  Synthetic
atgactaattuatttcagcctuccaca

SEQ ID NO: 4083 - DNA, 24 bp, Artificial Sequence
  Synthetic
tcgagaaaacaguggtagcaguag

SEQ ID NO: 4084 - DNA, 28 bp, Artificial Sequence
  Synthetic
cccatacacutacttaagucacagaaac

SEQ ID NO: 4085 - DNA, 23 bp, Artificial Sequence
  Synthetic
gcacactgucgagaacaaaucct

SEQ ID NO: 4086 - DNA, 28 bp, Artificial Sequence
  Synthetic
caggtgctattautttgtgagttctuga

SEQ ID NO: 4087 - DNA, 26 bp, Artificial Sequence
  Synthetic
ggtccagugtatatggauagcaaaca

SEQ ID NO: 4088 - DNA, 26 bp, Artificial Sequence
  Synthetic
gtagttgtttucacagtagtcugcca

SEQ ID NO: 4089 - DNA, 23 bp, Artificial Sequence
  Synthetic
cugtctcttuaacgcgagaggaa

SEQ ID NO: 4090 - DNA, 17 bp, Artificial Sequence
  Synthetic
ggagguggctggacugg

SEQ ID NO: 4091 - DNA, 21 bp, Artificial Sequence
  Synthetic
ccaagucaggctgtgtuaggt

SEQ ID NO: 4092 - DNA, 26 bp, Artificial Sequence
  Synthetic
caaaaacaaggcucataagacaugca

SEQ ID NO: 4093 - DNA, 23 bp, Artificial Sequence
  Synthetic
gaggaacgucacaugagagaaga

SEQ ID NO: 4094 - DNA, 26 bp, Artificial Sequence
  Synthetic
cccatacugaacagcaagacuaaaca

SEQ ID NO: 4095 - DNA, 25 bp, Artificial Sequence
  Synthetic
gcctgacactutggtaacactttut

SEQ ID NO: 4096 - DNA, 23 bp, Artificial Sequence
  Synthetic
ttctccttcugcaaagccugaat

SEQ ID NO: 4097 - DNA, 30 bp, Artificial Sequence
  Synthetic
ttcctgtttcctuaacatgtgttttgttut

SEQ ID NO: 4098 - DNA, 28 bp, Artificial Sequence
  Synthetic
caattgaacaaugcctcagctatacaut

SEQ ID NO: 4099 - DNA, 25 bp, Artificial Sequence
  Synthetic
gggaugagtugaaagaacagaagca

SEQ ID NO: 4100 - DNA, 24 bp, Artificial Sequence
  Synthetic
tggacattgcuttgccatcauaga

SEQ ID NO: 4101 - DNA, 21 bp, Artificial Sequence
  Synthetic
ctttcatauggcccctcccut

SEQ ID NO: 4102 - DNA, 21 bp, Artificial Sequence
  Synthetic
cattcgauggctggtttugct

SEQ ID NO: 4103 - DNA, 24 bp, Artificial Sequence
  Synthetic
gttaatggtttcugcaactggcut

SEQ ID NO: 4104 - DNA, 21 bp, Artificial Sequence
  Synthetic
gautcagatgguccggcaagt

SEQ ID NO: 4105 - DNA, 27 bp, Artificial Sequence
  Synthetic
ttggtagauttctgtttcucgaaacca

SEQ ID NO: 4106 - DNA, 28 bp, Artificial Sequence
  Synthetic
ctctctatgactucctgaaatgtgcuac

SEQ ID NO: 4107 - DNA, 25 bp, Artificial Sequence
  Synthetic
gctctttagguctcgatgagcaaut

SEQ ID NO: 4108 - DNA, 28 bp, Artificial Sequence
  Synthetic
tttagcaaaagaugcttactagatuggt

SEQ ID NO: 4109 - DNA, 22 bp, Artificial Sequence
  Synthetic
cacacacaaccucacgcatauc

SEQ ID NO: 4110 - DNA, 28 bp, Artificial Sequence
  Synthetic
caagatggttgaaucccaagatguaaaa

SEQ ID NO: 4111 - DNA, 20 bp, Artificial Sequence
  Synthetic
agcagccugtgaacacguag

SEQ ID NO: 4112 - DNA, 26 bp, Artificial Sequence
  Synthetic
agccactaguccacaatggttuaaaa

SEQ ID NO: 4113 - DNA, 23 bp, Artificial Sequence
  Synthetic
gccaagaagcugaagaagctcut

SEQ ID NO: 4114 - DNA, 28 bp, Artificial Sequence
  Synthetic
cgcttaagtcautttcactttacucacc

SEQ ID NO: 4115 - DNA, 21 bp, Artificial Sequence
  Synthetic
agagcccagacucttcucaca

SEQ ID NO: 4116 - DNA, 20 bp, Artificial Sequence
  Synthetic
tccacacaggcugagggaua

SEQ ID NO: 4117 - DNA, 21 bp, Artificial Sequence
  Synthetic
cttggucagtcagugcaacct

SEQ ID NO: 4118 - DNA, 22 bp, Artificial Sequence
  Synthetic
ccatggtgtugctggagtaguc

SEQ ID NO: 4119 - DNA, 24 bp, Artificial Sequence
  Synthetic
acatgtgtaauggctgtagcacuc

SEQ ID NO: 4120 - DNA, 20 bp, Artificial Sequence
  Synthetic
tccaucgaagccccuaggag

SEQ ID NO: 4121 - DNA, 26 bp, Artificial Sequence
  Synthetic
tgataagtgauaaaggccuggacaag

SEQ ID NO: 4122 - DNA, 19 bp, Artificial Sequence
  Synthetic
cccuagggaaggccctugt

SEQ ID NO: 4123 - DNA, 26 bp, Artificial Sequence
  Synthetic
aaaatcccaggacautctcatgtcut

SEQ ID NO: 4124 - DNA, 20 bp, Artificial Sequence
  Synthetic
gctgaatccgutcgagcauc

SEQ ID NO: 4125 - DNA, 29 bp, Artificial Sequence
  Synthetic
ttttctacctggaaucacctttatgaaut

SEQ ID NO: 4126 - DNA, 22 bp, Artificial Sequence
  Synthetic
accacgtcaccuttttcccauc

SEQ ID NO: 4127 - DNA, 28 bp, Artificial Sequence
  Synthetic
aaaatggtctcugttgaattgttuacac

SEQ ID NO: 4128 - DNA, 23 bp, Artificial Sequence
  Synthetic
aaugaagaccaaguaccgaauct

SEQ ID NO: 4129 - DNA, 20 bp, Artificial Sequence
  Synthetic
ccuaacaaccggcacaucac

SEQ ID NO: 4130 - DNA, 24 bp, Artificial Sequence
  Synthetic
cgaugtgctuaaccagaacacact

SEQ ID NO: 4131 - DNA, 23 bp, Artificial Sequence
  Synthetic
ccaacucaagagcagaagcatuc

SEQ ID NO: 4132 - DNA, 20 bp, Artificial Sequence
  Synthetic
ggactuaccggcaaggcuac

SEQ ID NO: 4133 - DNA, 22 bp, Artificial Sequence
  Synthetic
gctttgaugcccaccacacuaa

SEQ ID NO: 4134 - DNA, 23 bp, Artificial Sequence
  Synthetic
cggttgtcatugcagactccuat

SEQ ID NO: 4135 - DNA, 28 bp, Artificial Sequence
  Synthetic
tagttctugaaccagggtatacatuaca

SEQ ID NO: 4136 - DNA, 25 bp, Artificial Sequence
  Synthetic
tgacgatattgggucagccatatug

SEQ ID NO: 4137 - DNA, 22 bp, Artificial Sequence
  Synthetic
ctctctacucggtcgtagguga

SEQ ID NO: 4138 - DNA, 26 bp, Artificial Sequence
  Synthetic
gctgttctggccautgatgatgauat

SEQ ID NO: 4139 - DNA, 30 bp, Artificial Sequence
  Synthetic
tttuagaaaagauaagcagtcauaggaagt

SEQ ID NO: 4140 - DNA, 28 bp, Artificial Sequence
  Synthetic
aagcatgattttatugtccttgacacug

SEQ ID NO: 4141 - DNA, 23 bp, Artificial Sequence
  Synthetic
acttttggtuggaggctcactua

SEQ ID NO: 4142 - DNA, 20 bp, Artificial Sequence
  Synthetic
gcatgttuggcgggaagtug

SEQ ID NO: 4143 - DNA, 19 bp, Artificial Sequence
  Synthetic
ggcguttctugggagccat

SEQ ID NO: 4144 - DNA, 23 bp, Artificial Sequence
  Synthetic
agaagatgugactcagacugcct

SEQ ID NO: 4145 - DNA, 23 bp, Artificial Sequence
  Synthetic
acgtgtaaacccutgaggactug

SEQ ID NO: 4146 - DNA, 22 bp, Artificial Sequence
  Synthetic
cccatcatcacucactggctut

SEQ ID NO: 4147 - DNA, 23 bp, Artificial Sequence
  Synthetic
tgcctttaaagucttgcagccua

SEQ ID NO: 4148 - DNA, 19 bp, Artificial Sequence
  Synthetic
gttctgtguccccaccuga

SEQ ID NO: 4149 - DNA, 23 bp, Artificial Sequence
  Synthetic
gcaggtcccaaautttcactgut

SEQ ID NO: 4150 - DNA, 24 bp, Artificial Sequence
  Synthetic
cccccttgaucatgttctgtgtut

SEQ ID NO: 4151 - DNA, 22 bp, Artificial Sequence
  Synthetic
ctgagtttccaucgaacacguc

SEQ ID NO: 4152 - DNA, 22 bp, Artificial Sequence
  Synthetic
cautctcatcuggagccaggag

SEQ ID NO: 4153 - DNA, 19 bp, Artificial Sequence
  Synthetic
acccctgcuccaacccuaa

SEQ ID NO: 4154 - DNA, 26 bp, Artificial Sequence
  Synthetic
gcttatgtcuccaaggacactccuat

SEQ ID NO: 4155 - DNA, 22 bp, Artificial Sequence
  Synthetic
ctgtagacutgcccacaucagt

SEQ ID NO: 4156 - DNA, 26 bp, Artificial Sequence
  Synthetic
ggtttgtctgggugtttttgttctua

SEQ ID NO: 4157 - DNA, 21 bp, Artificial Sequence
  Synthetic
ctgguaaccagagccctugac

SEQ ID NO: 4158 - DNA, 23 bp, Artificial Sequence
  Synthetic
caccatcccagacucctgttuac

SEQ ID NO: 4159 - DNA, 22 bp, Artificial Sequence
  Synthetic
gacaggtuctcctctguaccct

SEQ ID NO: 4160 - DNA, 19 bp, Artificial Sequence
  Synthetic
agccauggaacaccagcuc

SEQ ID NO: 4161 - DNA, 19 bp, Artificial Sequence
  Synthetic
ggaccuccttcugcacaca

SEQ ID NO: 4162 - DNA, 18 bp, Artificial Sequence
  Synthetic
gccgcucaccctgtgtuc

SEQ ID NO: 4163 - DNA, 20 bp, Artificial Sequence
  Synthetic
gtttgttcucctccgccuct

SEQ ID NO: 4164 - DNA, 18 bp, Artificial Sequence
  Synthetic
cacctcuccccacccuct

SEQ ID NO: 4165 - DNA, 18 bp, Artificial Sequence
  Synthetic
tgugcaagccagguccac

SEQ ID NO: 4166 - DNA, 29 bp, Artificial Sequence
  Synthetic
aatttttcatttuggcttttcagccuagt

SEQ ID NO: 4167 - DNA, 23 bp, Artificial Sequence
  Synthetic
cgtgtuggcgcttttcaucaaat

SEQ ID NO: 4168 - DNA, 26 bp, Artificial Sequence
  Synthetic
cagattcgtucagagtctaaatuccg

SEQ ID NO: 4169 - DNA, 27 bp, Artificial Sequence
  Synthetic
ctctggagttuacaggatttgauggag

SEQ ID NO: 4170 - DNA, 29 bp, Artificial Sequence
  Synthetic
tgcccatttauagaaaatcagctucaaga

SEQ ID NO: 4171 - DNA, 28 bp, Artificial Sequence
  Synthetic
ctgctcaggautaactagaacacuagag

SEQ ID NO: 4172 - DNA, 33 bp, Artificial Sequence
  Synthetic
tattttctttacatttuaggtgtgagtactuga

SEQ ID NO: 4173 - DNA, 28 bp, Artificial Sequence
  Synthetic
gcaatttctctgauggcaaccaatatut

SEQ ID NO: 4174 - DNA, 23 bp, Artificial Sequence
  Synthetic
ctggaaggaaguttgugagcaga

SEQ ID NO: 4175 - DNA, 30 bp, Artificial Sequence
  Synthetic
tcttgttcattaauaattccggcagtuagt

SEQ ID NO: 4176 - DNA, 23 bp, Artificial Sequence
  Synthetic
cactgaagaagcaaacugcctut

SEQ ID NO: 4177 - DNA, 30 bp, Artificial Sequence
  Synthetic
aggaataaacactauggacacttctttguc

SEQ ID NO: 4178 - DNA, 23 bp, Artificial Sequence
  Synthetic
gttgctcttugtgatggcaugaa

SEQ ID NO: 4179 - DNA, 23 bp, Artificial Sequence
  Synthetic
ggcttgtgutgaggctgauacat

SEQ ID NO: 4180 - DNA, 26 bp, Artificial Sequence
  Synthetic
gaattgttcuctgtgtactucaggct

SEQ ID NO: 4181 - DNA, 29 bp, Artificial Sequence
  Synthetic
aatttggaatttaauccgtcagtcugaga

SEQ ID NO: 4182 - DNA, 32 bp, Artificial Sequence
  Synthetic
ggactcaacauaggcttaatgattcttuaaaa

SEQ ID NO: 4183 - DNA, 30 bp, Artificial Sequence
  Synthetic
gaatgaagaagcaaautcaaaacaguaaac

SEQ ID NO: 4184 - DNA, 26 bp, Artificial Sequence
  Synthetic
ggaagaaaauagaactaggcugggaa

SEQ ID NO: 4185 - DNA, 27 bp, Artificial Sequence
  Synthetic
gttgagaugaaaggattccacugaaag

SEQ ID NO: 4186 - DNA, 26 bp, Artificial Sequence
  Synthetic
gcaaatacaagcugaaaacttuggct

SEQ ID NO: 4187 - DNA, 27 bp, Artificial Sequence
  Synthetic
tctgtaagtcagacauaatgcatgcug

SEQ ID NO: 4188 - DNA, 29 bp, Artificial Sequence
  Synthetic
agtattctttacauggcttttggtctuct

SEQ ID NO: 4189 - DNA, 30 bp, Artificial Sequence
  Synthetic
attcattgcagcuttacagtttttcauagt

SEQ ID NO: 4190 - DNA, 23 bp, Artificial Sequence
  Synthetic
ctctguccaccagaatcucaagg

SEQ ID NO: 4191 - DNA, 30 bp, Artificial Sequence
  Synthetic
ccttcctaacaguttaccaaagttgaauca

SEQ ID NO: 4192 - DNA, 32 bp, Artificial Sequence
  Synthetic
tgcaggagaaagtaucactctgtttaaaaaua

SEQ ID NO: 4193 - DNA, 31 bp, Artificial Sequence
  Synthetic
agaagaagaaaatctuaccttggtacagtug

SEQ ID NO: 4194 - DNA, 24 bp, Artificial Sequence
  Synthetic
gactatatauggctgttgugccct

SEQ ID NO: 4195 - DNA, 24 bp, Artificial Sequence
  Synthetic
gacacagtatuggtctgagcagua

SEQ ID NO: 4196 - DNA, 27 bp, Artificial Sequence
  Synthetic
cagtgagttttcugagtgcttttauca

SEQ ID NO: 4197 - DNA, 27 bp, Artificial Sequence
  Synthetic
agtttuaaggcaatttacuagggccat

SEQ ID NO: 4198 - DNA, 26 bp, Artificial Sequence
  Synthetic
tggaatatgcttuggaaagtagggut

SEQ ID NO: 4199 - DNA, 27 bp, Artificial Sequence
  Synthetic
agtatgcatttucaaaagctgttugct

SEQ ID NO: 4200 - DNA, 30 bp, Artificial Sequence
  Synthetic
ttttcttaacacautgactttttggtucgt

SEQ ID NO: 4201 - DNA, 31 bp, Artificial Sequence
  Synthetic
tgaagatttagccautccaaaaccagauaat

SEQ ID NO: 4202 - DNA, 29 bp, Artificial Sequence
  Synthetic
gctaatcagautcaagaggacuggaaaag

SEQ ID NO: 4203 - DNA, 22 bp, Artificial Sequence
  Synthetic
cagtctcuctttgctgugccat

SEQ ID NO: 4204 - DNA, 26 bp, Artificial Sequence
  Synthetic
agttcactgguctatgaacaaaacut

SEQ ID NO: 4205 - DNA, 31 bp, Artificial Sequence
  Synthetic
ggttttatgacaautgctgatauaggcaaat

SEQ ID NO: 4206 - DNA, 22 bp, Artificial Sequence
  Synthetic
aaagtggctuaggaggagctug

SEQ ID NO: 4207 - DNA, 28 bp, Artificial Sequence
  Synthetic
aaacaggaagaacaggauagaaagacug

SEQ ID NO: 4208 - DNA, 32 bp, Artificial Sequence
  Synthetic
agtgatagataacaaggauaatgaaaaccuct

SEQ ID NO: 4209 - DNA, 29 bp, Artificial Sequence
  Synthetic
gtgaaaagggtccuctactgtatttgaut

SEQ ID NO: 4210 - DNA, 30 bp, Artificial Sequence
  Synthetic
aacaaaagtgttgucttcatgctagttuaa

SEQ ID NO: 4211 - DNA, 26 bp, Artificial Sequence
  Synthetic
cgcatgacugtagtttaccuagaact

SEQ ID NO: 4212 - DNA, 30 bp, Artificial Sequence
  Synthetic
acattcatcaagautaataactggtguact

SEQ ID NO: 4213 - DNA, 26 bp, Artificial Sequence
  Synthetic
ccagcattggauctgttgtcatctua

SEQ ID NO: 4214 - DNA, 27 bp, Artificial Sequence
  Synthetic
tggataaagacacugacttgtgcttut

SEQ ID NO: 4215 - DNA, 26 bp, Artificial Sequence
  Synthetic
tgtgaagatgaugtgcagtaucacag

SEQ ID NO: 4216 - DNA, 31 bp, Artificial Sequence
  Synthetic
gcagtcacuaccattgtattctataucaaca

SEQ ID NO: 4217 - DNA, 22 bp, Artificial Sequence
  Synthetic
actgagctaccutggcaactuc

SEQ ID NO: 4218 - DNA, 28 bp, Artificial Sequence
  Synthetic
ggaagccagaauacaactatttcuagct

SEQ ID NO: 4219 - DNA, 27 bp, Artificial Sequence
  Synthetic
ttcagtttaaaaaucacatggcatcug

SEQ ID NO: 4220 - DNA, 24 bp, Artificial Sequence
  Synthetic
cataugaacacgaagcaatguggg

SEQ ID NO: 4221 - DNA, 25 bp, Artificial Sequence
  Synthetic
ccaacatacugaaataaccucagca

SEQ ID NO: 4222 - DNA, 30 bp, Artificial Sequence
  Synthetic
tgctctacaatctcuaagagacagagaaut

SEQ ID NO: 4223 - DNA, 26 bp, Artificial Sequence
  Synthetic
caagtttucagaaaagaagccaugac

SEQ ID NO: 4224 - DNA, 23 bp, Artificial Sequence
  Synthetic
agaaacacucccagcttcucaag

SEQ ID NO: 4225 - DNA, 25 bp, Artificial Sequence
  Synthetic
agagttcuacaaggtgtttggugag

SEQ ID NO: 4226 - DNA, 21 bp, Artificial Sequence
  Synthetic
atgaagggcagutggguacag

SEQ ID NO: 4227 - DNA, 21 bp, Artificial Sequence
  Synthetic
ccgcaggautttcuaagcacg

SEQ ID NO: 4228 - DNA, 24 bp, Artificial Sequence
  Synthetic
gcuctccugaaaagagccaaagag

SEQ ID NO: 4229 - DNA, 25 bp, Artificial Sequence
  Synthetic
tctatgcaaaaacacucactcagut

SEQ ID NO: 4230 - DNA, 31 bp, Artificial Sequence
  Synthetic
ttgcttagatgugagaatatttgaaauacct

SEQ ID NO: 4231 - DNA, 28 bp, Artificial Sequence
  Synthetic
cattctagcagccaautggtacauaaga

SEQ ID NO: 4232 - DNA, 30 bp, Artificial Sequence
  Synthetic
tctaactctgagaaguttaaatgttgggua

SEQ ID NO: 4233 - DNA, 21 bp, Artificial Sequence
  Synthetic
agtgccucaacacttcugacc

SEQ ID NO: 4234 - DNA, 29 bp, Artificial Sequence
  Synthetic
ctggtgacuatacagtcattuaaagcaga

SEQ ID NO: 4235 - DNA, 25 bp, Artificial Sequence
  Synthetic
cactaaaacuctaagggcuaagcca

SEQ ID NO: 4236 - DNA, 25 bp, Artificial Sequence
  Synthetic
tgtccccatuggtgaatttcttgut

SEQ ID NO: 4237 - DNA, 23 bp, Artificial Sequence
  Synthetic
acagctgucagctttaauaagcc

SEQ ID NO: 4238 - DNA, 27 bp, Artificial Sequence
  Synthetic
tggacttggugatagacatguacagaa

SEQ ID NO: 4239 - DNA, 24 bp, Artificial Sequence
  Synthetic
atcttgguaggcaaacaacatucc

SEQ ID NO: 4240 - DNA, 30 bp, Artificial Sequence
  Synthetic
gactggcttatttguatgatactggttcua

SEQ ID NO: 4241 - DNA, 21 bp, Artificial Sequence
  Synthetic
cttccggccuctgctguaaat

SEQ ID NO: 4242 - DNA, 22 bp, Artificial Sequence
  Synthetic
aaatcucagccgactttuccca

SEQ ID NO: 4243 - DNA, 25 bp, Artificial Sequence
  Synthetic
ccctacutaaagtatgtuggcaggt

SEQ ID NO: 4244 - DNA, 24 bp, Artificial Sequence
  Synthetic
aacttgggagaaaaauacugggua

SEQ ID NO: 4245 - DNA, 28 bp, Artificial Sequence
  Synthetic
gggctgtataugagtgttaatcaaaugg

SEQ ID NO: 4246 - DNA, 26 bp, Artificial Sequence
  Synthetic
gtactgggttacucccttcagagtua

SEQ ID NO: 4247 - DNA, 26 bp, Artificial Sequence
  Synthetic
gtttaucggacagaaacgtauagggt

SEQ ID NO: 4248 - DNA, 26 bp, Artificial Sequence
  Synthetic
acatgatcaaccuttgctactcctut

SEQ ID NO: 4249 - DNA, 30 bp, Artificial Sequence
  Synthetic
aagcagcucaggactgtaatattauaaacc

SEQ ID NO: 4250 - DNA, 24 bp, Artificial Sequence
  Synthetic
tcaaguaagggaatgagguaggca

SEQ ID NO: 4251 - DNA, 28 bp, Artificial Sequence
  Synthetic
agtgtattucagagaggaatttgctugt

SEQ ID NO: 4252 - DNA, 27 bp, Artificial Sequence
  Synthetic
tcaacaccaaaguaacacaaatctugg

SEQ ID NO: 4253 - DNA, 25 bp, Artificial Sequence
  Synthetic
caacagaugaaccagcugaaaaaca

SEQ ID NO: 4254 - DNA, 17 bp, Artificial Sequence
  Synthetic
acgcccugcttctcucc

SEQ ID NO: 4255 - DNA, 21 bp, Artificial Sequence
  Synthetic
cgtccttcaugagcccaauca

SEQ ID NO: 4256 - DNA, 26 bp, Artificial Sequence
  Synthetic
gcccaccttataucttagacctgcua

SEQ ID NO: 4257 - DNA, 22 bp, Artificial Sequence
  Synthetic
cctcctugaagaggcttauggt

SEQ ID NO: 4258 - DNA, 32 bp, Artificial Sequence
  Synthetic
aattatctctgttauttcactttatgccucct

SEQ ID NO: 4259 - DNA, 32 bp, Artificial Sequence
  Synthetic
gaaatataatcatugcaggtcagatcaauagt

SEQ ID NO: 4260 - DNA, 26 bp, Artificial Sequence
  Synthetic
cttccaccguaataccagcataauct

SEQ ID NO: 4261 - DNA, 26 bp, Artificial Sequence
  Synthetic
agtgctuggaagagaggtttattgug

SEQ ID NO: 4262 - DNA, 32 bp, Artificial Sequence
  Synthetic
gtgctgaaaatgauaaggatgtaaagatugag

SEQ ID NO: 4263 - DNA, 29 bp, Artificial Sequence
  Synthetic
ccgaattttccaaggutattacatagcug

SEQ ID NO: 4264 - DNA, 20 bp, Artificial Sequence
  Synthetic
gccaccacgacutgacctuc

SEQ ID NO: 4265 - DNA, 25 bp, Artificial Sequence
  Synthetic
gtaaaaacccacuaguacacagcaa

SEQ ID NO: 4266 - DNA, 26 bp, Artificial Sequence
  Synthetic
ccuggacaggaagagaatuaaccaac

SEQ ID NO: 4267 - DNA, 28 bp, Artificial Sequence
  Synthetic
gcccacacatauttcttaacaggtuaga

SEQ ID NO: 4268 - DNA, 22 bp, Artificial Sequence
  Synthetic
caaugtgagggugaagaggaca

SEQ ID NO: 4269 - DNA, 24 bp, Artificial Sequence
  Synthetic
gaagggtgucaattacccacauaa

SEQ ID NO: 4270 - DNA, 25 bp, Artificial Sequence
  Synthetic
tgctgttgtuaaatgaggattuccc

SEQ ID NO: 4271 - DNA, 21 bp, Artificial Sequence
  Synthetic
aggaccacuaccttgcugaca

SEQ ID NO: 4272 - DNA, 27 bp, Artificial Sequence
  Synthetic
catggaagtattutgaaccgagaguca

SEQ ID NO: 4273 - DNA, 30 bp, Artificial Sequence
  Synthetic
gctctattattcugaacttcactactcuca

SEQ ID NO: 4274 - DNA, 28 bp, Artificial Sequence
  Synthetic
ctactttcgtttucttacaggtgaaugg

SEQ ID NO: 4275 - DNA, 27 bp, Artificial Sequence
  Synthetic
ctgctcctuactttaagggttucagaa

SEQ ID NO: 4276 - DNA, 26 bp, Artificial Sequence
  Synthetic
agttatugcaggaagatuacaaccga

SEQ ID NO: 4277 - DNA, 25 bp, Artificial Sequence
  Synthetic
gggtagcacutgtaatagtgaugct

SEQ ID NO: 4278 - DNA, 27 bp, Artificial Sequence
  Synthetic
tctttttctaaattugaccaccaggua

SEQ ID NO: 4279 - DNA, 30 bp, Artificial Sequence
  Synthetic
accaaaatcatcaucttctgctccaauaat

SEQ ID NO: 4280 - DNA, 28 bp, Artificial Sequence
  Synthetic
ggttcctcatuttgtctttttcatucct

SEQ ID NO: 4281 - DNA, 30 bp, Artificial Sequence
  Synthetic
gatcgatcuagaaagaactgatgaaacuca

SEQ ID NO: 4282 - DNA, 27 bp, Artificial Sequence
  Synthetic
aagaaaagagaagaccugagctcatuc

SEQ ID NO: 4283 - DNA, 31 bp, Artificial Sequence
  Synthetic
gaaattctatcuaccactaagctuaccgaaa

SEQ ID NO: 4284 - DNA, 31 bp, Artificial Sequence
  Synthetic
atgtatatgaagcauttgggagtaaaaguga

SEQ ID NO: 4285 - DNA, 26 bp, Artificial Sequence
  Synthetic
tgcaaccaaatguaaagaagcccuaa

SEQ ID NO: 4286 - DNA, 29 bp, Artificial Sequence
  Synthetic
actcttcaaatguctgacttttgtcuaca

SEQ ID NO: 4287 - DNA, 22 bp, Artificial Sequence
  Synthetic
ctcctgcacutggtctaaugga

SEQ ID NO: 4288 - DNA, 28 bp, Artificial Sequence
  Synthetic
tgattgatcccauggaattgttcuaagt

SEQ ID NO: 4289 - DNA, 24 bp, Artificial Sequence
  Synthetic
ctgagggugacagaattccttcuc

SEQ ID NO: 4290 - DNA, 25 bp, Artificial Sequence
  Synthetic
gagaaattgaaacaugctgctgcua

SEQ ID NO: 4291 - DNA, 30 bp, Artificial Sequence
  Synthetic
tttttcttacatgacucactcaactcacut

SEQ ID NO: 4292 - DNA, 20 bp, Artificial Sequence
  Synthetic
cttggtuccaccctgccuaa

SEQ ID NO: 4293 - DNA, 27 bp, Artificial Sequence
  Synthetic
cctgccagguctttagcaaattttaut

SEQ ID NO: 4294 - DNA, 25 bp, Artificial Sequence
  Synthetic
cctccccaggucatagtatuagagt

SEQ ID NO: 4295 - DNA, 29 bp, Artificial Sequence
  Synthetic
gctatagcaagguagccatatctgauaca

SEQ ID NO: 4296 - DNA, 24 bp, Artificial Sequence
  Synthetic
actgagtaccuctgggaaaucaga

SEQ ID NO: 4297 - DNA, 24 bp, Artificial Sequence
  Synthetic
gtgtgaatcugggattgcgattug

SEQ ID NO: 4298 - DNA, 24 bp, Artificial Sequence
  Synthetic
tcattctggugaaggacataugcc

SEQ ID NO: 4299 - DNA, 28 bp, Artificial Sequence
  Synthetic
gggtcataatcaugtggtccattacuaa

SEQ ID NO: 4300 - DNA, 23 bp, Artificial Sequence
  Synthetic
agagttccacagaugaggaggut

SEQ ID NO: 4301 - DNA, 20 bp, Artificial Sequence
  Synthetic
ctgcuggaccagaaatucgg

SEQ ID NO: 4302 - DNA, 24 bp, Artificial Sequence
  Synthetic
tcagtggctucactggtgatctua

SEQ ID NO: 4303 - DNA, 25 bp, Artificial Sequence
  Synthetic
cgaaggcaagcutaaaagaacucac

SEQ ID NO: 4304 - DNA, 31 bp, Artificial Sequence
  Synthetic
atccaatatttatttcuggagtactgtagug

SEQ ID NO: 4305 - DNA, 22 bp, Artificial Sequence
  Synthetic
cgaccaaauagcaugcccaaga

SEQ ID NO: 4306 - DNA, 32 bp, Artificial Sequence
  Synthetic
cttttggtttagauaacctcaaaatcucagac

SEQ ID NO: 4307 - DNA, 27 bp, Artificial Sequence
  Synthetic
ggttctgcaugaaattctcttctctuc

SEQ ID NO: 4308 - DNA, 27 bp, Artificial Sequence
  Synthetic
agctctgcugcataaaatcttagtuga

SEQ ID NO: 4309 - DNA, 26 bp, Artificial Sequence
  Synthetic
actttgcaautaccttttctuccaca

SEQ ID NO: 4310 - DNA, 28 bp, Artificial Sequence
  Synthetic
cagcccctcauacattgataaattggua

SEQ ID NO: 4311 - DNA, 28 bp, Artificial Sequence
  Synthetic
aaaattaaatuccctcacctgugaggat

SEQ ID NO: 4312 - DNA, 28 bp, Artificial Sequence
  Synthetic
gcttaaccttauttttgttgcctuaggt

SEQ ID NO: 4313 - DNA, 29 bp, Artificial Sequence
  Synthetic
acauaaaaatacctuagaaagccggaagt

SEQ ID NO: 4314 - DNA, 21 bp, Artificial Sequence
  Synthetic
cctttccugacctugcaacca

SEQ ID NO: 4315 - DNA, 20 bp, Artificial Sequence
  Synthetic
ctccaacacugctucccgaa

SEQ ID NO: 4316 - DNA, 25 bp, Artificial Sequence
  Synthetic
gtcaggcgagagauaacacaaucat

SEQ ID NO: 4317 - DNA, 21 bp, Artificial Sequence
  Synthetic
cagggcucgttccttctucag

SEQ ID NO: 4318 - DNA, 23 bp, Artificial Sequence
  Synthetic
aactttcagaggcutcatgcuga

SEQ ID NO: 4319 - DNA, 24 bp, Artificial Sequence
  Synthetic
tttgctcugcaacattuccagaag

SEQ ID NO: 4320 - DNA, 23 bp, Artificial Sequence
  Synthetic
caggagatgcaucgaaggttuga

SEQ ID NO: 4321 - DNA, 24 bp, Artificial Sequence
  Synthetic
acatgccatutcctaacacucaca

SEQ ID NO: 4322 - DNA, 29 bp, Artificial Sequence
  Synthetic
ttcatattttgugactcagatctgugaaa

SEQ ID NO: 4323 - DNA, 23 bp, Artificial Sequence
  Synthetic
gcgagtagtuctgtgtccttuct

SEQ ID NO: 4324 - DNA, 26 bp, Artificial Sequence
  Synthetic
gagatacatgaccucaaggacatgut

SEQ ID NO: 4325 - DNA, 25 bp, Artificial Sequence
  Synthetic
tgagcaagaaacuctgacagcatut

SEQ ID NO: 4326 - DNA, 28 bp, Artificial Sequence
  Synthetic
gcaaaagggaauttcttcacatgtugat

SEQ ID NO: 4327 - DNA, 28 bp, Artificial Sequence
  Synthetic
aggctgacttttuccttcaagtcttuaa

SEQ ID NO: 4328 - DNA, 21 bp, Artificial Sequence
  Synthetic
cccatugccacctgtgtguat

SEQ ID NO: 4329 - DNA, 25 bp, Artificial Sequence
  Synthetic
gggccttgcuagattcatctttgua

SEQ ID NO: 4330 - DNA, 26 bp, Artificial Sequence
  Synthetic
tcttaataaauaggctctcccugggt

SEQ ID NO: 4331 - DNA, 23 bp, Artificial Sequence
  Synthetic
catttcccgcuctgcagttauct

SEQ ID NO: 4332 - DNA, 24 bp, Artificial Sequence
  Synthetic
tgttggcatutgctttctttugca

SEQ ID NO: 4333 - DNA, 22 bp, Artificial Sequence
  Synthetic
tgctguaccagacgatcctuct

SEQ ID NO: 4334 - DNA, 24 bp, Artificial Sequence
  Synthetic
cagactgaccutgactttccucat

SEQ ID NO: 4335 - DNA, 20 bp, Artificial Sequence
  Synthetic
gtgaguccacggaggaucag

SEQ ID NO: 4336 - DNA, 20 bp, Artificial Sequence
  Synthetic
gcccuggaagagtcctctug

SEQ ID NO: 4337 - DNA, 20 bp, Artificial Sequence
  Synthetic
aacggugctggaaucacact

SEQ ID NO: 4338 - DNA, 27 bp, Artificial Sequence
  Synthetic
ctttttctctttugctgatgctaugct

SEQ ID NO: 4339 - DNA, 25 bp, Artificial Sequence
  Synthetic
caagaaacgguccaggtaattcaug

SEQ ID NO: 4340 - DNA, 22 bp, Artificial Sequence
  Synthetic
cagctgtcacucctcatgacut

SEQ ID NO: 4341 - DNA, 21 bp, Artificial Sequence
  Synthetic
ccggcucaagcctcatctuac

SEQ ID NO: 4342 - DNA, 19 bp, Artificial Sequence
  Synthetic
ccgucaggaccaacgugac

SEQ ID NO: 4343 - DNA, 23 bp, Artificial Sequence
  Synthetic
agattatggacgcguctctcuct

SEQ ID NO: 4344 - DNA, 20 bp, Artificial Sequence
  Synthetic
ccgagtuacgcttccucgac

SEQ ID NO: 4345 - DNA, 22 bp, Artificial Sequence
  Synthetic
gccatcaaucctctgtcccuct

SEQ ID NO: 4346 - DNA, 25 bp, Artificial Sequence
  Synthetic
gcagaggaaaccucggattctttut

SEQ ID NO: 4347 - DNA, 27 bp, Artificial Sequence
  Synthetic
aacttcctggauttgtctaaaccucag

SEQ ID NO: 4348 - DNA, 22 bp, Artificial Sequence
  Synthetic
gagaauaatcacugcccagcgt

SEQ ID NO: 4349 - DNA, 23 bp, Artificial Sequence
  Synthetic
ggacugtttgaaauccacggagt

SEQ ID NO: 4350 - DNA, 22 bp, Artificial Sequence
  Synthetic
cutcatccgaugggaggacaaa

SEQ ID NO: 4351 - DNA, 25 bp, Artificial Sequence
  Synthetic
agacagacgautatcctccaaucca

SEQ ID NO: 4352 - DNA, 31 bp, Artificial Sequence
  Synthetic
gctggatgaacaaauataccaagaagaugaa

SEQ ID NO: 4353 - DNA, 20 bp, Artificial Sequence
  Synthetic
ctgggucgcttcctttucca

SEQ ID NO: 4354 - DNA, 24 bp, Artificial Sequence
  Synthetic
ggagacggagaaaautctggagut

SEQ ID NO: 4355 - DNA, 31 bp, Artificial Sequence
  Synthetic
ggttttgtgtgtutataatgtggaaacugat

SEQ ID NO: 4356 - DNA, 28 bp, Artificial Sequence
  Synthetic
ttctgtcuacagaaagtctccuaacact

SEQ ID NO: 4357 - DNA, 23 bp, Artificial Sequence
  Synthetic
gtcacaggagaugtcaucaccac

SEQ ID NO: 4358 - DNA, 25 bp, Artificial Sequence
  Synthetic
acctttccutttgtctacuccaagc

SEQ ID NO: 4359 - DNA, 21 bp, Artificial Sequence
  Synthetic
gtgaatcugcaccaagcauga

SEQ ID NO: 4360 - DNA, 24 bp, Artificial Sequence
  Synthetic
tctgactggaauctggagagugag

SEQ ID NO: 4361 - DNA, 28 bp, Artificial Sequence
  Synthetic
ctatgttccctutcctcatttcctugaa

SEQ ID NO: 4362 - DNA, 22 bp, Artificial Sequence
  Synthetic
tggcagcutttcttcctuccat

SEQ ID NO: 4363 - DNA, 23 bp, Artificial Sequence
  Synthetic
atggttttcugacctttgccuct

SEQ ID NO: 4364 - DNA, 21 bp, Artificial Sequence
  Synthetic
ggtaguccagggtatgugggt

SEQ ID NO: 4365 - DNA, 27 bp, Artificial Sequence
  Synthetic
cccatccattcutcctattcccttuag

SEQ ID NO: 4366 - DNA, 25 bp, Artificial Sequence
  Synthetic
ccttgtccagauatgtccttagguc

SEQ ID NO: 4367 - DNA, 25 bp, Artificial Sequence
  Synthetic
aataatgagaggccaugttgggtua

SEQ ID NO: 4368 - DNA, 25 bp, Artificial Sequence
  Synthetic
acagctgugacatggtttaaatucc

SEQ ID NO: 4369 - DNA, 24 bp, Artificial Sequence
  Synthetic
acgagcccutccaaaaacuacaat

SEQ ID NO: 4370 - DNA, 28 bp, Artificial Sequence
  Synthetic
aggatccattttauggttgatgcgaaua

SEQ ID NO: 4371 - DNA, 20 bp, Artificial Sequence
  Synthetic
aatccgcagugggagcuaac

SEQ ID NO: 4372 - DNA, 19 bp, Artificial Sequence
  Synthetic
cgggtguagaagggaugca

SEQ ID NO: 4373 - DNA, 17 bp, Artificial Sequence
  Synthetic
ccccucacgccctcuct

SEQ ID NO: 4374 - DNA, 19 bp, Artificial Sequence
  Synthetic
gtgcgcacacacaugauct

SEQ ID NO: 4375 - DNA, 17 bp, Artificial Sequence
  Synthetic
gcaggccaugggcacuc

SEQ ID NO: 4376 - DNA, 19 bp, Artificial Sequence
  Synthetic
gtctggagacucgggtcug

SEQ ID NO: 4377 - DNA, 22 bp, Artificial Sequence
  Synthetic
agutccaatgguccaacgacaa

SEQ ID NO: 4378 - DNA, 21 bp, Artificial Sequence
  Synthetic
ctcatggcucagcctggaaut

SEQ ID NO: 4379 - DNA, 20 bp, Artificial Sequence
  Synthetic
gaagtgucccagagccctug

SEQ ID NO: 4380 - DNA, 22 bp, Artificial Sequence
  Synthetic
ggatggtgaugtagcgactgua

SEQ ID NO: 4381 - DNA, 25 bp, Artificial Sequence
  Synthetic
gaggtttgtcautacccatgacuga

SEQ ID NO: 4382 - DNA, 17 bp, Artificial Sequence
  Synthetic
ggcgcguagccatucca

SEQ ID NO: 4383 - DNA, 18 bp, Artificial Sequence
  Synthetic
ccggacuacggcggtuac

SEQ ID NO: 4384 - DNA, 26 bp, Artificial Sequence
  Synthetic
acataataaggaaugcatccctgugt

SEQ ID NO: 4385 - DNA, 28 bp, Artificial Sequence
  Synthetic
gttgcagcgugtcttaaaaattucaaaa

SEQ ID NO: 4386 - DNA, 32 bp, Artificial Sequence
  Synthetic
gaatctgaacauaaaaacaacaatuacgaacc

SEQ ID NO: 4387 - DNA, 18 bp, Artificial Sequence
  Synthetic
gguacagcggcagaguca

SEQ ID NO: 4388 - DNA, 22 bp, Artificial Sequence
  Synthetic
aaagtcuaggagctgaggugga

SEQ ID NO: 4389 - DNA, 28 bp, Artificial Sequence
  Synthetic
atgacaattatcaaccucatctgctcut

SEQ ID NO: 4390 - DNA, 29 bp, Artificial Sequence
  Synthetic
ggatttggaaaaacaucagggaattcaut

SEQ ID NO: 4391 - DNA, 32 bp, Artificial Sequence
  Synthetic
gaaaaactatcttcutcagaggtatcuacaac

SEQ ID NO: 4392 - DNA, 22 bp, Artificial Sequence
  Synthetic
gtctttggccugtgaatgguct

SEQ ID NO: 4393 - DNA, 30 bp, Artificial Sequence
  Synthetic
tctttctttctttugttctctgtgtcuaat

SEQ ID NO: 4394 - DNA, 30 bp, Artificial Sequence
  Synthetic
gactttcaatgcaaguttttcaggtcauat

SEQ ID NO: 4395 - DNA, 28 bp, Artificial Sequence
  Synthetic
ctggccagctuccattatcaattaaaut

SEQ ID NO: 4396 - DNA, 30 bp, Artificial Sequence
  Synthetic
tgatggtactttaautttgtcactttgugt

SEQ ID NO: 4397 - DNA, 32 bp, Artificial Sequence
  Synthetic
tttcatttctagaacauttcctcagaattguc

SEQ ID NO: 4398 - DNA, 29 bp, Artificial Sequence
  Synthetic
agtgatacugactttcaaucccagaaaag

SEQ ID NO: 4399 - DNA, 30 bp, Artificial Sequence
  Synthetic
ctttgagcttgtcugacattttgtatgaut

SEQ ID NO: 4400 - DNA, 27 bp, Artificial Sequence
  Synthetic
ccagactcugaagaacttttcucagac

SEQ ID NO: 4401 - DNA, 29 bp, Artificial Sequence
  Synthetic
gtgtctccatauaaaaccatggtagagut

SEQ ID NO: 4402 - DNA, 27 bp, Artificial Sequence
  Synthetic
aggtagctucagaacagcttcaaauaa

SEQ ID NO: 4403 - DNA, 28 bp, Artificial Sequence
  Synthetic
gaggcttgcucagtttcttttgattauc

SEQ ID NO: 4404 - DNA, 26 bp, Artificial Sequence
  Synthetic
gtgcctgaaaaccagaugactatcut

SEQ ID NO: 4405 - DNA, 22 bp, Artificial Sequence
  Synthetic
ggccagcaaacutccgttuaat

SEQ ID NO: 4406 - DNA, 30 bp, Artificial Sequence
  Synthetic
gtcatgattctgutgtttcaatgttuaaga

SEQ ID NO: 4407 - DNA, 28 bp, Artificial Sequence
  Synthetic
cagtaatttcutcaacaaaagugccagt

SEQ ID NO: 4408 - DNA, 23 bp, Artificial Sequence
  Synthetic
tttggaagtugcgaaagcucaag

SEQ ID NO: 4409 - DNA, 28 bp, Artificial Sequence
  Synthetic
attaaatgactcttuggcgacactaaua

SEQ ID NO: 4410 - DNA, 29 bp, Artificial Sequence
  Synthetic
acgtgatgaaaagaucaaagaacctacuc

SEQ ID NO: 4411 - DNA, 25 bp, Artificial Sequence
  Synthetic
cccattgauggctaaaactggugat

SEQ ID NO: 4412 - DNA, 30 bp, Artificial Sequence
  Synthetic
gtagacaaacugaaaatctcaaaacaucaa

SEQ ID NO: 4413 - DNA, 27 bp, Artificial Sequence
  Synthetic
caacttgtguaaaaagctaaggcugaa

SEQ ID NO: 4414 - DNA, 32 bp, Artificial Sequence
  Synthetic
ccattctgaugaggtatataatgatucaggat

SEQ ID NO: 4415 - DNA, 30 bp, Artificial Sequence
  Synthetic
tgcatcttttacautggatattacttugga

SEQ ID NO: 4416 - DNA, 30 bp, Artificial Sequence
  Synthetic
tcaguaaagtaatuaaggaaaacaacgaga

SEQ ID NO: 4417 - DNA, 28 bp, Artificial Sequence
  Synthetic
gcgtgctacautcatcattatcuagaga

SEQ ID NO: 4418 - DNA, 27 bp, Artificial Sequence
  Synthetic
ctgtccaggtaucagatgcttcatuac

SEQ ID NO: 4419 - DNA, 29 bp, Artificial Sequence
  Synthetic
gttctggagtacguatagcagtatttuct

SEQ ID NO: 4420 - DNA, 24 bp, Artificial Sequence
  Synthetic
ccucgtgttgauaagagaaaccca

SEQ ID NO: 4421 - DNA, 32 bp, Artificial Sequence
  Synthetic
cttgttgaaatugagagagatauggagaaact

SEQ ID NO: 4422 - DNA, 30 bp, Artificial Sequence
  Synthetic
ggaagatgaugaactgacagattcuaaact

SEQ ID NO: 4423 - DNA, 26 bp, Artificial Sequence
  Synthetic
tggcaacacgaaagguaaaaaugaac

SEQ ID NO: 4424 - DNA, 30 bp, Artificial Sequence
  Synthetic
tctcatttgtaugaacatctgacttuggaa

SEQ ID NO: 4425 - DNA, 23 bp, Artificial Sequence
  Synthetic
gtggaacaaagacuttggtuggt

SEQ ID NO: 4426 - DNA, 32 bp, Artificial Sequence
  Synthetic
tgatagatttaatuacaagtcttcagaaugcc

SEQ ID NO: 4427 - DNA, 22 bp, Artificial Sequence
  Synthetic
ctcctacugctgcttucagaga

SEQ ID NO: 4428 - DNA, 28 bp, Artificial Sequence
  Synthetic
tgttgaattcaguatcatcctatguggt

SEQ ID NO: 4429 - DNA, 32 bp, Artificial Sequence
  Synthetic
ccagtttccatatgauccatctatagtgatua

SEQ ID NO: 4430 - DNA, 30 bp, Artificial Sequence
  Synthetic
gaaattgauagaagcagaagatuggctaua

SEQ ID NO: 4431 - DNA, 29 bp, Artificial Sequence
  Synthetic
actttttgggtatcugcactactagttut

SEQ ID NO: 4432 - DNA, 30 bp, Artificial Sequence
  Synthetic
attaatttgtccagauttctgctaacagua

SEQ ID NO: 4433 - DNA, 26 bp, Artificial Sequence
  Synthetic
ccaacattucctccatcacugaaaag

SEQ ID NO: 4434 - DNA, 27 bp, Artificial Sequence
  Synthetic
tgggtgttttaugcttggttcttuagt

SEQ ID NO: 4435 - DNA, 25 bp, Artificial Sequence
  Synthetic
cttcataaagcuctgcaccatctug

SEQ ID NO: 4436 - DNA, 20 bp, Artificial Sequence
  Synthetic
ggaaggccauggaatcugct

SEQ ID NO: 4437 - DNA, 30 bp, Artificial Sequence
  Synthetic
aaacaaagcattuacatacttacctgaauc

SEQ ID NO: 4438 - DNA, 29 bp, Artificial Sequence
  Synthetic
aatttttagatccagacuttcagccauct

SEQ ID NO: 4439 - DNA, 30 bp, Artificial Sequence
  Synthetic
actggtagctccaacuaatcataagagaut

SEQ ID NO: 4440 - DNA, 23 bp, Artificial Sequence
  Synthetic
catgcaaatgaucccaagtgguc

SEQ ID NO: 4441 - DNA, 31 bp, Artificial Sequence
  Synthetic
acgatggcctccauatatacttcttataaua

SEQ ID NO: 4442 - DNA, 24 bp, Artificial Sequence
  Synthetic
gcaccaaauacgaaacacccauaa

SEQ ID NO: 4443 - DNA, 24 bp, Artificial Sequence
  Synthetic
gtugaaccagauaaaagagctugg

SEQ ID NO: 4444 - DNA, 28 bp, Artificial Sequence
  Synthetic
ggcttctgtattauttgccatctttgut

SEQ ID NO: 4445 - DNA, 18 bp, Artificial Sequence
  Synthetic
ctuccagagccccuggac

SEQ ID NO: 4446 - DNA, 28 bp, Artificial Sequence
  Synthetic
aatcacagcaatguttctagtggtcuaa

SEQ ID NO: 4447 - DNA, 23 bp, Artificial Sequence
  Synthetic
gaagcttctcugtcgttttccug

SEQ ID NO: 4448 - DNA, 27 bp, Artificial Sequence
  Synthetic
agaagaggaagaugaaaaagaauggca

SEQ ID NO: 4449 - DNA, 28 bp, Artificial Sequence
  Synthetic
tcaggaacttucacagtttgatauacct

SEQ ID NO: 4450 - DNA, 27 bp, Artificial Sequence
  Synthetic
ttttgcctttaggaguctgatgactut

SEQ ID NO: 4451 - DNA, 23 bp, Artificial Sequence
  Synthetic
cttcggatgugtcctgaatgtug

SEQ ID NO: 4452 - DNA, 19 bp, Artificial Sequence
  Synthetic
agcaaaaugcacggcaugt

SEQ ID NO: 4453 - DNA, 23 bp, Artificial Sequence
  Synthetic
cgattttcacuctccagctccuc

SEQ ID NO: 4454 - DNA, 25 bp, Artificial Sequence
  Synthetic
ccacagacucagtuccaaaagaaca

SEQ ID NO: 4455 - DNA, 21 bp, Artificial Sequence
  Synthetic
tgtcagtucccttccatucgg

SEQ ID NO: 4456 - DNA, 27 bp, Artificial Sequence
  Synthetic
agagcaugagaattttcuggaaaccat

SEQ ID NO: 4457 - DNA, 28 bp, Artificial Sequence
  Synthetic
atcctaccgutccagatttcuacaaaag

SEQ ID NO: 4458 - DNA, 29 bp, Artificial Sequence
  Synthetic
agcttattggtaauttcagtcagacuaaa

SEQ ID NO: 4459 - DNA, 25 bp, Artificial Sequence
  Synthetic
tcagtgaatuctgctgtgcuaagag

SEQ ID NO: 4460 - DNA, 25 bp, Artificial Sequence
  Synthetic
cgcggcatguctatagaaactttut

SEQ ID NO: 4461 - DNA, 28 bp, Artificial Sequence
  Synthetic
cttggaaagaaaacutccuaggacaaac

SEQ ID NO: 4462 - DNA, 21 bp, Artificial Sequence
  Synthetic
ctcaccccuggctttccuaac

SEQ ID NO: 4463 - DNA, 28 bp, Artificial Sequence
  Synthetic
aggtgttuccttctctttuaagaagcaa

SEQ ID NO: 4464 - DNA, 28 bp, Artificial Sequence
  Synthetic
caacaggagaaagaagaugctaaacgua

SEQ ID NO: 4465 - DNA, 29 bp, Artificial Sequence
  Synthetic
cttttgccttaucaagtagctcaaatuct

SEQ ID NO: 4466 - DNA, 23 bp, Artificial Sequence
  Synthetic
gcttcagatucgcagaacucagt

SEQ ID NO: 4467 - DNA, 26 bp, Artificial Sequence
  Synthetic
tcttttctucccaaacacagatcugg

SEQ ID NO: 4468 - DNA, 19 bp, Artificial Sequence
  Synthetic
ctgttgcugggttcaggug

SEQ ID NO: 4469 - DNA, 23 bp, Artificial Sequence
  Synthetic
tctgcccuaggtaacaacuccaa

SEQ ID NO: 4470 - DNA, 28 bp, Artificial Sequence
  Synthetic
gaggtcaattcuacatccttgctttgua

SEQ ID NO: 4471 - DNA, 25 bp, Artificial Sequence
  Synthetic
ttctttuggaaccaggtacaucagg

SEQ ID NO: 4472 - DNA, 20 bp, Artificial Sequence
  Synthetic
gcagugacccatgcauagcc

SEQ ID NO: 4473 - DNA, 27 bp, Artificial Sequence
  Synthetic
attgcaatttaacutacttggccttut

SEQ ID NO: 4474 - DNA, 29 bp, Artificial Sequence
  Synthetic
gtaactucgaccaauacctttaaattucc

SEQ ID NO: 4475 - DNA, 23 bp, Artificial Sequence
  Synthetic
tgagagugcacactaaatgcuga

SEQ ID NO: 4476 - DNA, 28 bp, Artificial Sequence
  Synthetic
tttttcaacatcgutttgaacagcacua

SEQ ID NO: 4477 - DNA, 25 bp, Artificial Sequence
  Synthetic
ggctguaaagtacgacuaccacaag

SEQ ID NO: 4478 - DNA, 26 bp, Artificial Sequence
  Synthetic
tgatagtautgtagtgguaggaggca

SEQ ID NO: 4479 - DNA, 29 bp, Artificial Sequence
  Synthetic
tgaagatuccaccaagatgtatgttugat

SEQ ID NO: 4480 - DNA, 24 bp, Artificial Sequence
  Synthetic
tcgtaagaaauggactgcttuccc

SEQ ID NO: 4481 - DNA, 30 bp, Artificial Sequence
  Synthetic
agtatgccatuttcatcagatttugaggat

SEQ ID NO: 4482 - DNA, 26 bp, Artificial Sequence
  Synthetic
ccgaaaagtaaauccctccagtuaca

SEQ ID NO: 4483 - DNA, 24 bp, Artificial Sequence
  Synthetic
gtggtgucaatatttgauccccct

SEQ ID NO: 4484 - DNA, 23 bp, Artificial Sequence
  Synthetic
gagtacccaauagaagggctcug

SEQ ID NO: 4485 - DNA, 26 bp, Artificial Sequence
  Synthetic
agcgatgaatguactctcctgaguaa

SEQ ID NO: 4486 - DNA, 28 bp, Artificial Sequence
  Synthetic
gttcacagacauttggtcatgatttuct

SEQ ID NO: 4487 - DNA, 28 bp, Artificial Sequence
  Synthetic
catctcaattuctaactcctctucagct

SEQ ID NO: 4488 - DNA, 32 bp, Artificial Sequence
  Synthetic
actcaaacaaatacuaagttatgctaguacaa

SEQ ID NO: 4489 - DNA, 26 bp, Artificial Sequence
  Synthetic
tgacaccucgacatttgaaucagaag

SEQ ID NO: 4490 - DNA, 22 bp, Artificial Sequence
  Synthetic
gcccgaccuagtgcatctttua

SEQ ID NO: 4491 - DNA, 30 bp, Artificial Sequence
  Synthetic
ggcattcccaguacaaagtauacaaaagaa

SEQ ID NO: 4492 - DNA, 27 bp, Artificial Sequence
  Synthetic
ctgaatcagcguctgtaggtttaaaut

SEQ ID NO: 4493 - DNA, 21 bp, Artificial Sequence
  Synthetic
acacacgcuctggagaggtua

SEQ ID NO: 4494 - DNA, 30 bp, Artificial Sequence
  Synthetic
acaaagtcagaaaugctaggtttttacuct

SEQ ID NO: 4495 - DNA, 22 bp, Artificial Sequence
  Synthetic
gaugccagtugggaaagagact

SEQ ID NO: 4496 - DNA, 28 bp, Artificial Sequence
  Synthetic
tgaataaaatguaccatcaggcaacuct

SEQ ID NO: 4497 - DNA, 30 bp, Artificial Sequence
  Synthetic
aatattttctcagtugtagattcagccuca

SEQ ID NO: 4498 - DNA, 22 bp, Artificial Sequence
  Synthetic
ggtgccctugctcttccttuag

SEQ ID NO: 4499 - DNA, 27 bp, Artificial Sequence
  Synthetic
ccaacctgctuattgcaacaagtatug

SEQ ID NO: 4500 - DNA, 26 bp, Artificial Sequence
  Synthetic
tgttctcatgugaaaggagtcaacut

SEQ ID NO: 4501 - DNA, 29 bp, Artificial Sequence
  Synthetic
ctgaggatgatgaugaggatgaagaaaut

SEQ ID NO: 4502 - DNA, 23 bp, Artificial Sequence
  Synthetic
cuactttatcugcacaccagggt

SEQ ID NO: 4503 - DNA, 25 bp, Artificial Sequence
  Synthetic
cagtuaaaccccacatgaaaaugct

SEQ ID NO: 4504 - DNA, 26 bp, Artificial Sequence
  Synthetic
caattcctcuggatcacattucccat

SEQ ID NO: 4505 - DNA, 27 bp, Artificial Sequence
  Synthetic
atgttttaatauggcgatgtctctcut

SEQ ID NO: 4506 - DNA, 22 bp, Artificial Sequence
  Synthetic
catccaauttccccugcacaac

SEQ ID NO: 4507 - DNA, 31 bp, Artificial Sequence
  Synthetic
ggaagacatttatugcagtactactcacuaa

SEQ ID NO: 4508 - DNA, 19 bp, Artificial Sequence
  Synthetic
ggugacacggaggcaaguc

SEQ ID NO: 4509 - DNA, 25 bp, Artificial Sequence
  Synthetic
acccuggagaaacacaugaaaaagt

SEQ ID NO: 4510 - DNA, 19 bp, Artificial Sequence
  Synthetic
acacctugccgcagtacuc

SEQ ID NO: 4511 - DNA, 17 bp, Artificial Sequence
  Synthetic
agccugcgcttcuccac

SEQ ID NO: 4512 - DNA, 17 bp, Artificial Sequence
  Synthetic
gccuaggcccacgtuct

SEQ ID NO: 4513 - DNA, 17 bp, Artificial Sequence
  Synthetic
gcccgagucgagctuca

SEQ ID NO: 4514 - DNA, 18 bp, Artificial Sequence
  Synthetic
gccggugcacgaugagat

SEQ ID NO: 4515 - DNA, 18 bp, Artificial Sequence
  Synthetic
gtccccgutccugagcac

SEQ ID NO: 4516 - DNA, 18 bp, Artificial Sequence
  Synthetic
ccatctccucggcacuga

SEQ ID NO: 4517 - DNA, 18 bp, Artificial Sequence
  Synthetic
auttccugggcgacagca

SEQ ID NO: 4518 - DNA, 17 bp, Artificial Sequence
  Synthetic
cgcggcgucgtctgtua

SEQ ID NO: 4519 - DNA, 21 bp, Artificial Sequence
  Synthetic
gtgatcacutcacctcugcgt

SEQ ID NO: 4520 - DNA, 21 bp, Artificial Sequence
  Synthetic
gacttggaucccgatcuccac

SEQ ID NO: 4521 - DNA, 28 bp, Artificial Sequence
  Synthetic
gacaucctggtttttauagagcacaaaa

SEQ ID NO: 4522 - DNA, 21 bp, Artificial Sequence
  Synthetic
tccatcccuccaagctaucgt

SEQ ID NO: 4523 - DNA, 21 bp, Artificial Sequence
  Synthetic
ggtcugagctgtcuacaccca

SEQ ID NO: 4524 - DNA, 20 bp, Artificial Sequence
  Synthetic
gaggtguagcctgtagcugg

SEQ ID NO: 4525 - DNA, 20 bp, Artificial Sequence
  Synthetic
cugcccttcuacaaccagga

SEQ ID NO: 4526 - DNA, 21 bp, Artificial Sequence
  Synthetic
cagcatgaggutctccagcua

SEQ ID NO: 4527 - DNA, 22 bp, Artificial Sequence
  Synthetic
gcttctauggcgctgagatugt

SEQ ID NO: 4528 - DNA, 18 bp, Artificial Sequence
  Synthetic
gggccaccucgtcctgua

SEQ ID NO: 4529 - DNA, 18 bp, Artificial Sequence
  Synthetic
cggcaaggugatccuggt

SEQ ID NO: 4530 - DNA, 25 bp, Artificial Sequence
  Synthetic
ccaaauctgaaucccgagaggccaa

SEQ ID NO: 4531 - DNA, 26 bp, Artificial Sequence
  Synthetic
ttcctcctcaagaaugatggcaccut

SEQ ID NO: 4532 - DNA, 22 bp, Artificial Sequence
  Synthetic
ctuccagacagccacagtuagt

SEQ ID NO: 4533 - DNA, 22 bp, Artificial Sequence
  Synthetic
tucctttaggucagcccagaga

SEQ ID NO: 4534 - DNA, 26 bp, Artificial Sequence
  Synthetic
tcautgtcaaagucaagacagaaggg

SEQ ID NO: 4535 - DNA, 26 bp, Artificial Sequence
  Synthetic
aatggtcttcacautagatgctguca

SEQ ID NO: 4536 - DNA, 26 bp, Artificial Sequence
  Synthetic
gatgtgttatugatgtaggtgucagg

SEQ ID NO: 4537 - DNA, 21 bp, Artificial Sequence
  Synthetic
ccctccuccagggtcatagug

SEQ ID NO: 4538 - DNA, 23 bp, Artificial Sequence
  Synthetic
gtggtttcugtgctactucccat

SEQ ID NO: 4539 - DNA, 21 bp, Artificial Sequence
  Synthetic
gcttctggugggatctcctug

SEQ ID NO: 4540 - DNA, 22 bp, Artificial Sequence
  Synthetic
cagauctgctguccccagaaaa

SEQ ID NO: 4541 - DNA, 21 bp, Artificial Sequence
  Synthetic
gccataucacccacgacagug

SEQ ID NO: 4542 - DNA, 20 bp, Artificial Sequence
  Synthetic
ggaugggaacactcugccat

SEQ ID NO: 4543 - DNA, 24 bp, Artificial Sequence
  Synthetic
ggccatccugatgtagagauacct

SEQ ID NO: 4544 - DNA, 22 bp, Artificial Sequence
  Synthetic
gagaugacagagguacccccat

SEQ ID NO: 4545 - DNA, 24 bp, Artificial Sequence
  Synthetic
ctcctctatttguacaggcagcuc

SEQ ID NO: 4546 - DNA, 24 bp, Artificial Sequence
  Synthetic
acccttgagguccaaagaaaauca

SEQ ID NO: 4547 - DNA, 21 bp, Artificial Sequence
  Synthetic
aaggagatugccttggcaugt

SEQ ID NO: 4548 - DNA, 25 bp, Artificial Sequence
  Synthetic
gctccttuacaagagagucaggagt

SEQ ID NO: 4549 - DNA, 23 bp, Artificial Sequence
  Synthetic
tgtctgcugacctgtgtgtttua

SEQ ID NO: 4550 - DNA, 21 bp, Artificial Sequence
  Synthetic
cactcaggagcucaactuggg

SEQ ID NO: 4551 - DNA, 19 bp, Artificial Sequence
  Synthetic
tgctcccuactggcuacga

SEQ ID NO: 4552 - DNA, 31 bp, Artificial Sequence
  Synthetic
tgagatttacatutgtttccttctucacagt

SEQ ID NO: 4553 - DNA, 28 bp, Artificial Sequence
  Synthetic
agagtattgtuacaggcagattcttgug

SEQ ID NO: 4554 - DNA, 23 bp, Artificial Sequence
  Synthetic
cagcuggacagagcagaactauc

SEQ ID NO: 4555 - DNA, 24 bp, Artificial Sequence
  Synthetic
actcagauggcactugagaaagac

SEQ ID NO: 4556 - DNA, 26 bp, Artificial Sequence
  Synthetic
tgagtctgguaaaatagtggucacct

SEQ ID NO: 4557 - DNA, 25 bp, Artificial Sequence
  Synthetic
tttagttcagcuagtgtgcttcgut

SEQ ID NO: 4558 - DNA, 26 bp, Artificial Sequence
  Synthetic
agccatggtcuatatatgctgtcuga

SEQ ID NO: 4559 - DNA, 24 bp, Artificial Sequence
  Synthetic
ccacatauggagtgaaacugggaa

SEQ ID NO: 4560 - DNA, 25 bp, Artificial Sequence
  Synthetic
ggagaagattuatgcaggaguaggg

SEQ ID NO: 4561 - DNA, 22 bp, Artificial Sequence
  Synthetic
tcagcucaacctucacacaact

SEQ ID NO: 4562 - DNA, 25 bp, Artificial Sequence
  Synthetic
caaattgctuccgagtcucagaaaa

SEQ ID NO: 4563 - DNA, 23 bp, Artificial Sequence
  Synthetic
gacttcaaggcacuagagaguca

SEQ ID NO: 4564 - DNA, 28 bp, Artificial Sequence
  Synthetic
tcaggatgaauttacaggaatugaaccc

SEQ ID NO: 4565 - DNA, 27 bp, Artificial Sequence
  Synthetic
tcatgaaaaggaguggauacaaaacga

SEQ ID NO: 4566 - DNA, 27 bp, Artificial Sequence
  Synthetic
tcctccatcaaaugtcttcaaatucct

SEQ ID NO: 4567 - DNA, 29 bp, Artificial Sequence
  Synthetic
aaaaagaaaaacauacagctcagttugct

SEQ ID NO: 4568 - DNA, 29 bp, Artificial Sequence
  Synthetic
gaggattacugcattaaacgagaauacct

SEQ ID NO: 4569 - DNA, 27 bp, Artificial Sequence
  Synthetic
gtaacaugaggacagttattgcuccaa

SEQ ID NO: 4570 - DNA, 27 bp, Artificial Sequence
  Synthetic
tctgccaaactugagaaatagtgagut

SEQ ID NO: 4571 - DNA, 22 bp, Artificial Sequence
  Synthetic
cttggacucaagtcaccaugga

SEQ ID NO: 4572 - DNA, 28 bp, Artificial Sequence
  Synthetic
ttttagctgatggugctttttgtgatut

SEQ ID NO: 4573 - DNA, 29 bp, Artificial Sequence
  Synthetic
cagagacccugacattcatcaatactuac

SEQ ID NO: 4574 - DNA, 22 bp, Artificial Sequence
  Synthetic
ctgccctuaggaatccaaugct

SEQ ID NO: 4575 - DNA, 29 bp, Artificial Sequence
  Synthetic
ttggtttgauacacaaaataccaguacct

SEQ ID NO: 4576 - DNA, 31 bp, Artificial Sequence
  Synthetic
tcaattatagaacauacccgugaaaggaaac

SEQ ID NO: 4577 - DNA, 28 bp, Artificial Sequence
  Synthetic
ggtggactttucacttatgggattauct

SEQ ID NO: 4578 - DNA, 29 bp, Artificial Sequence
  Synthetic
tgagauacctatttatuccaaggaaccga

SEQ ID NO: 4579 - DNA, 24 bp, Artificial Sequence
  Synthetic
ggctgtatgacacugggtgaaaut

SEQ ID NO: 4580 - DNA, 28 bp, Artificial Sequence
  Synthetic
aggttauggaactaaagctucaggaaat

SEQ ID NO: 4581 - DNA, 25 bp, Artificial Sequence
  Synthetic
ttctggcatccugattacaagtcug

SEQ ID NO: 4582 - DNA, 26 bp, Artificial Sequence
  Synthetic
ccagatgcuatgtcttctcucacaga

SEQ ID NO: 4583 - DNA, 31 bp, Artificial Sequence
  Synthetic
tgctatttgcacauttgattgatcttgttua

SEQ ID NO: 4584 - DNA, 23 bp, Artificial Sequence
  Synthetic
gtcaggttccucttgcagctuat

SEQ ID NO: 4585 - DNA, 25 bp, Artificial Sequence
  Synthetic
gtcggttaagcugtttttggctaut

SEQ ID NO: 4586 - DNA, 27 bp, Artificial Sequence
  Synthetic
ctgtacuaggccagaattctaaacugg

SEQ ID NO: 4587 - DNA, 26 bp, Artificial Sequence
  Synthetic
cagtgtggctcuttgttagatccaua

SEQ ID NO: 4588 - DNA, 22 bp, Artificial Sequence
  Synthetic
gggaaggaaaagugttggugga

SEQ ID NO: 4589 - DNA, 29 bp, Artificial Sequence
  Synthetic
caccaaatgacaaucacgtttctctaaua

SEQ ID NO: 4590 - DNA, 28 bp, Artificial Sequence
  Synthetic
actagaaatgacagagucccatactgut

SEQ ID NO: 4591 - DNA, 26 bp, Artificial Sequence
  Synthetic
aaaacactctccucagtaggaguaca

SEQ ID NO: 4592 - DNA, 29 bp, Artificial Sequence
  Synthetic
aagtuagagaagaaaaagccutaagcuaa

SEQ ID NO: 4593 - DNA, 23 bp, Artificial Sequence
  Synthetic
gttttagaagccccugccaaaug

SEQ ID NO: 4594 - DNA, 28 bp, Artificial Sequence
  Synthetic
cctttcctaaggauaatagctgtgtuca

SEQ ID NO: 4595 - DNA, 26 bp, Artificial Sequence
  Synthetic
gaccttttcauccatagcagcacuat

SEQ ID NO: 4596 - DNA, 25 bp, Artificial Sequence
  Synthetic
ccaattatugcccagtgcaaaauga

SEQ ID NO: 4597 - DNA, 29 bp, Artificial Sequence
  Synthetic
ggtactggttugaataacttcttcctuct

SEQ ID NO: 4598 - DNA, 25 bp, Artificial Sequence
  Synthetic
ccgaccaaccuccattaccuaaaaa

SEQ ID NO: 4599 - DNA, 20 bp, Artificial Sequence
  Synthetic
caggcugcagcaaaccatuc

SEQ ID NO: 4600 - DNA, 22 bp, Artificial Sequence
  Synthetic
tcatcuaccacccctuccagag

SEQ ID NO: 4601 - DNA, 28 bp, Artificial Sequence
  Synthetic
tggtttcagcuccattatgagactttut

SEQ ID NO: 4602 - DNA, 28 bp, Artificial Sequence
  Synthetic
ggtaaactgaaccuaagtccttcucaat

SEQ ID NO: 4603 - DNA, 29 bp, Artificial Sequence
  Synthetic
tggtgaaatctcuttttggtatgtcucaa

SEQ ID NO: 4604 - DNA, 27 bp, Artificial Sequence
  Synthetic
aaatcacatugaatggtcaugcaaact

SEQ ID NO: 4605 - DNA, 26 bp, Artificial Sequence
  Synthetic
acattttgccaagaaacugcactuac

SEQ ID NO: 4606 - DNA, 21 bp, Artificial Sequence
  Synthetic
aaagccuagccttccuagacc

SEQ ID NO: 4607 - DNA, 28 bp, Artificial Sequence
  Synthetic
gtgagtgaagacuttagtcatcttggua

SEQ ID NO: 4608 - DNA, 27 bp, Artificial Sequence
  Synthetic
acccttgcucaaatagactttaugcaa

SEQ ID NO: 4609 - DNA, 27 bp, Artificial Sequence
  Synthetic
tcaattgcuccaatcggttuaaacaac

SEQ ID NO: 4610 - DNA, 30 bp, Artificial Sequence
  Synthetic
ttgttgcatttttaautgtggatcttguct

SEQ ID NO: 4611 - DNA, 28 bp, Artificial Sequence
  Synthetic
gtggaaggtaauggtacagatggauaat

SEQ ID NO: 4612 - DNA, 29 bp, Artificial Sequence
  Synthetic
agtacctaacuccactgatttcttttucc

SEQ ID NO: 4613 - DNA, 25 bp, Artificial Sequence
  Synthetic
acagcaaaccagucaaaacactuac

SEQ ID NO: 4614 - DNA, 30 bp, Artificial Sequence
  Synthetic
gttcttcaccagautctttaagtaccauca

SEQ ID NO: 4615 - DNA, 27 bp, Artificial Sequence
  Synthetic
tgatttctgagcagugcttactctuac

SEQ ID NO: 4616 - DNA, 25 bp, Artificial Sequence
  Synthetic
gccctgttcuttctgtctcatuagt

SEQ ID NO: 4617 - DNA, 31 bp, Artificial Sequence
  Synthetic
tggaacaaaatccguatcataatcatcauca

SEQ ID NO: 4618 - DNA, 25 bp, Artificial Sequence
  Synthetic
acagataagttuacagcagcagcut

SEQ ID NO: 4619 - DNA, 23 bp, Artificial Sequence
  Synthetic
gataccttatgutccgctgcuga

SEQ ID NO: 4620 - DNA, 26 bp, Artificial Sequence
  Synthetic
ccttccctcaaautctgtttctccug

SEQ ID NO: 4621 - DNA, 25 bp, Artificial Sequence
  Synthetic
cccagttgcuacttacaaaggacut

SEQ ID NO: 4622 - DNA, 26 bp, Artificial Sequence
  Synthetic
ggtcggccaautaaatcagtaucaga

SEQ ID NO: 4623 - DNA, 30 bp, Artificial Sequence
  Synthetic
gggacagttttgutttcatataagcatuca

SEQ ID NO: 4624 - DNA, 28 bp, Artificial Sequence
  Synthetic
acttttacautcatgctcugaagacaga

SEQ ID NO: 4625 - DNA, 29 bp, Artificial Sequence
  Synthetic
gcttttggactugatctacgataagugat

SEQ ID NO: 4626 - DNA, 25 bp, Artificial Sequence
  Synthetic
gaaggaagcuccaagtagtcugaaa

SEQ ID NO: 4627 - DNA, 22 bp, Artificial Sequence
  Synthetic
tcaggatguccttctguaccct

SEQ ID NO: 4628 - DNA, 21 bp, Artificial Sequence
  Synthetic
gcctcagugattcugccagag

SEQ ID NO: 4629 - DNA, 24 bp, Artificial Sequence
  Synthetic
tgcattctacaugtgcatgttugg

SEQ ID NO: 4630 - DNA, 29 bp, Artificial Sequence
  Synthetic
aaccatcauacaagagaaactcactucaa

SEQ ID NO: 4631 - DNA, 27 bp, Artificial Sequence
  Synthetic
agcaattaucacaagaaacatcugggt

SEQ ID NO: 4632 - DNA, 28 bp, Artificial Sequence
  Synthetic
gtaagagtgcaaaaauccagtcagguat

SEQ ID NO: 4633 - DNA, 30 bp, Artificial Sequence
  Synthetic
cctggtcattggcautgatatataagtcut

SEQ ID NO: 4634 - DNA, 24 bp, Artificial Sequence
  Synthetic
tgaattcagugggttttctauggg

SEQ ID NO: 4635 - DNA, 22 bp, Artificial Sequence
  Synthetic
acugaaatcactuccgcaccat

SEQ ID NO: 4636 - DNA, 26 bp, Artificial Sequence
  Synthetic
ccactacuttgcaaguaaaaccagaa

SEQ ID NO: 4637 - DNA, 24 bp, Artificial Sequence
  Synthetic
gttgcacttutgtcctttctuccc

SEQ ID NO: 4638 - DNA, 22 bp, Artificial Sequence
  Synthetic
tgggattccuacacaatgcgut

SEQ ID NO: 4639 - DNA, 28 bp, Artificial Sequence
  Synthetic
gaatggtttctcugtttatctggaaugg

SEQ ID NO: 4640 - DNA, 20 bp, Artificial Sequence
  Synthetic
ctgcgctuttccttgtcugg

SEQ ID NO: 4641 - DNA, 19 bp, Artificial Sequence
  Synthetic
aaugcaggcugagccaaga

SEQ ID NO: 4642 - DNA, 18 bp, Artificial Sequence
  Synthetic
ctgccugcgctgtucaac

SEQ ID NO: 4643 - DNA, 22 bp, Artificial Sequence
  Synthetic
gtccctgccutagtgtcaacuc

SEQ ID NO: 4644 - DNA, 21 bp, Artificial Sequence
  Synthetic
tcccaguggattcactgucca

SEQ ID NO: 4645 - DNA, 22 bp, Artificial Sequence
  Synthetic
agtacctcucacaggcccuaag

SEQ ID NO: 4646 - DNA, 17 bp, Artificial Sequence
  Synthetic
ccuggagcgggaacugg

SEQ ID NO: 4647 - DNA, 20 bp, Artificial Sequence
  Synthetic
cccaatagcucttgcccuga

SEQ ID NO: 4648 - DNA, 22 bp, Artificial Sequence
  Synthetic
cctttuccagaagaagctgcuc

SEQ ID NO: 4649 - DNA, 22 bp, Artificial Sequence
  Synthetic
tgagctcucaaagtagcgcauc

SEQ ID NO: 4650 - DNA, 20 bp, Artificial Sequence
  Synthetic
caggaggaccagutcccauc

SEQ ID NO: 4651 - DNA, 22 bp, Artificial Sequence
  Synthetic
ttgtccttgauttcgccacuca

SEQ ID NO: 4652 - DNA, 17 bp, Artificial Sequence
  Synthetic
gcuggagctgcugcact

SEQ ID NO: 4653 - DNA, 19 bp, Artificial Sequence
  Synthetic
aaggcctugcccaguacat

SEQ ID NO: 4654 - DNA, 21 bp, Artificial Sequence
  Synthetic
catggguaagggctcagugac

SEQ ID NO: 4655 - DNA, 23 bp, Artificial Sequence
  Synthetic
aagacaauccacccctttgctua

SEQ ID NO: 4656 - DNA, 20 bp, Artificial Sequence
  Synthetic
gcatgcaaguttggtccuga

SEQ ID NO: 4657 - DNA, 19 bp, Artificial Sequence
  Synthetic
cagcaccugaccggtaucc

SEQ ID NO: 4658 - DNA, 22 bp, Artificial Sequence
  Synthetic
caccugcaacaacaggatucac

SEQ ID NO: 4659 - DNA, 22 bp, Artificial Sequence
  Synthetic
tgaaugccacctucacaaggac

SEQ ID NO: 4660 - DNA, 27 bp, Artificial Sequence
  Synthetic
ctgtgacctatuaaaaactgccctgua

SEQ ID NO: 4661 - DNA, 29 bp, Artificial Sequence
  Synthetic
actgttgcttgugatttcatttgtuacac

SEQ ID NO: 4662 - DNA, 27 bp, Artificial Sequence
  Synthetic
cgagtcttgucaagaagcattcatcut

SEQ ID NO: 4663 - DNA, 24 bp, Artificial Sequence
  Synthetic
gccacagauacagtttccucacaa

SEQ ID NO: 4664 - DNA, 28 bp, Artificial Sequence
  Synthetic
gctatacagacugctatactggacatut

SEQ ID NO: 4665 - DNA, 28 bp, Artificial Sequence
  Synthetic
actgtgctuaaaaggaaaaagaguacct

SEQ ID NO: 4666 - DNA, 26 bp, Artificial Sequence
  Synthetic
ttcgtattaggutggctgtttctuga

SEQ ID NO: 4667 - DNA, 29 bp, Artificial Sequence
  Synthetic
acacauttaaagactuaaccccacaagat

SEQ ID NO: 4668 - DNA, 21 bp, Artificial Sequence
  Synthetic
ggaggccutcttatugaggct

SEQ ID NO: 4669 - DNA, 25 bp, Artificial Sequence
  Synthetic
gggtctttaggucttttgtgagaut

SEQ ID NO: 4670 - DNA, 24 bp, Artificial Sequence
  Synthetic
tgctcugacaagggtactacauga

SEQ ID NO: 4671 - DNA, 25 bp, Artificial Sequence
  Synthetic
cctaaagaacugtgcaacugaaagc

SEQ ID NO: 4672 - DNA, 24 bp, Artificial Sequence
  Synthetic
ctttgagagtucttccccagugac

SEQ ID NO: 4673 - DNA, 24 bp, Artificial Sequence
  Synthetic
gatggatcagagauggaagcucac

SEQ ID NO: 4674 - DNA, 19 bp, Artificial Sequence
  Synthetic
cccuctcctcaugcaacgg

SEQ ID NO: 4675 - DNA, 25 bp, Artificial Sequence
  Synthetic
accccuggcattttuaacaagaagt

SEQ ID NO: 4676 - DNA, 27 bp, Artificial Sequence
  Synthetic
gtatcctctcugtaaaactttgccugt

SEQ ID NO: 4677 - DNA, 27 bp, Artificial Sequence
  Synthetic
ccaaagacacttutgatgacgattcut

SEQ ID NO: 4678 - DNA, 24 bp, Artificial Sequence
  Synthetic
ccaggtcuaggcatgtactgauac

SEQ ID NO: 4679 - DNA, 24 bp, Artificial Sequence
  Synthetic
gaggaagaagaugtccgugagaac

SEQ ID NO: 4680 - DNA, 19 bp, Artificial Sequence
  Synthetic
gctactcaugggcgggaug

SEQ ID NO: 4681 - DNA, 21 bp, Artificial Sequence
  Synthetic
ccgctgtgautccaatgguct

SEQ ID NO: 4682 - DNA, 23 bp, Artificial Sequence
  Synthetic
agcaaactugggagcattaucgt

SEQ ID NO: 4683 - DNA, 24 bp, Artificial Sequence
  Synthetic
ctctttcccaagaauatgccugga

SEQ ID NO: 4684 - DNA, 21 bp, Artificial Sequence
  Synthetic
cagcagcugcattttctugga

SEQ ID NO: 4685 - DNA, 23 bp, Artificial Sequence
  Synthetic
gcacaucgacccgaagtttauca

SEQ ID NO: 4686 - DNA, 28 bp, Artificial Sequence
  Synthetic
tggatctttagcuttcactcttccuact

SEQ ID NO: 4687 - DNA, 28 bp, Artificial Sequence
  Synthetic
agtcttacagcugccaaauaaaagagaa

SEQ ID NO: 4688 - DNA, 26 bp, Artificial Sequence
  Synthetic
gatactgtacacuaacttggcgcuat

SEQ ID NO: 4689 - DNA, 30 bp, Artificial Sequence
  Synthetic
cataatttgaaaauctgaggagatgtugct

SEQ ID NO: 4690 - DNA, 22 bp, Artificial Sequence
  Synthetic
tgggttggaaagcucaggatug

SEQ ID NO: 4691 - DNA, 21 bp, Artificial Sequence
  Synthetic
ttccaugggcaccaugagaag

SEQ ID NO: 4692 - DNA, 19 bp, Artificial Sequence
  Synthetic
cctgattucgggccgtcut

SEQ ID NO: 4693 - DNA, 20 bp, Artificial Sequence
  Synthetic
ggccagccgacutacgatut

SEQ ID NO: 4694 - DNA, 27 bp, Artificial Sequence
  Synthetic
gguatttcatgtattcugacagcagga

SEQ ID NO: 4695 - DNA, 24 bp, Artificial Sequence
  Synthetic
gctgtgaaacuctcacctccatut

SEQ ID NO: 4696 - DNA, 21 bp, Artificial Sequence
  Synthetic
gcggaagucagttcagacucc

SEQ ID NO: 4697 - DNA, 17 bp, Artificial Sequence
  Synthetic
gcgtcccucgcaaguca

SEQ ID NO: 4698 - DNA, 20 bp, Artificial Sequence
  Synthetic
cccucgacacccgatucaaa

SEQ ID NO: 4699 - DNA, 23 bp, Artificial Sequence
  Synthetic
cactgtatucagcgtgacttugg

SEQ ID NO: 4700 - DNA, 21 bp, Artificial Sequence
  Synthetic
cccagtgtugggatccttcut

SEQ ID NO: 4701 - DNA, 22 bp, Artificial Sequence
  Synthetic
caccttcagccaucctgttuct

SEQ ID NO: 4702 - DNA, 22 bp, Artificial Sequence
  Synthetic
gtcccaaagugcagcttgtcua

SEQ ID NO: 4703 - DNA, 25 bp, Artificial Sequence
  Synthetic
catatttttgucagggagcucagga

SEQ ID NO: 4704 - DNA, 29 bp, Artificial Sequence
  Synthetic
gtactttgtaaaugacacatctcttugct

SEQ ID NO: 4705 - DNA, 27 bp, Artificial Sequence
  Synthetic
gacaaattguccaccatcatcatucaa

SEQ ID NO: 4706 - DNA, 21 bp, Artificial Sequence
  Synthetic
tggaagtguccgaggacttug

SEQ ID NO: 4707 - DNA, 30 bp, Artificial Sequence
  Synthetic
aaatgatataaaauaaccagttgcugcaag

SEQ ID NO: 4708 - DNA, 21 bp, Artificial Sequence
  Synthetic
tgaaugacaacgcccccauac

SEQ ID NO: 4709 - DNA, 24 bp, Artificial Sequence
  Synthetic
gtuagttctgctgugaagggagat

SEQ ID NO: 4710 - DNA, 24 bp, Artificial Sequence
  Synthetic
tgcttctggccutctttatcttug

SEQ ID NO: 4711 - DNA, 21 bp, Artificial Sequence
  Synthetic
aataaacgttgucccgggugt

SEQ ID NO: 4712 - DNA, 21 bp, Artificial Sequence
  Synthetic
ggtgtgcccutcctttcacua

SEQ ID NO: 4713 - DNA, 22 bp, Artificial Sequence
  Synthetic
ctgactcugaggagtucaggga

SEQ ID NO: 4714 - DNA, 17 bp, Artificial Sequence
  Synthetic
gggaugggtgucagcgt

SEQ ID NO: 4715 - DNA, 19 bp, Artificial Sequence
  Synthetic
ggagcgugccaagauggag

SEQ ID NO: 4716 - DNA, 19 bp, Artificial Sequence
  Synthetic
gggcccutctttgtgucct

SEQ ID NO: 4717 - DNA, 22 bp, Artificial Sequence
  Synthetic
gcatcauggacatgguggagaa

SEQ ID NO: 4718 - DNA, 17 bp, Artificial Sequence
  Synthetic
gtctggguggcgguagg

SEQ ID NO: 4719 - DNA, 17 bp, Artificial Sequence
  Synthetic
cggccaugcacccugaa

SEQ ID NO: 4720 - DNA, 21 bp, Artificial Sequence
  Synthetic
gctggcaaggagugggatuaa

SEQ ID NO: 4721 - DNA, 24 bp, Artificial Sequence
  Synthetic
gagtttcautccaagctucaggag

SEQ ID NO: 4722 - DNA, 19 bp, Artificial Sequence
  Synthetic
gccattgcugaagccgtug

SEQ ID NO: 4723 - DNA, 21 bp, Artificial Sequence
  Synthetic
tctgggutgtgttgucaccat

SEQ ID NO: 4724 - DNA, 20 bp, Artificial Sequence
  Synthetic
ccttccccucgagcctctua

SEQ ID NO: 4725 - DNA, 19 bp, Artificial Sequence
  Synthetic
gttcagccucgggauccac

SEQ ID NO: 4726 - DNA, 20 bp, Artificial Sequence
  Synthetic
cuggaacccagccaucagag

SEQ ID NO: 4727 - DNA, 20 bp, Artificial Sequence
  Synthetic
ctggcccugtgcatttugat

SEQ ID NO: 4728 - DNA, 21 bp, Artificial Sequence
  Synthetic
tccuttctttgacuggagcgg

SEQ ID NO: 4729 - DNA, 19 bp, Artificial Sequence
  Synthetic
agacctggutccggaucct

SEQ ID NO: 4730 - DNA, 31 bp, Artificial Sequence
  Synthetic
cagaagucaaagcaaaagauagtgaaatuaa

SEQ ID NO: 4731 - DNA, 25 bp, Artificial Sequence
  Synthetic
agctcttatcauaggttccgtguca

SEQ ID NO: 4732 - DNA, 21 bp, Artificial Sequence
  Synthetic
ggctccucaagtagcgatgut

SEQ ID NO: 4733 - DNA, 24 bp, Artificial Sequence
  Synthetic
gacaattcacutacgctgttuggg

SEQ ID NO: 4734 - DNA, 23 bp, Artificial Sequence
  Synthetic
gagcagaagugcacaggtatuct

SEQ ID NO: 4735 - DNA, 29 bp, Artificial Sequence
  Synthetic
cagtttttcattttcutccttcagacgut

SEQ ID NO: 4736 - DNA, 25 bp, Artificial Sequence
  Synthetic
tugttgttaacugaccaaggaacct

SEQ ID NO: 4737 - DNA, 25 bp, Artificial Sequence
  Synthetic
gtctttgatcuctgcatcactcuct

SEQ ID NO: 4738 - DNA, 22 bp, Artificial Sequence
  Synthetic
cgugaagaggaaactgcuggag

SEQ ID NO: 4739 - DNA, 25 bp, Artificial Sequence
  Synthetic
ccccauacatagtgatugagaagca

SEQ ID NO: 4740 - DNA, 24 bp, Artificial Sequence
  Synthetic
tgtgtuagcagaacatcuccaaca

SEQ ID NO: 4741 - DNA, 30 bp, Artificial Sequence
  Synthetic
gggtggaguagagatagtagacataucaaa

SEQ ID NO: 4742 - DNA, 23 bp, Artificial Sequence
  Synthetic
tcacuagagtcacugagcagacc

SEQ ID NO: 4743 - DNA, 27 bp, Artificial Sequence
  Synthetic
ggaagaauaaaaggtgatuagcccgat

SEQ ID NO: 4744 - DNA, 27 bp, Artificial Sequence
  Synthetic
cagttgauattctttccuggcaaaagc

SEQ ID NO: 4745 - DNA, 23 bp, Artificial Sequence
  Synthetic
tgggtttgaugcctacacttuca

SEQ ID NO: 4746 - DNA, 21 bp, Artificial Sequence
  Synthetic
ccagtgtccuctgacccauct

SEQ ID NO: 4747 - DNA, 21 bp, Artificial Sequence
  Synthetic
aggtgagutccaggttuccct

SEQ ID NO: 4748 - DNA, 20 bp, Artificial Sequence
  Synthetic
cctggccgugctagacaaug

SEQ ID NO: 4749 - DNA, 23 bp, Artificial Sequence
  Synthetic
cctggucagctctgaauaaccaa

SEQ ID NO: 4750 - DNA, 19 bp, Artificial Sequence
  Synthetic
gggccagguagtctcccua

SEQ ID NO: 4751 - DNA, 18 bp, Artificial Sequence
  Synthetic
cagcacacugctcauggc

SEQ ID NO: 4752 - DNA, 20 bp, Artificial Sequence
  Synthetic
gcacggtaaugctgctcaug

SEQ ID NO: 4753 - DNA, 20 bp, Artificial Sequence
  Synthetic
acttcucacaccgctgtgut

SEQ ID NO: 4754 - DNA, 21 bp, Artificial Sequence
  Synthetic
agtgatguccaccctgtucct

SEQ ID NO: 4755 - DNA, 21 bp, Artificial Sequence
  Synthetic
cugcagaacaggaugcagaga

SEQ ID NO: 4756 - DNA, 19 bp, Artificial Sequence
  Synthetic
ggtccctucctcctcacug

SEQ ID NO: 4757 - DNA, 19 bp, Artificial Sequence
  Synthetic
ccctgcaguactcggcaut

SEQ ID NO: 4758 - DNA, 22 bp, Artificial Sequence
  Synthetic
aagagggtggutcccagaatug

SEQ ID NO: 4759 - DNA, 23 bp, Artificial Sequence
  Synthetic
gtgaagggcaaugaaggguacat

SEQ ID NO: 4760 - DNA, 20 bp, Artificial Sequence
  Synthetic
gcagaugcggatccugaaag

SEQ ID NO: 4761 - DNA, 19 bp, Artificial Sequence
  Synthetic
ctcttgccccucccaucag

SEQ ID NO: 4762 - DNA, 22 bp, Artificial Sequence
  Synthetic
ccaggcccucccagaaggtcua

SEQ ID NO: 4763 - DNA, 25 bp, Artificial Sequence
  Synthetic
gccagcccgaaguctgtaatttuga

SEQ ID NO: 4764 - DNA, 21 bp, Artificial Sequence
  Synthetic
gatcccugacctgcuggaaaa

SEQ ID NO: 4765 - DNA, 19 bp, Artificial Sequence
  Synthetic
cctggucccctttcaugcc

SEQ ID NO: 4766 - DNA, 20 bp, Artificial Sequence
  Synthetic
ctgcuggaggacgaugacat

SEQ ID NO: 4767 - DNA, 18 bp, Artificial Sequence
  Synthetic
gugaccgagggcacugac

SEQ ID NO: 4768 - DNA, 24 bp, Artificial Sequence
  Synthetic
cctaatgggucaccttctctugac

SEQ ID NO: 4769 - DNA, 23 bp, Artificial Sequence
  Synthetic
cgtcttugacgaccccattctuc

SEQ ID NO: 4770 - DNA, 28 bp, Artificial Sequence
  Synthetic
agtcctttucaggctgatgtacauaaaa

SEQ ID NO: 4771 - DNA, 19 bp, Artificial Sequence
  Synthetic
gaucccccacagccacuac

SEQ ID NO: 4772 - DNA, 21 bp, Artificial Sequence
  Synthetic
agucttgcucacaggagagaa

SEQ ID NO: 4773 - DNA, 30 bp, Artificial Sequence
  Synthetic
actgcagtgatuttacatctaaatguccat

SEQ ID NO: 4774 - DNA, 25 bp, Artificial Sequence
  Synthetic
caautctgaggtgtuaaagggagga

SEQ ID NO: 4775 - DNA, 30 bp, Artificial Sequence
  Synthetic
gttttcaacttctaaucctttgagtgttut

SEQ ID NO: 4776 - DNA, 23 bp, Artificial Sequence
  Synthetic
gggaactttcaaugcagaggtug

SEQ ID NO: 4777 - DNA, 30 bp, Artificial Sequence
  Synthetic
gttgtgtaaattaaacutctcccattccut

SEQ ID NO: 4778 - DNA, 24 bp, Artificial Sequence
  Synthetic
caccucaaacttgucagcagaaag

SEQ ID NO: 4779 - DNA, 28 bp, Artificial Sequence
  Synthetic
tgaautatcactaucagaacaaagcagt

SEQ ID NO: 4780 - DNA, 24 bp, Artificial Sequence
  Synthetic
auactactgaaugcaaaggacacc

SEQ ID NO: 4781 - DNA, 24 bp, Artificial Sequence
  Synthetic
gagagugaaacaagcgtctcugaa

SEQ ID NO: 4782 - DNA, 26 bp, Artificial Sequence
  Synthetic
tgugaagaaaacaagcuagcagaaca

SEQ ID NO: 4783 - DNA, 20 bp, Artificial Sequence
  Synthetic
aggcauagcaccgttgcuac

SEQ ID NO: 4784 - DNA, 24 bp, Artificial Sequence
  Synthetic
caucaggtgtcucagaacaaacct

SEQ ID NO: 4785 - DNA, 29 bp, Artificial Sequence
  Synthetic
cctggaagtaautgtaagcatccugaaat

SEQ ID NO: 4786 - DNA, 26 bp, Artificial Sequence
  Synthetic
ttcccatttctcuttcaggtgacaut

SEQ ID NO: 4787 - DNA, 29 bp, Artificial Sequence
  Synthetic
actggactcatuactccaaataaacaugg

SEQ ID NO: 4788 - DNA, 23 bp, Artificial Sequence
  Synthetic
ccuggattugaaaacggagcaaa

SEQ ID NO: 4789 - DNA, 30 bp, Artificial Sequence
  Synthetic
aatagaaaugacacagaaggutttaaguat

SEQ ID NO: 4790 - DNA, 32 bp, Artificial Sequence
  Synthetic
tttctagtttctcutctttttcttctctugga

SEQ ID NO: 4791 - DNA, 28 bp, Artificial Sequence
  Synthetic
gtaacaagccaaaugaacagacaaguaa

SEQ ID NO: 4792 - DNA, 29 bp, Artificial Sequence
  Synthetic
cttatactgctgcutataggttcagctut

SEQ ID NO: 4793 - DNA, 32 bp, Artificial Sequence
  Synthetic
agcagaatggucaagtgatgaatattacuaat

SEQ ID NO: 4794 - DNA, 32 bp, Artificial Sequence
  Synthetic
ttgtcttcaatatuactctctactgattugga

SEQ ID NO: 4795 - DNA, 27 bp, Artificial Sequence
  Synthetic
caaagtagctgaugtattggacgtuct

SEQ ID NO: 4796 - DNA, 24 bp, Artificial Sequence
  Synthetic
caugtttccttactuccagcccat

SEQ ID NO: 4797 - DNA, 26 bp, Artificial Sequence
  Synthetic
caaatactcaugccagctcatuacag

SEQ ID NO: 4798 - DNA, 29 bp, Artificial Sequence
  Synthetic
cctaccacaaauacaaattaugaccaaga

SEQ ID NO: 4799 - DNA, 23 bp, Artificial Sequence
  Synthetic
ggaactgugagaactcugaggac

SEQ ID NO: 4800 - DNA, 22 bp, Artificial Sequence
  Synthetic
tcatggacagcacutgagtguc

SEQ ID NO: 4801 - DNA, 29 bp, Artificial Sequence
  Synthetic
ttgctgagtgtguttctcaaacaattuaa

SEQ ID NO: 4802 - DNA, 24 bp, Artificial Sequence
  Synthetic
actcttgtgcugacttaccagaug

SEQ ID NO: 4803 - DNA, 30 bp, Artificial Sequence
  Synthetic
ttctaatgtgutaaagttcatuggaacaga

SEQ ID NO: 4804 - DNA, 21 bp, Artificial Sequence
  Synthetic
cttgagagcuggacgctgaut

SEQ ID NO: 4805 - DNA, 22 bp, Artificial Sequence
  Synthetic
ccccaccutaccccauacaaag

SEQ ID NO: 4806 - DNA, 24 bp, Artificial Sequence
  Synthetic
caatgaaacgugatgtgactccug

SEQ ID NO: 4807 - DNA, 21 bp, Artificial Sequence
  Synthetic
aacccccaauttccuccacaa

SEQ ID NO: 4808 - DNA, 22 bp, Artificial Sequence
  Synthetic
cctcccugagatgugaaggagt

SEQ ID NO: 4809 - DNA, 22 bp, Artificial Sequence
  Synthetic
atuccggagcccactcuaaaag

SEQ ID NO: 4810 - DNA, 22 bp, Artificial Sequence
  Synthetic
ctccttcttgaucctggtggug

SEQ ID NO: 4811 - DNA, 19 bp, Artificial Sequence
  Synthetic
acccagcuggtccucaaag

SEQ ID NO: 4812 - DNA, 17 bp, Artificial Sequence
  Synthetic
aggacuccgcugggact

SEQ ID NO: 4813 - DNA, 18 bp, Artificial Sequence
  Synthetic
cggauggagcggaggaug

SEQ ID NO: 4814 - DNA, 19 bp, Artificial Sequence
  Synthetic
gggccacaucgatgauggg

SEQ ID NO: 4815 - DNA, 21 bp, Artificial Sequence
  Synthetic
cttttuggccaggccatagug

SEQ ID NO: 4816 - DNA, 22 bp, Artificial Sequence
  Synthetic
ctccaggacutcatgtccctuc

SEQ ID NO: 4817 - DNA, 24 bp, Artificial Sequence
  Synthetic
agaacuggtacaucagcaagaacc

SEQ ID NO: 4818 - DNA, 21 bp, Artificial Sequence
  Synthetic
gctccggaugttctcgatcug

SEQ ID NO: 4819 - DNA, 22 bp, Artificial Sequence
  Synthetic
ctggttucgacttcagctucct

SEQ ID NO: 4820 - DNA, 25 bp, Artificial Sequence
  Synthetic
aagaggagagagaagguaugactua

SEQ ID NO: 4821 - DNA, 22 bp, Artificial Sequence
  Synthetic
tcaggctacauttgacgcucac

SEQ ID NO: 4822 - DNA, 21 bp, Artificial Sequence
  Synthetic
gaacuggagcccagctactua

SEQ ID NO: 4823 - DNA, 21 bp, Artificial Sequence
  Synthetic
ctgacccatautcccctgcuc

SEQ ID NO: 4824 - DNA, 20 bp, Artificial Sequence
  Synthetic
ccagggaagccuctctcucc

SEQ ID NO: 4825 - DNA, 19 bp, Artificial Sequence
  Synthetic
ctgctctcuggcaccucac

SEQ ID NO: 4826 - DNA, 17 bp, Artificial Sequence
  Synthetic
ccagcugccctcaccug

SEQ ID NO: 4827 - DNA, 21 bp, Artificial Sequence
  Synthetic
tgatgcctcugtgctctccua

SEQ ID NO: 4828 - DNA, 25 bp, Artificial Sequence
  Synthetic
gggtcttaacaggucttctgtacut

SEQ ID NO: 4829 - DNA, 25 bp, Artificial Sequence
  Synthetic
gggtcatcuactaggagtatucagg

SEQ ID NO: 4830 - DNA, 26 bp, Artificial Sequence
  Synthetic
ggttgaacttacuctgtcaccctuag

SEQ ID NO: 4831 - DNA, 23 bp, Artificial Sequence
  Synthetic
ctcactccagucttcttggtugt

SEQ ID NO: 4832 - DNA, 27 bp, Artificial Sequence
  Synthetic
gaagguttagaatcuggaagagaccaa

SEQ ID NO: 4833 - DNA, 23 bp, Artificial Sequence
  Synthetic
ccgtgactguagtgttctctcug

SEQ ID NO: 4834 - DNA, 18 bp, Artificial Sequence
  Synthetic
gggccagutttgccauca

SEQ ID NO: 4835 - DNA, 18 bp, Artificial Sequence
  Synthetic
aagggtcugccctcugga

SEQ ID NO: 4836 - DNA, 19 bp, Artificial Sequence
  Synthetic
cagugaacuccgcgacaca

SEQ ID NO: 4837 - DNA, 17 bp, Artificial Sequence
  Synthetic
ctggcccugcuggagag

SEQ ID NO: 4838 - DNA, 21 bp, Artificial Sequence
  Synthetic
gactgaagccuggcaggauac

SEQ ID NO: 4839 - DNA, 25 bp, Artificial Sequence
  Synthetic
tttgccactttcuaacctcagaguc

SEQ ID NO: 4840 - DNA, 19 bp, Artificial Sequence
  Synthetic
ctggccaguccctagagut

SEQ ID NO: 4841 - DNA, 25 bp, Artificial Sequence
  Synthetic
tgacttctctuggtttggttgucag

SEQ ID NO: 4842 - DNA, 22 bp, Artificial Sequence
  Synthetic
gtggacccagcucctaaaugaa

SEQ ID NO: 4843 - DNA, 24 bp, Artificial Sequence
  Synthetic
gatggtctttuctctccctcucag

SEQ ID NO: 4844 - DNA, 22 bp, Artificial Sequence
  Synthetic
ccacctccuctggatacccaut

SEQ ID NO: 4845 - DNA, 29 bp, Artificial Sequence
  Synthetic
ctcactctgactuctcttgtttgttcuag

SEQ ID NO: 4846 - DNA, 18 bp, Artificial Sequence
  Synthetic
gggcagutcttggtcucg

SEQ ID NO: 4847 - DNA, 22 bp, Artificial Sequence
  Synthetic
caccaaucacctgcguacagaa

SEQ ID NO: 4848 - DNA, 23 bp, Artificial Sequence
  Synthetic
ccagugacaggaggagaccauaa

SEQ ID NO: 4849 - DNA, 23 bp, Artificial Sequence
  Synthetic
tccatccttccuaccaccttcuc

SEQ ID NO: 4850 - DNA, 24 bp, Artificial Sequence
  Synthetic
agtgacagagcuagtctagguagg

SEQ ID NO: 4851 - DNA, 26 bp, Artificial Sequence
  Synthetic
tccatttccaaaaggugacatcauca

SEQ ID NO: 4852 - DNA, 22 bp, Artificial Sequence
  Synthetic
gaaggacaugcagctagcttug

SEQ ID NO: 4853 - DNA, 28 bp, Artificial Sequence
  Synthetic
tcataguagaaagccaaauacaagtuct

SEQ ID NO: 4854 - DNA, 27 bp, Artificial Sequence
  Synthetic
tgtatccaaaugaacacattgcagcua

SEQ ID NO: 4855 - DNA, 27 bp, Artificial Sequence
  Synthetic
cattctcagagccaaaucaggatttug

SEQ ID NO: 4856 - DNA, 28 bp, Artificial Sequence
  Synthetic
acttcagtactutggtatcctttuggac

SEQ ID NO: 4857 - DNA, 26 bp, Artificial Sequence
  Synthetic
tgcaaccaaagcaagautatgucaac

SEQ ID NO: 4858 - DNA, 25 bp, Artificial Sequence
  Synthetic
tgtaatgcgaaucagtccagaucag

SEQ ID NO: 4859 - DNA, 23 bp, Artificial Sequence
  Synthetic
cccccacuctccatttcaaucag

SEQ ID NO: 4860 - DNA, 26 bp, Artificial Sequence
  Synthetic
ttcataccaccaugaggttcaacaut

SEQ ID NO: 4861 - DNA, 23 bp, Artificial Sequence
  Synthetic
cagcatggcuctgagacattcua

SEQ ID NO: 4862 - DNA, 28 bp, Artificial Sequence
  Synthetic
gtgcactttaaatauattcaggcagcut

SEQ ID NO: 4863 - DNA, 25 bp, Artificial Sequence
  Synthetic
gtagaactgcuaacctggaauccaa

SEQ ID NO: 4864 - DNA, 24 bp, Artificial Sequence
  Synthetic
cctagatugaaactgcttcugcct

SEQ ID NO: 4865 - DNA, 24 bp, Artificial Sequence
  Synthetic
cgcgactgucatagtagggattut

SEQ ID NO: 4866 - DNA, 28 bp, Artificial Sequence
  Synthetic
aagtgtcagtaacugtaaaggcttucat

SEQ ID NO: 4867 - DNA, 30 bp, Artificial Sequence
  Synthetic
tgatgggccauaatttattaaagacugact

SEQ ID NO: 4868 - DNA, 29 bp, Artificial Sequence
  Synthetic
agcttaaatgtaautgctttggguaggat

SEQ ID NO: 4869 - DNA, 23 bp, Artificial Sequence
  Synthetic
tcattgcaacgutcagcaaacuc

SEQ ID NO: 4870 - DNA, 22 bp, Artificial Sequence
  Synthetic
gctcgagagucctatguggaga

SEQ ID NO: 4871 - DNA, 24 bp, Artificial Sequence
  Synthetic
accaagcuaatcaaguagcccaac

SEQ ID NO: 4872 - DNA, 28 bp, Artificial Sequence
  Synthetic
ctttaactgcacauttctcttgtucagg

SEQ ID NO: 4873 - DNA, 21 bp, Artificial Sequence
  Synthetic
ctccaggugctccctcattut

SEQ ID NO: 4874 - DNA, 27 bp, Artificial Sequence
  Synthetic
gatucagaaggagaaagutcatuagga

SEQ ID NO: 4875 - DNA, 20 bp, Artificial Sequence
  Synthetic
gtgtgauccaaccguggaga

SEQ ID NO: 4876 - DNA, 27 bp, Artificial Sequence
  Synthetic
caaaatactgatcuggcatttggaugg

SEQ ID NO: 4877 - DNA, 23 bp, Artificial Sequence
  Synthetic
cagcgatugttgccttugaagag

SEQ ID NO: 4878 - DNA, 24 bp, Artificial Sequence
  Synthetic
aaggcttttccacuttctgccaua

SEQ ID NO: 4879 - DNA, 29 bp, Artificial Sequence
  Synthetic
agcttgttcttctucttttctcagtgaut

SEQ ID NO: 4880 - DNA, 20 bp, Artificial Sequence
  Synthetic
cctggcuttggguacagcat

SEQ ID NO: 4881 - DNA, 27 bp, Artificial Sequence
  Synthetic
aaataaaggtuacaagaacacgtugcc

SEQ ID NO: 4882 - DNA, 28 bp, Artificial Sequence
  Synthetic
aactttgtatctaugcaatcctcagcut

SEQ ID NO: 4883 - DNA, 29 bp, Artificial Sequence
  Synthetic
ctgaaactgauagaggaaatagatuggct

SEQ ID NO: 4884 - DNA, 28 bp, Artificial Sequence
  Synthetic
gggtggcaucaatctttaatgaugaaat

SEQ ID NO: 4885 - DNA, 23 bp, Artificial Sequence
  Synthetic
ctagtccuccccgttucaaaaca

SEQ ID NO: 4886 - DNA, 30 bp, Artificial Sequence
  Synthetic
agacttctcuatcaaaggtaaaugggaaga

SEQ ID NO: 4887 - DNA, 27 bp, Artificial Sequence
  Synthetic
ccagaaaattutgtggaagaugaagca

SEQ ID NO: 4888 - DNA, 23 bp, Artificial Sequence
  Synthetic
actctaagcccagcugagatcut

SEQ ID NO: 4889 - DNA, 28 bp, Artificial Sequence
  Synthetic
ctggaaaactggauttatttccgatgut

SEQ ID NO: 4890 - DNA, 23 bp, Artificial Sequence
  Synthetic
ccctgtggutctacaatgacugt

SEQ ID NO: 4891 - DNA, 26 bp, Artificial Sequence
  Synthetic
agtcacatuggcttaaacaaaugaag

SEQ ID NO: 4892 - DNA, 26 bp, Artificial Sequence
  Synthetic
ggcacttcagguatcttctaactugt

SEQ ID NO: 4893 - DNA, 27 bp, Artificial Sequence
  Synthetic
accaatgaaauccttttcgucagaact

SEQ ID NO: 4894 - DNA, 25 bp, Artificial Sequence
  Synthetic
tgctagcauccaaattaggctatut

SEQ ID NO: 4895 - DNA, 26 bp, Artificial Sequence
  Synthetic
aggaggcaagagaaguacctgttaut

SEQ ID NO: 4896 - DNA, 32 bp, Artificial Sequence
  Synthetic
cagcacaaatacacuaatagacaaatcttcut

SEQ ID NO: 4897 - DNA, 23 bp, Artificial Sequence
  Synthetic
ctcgggaaucagcaagtuacagt

SEQ ID NO: 4898 - DNA, 23 bp, Artificial Sequence
  Synthetic
gcacatcccutggaaagtctgua

SEQ ID NO: 4899 - DNA, 33 bp, Artificial Sequence
  Synthetic
tttattccttctatgcuaatattggttcacaut

SEQ ID NO: 4900 - DNA, 27 bp, Artificial Sequence
  Synthetic
tgttcctctttugtcaaaaattggtut

SEQ ID NO: 4901 - DNA, 28 bp, Artificial Sequence
  Synthetic
acacaatttggaugcaaaagttgatuca

SEQ ID NO: 4902 - DNA, 23 bp, Artificial Sequence
  Synthetic
cagauatcaacugacccaggcaa

SEQ ID NO: 4903 - DNA, 22 bp, Artificial Sequence
  Synthetic
gtcatgtugttgtgcaugccat

SEQ ID NO: 4904 - DNA, 26 bp, Artificial Sequence
  Synthetic
cagaattcatcauagcaagctgugac

SEQ ID NO: 4905 - DNA, 28 bp, Artificial Sequence
  Synthetic
ggcgtgtcucaatatttgacatttucat

SEQ ID NO: 4906 - DNA, 25 bp, Artificial Sequence
  Synthetic
agauaggcacgatgaugaagaggat

SEQ ID NO: 4907 - DNA, 21 bp, Artificial Sequence
  Synthetic
gctgcccutgtaggccuaaaa

SEQ ID NO: 4908 - DNA, 25 bp, Artificial Sequence
  Synthetic
ctgttcatguagcagtgcatttuca

SEQ ID NO: 4909 - DNA, 21 bp, Artificial Sequence
  Synthetic
ggcacucaggaagaugccaag

SEQ ID NO: 4910 - DNA, 26 bp, Artificial Sequence
  Synthetic
cgaaaaagugcaccataattacugct

SEQ ID NO: 4911 - DNA, 27 bp, Artificial Sequence
  Synthetic
ccaatgccaacaggauattcccaauaa

SEQ ID NO: 4912 - DNA, 23 bp, Artificial Sequence
  Synthetic
ttccaaagcucccattggtguaa

SEQ ID NO: 4913 - DNA, 20 bp, Artificial Sequence
  Synthetic
accgucgggacagatacuct

SEQ ID NO: 4914 - DNA, 27 bp, Artificial Sequence
  Synthetic
gttaaauggagatcttcugggaaacca

SEQ ID NO: 4915 - DNA, 30 bp, Artificial Sequence
  Synthetic
acctagctagaatuctgctcagataatuga

SEQ ID NO: 4916 - DNA, 27 bp, Artificial Sequence
  Synthetic
catcacatcutcttttggttuccacaa

SEQ ID NO: 4917 - DNA, 23 bp, Artificial Sequence
  Synthetic
ctgaccataaaugtgtggcccua

SEQ ID NO: 4918 - DNA, 29 bp, Artificial Sequence
  Synthetic
gagtgaaaacacaautcagtttgaucaca

SEQ ID NO: 4919 - DNA, 23 bp, Artificial Sequence
  Synthetic
cctacctugtccttgaugaagca

SEQ ID NO: 4920 - DNA, 23 bp, Artificial Sequence
  Synthetic
gagcaccaccguagatacaagua

SEQ ID NO: 4921 - DNA, 29 bp, Artificial Sequence
  Synthetic
gcagtttaaaacuagtatccaggtttgug

SEQ ID NO: 4922 - DNA, 26 bp, Artificial Sequence
  Synthetic
ggtagguagaactgaaaaguagcact

SEQ ID NO: 4923 - DNA, 28 bp, Artificial Sequence
  Synthetic
ggtggttgtcaugaattttaagactgut

SEQ ID NO: 4924 - DNA, 21 bp, Artificial Sequence
  Synthetic
ggucactcgaauaacccgaca

SEQ ID NO: 4925 - DNA, 18 bp, Artificial Sequence
  Synthetic
agcttcggcuggtgucat

SEQ ID NO: 4926 - DNA, 23 bp, Artificial Sequence
  Synthetic
tcugagcaaacaaacugagagca

SEQ ID NO: 4927 - DNA, 26 bp, Artificial Sequence
  Synthetic
ccagtgagttggutgtcacttactut

SEQ ID NO: 4928 - DNA, 20 bp, Artificial Sequence
  Synthetic
aaacccaauccctgccucaa

SEQ ID NO: 4929 - DNA, 17 bp, Artificial Sequence
  Synthetic
ccaggacccugcgaugc

SEQ ID NO: 4930 - DNA, 18 bp, Artificial Sequence
  Synthetic
ccgcucactcuccagcat

SEQ ID NO: 4931 - DNA, 20 bp, Artificial Sequence
  Synthetic
gcagcagaggcaguacctug

SEQ ID NO: 4932 - DNA, 20 bp, Artificial Sequence
  Synthetic
gtggacaugcttcgtcguct

SEQ ID NO: 4933 - DNA, 21 bp, Artificial Sequence
  Synthetic
ccaccatucgcagtaccacuc

SEQ ID NO: 4934 - DNA, 21 bp, Artificial Sequence
  Synthetic
cacatgcgcauacacauacga

SEQ ID NO: 4935 - DNA, 21 bp, Artificial Sequence
  Synthetic
cctttgcagcugagctgauct

SEQ ID NO: 4936 - DNA, 20 bp, Artificial Sequence
  Synthetic
ggaaucatccgucagcgcat

SEQ ID NO: 4937 - DNA, 21 bp, Artificial Sequence
  Synthetic
tggtgagggucagtgacugaa

SEQ ID NO: 4938 - DNA, 25 bp, Artificial Sequence
  Synthetic
cctggtcaaacaugatggaaucaat

SEQ ID NO: 4939 - DNA, 23 bp, Artificial Sequence
  Synthetic
ggcagaugaacctgaaggauacc

SEQ ID NO: 4940 - DNA, 19 bp, Artificial Sequence
  Synthetic
ccttctucccctggcacug

SEQ ID NO: 4941 - DNA, 27 bp, Artificial Sequence
  Synthetic
aacuggaagaagaaaaatucccagact

SEQ ID NO: 4942 - DNA, 20 bp, Artificial Sequence
  Synthetic
gctgtccucctcggattuga

SEQ ID NO: 4943 - DNA, 17 bp, Artificial Sequence
  Synthetic
gccaaccugctgcugag

SEQ ID NO: 4944 - DNA, 20 bp, Artificial Sequence
  Synthetic
ttguagcccaccacctucac

SEQ ID NO: 4945 - DNA, 20 bp, Artificial Sequence
  Synthetic
ggccuaaggacactctgcut

SEQ ID NO: 4946 - DNA, 18 bp, Artificial Sequence
  Synthetic
cagccggugtcctttgug

SEQ ID NO: 4947 - DNA, 19 bp, Artificial Sequence
  Synthetic
ccatcctcuggctgctcug

SEQ ID NO: 4948 - DNA, 18 bp, Artificial Sequence
  Synthetic
gtccuggctgtugccgat

SEQ ID NO: 4949 - DNA, 18 bp, Artificial Sequence
  Synthetic
gctcggcgucacctucac

SEQ ID NO: 4950 - DNA, 29 bp, Artificial Sequence
  Synthetic
tgctttagtgaaccutttgcatatttgut

SEQ ID NO: 4951 - DNA, 23 bp, Artificial Sequence
  Synthetic
cggcctctguttgatttctccug

SEQ ID NO: 4952 - DNA, 22 bp, Artificial Sequence
  Synthetic
ctcacaucaccaagtgcaccua

SEQ ID NO: 4953 - DNA, 21 bp, Artificial Sequence
  Synthetic
tgtggccutctttgagtucgg

SEQ ID NO: 4954 - DNA, 17 bp, Artificial Sequence
  Synthetic
ggaugcggctggauggg

SEQ ID NO: 4955 - DNA, 25 bp, Artificial Sequence
  Synthetic
acgataaccgggagauagtgaugaa

SEQ ID NO: 4956 - DNA, 29 bp, Artificial Sequence
  Synthetic
gcatgagaugcaggaaatttttatuccaa

SEQ ID NO: 4957 - DNA, 21 bp, Artificial Sequence
  Synthetic
guacagggaaacgcaccugat

SEQ ID NO: 4958 - DNA, 27 bp, Artificial Sequence
  Synthetic
tgcgcucagaaaagattttctucaaat

SEQ ID NO: 4959 - DNA, 21 bp, Artificial Sequence
  Synthetic
gggtatgagggcutgtagcug

SEQ ID NO: 4960 - DNA, 17 bp, Artificial Sequence
  Synthetic
gacuggtguggccccaa

SEQ ID NO: 4961 - DNA, 19 bp, Artificial Sequence
  Synthetic
gacagctucgagcagtucc

SEQ ID NO: 4962 - DNA, 17 bp, Artificial Sequence
  Synthetic
cctgagcccuggctgug

SEQ ID NO: 4963 - DNA, 22 bp, Artificial Sequence
  Synthetic
aggagaagauccacucacccat

SEQ ID NO: 4964 - DNA, 22 bp, Artificial Sequence
  Synthetic
cttcuggcttccugaggacaaa

SEQ ID NO: 4965 - DNA, 21 bp, Artificial Sequence
  Synthetic
ccucagcaagtcauccagcac

SEQ ID NO: 4966 - DNA, 18 bp, Artificial Sequence
  Synthetic
gggcagguggctctucat

SEQ ID NO: 4967 - DNA, 19 bp, Artificial Sequence
  Synthetic
cacuaccccagcagccauc

SEQ ID NO: 4968 - DNA, 20 bp, Artificial Sequence
  Synthetic
agacccaacgucccaccuaa

SEQ ID NO: 4969 - DNA, 25 bp, Artificial Sequence
  Synthetic
cagagcctcacuaccttctctttuc

SEQ ID NO: 4970 - DNA, 18 bp, Artificial Sequence
  Synthetic
ggacggcutcagggtcuc

SEQ ID NO: 4971 - DNA, 25 bp, Artificial Sequence
  Synthetic
gcaagccuatgtcctaugaggagaa

SEQ ID NO: 4972 - DNA, 19 bp, Artificial Sequence
  Synthetic
cagaaguctgcucccacga

SEQ ID NO: 4973 - DNA, 25 bp, Artificial Sequence
  Synthetic
ccgattgatgtuctccaactgcuat

SEQ ID NO: 4974 - DNA, 20 bp, Artificial Sequence
  Synthetic
cgagacctugctgctctuct

SEQ ID NO: 4975 - DNA, 21 bp, Artificial Sequence
  Synthetic
caccatugaccccatucacga

SEQ ID NO: 4976 - DNA, 19 bp, Artificial Sequence
  Synthetic
gggaggcaccacugtcaug

SEQ ID NO: 4977 - DNA, 23 bp, Artificial Sequence
  Synthetic
ccacgguaccaaacacaacucaa

SEQ ID NO: 4978 - DNA, 20 bp, Artificial Sequence
  Synthetic
gacacccaccccuacatcuc

SEQ ID NO: 4979 - DNA, 28 bp, Artificial Sequence
  Synthetic
aaacgcctatggauatgggaacaauaaa

SEQ ID NO: 4980 - DNA, 24 bp, Artificial Sequence
  Synthetic
ggaagttuctagtccaucccccat

SEQ ID NO: 4981 - DNA, 22 bp, Artificial Sequence
  Synthetic
gcccatcugctgactgatauct

SEQ ID NO: 4982 - DNA, 17 bp, Artificial Sequence
  Synthetic
aagcucgtgguggcgat

SEQ ID NO: 4983 - DNA, 17 bp, Artificial Sequence
  Synthetic
ccgcatugagcgcauca

SEQ ID NO: 4984 - DNA, 18 bp, Artificial Sequence
  Synthetic
gacaccccaugaggguga

SEQ ID NO: 4985 - DNA, 18 bp, Artificial Sequence
  Synthetic
gcccagcutccagacugt

SEQ ID NO: 4986 - DNA, 24 bp, Artificial Sequence
  Synthetic
ctctctgagugaagtgcgataucc

SEQ ID NO: 4987 - DNA, 20 bp, Artificial Sequence
  Synthetic
ggcgtugggttttcuagcca

SEQ ID NO: 4988 - DNA, 17 bp, Artificial Sequence
  Synthetic
ggccguccttcugcagt

SEQ ID NO: 4989 - DNA, 19 bp, Artificial Sequence
  Synthetic
cccatcaacutggcgagug

SEQ ID NO: 4990 - DNA, 19 bp, Artificial Sequence
  Synthetic
tggcagggugaccucaaga

SEQ ID NO: 4991 - DNA, 17 bp, Artificial Sequence
  Synthetic
gcgcggacgutctccut

SEQ ID NO: 4992 - DNA, 18 bp, Artificial Sequence
  Synthetic
ccttgcugccgtcgcuaa

SEQ ID NO: 4993 - DNA, 21 bp, Artificial Sequence
  Synthetic
catgaataaugcagcgcguca

SEQ ID NO: 4994 - DNA, 18 bp, Artificial Sequence
  Synthetic
cgcaggcggucattguca

SEQ ID NO: 4995 - DNA, 23 bp, Artificial Sequence
  Synthetic
guggacaagaauagcaacgagua

SEQ ID NO: 4996 - DNA, 20 bp, Artificial Sequence
  Synthetic
gtcgatguaggcgctgaugt

SEQ ID NO: 4997 - DNA, 18 bp, Artificial Sequence
  Synthetic
ccgaugagcagccaccug

SEQ ID NO: 4998 - DNA, 17 bp, Artificial Sequence
  Synthetic
cuctgcgugggcagact

SEQ ID NO: 4999 - DNA, 18 bp, Artificial Sequence
  Synthetic
actggtccuccccaucca

SEQ ID NO: 5000 - DNA, 17 bp, Artificial Sequence
  Synthetic
cagcccucacctcugct

SEQ ID NO: 5001 - DNA, 19 bp, Artificial Sequence
  Synthetic
ccgccugcccttcuacaac

SEQ ID NO: 5002 - DNA, 20 bp, Artificial Sequence
  Synthetic
gagtcccaugtggtgugcat

SEQ ID NO: 5003 - DNA, 21 bp, Artificial Sequence
  Synthetic
gagcgugtctucacagaggag

SEQ ID NO: 5004 - DNA, 17 bp, Artificial Sequence
  Synthetic
cucgcgagcgcaatucc

SEQ ID NO: 5005 - DNA, 24 bp, Artificial Sequence
  Synthetic
cgactatcucaaactcctuggcaa

SEQ ID NO: 5006 - DNA, 21 bp, Artificial Sequence
  Synthetic
ccagggaaaauctcuccagct

SEQ ID NO: 5007 - DNA, 22 bp, Artificial Sequence
  Synthetic
cgacccaacaccuttgtcauac

SEQ ID NO: 5008 - DNA, 21 bp, Artificial Sequence
  Synthetic
ccagcgugggagaaagaauct

SEQ ID NO: 5009 - DNA, 19 bp, Artificial Sequence
  Synthetic
cctgagctgucccgagcua

SEQ ID NO: 5010 - DNA, 22 bp, Artificial Sequence
  Synthetic
gaaatgugtcaccauccccagt

SEQ ID NO: 5011 - DNA, 21 bp, Artificial Sequence
  Synthetic
ctattgugcgggcatuggaag

SEQ ID NO: 5012 - DNA, 21 bp, Artificial Sequence
  Synthetic
ccagggctcugagccatacua

SEQ ID NO: 5013 - DNA, 19 bp, Artificial Sequence
  Synthetic
cucacccugaacagcagca

SEQ ID NO: 5014 - DNA, 23 bp, Artificial Sequence
  Synthetic
agcctcaacauaggagatgucca

SEQ ID NO: 5015 - DNA, 23 bp, Artificial Sequence
  Synthetic
agaagggcugaaaggagaatguc

SEQ ID NO: 5016 - DNA, 19 bp, Artificial Sequence
  Synthetic
ggccuaggagccctcugat

SEQ ID NO: 5017 - DNA, 18 bp, Artificial Sequence
  Synthetic
ctcucagggcatguggct

SEQ ID NO: 5018 - DNA, 20 bp, Artificial Sequence
  Synthetic
cagugcccuacccaaggaac

SEQ ID NO: 5019 - DNA, 21 bp, Artificial Sequence
  Synthetic
gacagutaggaccuggcagac

SEQ ID NO: 5020 - DNA, 18 bp, Artificial Sequence
  Synthetic
guccagcucagaggccaa

SEQ ID NO: 5021 - DNA, 18 bp, Artificial Sequence
  Synthetic
gggtagcuggtggctcuc

SEQ ID NO: 5022 - DNA, 17 bp, Artificial Sequence
  Synthetic
gugggcagggaaccugt

SEQ ID NO: 5023 - DNA, 19 bp, Artificial Sequence
  Synthetic
gcugcaaagggtccuggag

SEQ ID NO: 5024 - DNA, 22 bp, Artificial Sequence
  Synthetic
gtgtctcccutcctttcaugca

SEQ ID NO: 5025 - DNA, 21 bp, Artificial Sequence
  Synthetic
ggaaccauagccttugccaaa

SEQ ID NO: 5026 - DNA, 18 bp, Artificial Sequence
  Synthetic
ccugcagacactggugct

SEQ ID NO: 5027 - DNA, 20 bp, Artificial Sequence
  Synthetic
cgcaccacautggugaccat

SEQ ID NO: 5028 - DNA, 17 bp, Artificial Sequence
  Synthetic
cctgcugggcactgugg

SEQ ID NO: 5029 - DNA, 17 bp, Artificial Sequence
  Synthetic
ccagcaccugctccuga

SEQ ID NO: 5030 - DNA, 19 bp, Artificial Sequence
  Synthetic
catccguttcacccuccca

SEQ ID NO: 5031 - DNA, 19 bp, Artificial Sequence
  Synthetic
gactatggccccuccccua

SEQ ID NO: 5032 - DNA, 22 bp, Artificial Sequence
  Synthetic
gcttacctcacucctccccaut

SEQ ID NO: 5033 - DNA, 21 bp, Artificial Sequence
  Synthetic
cctagagcuacagagctcgug

SEQ ID NO: 5034 - DNA, 18 bp, Artificial Sequence
  Synthetic
ccccggaggucctgucat

SEQ ID NO: 5035 - DNA, 19 bp, Artificial Sequence
  Synthetic
agaatgguggctgcaggug

SEQ ID NO: 5036 - DNA, 19 bp, Artificial Sequence
  Synthetic
ccaguccgagagccaacug

SEQ ID NO: 5037 - DNA, 19 bp, Artificial Sequence
  Synthetic
cgctcaccauggtcucagg

SEQ ID NO: 5038 - DNA, 20 bp, Artificial Sequence
  Synthetic
gcuggtacuggcaagaaggt

SEQ ID NO: 5039 - DNA, 17 bp, Artificial Sequence
  Synthetic
ctgcagcugcucccact

SEQ ID NO: 5040 - DNA, 19 bp, Artificial Sequence
  Synthetic
cccccaagagugccaagug

SEQ ID NO: 5041 - DNA, 22 bp, Artificial Sequence
  Synthetic
tctctcactcuctaaccgccut

SEQ ID NO: 5042 - DNA, 21 bp, Artificial Sequence
  Synthetic
gcccgctaugcagacatctut

SEQ ID NO: 5043 - DNA, 20 bp, Artificial Sequence
  Synthetic
guacagggagaggagucuca

SEQ ID NO: 5044 - DNA, 23 bp, Artificial Sequence
  Synthetic
cctacaccccuataccccaugat

SEQ ID NO: 5045 - DNA, 21 bp, Artificial Sequence
  Synthetic
tgtgttauggacggctgguct

SEQ ID NO: 5046 - DNA, 18 bp, Artificial Sequence
  Synthetic
gggccuaggttucaccga

SEQ ID NO: 5047 - DNA, 18 bp, Artificial Sequence
  Synthetic
gctcctagugcacgcuca

SEQ ID NO: 5048 - DNA, 22 bp, Artificial Sequence
  Synthetic
ccctctguctctcttcctucct

SEQ ID NO: 5049 - DNA, 18 bp, Artificial Sequence
  Synthetic
gaaggcggguggagaugg

SEQ ID NO: 5050 - DNA, 20 bp, Artificial Sequence
  Synthetic
gccctcucctttcactcugg

SEQ ID NO: 5051 - DNA, 18 bp, Artificial Sequence
  Synthetic
ttcuaggcgcugcagcat

SEQ ID NO: 5052 - DNA, 22 bp, Artificial Sequence
  Synthetic
catctaccuggccaatcuggag

SEQ ID NO: 5053 - DNA, 21 bp, Artificial Sequence
  Synthetic
ctcacuccagaggacuttgut

SEQ ID NO: 5054 - DNA, 18 bp, Artificial Sequence
  Synthetic
ccugccaccctguggaac

SEQ ID NO: 5055 - DNA, 18 bp, Artificial Sequence
  Synthetic
gcctuggccttcccugac

SEQ ID NO: 5056 - DNA, 22 bp, Artificial Sequence
  Synthetic
atcggctatgugagctcagaug

SEQ ID NO: 5057 - DNA, 26 bp, Artificial Sequence
  Synthetic
catgcaagatcuttccaaccagatut

SEQ ID NO: 5058 - DNA, 18 bp, Artificial Sequence
  Synthetic
gcucctcgtuggcccaag

SEQ ID NO: 5059 - DNA, 23 bp, Artificial Sequence
  Synthetic
accgtggaacuggtagatacuca

SEQ ID NO: 5060 - DNA, 28 bp, Artificial Sequence
  Synthetic
caaaatatctccatugcagagactccua

SEQ ID NO: 5061 - DNA, 22 bp, Artificial Sequence
  Synthetic
gggttagaugaggtcaccucca

SEQ ID NO: 5062 - DNA, 21 bp, Artificial Sequence
  Synthetic
caggaagtacutggccaccug

SEQ ID NO: 5063 - DNA, 20 bp, Artificial Sequence
  Synthetic
ctccccgaaugaccttcugt

SEQ ID NO: 5064 - DNA, 20 bp, Artificial Sequence
  Synthetic
gagctcugggaagacaccug

SEQ ID NO: 5065 - DNA, 20 bp, Artificial Sequence
  Synthetic
cctaactugcgtctcgguct

SEQ ID NO: 5066 - DNA, 22 bp, Artificial Sequence
  Synthetic
cggtgctcuccatgtactggua

SEQ ID NO: 5067 - DNA, 26 bp, Artificial Sequence
  Synthetic
cuagttcuaagauagagaagggagga

SEQ ID NO: 5068 - DNA, 21 bp, Artificial Sequence
  Synthetic
cacagagcautcacacccuca

SEQ ID NO: 5069 - DNA, 21 bp, Artificial Sequence
  Synthetic
gtaatcucacccctcctugcc

SEQ ID NO: 5070 - DNA, 17 bp, Artificial Sequence
  Synthetic
gcucacccugcagcact

SEQ ID NO: 5071 - DNA, 19 bp, Artificial Sequence
  Synthetic
cagccccagcucatctcuc

SEQ ID NO: 5072 - DNA, 18 bp, Artificial Sequence
  Synthetic
cuctgcccaucccaccag

SEQ ID NO: 5073 - DNA, 18 bp, Artificial Sequence
  Synthetic
cctggcacucttguccca

SEQ ID NO: 5074 - DNA, 26 bp, Artificial Sequence
  Synthetic
acctcagggugaatacacaagtttut

SEQ ID NO: 5075 - DNA, 20 bp, Artificial Sequence
  Synthetic
gggtttgugcctccaaugag

SEQ ID NO: 5076 - DNA, 20 bp, Artificial Sequence
  Synthetic
cgtttgagcucccgcatgua

SEQ ID NO: 5077 - DNA, 19 bp, Artificial Sequence
  Synthetic
cttcuctgggcucgacgac

SEQ ID NO: 5078 - DNA, 24 bp, Artificial Sequence
  Synthetic
accctcatccautcttttgtggut

SEQ ID NO: 5079 - DNA, 29 bp, Artificial Sequence
  Synthetic
tgcaccaaaagagagutcatatcactuac

SEQ ID NO: 5080 - DNA, 23 bp, Artificial Sequence
  Synthetic
aaaugagcttgtcugagagccat

SEQ ID NO: 5081 - DNA, 19 bp, Artificial Sequence
  Synthetic
gccuggccacgaauagcag

SEQ ID NO: 5082 - DNA, 23 bp, Artificial Sequence
  Synthetic
catgcctuaccatcacactucca

SEQ ID NO: 5083 - DNA, 33 bp, Artificial Sequence
  Synthetic
ccuaataaataaactuaaaagagaacagaagcc

SEQ ID NO: 5084 - DNA, 29 bp, Artificial Sequence
  Synthetic
catagaaataagagacaugtccactcugg

SEQ ID NO: 5085 - DNA, 23 bp, Artificial Sequence
  Synthetic
cugattctccugggacacacaag

SEQ ID NO: 5086 - DNA, 23 bp, Artificial Sequence
  Synthetic
ccgaattcccagutgagtctgug

SEQ ID NO: 5087 - DNA, 23 bp, Artificial Sequence
  Synthetic
gcctgcucaaaggatttcctcut

SEQ ID NO: 5088 - DNA, 21 bp, Artificial Sequence
  Synthetic
cagataugcccccggatcauc

SEQ ID NO: 5089 - DNA, 21 bp, Artificial Sequence
  Synthetic
tctctauggcagtggugacct

SEQ ID NO: 5090 - DNA, 24 bp, Artificial Sequence
  Synthetic
agaaaggaggaaagcugcctacua

SEQ ID NO: 5091 - DNA, 22 bp, Artificial Sequence
  Synthetic
ggctgcuccactaatctcucag

SEQ ID NO: 5092 - DNA, 30 bp, Artificial Sequence
  Synthetic
cctatgagggaaagugatacuagacaagaa

SEQ ID NO: 5093 - DNA, 25 bp, Artificial Sequence
  Synthetic
gctcaacagauggtatgtgttcuct

SEQ ID NO: 5094 - DNA, 22 bp, Artificial Sequence
  Synthetic
gaggctgacacuagagaagcug

SEQ ID NO: 5095 - DNA, 23 bp, Artificial Sequence
  Synthetic
tcccatcugtccttguaaccaga

SEQ ID NO: 5096 - DNA, 26 bp, Artificial Sequence
  Synthetic
catgggatcuttacatggtctuggaa

SEQ ID NO: 5097 - DNA, 21 bp, Artificial Sequence
  Synthetic
cucaatccuggcaagaccagt

SEQ ID NO: 5098 - DNA, 24 bp, Artificial Sequence
  Synthetic
ctgggtgaucagagcaatgtuaca

SEQ ID NO: 5099 - DNA, 22 bp, Artificial Sequence
  Synthetic
gtttgtgctuggtcccaactuc

SEQ ID NO: 5100 - DNA, 26 bp, Artificial Sequence
  Synthetic
gcaggcattttaugggaagctttcua

SEQ ID NO: 5101 - DNA, 23 bp, Artificial Sequence
  Synthetic
ccaaagttugctttgtggcucag

SEQ ID NO: 5102 - DNA, 21 bp, Artificial Sequence
  Synthetic
cctccgccagguctttaguag

SEQ ID NO: 5103 - DNA, 23 bp, Artificial Sequence
  Synthetic
ccccgtgacaucttccagtttut

SEQ ID NO: 5104 - DNA, 22 bp, Artificial Sequence
  Synthetic
cgtcatctugaactccccgtug

SEQ ID NO: 5105 - DNA, 22 bp, Artificial Sequence
  Synthetic
ctgtgcucactggagtttucct

SEQ ID NO: 5106 - DNA, 28 bp, Artificial Sequence
  Synthetic
gcaaaatcacagautaaccacagaaaut

SEQ ID NO: 5107 - DNA, 17 bp, Artificial Sequence
  Synthetic
tcagccuggaccgguca

SEQ ID NO: 5108 - DNA, 21 bp, Artificial Sequence
  Synthetic
ctctggaagucgtccttgguc

SEQ ID NO: 5109 - DNA, 22 bp, Artificial Sequence
  Synthetic
tgaatgtgtucccaccccttuc

SEQ ID NO: 5110 - DNA, 20 bp, Artificial Sequence
  Synthetic
cgtgggcucatctuggaagt

SEQ ID NO: 5111 - DNA, 29 bp, Artificial Sequence
  Synthetic
tcttgaattatgtguttctttgggcatuc

SEQ ID NO: 5112 - DNA, 20 bp, Artificial Sequence
  Synthetic
ggtccgggacaguctgaauc

SEQ ID NO: 5113 - DNA, 23 bp, Artificial Sequence
  Synthetic
attggtgaatugtgtcctgucct

SEQ ID NO: 5114 - DNA, 21 bp, Artificial Sequence
  Synthetic
gtaagggcagugggacttuga

SEQ ID NO: 5115 - DNA, 20 bp, Artificial Sequence
  Synthetic
gtgctttugcctcctugcag

SEQ ID NO: 5116 - DNA, 19 bp, Artificial Sequence
  Synthetic
tgugacccccaaagccauc

SEQ ID NO: 5117 - DNA, 20 bp, Artificial Sequence
  Synthetic
tgcatugcggcctatctgua

SEQ ID NO: 5118 - DNA, 28 bp, Artificial Sequence
  Synthetic
aaaggtgctatcautcagatgacttugt

SEQ ID NO: 5119 - DNA, 22 bp, Artificial Sequence
  Synthetic
actgctcaucaatgacctgcug

SEQ ID NO: 5120 - DNA, 20 bp, Artificial Sequence
  Synthetic
ctgccagacugcaaggagua

SEQ ID NO: 5121 - DNA, 21 bp, Artificial Sequence
  Synthetic
cacatgggcaugttcacugag

SEQ ID NO: 5122 - DNA, 19 bp, Artificial Sequence
  Synthetic
cactctgccguctgcagut

SEQ ID NO: 5123 - DNA, 20 bp, Artificial Sequence
  Synthetic
ggctgccaagcugctctaua

SEQ ID NO: 5124 - DNA, 24 bp, Artificial Sequence
  Synthetic
ctctatataggacucacggcccut

SEQ ID NO: 5125 - DNA, 24 bp, Artificial Sequence
  Synthetic
ctgagaacagaaugggaggaatug

SEQ ID NO: 5126 - DNA, 18 bp, Artificial Sequence
  Synthetic
cgatgcucgcgatgucca

SEQ ID NO: 5127 - DNA, 20 bp, Artificial Sequence
  Synthetic
ggtttgugcagccttcgtuc

SEQ ID NO: 5128 - DNA, 24 bp, Artificial Sequence
  Synthetic
gtcaattagcugtctcctggaugg

SEQ ID NO: 5129 - DNA, 23 bp, Artificial Sequence
  Synthetic
tcacacacaugagtgtgctcaut

SEQ ID NO: 5130 - DNA, 31 bp, Artificial Sequence
  Synthetic
gaatuagacagaaacaauaacagacacuaga

SEQ ID NO: 5131 - DNA, 28 bp, Artificial Sequence
  Synthetic
gtggattgttcugaggaagtgatuaaac

SEQ ID NO: 5132 - DNA, 19 bp, Artificial Sequence
  Synthetic
aucagcaagggcagcucat

SEQ ID NO: 5133 - DNA, 26 bp, Artificial Sequence
  Synthetic
caagacccagaugtgcatctgaaaua

SEQ ID NO: 5134 - DNA, 23 bp, Artificial Sequence
  Synthetic
gggagcaugtgacattaatugca

SEQ ID NO: 5135 - DNA, 20 bp, Artificial Sequence
  Synthetic
agcaagcacuggagcacuac

SEQ ID NO: 5136 - DNA, 20 bp, Artificial Sequence
  Synthetic
tgtccaaaacugccuacgct

SEQ ID NO: 5137 - DNA, 22 bp, Artificial Sequence
  Synthetic
gattggtgcucccttgcttcua

SEQ ID NO: 5138 - DNA, 19 bp, Artificial Sequence
  Synthetic
caucgagcaggagcuggag

SEQ ID NO: 5139 - DNA, 17 bp, Artificial Sequence
  Synthetic
ccatcgcugccggucat

SEQ ID NO: 5140 - DNA, 19 bp, Artificial Sequence
  Synthetic
ccaggccaugcagauggag

SEQ ID NO: 5141 - DNA, 22 bp, Artificial Sequence
  Synthetic
cgatcaggutgtcctucaggaa

SEQ ID NO: 5142 - DNA, 22 bp, Artificial Sequence
  Synthetic
tccaaugagaacctcaccucca

SEQ ID NO: 5143 - DNA, 20 bp, Artificial Sequence
  Synthetic
ctgucgaaggactgtugcga

SEQ ID NO: 5144 - DNA, 20 bp, Artificial Sequence
  Synthetic
caagatgggcugcccuacat

SEQ ID NO: 5145 - DNA, 18 bp, Artificial Sequence
  Synthetic
cgctucagggagccucac

SEQ ID NO: 5146 - DNA, 21 bp, Artificial Sequence
  Synthetic
gcacctgucccactctctcut

SEQ ID NO: 5147 - DNA, 22 bp, Artificial Sequence
  Synthetic
ctgaacggcaucaaggcatuac

SEQ ID NO: 5148 - DNA, 17 bp, Artificial Sequence
  Synthetic
accccagccutcccugt

SEQ ID NO: 5149 - DNA, 18 bp, Artificial Sequence
  Synthetic
gggccacaucgtcacuca

SEQ ID NO: 5150 - DNA, 18 bp, Artificial Sequence
  Synthetic
guggcatcuccccacaga

SEQ ID NO: 5151 - DNA, 17 bp, Artificial Sequence
  Synthetic
cgctcaccutgccgtug

SEQ ID NO: 5152 - DNA, 24 bp, Artificial Sequence
  Synthetic
gatgtggaaaagaccugtgaccut

SEQ ID NO: 5153 - DNA, 22 bp, Artificial Sequence
  Synthetic
gcccttguggaatcagttccuc

SEQ ID NO: 5154 - DNA, 22 bp, Artificial Sequence
  Synthetic
gggctgutaggacacugagaac

SEQ ID NO: 5155 - DNA, 17 bp, Artificial Sequence
  Synthetic
ggaugtccguggccaca

SEQ ID NO: 5156 - DNA, 21 bp, Artificial Sequence
  Synthetic
cgttgugaccccaaggaguaa

SEQ ID NO: 5157 - DNA, 19 bp, Artificial Sequence
  Synthetic
catgggagagcugggcuac

SEQ ID NO: 5158 - DNA, 23 bp, Artificial Sequence
  Synthetic
atcctgttcuccaccgaagtcua

SEQ ID NO: 5159 - DNA, 17 bp, Artificial Sequence
  Synthetic
ggctttgggucgctguc

SEQ ID NO: 5160 - DNA, 25 bp, Artificial Sequence
  Synthetic
accacagcacauacacatttuagca

SEQ ID NO: 5161 - DNA, 24 bp, Artificial Sequence
  Synthetic
tcacugaaggatcagaucaccagt

SEQ ID NO: 5162 - DNA, 30 bp, Artificial Sequence
  Synthetic
aaaagtttcugaacaagaatcuacaggaat

SEQ ID NO: 5163 - DNA, 22 bp, Artificial Sequence
  Synthetic
gtcatgccugcctttctgtgua

SEQ ID NO: 5164 - DNA, 26 bp, Artificial Sequence
  Synthetic
gcaaacttcctuttgctgatgatcut

SEQ ID NO: 5165 - DNA, 25 bp, Artificial Sequence
  Synthetic
cuaatacttgaaguggacccaggag

SEQ ID NO: 5166 - DNA, 22 bp, Artificial Sequence
  Synthetic
cggcgtttucctttcccuacaa

SEQ ID NO: 5167 - DNA, 30 bp, Artificial Sequence
  Synthetic
attttcccactauaaatctctgctatucaa

SEQ ID NO: 5168 - DNA, 22 bp, Artificial Sequence
  Synthetic
tcaggttcutggtccucaggaa

SEQ ID NO: 5169 - DNA, 20 bp, Artificial Sequence
  Synthetic
caaggctccucctcacaguc

SEQ ID NO: 5170 - DNA, 27 bp, Artificial Sequence
  Synthetic
aggaatgttttugattttggttcucca

SEQ ID NO: 5171 - DNA, 22 bp, Artificial Sequence
  Synthetic
gacatcagugggctgtccauag

SEQ ID NO: 5172 - DNA, 22 bp, Artificial Sequence
  Synthetic
ggcactggugcttatgauacca

SEQ ID NO: 5173 - DNA, 22 bp, Artificial Sequence
  Synthetic
agacugacgcatuaaggacacc

SEQ ID NO: 5174 - DNA, 22 bp, Artificial Sequence
  Synthetic
ctgtgtcacauggtgtgaaugt

SEQ ID NO: 5175 - DNA, 25 bp, Artificial Sequence
  Synthetic
tctgatcataacuagtcggctgugt

SEQ ID NO: 5176 - DNA, 21 bp, Artificial Sequence
  Synthetic
gcatgaguggccctgauaacc

SEQ ID NO: 5177 - DNA, 25 bp, Artificial Sequence
  Synthetic
agtcccttctutccactgaaaaucc

SEQ ID NO: 5178 - DNA, 18 bp, Artificial Sequence
  Synthetic
gccagugcccttctuccc

SEQ ID NO: 5179 - DNA, 24 bp, Artificial Sequence
  Synthetic
actcaaaaactuaccaccaggcut

SEQ ID NO: 5180 - DNA, 28 bp, Artificial Sequence
  Synthetic
atgtgagaaatuggtacttttccuggat

SEQ ID NO: 5181 - DNA, 22 bp, Artificial Sequence
  Synthetic
tgggctttccugtttccttguc

SEQ ID NO: 5182 - DNA, 28 bp, Artificial Sequence
  Synthetic
atgatttgctgtutcttgttgttctugt

SEQ ID NO: 5183 - DNA, 20 bp, Artificial Sequence
  Synthetic
tggacguttcctccuccaga

SEQ ID NO: 5184 - DNA, 17 bp, Artificial Sequence
  Synthetic
gagguggcttccguggt

SEQ ID NO: 5185 - DNA, 20 bp, Artificial Sequence
  Synthetic
agcugctttucaccagcact

SEQ ID NO: 5186 - DNA, 26 bp, Artificial Sequence
  Synthetic
aattaaaaauggccgagaatgtggug

SEQ ID NO: 5187 - DNA, 22 bp, Artificial Sequence
  Synthetic
aagaauaaaggcgcaccgagua

SEQ ID NO: 5188 - DNA, 22 bp, Artificial Sequence
  Synthetic
tggucaaaagcccaaugacaca

SEQ ID NO: 5189 - DNA, 21 bp, Artificial Sequence
  Synthetic
aggattcaugcccgcatucat

SEQ ID NO: 5190 - DNA, 27 bp, Artificial Sequence
  Synthetic
accccaatcctuatggttcaccataua

SEQ ID NO: 5191 - DNA, 23 bp, Artificial Sequence
  Synthetic
agtactcaccaugttgggcatuc

SEQ ID NO: 5192 - DNA, 23 bp, Artificial Sequence
  Synthetic
cactgucgcacaatgaagaaugt

SEQ ID NO: 5193 - DNA, 23 bp, Artificial Sequence
  Synthetic
cattttcctucttctcccuggct

SEQ ID NO: 5194 - DNA, 21 bp, Artificial Sequence
  Synthetic
cccccaaccuaagcactgtua

SEQ ID NO: 5195 - DNA, 24 bp, Artificial Sequence
  Synthetic
ctgattctgcuggttctttgctug

SEQ ID NO: 5196 - DNA, 21 bp, Artificial Sequence
  Synthetic
cctaugccaacagcagcucaa

SEQ ID NO: 5197 - DNA, 25 bp, Artificial Sequence
  Synthetic
cccaggagautgaaaacatgtugac

SEQ ID NO: 5198 - DNA, 29 bp, Artificial Sequence
  Synthetic
actaccaccttcuagctgagaaaatcuat

SEQ ID NO: 5199 - DNA, 17 bp, Artificial Sequence
  Synthetic
ttgcggcugtcccaugt

SEQ ID NO: 5200 - DNA, 19 bp, Artificial Sequence
  Synthetic
cccagcccccuattguacc

SEQ ID NO: 5201 - DNA, 26 bp, Artificial Sequence
  Synthetic
tcaaaauaccagguaaaggccaaaga

SEQ ID NO: 5202 - DNA, 21 bp, Artificial Sequence
  Synthetic
cacattcacugtccccagcut

SEQ ID NO: 5203 - DNA, 21 bp, Artificial Sequence
  Synthetic
gaattgttgutgctgguggct

SEQ ID NO: 5204 - DNA, 20 bp, Artificial Sequence
  Synthetic
ctgcgtgugtctcaccuact

SEQ ID NO: 5205 - DNA, 24 bp, Artificial Sequence
  Synthetic
cattttggccuccatcttcactuc

SEQ ID NO: 5206 - DNA, 28 bp, Artificial Sequence
  Synthetic
attgattcttgagaugcttttagagcut

SEQ ID NO: 5207 - DNA, 21 bp, Artificial Sequence
  Synthetic
tgacgguaaagtgccuccaaa

SEQ ID NO: 5208 - DNA, 23 bp, Artificial Sequence
  Synthetic
aaatugacccagtgaugcaaagc

SEQ ID NO: 5209 - DNA, 25 bp, Artificial Sequence
  Synthetic
gucaaagccagaaguaggatatuct

SEQ ID NO: 5210 - DNA, 27 bp, Artificial Sequence
  Synthetic
gcaagttttcauttggttaaggttugg

SEQ ID NO: 5211 - DNA, 24 bp, Artificial Sequence
  Synthetic
acaacgutaagactuacccagcag

SEQ ID NO: 5212 - DNA, 26 bp, Artificial Sequence
  Synthetic
gtggatccaaaautgctcatacaugg

SEQ ID NO: 5213 - DNA, 27 bp, Artificial Sequence
  Synthetic
accaucaatttctucaaaggcaaagag

SEQ ID NO: 5214 - DNA, 29 bp, Artificial Sequence
  Synthetic
tggtatctataucaactccaacttguggt

SEQ ID NO: 5215 - DNA, 28 bp, Artificial Sequence
  Synthetic
ggaggatggcaauggaagatataaucat

SEQ ID NO: 5216 - DNA, 25 bp, Artificial Sequence
  Synthetic
cautaaggaacuggaacaggaggaa

SEQ ID NO: 5217 - DNA, 30 bp, Artificial Sequence
  Synthetic
agtgcacttcuggattaaatattagaauca

SEQ ID NO: 5218 - DNA, 21 bp, Artificial Sequence
  Synthetic
gatctgauggatggucgggat

SEQ ID NO: 5219 - DNA, 23 bp, Artificial Sequence
  Synthetic
ccacatggugcttgcattcatug

SEQ ID NO: 5220 - DNA, 19 bp, Artificial Sequence
  Synthetic
tgctugccagtgucggaat

SEQ ID NO: 5221 - DNA, 20 bp, Artificial Sequence
  Synthetic
tgttctccuggcagtgctug

SEQ ID NO: 5222 - DNA, 23 bp, Artificial Sequence
  Synthetic
ccaatagcaugccaccctactug

SEQ ID NO: 5223 - DNA, 22 bp, Artificial Sequence
  Synthetic
cgctgctcuctgaatctgcaut

SEQ ID NO: 5224 - DNA, 21 bp, Artificial Sequence
  Synthetic
ggtaucagcccacucaaacca

SEQ ID NO: 5225 - DNA, 22 bp, Artificial Sequence
  Synthetic
gcutgatgaaugcagccaacag

SEQ ID NO: 5226 - DNA, 21 bp, Artificial Sequence
  Synthetic
ccaggcucagcagaugaacat

SEQ ID NO: 5227 - DNA, 23 bp, Artificial Sequence
  Synthetic
gttgctggaacuggttatggtug

SEQ ID NO: 5228 - DNA, 21 bp, Artificial Sequence
  Synthetic
ggccagcagauccctaatuct

SEQ ID NO: 5229 - DNA, 21 bp, Artificial Sequence
  Synthetic
ggaaacguggtguggagaagg

SEQ ID NO: 5230 - DNA, 28 bp, Artificial Sequence
  Synthetic
ccgtgtccctacuccagaattgataaua

SEQ ID NO: 5231 - DNA, 20 bp, Artificial Sequence
  Synthetic
ctcagcccacucactauggg

SEQ ID NO: 5232 - DNA, 27 bp, Artificial Sequence
  Synthetic
tgactctggcacugatagtgatatuga

SEQ ID NO: 5233 - DNA, 20 bp, Artificial Sequence
  Synthetic
ggcctatgautggcctgcut

SEQ ID NO: 5234 - DNA, 23 bp, Artificial Sequence
  Synthetic
caggccttgguagaatcgacuat

SEQ ID NO: 5235 - DNA, 24 bp, Artificial Sequence
  Synthetic
gggaaggcaagugtgaagagaauc

SEQ ID NO: 5236 - DNA, 22 bp, Artificial Sequence
  Synthetic
tgcaucaggcaggtacttugat

SEQ ID NO: 5237 - DNA, 20 bp, Artificial Sequence
  Synthetic
gggtaucagggacctcucag

SEQ ID NO: 5238 - DNA, 25 bp, Artificial Sequence
  Synthetic
agctcccaauacaacaactgttuct

SEQ ID NO: 5239 - DNA, 22 bp, Artificial Sequence
  Synthetic
aactctccaccuggagaugact

SEQ ID NO: 5240 - DNA, 24 bp, Artificial Sequence
  Synthetic
gatgguagcccaggttcatatugg

SEQ ID NO: 5241 - DNA, 23 bp, Artificial Sequence
  Synthetic
ccttgccagaugatgaugacgag

SEQ ID NO: 5242 - DNA, 23 bp, Artificial Sequence
  Synthetic
tgctactaccutctcccctgtut

SEQ ID NO: 5243 - DNA, 22 bp, Artificial Sequence
  Synthetic
ctccaauaccagaaccutcucc

SEQ ID NO: 5244 - DNA, 23 bp, Artificial Sequence
  Synthetic
aaacttcucagccacagcttuct

SEQ ID NO: 5245 - DNA, 22 bp, Artificial Sequence
  Synthetic
gtcagugaaggaactggctuct

SEQ ID NO: 5246 - DNA, 22 bp, Artificial Sequence
  Synthetic
tgccttgttcutggctccttut

SEQ ID NO: 5247 - DNA, 21 bp, Artificial Sequence
  Synthetic
cagctggacguacctcagtug

SEQ ID NO: 5248 - DNA, 21 bp, Artificial Sequence
  Synthetic
cacactaggcucagccaucag

SEQ ID NO: 5249 - DNA, 21 bp, Artificial Sequence
  Synthetic
cactuccaacccaggtggtut

SEQ ID NO: 5250 - DNA, 18 bp, Artificial Sequence
  Synthetic
gggttggucggacggtug

SEQ ID NO: 5251 - DNA, 22 bp, Artificial Sequence
  Synthetic
ccttcacttugcaggcctctut

SEQ ID NO: 5252 - DNA, 21 bp, Artificial Sequence
  Synthetic
cccaautccagacucgcagat

SEQ ID NO: 5253 - DNA, 19 bp, Artificial Sequence
  Synthetic
ctgtggccuctgccaguac

SEQ ID NO: 5254 - DNA, 24 bp, Artificial Sequence
  Synthetic
catgtcaggcutgtttttctgcut

SEQ ID NO: 5255 - DNA, 24 bp, Artificial Sequence
  Synthetic
catctatctgugggagttccucct

SEQ ID NO: 5256 - DNA, 21 bp, Artificial Sequence
  Synthetic
ccctcctggucactagtguca

SEQ ID NO: 5257 - DNA, 22 bp, Artificial Sequence
  Synthetic
cccaccucaggtctttcttcut

SEQ ID NO: 5258 - DNA, 23 bp, Artificial Sequence
  Synthetic
gctaactgugctctgttctcugg

SEQ ID NO: 5259 - DNA, 24 bp, Artificial Sequence
  Synthetic
cgttgucagctctcugaaaagaca

SEQ ID NO: 5260 - DNA, 18 bp, Artificial Sequence
  Synthetic
ccgcugggaaaggagcug

SEQ ID NO: 5261 - DNA, 23 bp, Artificial Sequence
  Synthetic
ctccgugaggttattgtucaggg

SEQ ID NO: 5262 - DNA, 17 bp, Artificial Sequence
  Synthetic
cgcctccucgtcgtcut

SEQ ID NO: 5263 - DNA, 17 bp, Artificial Sequence
  Synthetic
gguagccctgguagccc

SEQ ID NO: 5264 - DNA, 25 bp, Artificial Sequence
  Synthetic
gggutatatattcaguggccagagg

SEQ ID NO: 5265 - DNA, 19 bp, Artificial Sequence
  Synthetic
cctgacggagguccctgut

SEQ ID NO: 5266 - DNA, 21 bp, Artificial Sequence
  Synthetic
caaagtccucacccucagcag

SEQ ID NO: 5267 - DNA, 19 bp, Artificial Sequence
  Synthetic
ctgatguggaggcugggat

SEQ ID NO: 5268 - DNA, 22 bp, Artificial Sequence
  Synthetic
ccctcaaugacctccaguaagg

SEQ ID NO: 5269 - DNA, 28 bp, Artificial Sequence
  Synthetic
aactaactagttugcattggtttccuct

SEQ ID NO: 5270 - DNA, 26 bp, Artificial Sequence
  Synthetic
gcttatgtugttctttgtcuggagca

SEQ ID NO: 5271 - DNA, 20 bp, Artificial Sequence
  Synthetic
aaatgtcugccctagcuccc

SEQ ID NO: 5272 - DNA, 21 bp, Artificial Sequence
  Synthetic
gctggaggcauaaaccccaug

SEQ ID NO: 5273 - DNA, 20 bp, Artificial Sequence
  Synthetic
acatcccugacccaaccuga

SEQ ID NO: 5274 - DNA, 26 bp, Artificial Sequence
  Synthetic
ggatttctucaagagtcacaucacag

SEQ ID NO: 5275 - DNA, 25 bp, Artificial Sequence
  Synthetic
cccatctgccutgttgttcatttug

SEQ ID NO: 5276 - DNA, 20 bp, Artificial Sequence
  Synthetic
caggcgggagauataccucg

SEQ ID NO: 5277 - DNA, 26 bp, Artificial Sequence
  Synthetic
atcttgcatucaaaggcauagagaca

SEQ ID NO: 5278 - DNA, 25 bp, Artificial Sequence
  Synthetic
cgtgtccuttgttatatuggaggaa

SEQ ID NO: 5279 - DNA, 22 bp, Artificial Sequence
  Synthetic
ctgatacccaggguttggaguc

SEQ ID NO: 5280 - DNA, 21 bp, Artificial Sequence
  Synthetic
ccagcacccugaagctauagt

SEQ ID NO: 5281 - DNA, 23 bp, Artificial Sequence
  Synthetic
aggagaatacauccccgagtcug

SEQ ID NO: 5282 - DNA, 20 bp, Artificial Sequence
  Synthetic
tgtacagcgugccauacagc

SEQ ID NO: 5283 - DNA, 23 bp, Artificial Sequence
  Synthetic
ggataggcatugccatactggut

SEQ ID NO: 5284 - DNA, 22 bp, Artificial Sequence
  Synthetic
gcgugaaccgaacagaugaaat

SEQ ID NO: 5285 - DNA, 21 bp, Artificial Sequence
  Synthetic
gtgattcugcatgcttggugg

SEQ ID NO: 5286 - DNA, 20 bp, Artificial Sequence
  Synthetic
tgggctuggtggauagacga

SEQ ID NO: 5287 - DNA, 27 bp, Artificial Sequence
  Synthetic
catcatacagcaggaugttgatgguat

SEQ ID NO: 5288 - DNA, 22 bp, Artificial Sequence
  Synthetic
cagagaacgcuactggatccug

SEQ ID NO: 5289 - DNA, 22 bp, Artificial Sequence
  Synthetic
ttgtccttgccugaaaaggcua

SEQ ID NO: 5290 - DNA, 21 bp, Artificial Sequence
  Synthetic
ccucggaagcatgugacaaca

SEQ ID NO: 5291 - DNA, 23 bp, Artificial Sequence
  Synthetic
tgatggccuctgaactctuagct

SEQ ID NO: 5292 - DNA, 20 bp, Artificial Sequence
  Synthetic
tgaucctgcugcaccacaag

SEQ ID NO: 5293 - DNA, 21 bp, Artificial Sequence
  Synthetic
ccgagatgtuggcgagtguaa

SEQ ID NO: 5294 - DNA, 25 bp, Artificial Sequence
  Synthetic
agaagttgtauagcactatggugcg

SEQ ID NO: 5295 - DNA, 20 bp, Artificial Sequence
  Synthetic
ttgccgatacugcccttcug

SEQ ID NO: 5296 - DNA, 25 bp, Artificial Sequence
  Synthetic
gtactgttttugattggccagucat

SEQ ID NO: 5297 - DNA, 18 bp, Artificial Sequence
  Synthetic
gcuggacagcacagggua

SEQ ID NO: 5298 - DNA, 26 bp, Artificial Sequence
  Synthetic
ggagactgcuacttagaggtgcuaat

SEQ ID NO: 5299 - DNA, 27 bp, Artificial Sequence
  Synthetic
ggttcccttcautatcctcgatgtuaa

SEQ ID NO: 5300 - DNA, 28 bp, Artificial Sequence
  Synthetic
ttgtcacattuacaggaatcucaaacct

SEQ ID NO: 5301 - DNA, 27 bp, Artificial Sequence
  Synthetic
gcactcagcaaauctgagataucagaa

SEQ ID NO: 5302 - DNA, 25 bp, Artificial Sequence
  Synthetic
gcttggatcagccuctttattggua

SEQ ID NO: 5303 - DNA, 26 bp, Artificial Sequence
  Synthetic
atccagggaaaagauccaucaacaaa

SEQ ID NO: 5304 - DNA, 27 bp, Artificial Sequence
  Synthetic
gttcttttgguggaaacacagtatgut

SEQ ID NO: 5305 - DNA, 23 bp, Artificial Sequence
  Synthetic
catttuagccacagaccccttug

SEQ ID NO: 5306 - DNA, 25 bp, Artificial Sequence
  Synthetic
gggcttcaguttcagacctaaauaa

SEQ ID NO: 5307 - DNA, 27 bp, Artificial Sequence
  Synthetic
ttatcacaggtgaucctttcaaggaug

SEQ ID NO: 5308 - DNA, 22 bp, Artificial Sequence
  Synthetic
gatgaggcaaggccaugtatut

SEQ ID NO: 5309 - DNA, 26 bp, Artificial Sequence
  Synthetic
gccaacctuaatgaacatgtugaagg

SEQ ID NO: 5310 - DNA, 23 bp, Artificial Sequence
  Synthetic
cactctccuccaattctgctgut

SEQ ID NO: 5311 - DNA, 31 bp, Artificial Sequence
  Synthetic
tcttttaatccccauttcttctcattcacut

SEQ ID NO: 5312 - DNA, 26 bp, Artificial Sequence
  Synthetic
gaagaccagcaaacaaugcaagaaua

SEQ ID NO: 5313 - DNA, 26 bp, Artificial Sequence
  Synthetic
gagggtagaaaaauctgcccttcaut

SEQ ID NO: 5314 - DNA, 25 bp, Artificial Sequence
  Synthetic
acugattaagugaaaagccaaggca

SEQ ID NO: 5315 - DNA, 27 bp, Artificial Sequence
  Synthetic
aaagctgcataguggtactttttcuct

SEQ ID NO: 5316 - DNA, 28 bp, Artificial Sequence
  Synthetic
ggatgaacuaaaagaggaaattugcaca

SEQ ID NO: 5317 - DNA, 27 bp, Artificial Sequence
  Synthetic
gagttgagtgauattgaccatgaugga

SEQ ID NO: 5318 - DNA, 28 bp, Artificial Sequence
  Synthetic
gguagagagagagtagauaggaagcaat

SEQ ID NO: 5319 - DNA, 30 bp, Artificial Sequence
  Synthetic
tcaactcttgttgugctttactttcttcua

SEQ ID NO: 5320 - DNA, 27 bp, Artificial Sequence
  Synthetic
gatggcatctutctaaatttgcaucca

SEQ ID NO: 5321 - DNA, 23 bp, Artificial Sequence
  Synthetic
gatgctgcugctttccugaaaaa

SEQ ID NO: 5322 - DNA, 25 bp, Artificial Sequence
  Synthetic
ggcaataaagugtcattgtcgugaa

SEQ ID NO: 5323 - DNA, 24 bp, Artificial Sequence
  Synthetic
tcutcaactacactucccagacct

SEQ ID NO: 5324 - DNA, 29 bp, Artificial Sequence
  Synthetic
agtttcagcactucatctgtaatcttcug

SEQ ID NO: 5325 - DNA, 28 bp, Artificial Sequence
  Synthetic
aaaagggcuggaaaattgttagacuact

SEQ ID NO: 5326 - DNA, 23 bp, Artificial Sequence
  Synthetic
acgtccttcutcacttcagugag

SEQ ID NO: 5327 - DNA, 21 bp, Artificial Sequence
  Synthetic
cctccuctccttctuccccat

SEQ ID NO: 5328 - DNA, 19 bp, Artificial Sequence
  Synthetic
gaaucgcgctgtugccaaa

SEQ ID NO: 5329 - DNA, 23 bp, Artificial Sequence
  Synthetic
caatgtatcagucccactgcuga

SEQ ID NO: 5330 - DNA, 23 bp, Artificial Sequence
  Synthetic
ggaatagaggucccccauggaat

SEQ ID NO: 5331 - DNA, 20 bp, Artificial Sequence
  Synthetic
cctgaaccugaccgctgauc

SEQ ID NO: 5332 - DNA, 26 bp, Artificial Sequence
  Synthetic
acagttctttugcacgtttcaacaut

SEQ ID NO: 5333 - DNA, 20 bp, Artificial Sequence
  Synthetic
gcagcucagauggagaaggg

SEQ ID NO: 5334 - DNA, 20 bp, Artificial Sequence
  Synthetic
gtcugaggagacccuccgaa

SEQ ID NO: 5335 - DNA, 23 bp, Artificial Sequence
  Synthetic
ctccacacagaugagctttcuct

SEQ ID NO: 5336 - DNA, 20 bp, Artificial Sequence
  Synthetic
gaagatgauggcgccacuct

SEQ ID NO: 5337 - DNA, 22 bp, Artificial Sequence
  Synthetic
acctcgcucagcactucaaaat

SEQ ID NO: 5338 - DNA, 23 bp, Artificial Sequence
  Synthetic
ggaaatctacuacccagggucac

SEQ ID NO: 5339 - DNA, 28 bp, Artificial Sequence
  Synthetic
gcatcgtucccaaucattctcatattua

SEQ ID NO: 5340 - DNA, 21 bp, Artificial Sequence
  Synthetic
gctcagaagguccatggauga

SEQ ID NO: 5341 - DNA, 23 bp, Artificial Sequence
  Synthetic
aggaagtcagutcttgtgacuct

SEQ ID NO: 5342 - DNA, 22 bp, Artificial Sequence
  Synthetic
cagtgatguccccatcuggaaa

SEQ ID NO: 5343 - DNA, 20 bp, Artificial Sequence
  Synthetic
ccattctucagccccaugct

SEQ ID NO: 5344 - DNA, 23 bp, Artificial Sequence
  Synthetic
cacataaagucccaggatuccca

SEQ ID NO: 5345 - DNA, 21 bp, Artificial Sequence
  Synthetic
tggagtctuctgagcaggugt

SEQ ID NO: 5346 - DNA, 29 bp, Artificial Sequence
  Synthetic
attgcccttcugttcagtttactaaugat

SEQ ID NO: 5347 - DNA, 22 bp, Artificial Sequence
  Synthetic
gagttggcugcagtctggtaut

SEQ ID NO: 5348 - DNA, 21 bp, Artificial Sequence
  Synthetic
cactgggagagaaucccgaug

SEQ ID NO: 5349 - DNA, 21 bp, Artificial Sequence
  Synthetic
cccactttgugctcctgugaa

SEQ ID NO: 5350 - DNA, 22 bp, Artificial Sequence
  Synthetic
cgaccaccutgaccataugact

SEQ ID NO: 5351 - DNA, 22 bp, Artificial Sequence
  Synthetic
gctgatggaccaucatgtccug

SEQ ID NO: 5352 - DNA, 25 bp, Artificial Sequence
  Synthetic
agatgatgugccaaaaaucccagat

SEQ ID NO: 5353 - DNA, 21 bp, Artificial Sequence
  Synthetic
ggagacccagcugtttctcug

SEQ ID NO: 5354 - DNA, 23 bp, Artificial Sequence
  Synthetic
caacatgggauccaactcucaga

SEQ ID NO: 5355 - DNA, 20 bp, Artificial Sequence
  Synthetic
gtgctcaccaaauggcagug

SEQ ID NO: 5356 - DNA, 18 bp, Artificial Sequence
  Synthetic
gtcucccacgaugcacca

SEQ ID NO: 5357 - DNA, 19 bp, Artificial Sequence
  Synthetic
guggacaggugaagcagca

SEQ ID NO: 5358 - DNA, 23 bp, Artificial Sequence
  Synthetic
ccctggaagucttccctctagua

SEQ ID NO: 5359 - DNA, 22 bp, Artificial Sequence
  Synthetic
gagcuggccacagtcttgauag

SEQ ID NO: 5360 - DNA, 26 bp, Artificial Sequence
  Synthetic
ggcttgatgucacacaatcctaucat

SEQ ID NO: 5361 - DNA, 22 bp, Artificial Sequence
  Synthetic
ccattgugagggaauggaacct

SEQ ID NO: 5362 - DNA, 21 bp, Artificial Sequence
  Synthetic
ggaagtuccaggccguaaaca

SEQ ID NO: 5363 - DNA, 20 bp, Artificial Sequence
  Synthetic
tggcatggauggagctguac

SEQ ID NO: 5364 - DNA, 23 bp, Artificial Sequence
  Synthetic
ccccaacagaacaucatgauccc

SEQ ID NO: 5365 - DNA, 23 bp, Artificial Sequence
  Synthetic
tcatttugacaaggaucggcaca

SEQ ID NO: 5366 - DNA, 23 bp, Artificial Sequence
  Synthetic
accctttctcucccagcttcuaa

SEQ ID NO: 5367 - DNA, 25 bp, Artificial Sequence
  Synthetic
gcctcatcaucgttcaagttcuagt

SEQ ID NO: 5368 - DNA, 29 bp, Artificial Sequence
  Synthetic
aaaataauacacagggaauacacagauga

SEQ ID NO: 5369 - DNA, 23 bp, Artificial Sequence
  Synthetic
tgtaaccatugtccagccaucag

SEQ ID NO: 5370 - DNA, 30 bp, Artificial Sequence
  Synthetic
cgcattgatgtugtgatagatttcugaaaa

SEQ ID NO: 5371 - DNA, 28 bp, Artificial Sequence
  Synthetic
tttatcattgtatuccacaggtggtuca

SEQ ID NO: 5372 - DNA, 27 bp, Artificial Sequence
  Synthetic
acatacttcacautggtgttgguacag

SEQ ID NO: 5373 - DNA, 27 bp, Artificial Sequence
  Synthetic
tcagguagtgaaatuaaaaggccaagt

SEQ ID NO: 5374 - DNA, 26 bp, Artificial Sequence
  Synthetic
gaagauctgctctaatugaacgggaa

SEQ ID NO: 5375 - DNA, 23 bp, Artificial Sequence
  Synthetic
ggaggtccccgutaaacctttua

SEQ ID NO: 5376 - DNA, 28 bp, Artificial Sequence
  Synthetic
acaagaaaggacutctcattcattuccc

SEQ ID NO: 5377 - DNA, 22 bp, Artificial Sequence
  Synthetic
atggttuggcagcacactcuat

SEQ ID NO: 5378 - DNA, 20 bp, Artificial Sequence
  Synthetic
tgtgagaaacugccaugcgt

SEQ ID NO: 5379 - DNA, 23 bp, Artificial Sequence
  Synthetic
ggcttctcuttctttccaugcag

SEQ ID NO: 5380 - DNA, 19 bp, Artificial Sequence
  Synthetic
agtccuccgtctccucacc

SEQ ID NO: 5381 - DNA, 20 bp, Artificial Sequence
  Synthetic
gggaguggcctttctttucc

SEQ ID NO: 5382 - DNA, 24 bp, Artificial Sequence
  Synthetic
gagattccaguggaacctgaugac

SEQ ID NO: 5383 - DNA, 19 bp, Artificial Sequence
  Synthetic
gagtgccaucccgactgua

SEQ ID NO: 5384 - DNA, 21 bp, Artificial Sequence
  Synthetic
cttggctgugtttccttugca

SEQ ID NO: 5385 - DNA, 28 bp, Artificial Sequence
  Synthetic
agtggccaatutcccattctaauaaagt

SEQ ID NO: 5386 - DNA, 23 bp, Artificial Sequence
  Synthetic
gaacctaaugccatttcctuccc

SEQ ID NO: 5387 - DNA, 25 bp, Artificial Sequence
  Synthetic
ctgaacatcauccaggtatcugcaa

SEQ ID NO: 5388 - DNA, 24 bp, Artificial Sequence
  Synthetic
cttggtggccaucatctttaucct

SEQ ID NO: 5389 - DNA, 24 bp, Artificial Sequence
  Synthetic
aguggctuaagaaagaaaggagca

SEQ ID NO: 5390 - DNA, 21 bp, Artificial Sequence
  Synthetic
ccactaugcagaggcugacat

SEQ ID NO: 5391 - DNA, 29 bp, Artificial Sequence
  Synthetic
gcttctctttgaaagutaggagtttccug

SEQ ID NO: 5392 - DNA, 27 bp, Artificial Sequence
  Synthetic
gcattcttctcuctcttgattcugact

SEQ ID NO: 5393 - DNA, 25 bp, Artificial Sequence
  Synthetic
atcatacagagagggucatcaguga

SEQ ID NO: 5394 - DNA, 22 bp, Artificial Sequence
  Synthetic
gctgacuttggaaugagcagga

SEQ ID NO: 5395 - DNA, 21 bp, Artificial Sequence
  Synthetic
tcaugcatgugagcccacaag

SEQ ID NO: 5396 - DNA, 27 bp, Artificial Sequence
  Synthetic
gccatttgtccugactctgtgtauaag

SEQ ID NO: 5397 - DNA, 22 bp, Artificial Sequence
  Synthetic
ggtcttguagggaggaccugag

SEQ ID NO: 5398 - DNA, 23 bp, Artificial Sequence
  Synthetic
gctgcugaagaaacctgtagcuc

SEQ ID NO: 5399 - DNA, 21 bp, Artificial Sequence
  Synthetic
ggacaccagcugcttgacuac

SEQ ID NO: 5400 - DNA, 21 bp, Artificial Sequence
  Synthetic
gatgtggacugtcctgcagut

SEQ ID NO: 5401 - DNA, 24 bp, Artificial Sequence
  Synthetic
ctcttatcugagcatcaggucaca

SEQ ID NO: 5402 - DNA, 24 bp, Artificial Sequence
  Synthetic
tctguaatggctagauccccagag

SEQ ID NO: 5403 - DNA, 22 bp, Artificial Sequence
  Synthetic
ggccaaugacatgctuccaaaa

SEQ ID NO: 5404 - DNA, 25 bp, Artificial Sequence
  Synthetic
cattacagaggutcctctgugcaaa

SEQ ID NO: 5405 - DNA, 25 bp, Artificial Sequence
  Synthetic
agaaatggagaaucagccccauaag

SEQ ID NO: 5406 - DNA, 21 bp, Artificial Sequence
  Synthetic
tgtgccccutcaatgttcucc

SEQ ID NO: 5407 - DNA, 27 bp, Artificial Sequence
  Synthetic
gttctttttattgguccccttgtctuc

SEQ ID NO: 5408 - DNA, 26 bp, Artificial Sequence
  Synthetic
aggctgttccautcgatatcctttut

SEQ ID NO: 5409 - DNA, 32 bp, Artificial Sequence
  Synthetic
aataaataaucggagaagaaauactaagugct

SEQ ID NO: 5410 - DNA, 22 bp, Artificial Sequence
  Synthetic
cggttgcatuctcggagguaat

SEQ ID NO: 5411 - DNA, 27 bp, Artificial Sequence
  Synthetic
ttgtcaaattatucttggccaaagugg

SEQ ID NO: 5412 - DNA, 23 bp, Artificial Sequence
  Synthetic
ggacacaccauagactguaggct

SEQ ID NO: 5413 - DNA, 30 bp, Artificial Sequence
  Synthetic
agttgtttagctuttctccttttctuacca

SEQ ID NO: 5414 - DNA, 32 bp, Artificial Sequence
  Synthetic
cattaatgaaaacugaaaagtgaaaggaugct

SEQ ID NO: 5415 - DNA, 21 bp, Artificial Sequence
  Synthetic
agccacugagagtgacccuaa

SEQ ID NO: 5416 - DNA, 23 bp, Artificial Sequence
  Synthetic
ggtgaagatautgaagccgguct

SEQ ID NO: 5417 - DNA, 19 bp, Artificial Sequence
  Synthetic
guacgcgagaguagggaug

SEQ ID NO: 5418 - DNA, 29 bp, Artificial Sequence
  Synthetic
gcctgaagagutgaattagaattgucagt

SEQ ID NO: 5419 - DNA, 17 bp, Artificial Sequence
  Synthetic
agcugcacgucggacat

SEQ ID NO: 5420 - DNA, 24 bp, Artificial Sequence
  Synthetic
cccgagauattgucagcagagaga

SEQ ID NO: 5421 - DNA, 29 bp, Artificial Sequence
  Synthetic
accaattctauaaccacagatuaaacgca

SEQ ID NO: 5422 - DNA, 23 bp, Artificial Sequence
  Synthetic
tttcguagaaacggaaggctuca

SEQ ID NO: 5423 - DNA, 26 bp, Artificial Sequence
  Synthetic
gtgctacucacataaaatcccuggaa

SEQ ID NO: 5424 - DNA, 29 bp, Artificial Sequence
  Synthetic
ctaaagctcaaguttgaaataatcuccgt

SEQ ID NO: 5425 - DNA, 23 bp, Artificial Sequence
  Synthetic
acuggtgatccaucaggcaaaag

SEQ ID NO: 5426 - DNA, 26 bp, Artificial Sequence
  Synthetic
aggtacatgguaaagcataaaucgca

SEQ ID NO: 5427 - DNA, 28 bp, Artificial Sequence
  Synthetic
gaagcacaaagcaucaaataaggtctua

SEQ ID NO: 5428 - DNA, 24 bp, Artificial Sequence
  Synthetic
ctgccttttugcctctttctucat

SEQ ID NO: 5429 - DNA, 21 bp, Artificial Sequence
  Synthetic
cccttgcuctccagtauccac

SEQ ID NO: 5430 - DNA, 25 bp, Artificial Sequence
  Synthetic
gggtaacttucacatgacagucaca

SEQ ID NO: 5431 - DNA, 22 bp, Artificial Sequence
  Synthetic
gtagcttgcucgctctttaugg

SEQ ID NO: 5432 - DNA, 21 bp, Artificial Sequence
  Synthetic
tctgggugagaactcaguggt

SEQ ID NO: 5433 - DNA, 24 bp, Artificial Sequence
  Synthetic
ccaagcttuggagacattggttuc

SEQ ID NO: 5434 - DNA, 21 bp, Artificial Sequence
  Synthetic
caccaggcugaggtggttuat

SEQ ID NO: 5435 - DNA, 30 bp, Artificial Sequence
  Synthetic
gaagtttgtguacaagtttgtctcttaucc

SEQ ID NO: 5436 - DNA, 24 bp, Artificial Sequence
  Synthetic
ttctgccugcaaaagcttaaacug

SEQ ID NO: 5437 - DNA, 23 bp, Artificial Sequence
  Synthetic
tcagctcatugctatggacagug

SEQ ID NO: 5438 - DNA, 20 bp, Artificial Sequence
  Synthetic
gcacaacccggguaccttuc

SEQ ID NO: 5439 - DNA, 28 bp, Artificial Sequence
  Synthetic
gcttattcctctuttctcctcttcauct

SEQ ID NO: 5440 - DNA, 22 bp, Artificial Sequence
  Synthetic
ccauggccaccacattcucaaa

SEQ ID NO: 5441 - DNA, 21 bp, Artificial Sequence
  Synthetic
agctgauggctttctctuccg

SEQ ID NO: 5442 - DNA, 22 bp, Artificial Sequence
  Synthetic
cgtacatgatcutcccctggug

SEQ ID NO: 5443 - DNA, 21 bp, Artificial Sequence
  Synthetic
ctccaaguaacggtgctguct

SEQ ID NO: 5444 - DNA, 21 bp, Artificial Sequence
  Synthetic
ccagcuaaggagaccacugga

SEQ ID NO: 5445 - DNA, 18 bp, Artificial Sequence
  Synthetic
ccttcccgcugctgtcua

SEQ ID NO: 5446 - DNA, 20 bp, Artificial Sequence
  Synthetic
gcttctccgcugtgctctuc

SEQ ID NO: 5447 - DNA, 22 bp, Artificial Sequence
  Synthetic
tggagtttccugtcagcctgua

SEQ ID NO: 5448 - DNA, 21 bp, Artificial Sequence
  Synthetic
gccctgggaucaagaacctuc

SEQ ID NO: 5449 - DNA, 22 bp, Artificial Sequence
  Synthetic
gcattgtgucttggtggaugac

SEQ ID NO: 5450 - DNA, 23 bp, Artificial Sequence
  Synthetic
ctggttttctuccacagcatuca

SEQ ID NO: 5451 - DNA, 22 bp, Artificial Sequence
  Synthetic
aaacatgguccccttgagtguc

SEQ ID NO: 5452 - DNA, 17 bp, Artificial Sequence
  Synthetic
gccactcgucccgctug

SEQ ID NO: 5453 - DNA, 21 bp, Artificial Sequence
  Synthetic
cccacccuaatgccctaaugt

SEQ ID NO: 5454 - DNA, 22 bp, Artificial Sequence
  Synthetic
ttttccactgcucttgaggcut

SEQ ID NO: 5455 - DNA, 21 bp, Artificial Sequence
  Synthetic
caggcgccucagagctatuac

SEQ ID NO: 5456 - DNA, 18 bp, Artificial Sequence
  Synthetic
gcagagcugctggtgucc

SEQ ID NO: 5457 - DNA, 18 bp, Artificial Sequence
  Synthetic
ggcucaacaccgggauct

SEQ ID NO: 5458 - DNA, 21 bp, Artificial Sequence
  Synthetic
ctcccagutgcaacgtuaggt

SEQ ID NO: 5459 - DNA, 21 bp, Artificial Sequence
  Synthetic
cgtacggcucctggttuacag

SEQ ID NO: 5460 - DNA, 22 bp, Artificial Sequence
  Synthetic
gutttgcctgtugagagaccag

SEQ ID NO: 5461 - DNA, 20 bp, Artificial Sequence
  Synthetic
gcaggacccggaugtaauca

SEQ ID NO: 5462 - DNA, 24 bp, Artificial Sequence
  Synthetic
acaaactccagaacutcctggtug

SEQ ID NO: 5463 - DNA, 26 bp, Artificial Sequence
  Synthetic
gggtgtgtctauatccatctccaugt

SEQ ID NO: 5464 - DNA, 22 bp, Artificial Sequence
  Synthetic
caacaacugcagcaaagacugg

SEQ ID NO: 5465 - DNA, 22 bp, Artificial Sequence
  Synthetic
agaacattgtucgctgcatugg

SEQ ID NO: 5466 - DNA, 23 bp, Artificial Sequence
  Synthetic
tgataacatucagccccuacact

SEQ ID NO: 5467 - DNA, 21 bp, Artificial Sequence
  Synthetic
caugaccgacuacaaccccaa

SEQ ID NO: 5468 - DNA, 21 bp, Artificial Sequence
  Synthetic
catgggccaaauctcaggcua

SEQ ID NO: 5469 - DNA, 22 bp, Artificial Sequence
  Synthetic
actgcagucactgtgagguaga

SEQ ID NO: 5470 - DNA, 20 bp, Artificial Sequence
  Synthetic
ccacccccacutcttcaugg

SEQ ID NO: 5471 - DNA, 22 bp, Artificial Sequence
  Synthetic
gcuaattgaacctugccagcat

SEQ ID NO: 5472 - DNA, 21 bp, Artificial Sequence
  Synthetic
actcaugcacgcttctgtuca

SEQ ID NO: 5473 - DNA, 29 bp, Artificial Sequence
  Synthetic
tgtttttaagcauagaagttctgtcugct

SEQ ID NO: 5474 - DNA, 20 bp, Artificial Sequence
  Synthetic
cacgcucaggttggagtuct

SEQ ID NO: 5475 - DNA, 20 bp, Artificial Sequence
  Synthetic
ccacatgagugactgccuct

SEQ ID NO: 5476 - DNA, 25 bp, Artificial Sequence
  Synthetic
tggagauattgucaaaagccacgat

SEQ ID NO: 5477 - DNA, 21 bp, Artificial Sequence
  Synthetic
attcugagccaggtgaucagc

SEQ ID NO: 5478 - DNA, 22 bp, Artificial Sequence
  Synthetic
ccatctgtcuatgtgggcauga

SEQ ID NO: 5479 - DNA, 22 bp, Artificial Sequence
  Synthetic
tttgaagauggcttctguggct

SEQ ID NO: 5480 - DNA, 27 bp, Artificial Sequence
  Synthetic
gacacatcuaacacaataggcuaccaa

SEQ ID NO: 5481 - DNA, 22 bp, Artificial Sequence
  Synthetic
tccagacaacccauttcgagug

SEQ ID NO: 5482 - DNA, 19 bp, Artificial Sequence
  Synthetic
tgcucctcauccacggact

SEQ ID NO: 5483 - DNA, 26 bp, Artificial Sequence
  Synthetic
atctctgatttugatgccatttguct

SEQ ID NO: 5484 - DNA, 27 bp, Artificial Sequence
  Synthetic
gaaagggaaggaguctttcattaucca

SEQ ID NO: 5485 - DNA, 29 bp, Artificial Sequence
  Synthetic
ctgatattgagugacagcuaaaagacaca

SEQ ID NO: 5486 - DNA, 19 bp, Artificial Sequence
  Synthetic
cctccaagaucgcctccuc

SEQ ID NO: 5487 - DNA, 17 bp, Artificial Sequence
  Synthetic
ccgcugctcaggtugct

SEQ ID NO: 5488 - DNA, 18 bp, Artificial Sequence
  Synthetic
gcgaguagctgaguggct

SEQ ID NO: 5489 - DNA, 19 bp, Artificial Sequence
  Synthetic
gcagtguaaacggccucct

SEQ ID NO: 5490 - DNA, 23 bp, Artificial Sequence
  Synthetic
ctgatgttcaagaucgcctguca

SEQ ID NO: 5491 - DNA, 23 bp, Artificial Sequence
  Synthetic
ttcacugaggccacatgatctuc

SEQ ID NO: 5492 - DNA, 26 bp, Artificial Sequence
  Synthetic
aaggaaatgtuaattgctgctttugt

SEQ ID NO: 5493 - DNA, 28 bp, Artificial Sequence
  Synthetic
ggctatcatcugaattttcccaagaaut

SEQ ID NO: 5494 - DNA, 30 bp, Artificial Sequence
  Synthetic
cgtatgacttaacutttgtcttgtgttuca

SEQ ID NO: 5495 - DNA, 21 bp, Artificial Sequence
  Synthetic
aggcagtuccgttctgatguc

SEQ ID NO: 5496 - DNA, 22 bp, Artificial Sequence
  Synthetic
agagaacucagcgacacuacct

SEQ ID NO: 5497 - DNA, 25 bp, Artificial Sequence
  Synthetic
gagcttuccacaagaaatcacttuc

SEQ ID NO: 5498 - DNA, 30 bp, Artificial Sequence
  Synthetic
ctttcttagaatgutagccctatcagugaa

SEQ ID NO: 5499 - DNA, 24 bp, Artificial Sequence
  Synthetic
cttctgccagucccatacaguaag

SEQ ID NO: 5500 - DNA, 23 bp, Artificial Sequence
  Synthetic
ggagcggcaautcacuaacaaga

SEQ ID NO: 5501 - DNA, 26 bp, Artificial Sequence
  Synthetic
ttttcagtttuctttttgccaugaca

SEQ ID NO: 5502 - DNA, 29 bp, Artificial Sequence
  Synthetic
cuggaggagggaaagauagaaaaataaut

SEQ ID NO: 5503 - DNA, 28 bp, Artificial Sequence
  Synthetic
atgtgggacaaaauacctgagttuagag

SEQ ID NO: 5504 - DNA, 21 bp, Artificial Sequence
  Synthetic
gtcttgccacacauccctuca

SEQ ID NO: 5505 - DNA, 25 bp, Artificial Sequence
  Synthetic
gggaggttaauaatcacatccugct

SEQ ID NO: 5506 - DNA, 27 bp, Artificial Sequence
  Synthetic
acaagtaaacguggctagtttgaauca

SEQ ID NO: 5507 - DNA, 24 bp, Artificial Sequence
  Synthetic
gtccttacaauccgatcgatucct

SEQ ID NO: 5508 - DNA, 29 bp, Artificial Sequence
  Synthetic
aggcatgtcaagaaugagtttaatttucc

SEQ ID NO: 5509 - DNA, 26 bp, Artificial Sequence
  Synthetic
actgaatgaugctcatgtctttucca

SEQ ID NO: 5510 - DNA, 24 bp, Artificial Sequence
  Synthetic
gaccttggugagcctctttaugaa

SEQ ID NO: 5511 - DNA, 24 bp, Artificial Sequence
  Synthetic
gctgaaggaaaagagutgcacuga

SEQ ID NO: 5512 - DNA, 22 bp, Artificial Sequence
  Synthetic
ctcgagcutccauccgaaaact

SEQ ID NO: 5513 - DNA, 21 bp, Artificial Sequence
  Synthetic
ggccaagucacacctgtacut

SEQ ID NO: 5514 - DNA, 23 bp, Artificial Sequence
  Synthetic
cttctcctguggacagtgagaut

SEQ ID NO: 5515 - DNA, 21 bp, Artificial Sequence
  Synthetic
ggagcacgccccauattagug

SEQ ID NO: 5516 - DNA, 19 bp, Artificial Sequence
  Synthetic
ggcaggucgaactcctuct

SEQ ID NO: 5517 - DNA, 19 bp, Artificial Sequence
  Synthetic
cgagucggaccgcauagac

SEQ ID NO: 5518 - DNA, 17 bp, Artificial Sequence
  Synthetic
cucagcccgaagccgua

SEQ ID NO: 5519 - DNA, 17 bp, Artificial Sequence
  Synthetic
cgctcaaguccgtggug

SEQ ID NO: 5520 - DNA, 17 bp, Artificial Sequence
  Synthetic
gggcggcutgctaccug

SEQ ID NO: 5521 - DNA, 19 bp, Artificial Sequence
  Synthetic
cctcccgccauggattuct

SEQ ID NO: 5522 - DNA, 25 bp, Artificial Sequence
  Synthetic
gcaatatgaaucccatggagaggug

SEQ ID NO: 5523 - DNA, 24 bp, Artificial Sequence
  Synthetic
acgcacagaacacucatggatuaa

SEQ ID NO: 5524 - DNA, 22 bp, Artificial Sequence
  Synthetic
tccacgggautggatgctttut

SEQ ID NO: 5525 - DNA, 21 bp, Artificial Sequence
  Synthetic
gcagugccagatgaactuccc

SEQ ID NO: 5526 - DNA, 22 bp, Artificial Sequence
  Synthetic
cacatgcccugcaaaagaucat

SEQ ID NO: 5527 - DNA, 18 bp, Artificial Sequence
  Synthetic
agcgcccaccugtcauag

SEQ ID NO: 5528 - DNA, 17 bp, Artificial Sequence
  Synthetic
gccgccauctgguggat

SEQ ID NO: 5529 - DNA, 24 bp, Artificial Sequence
  Synthetic
tctggtttttcuacctctccccut

SEQ ID NO: 5530 - DNA, 23 bp, Artificial Sequence
  Synthetic
atagtgctuccacacattccuca

SEQ ID NO: 5531 - DNA, 23 bp, Artificial Sequence
  Synthetic
tguggaaatgcaauggaacaagg

SEQ ID NO: 5532 - DNA, 22 bp, Artificial Sequence
  Synthetic
caagtttcugcctcttgcaguc

SEQ ID NO: 5533 - DNA, 21 bp, Artificial Sequence
  Synthetic
ttcaccagguggccaattuct

SEQ ID NO: 5534 - DNA, 26 bp, Artificial Sequence
  Synthetic
cagtcttgaagagcugtctttctcuc

SEQ ID NO: 5535 - DNA, 28 bp, Artificial Sequence
  Synthetic
tgggaactcauaatacctcttgaaaucc

SEQ ID NO: 5536 - DNA, 19 bp, Artificial Sequence
  Synthetic
ccttggcgaugtcacuggt

SEQ ID NO: 5537 - DNA, 21 bp, Artificial Sequence
  Synthetic
gaguaccctctguccaaagca

SEQ ID NO: 5538 - DNA, 17 bp, Artificial Sequence
  Synthetic
gcctggugggcttctug

SEQ ID NO: 5539 - DNA, 18 bp, Artificial Sequence
  Synthetic
acaaggccccugggagua

SEQ ID NO: 5540 - DNA, 26 bp, Artificial Sequence
  Synthetic
tgctatcctcauagagacagaagugg

SEQ ID NO: 5541 - DNA, 18 bp, Artificial Sequence
  Synthetic
agctccuccagcgacuca

SEQ ID NO: 5542 - DNA, 28 bp, Artificial Sequence
  Synthetic
cctttctattuagagtctatgucccaca

SEQ ID NO: 5543 - DNA, 28 bp, Artificial Sequence
  Synthetic
ggtcatcaatctautccatcaggctuaa

SEQ ID NO: 5544 - DNA, 19 bp, Artificial Sequence
  Synthetic
cccaccuccacatugcaca

SEQ ID NO: 5545 - DNA, 23 bp, Artificial Sequence
  Synthetic
ccccctcauccttatcttccuct

SEQ ID NO: 5546 - DNA, 23 bp, Artificial Sequence
  Synthetic
cgucacagggagugagagaaaca

SEQ ID NO: 5547 - DNA, 30 bp, Artificial Sequence
  Synthetic
cgagaaagaagaaaucaagaaacucaacag

SEQ ID NO: 5548 - DNA, 21 bp, Artificial Sequence
  Synthetic
caagccctugatgcatctucc

SEQ ID NO: 5549 - DNA, 22 bp, Artificial Sequence
  Synthetic
gctctucaagcgcttuaggaaa

SEQ ID NO: 5550 - DNA, 23 bp, Artificial Sequence
  Synthetic
agagctgctgutgctcttcttut

SEQ ID NO: 5551 - DNA, 21 bp, Artificial Sequence
  Synthetic
gaagugaccaaagcaggugga

SEQ ID NO: 5552 - DNA, 28 bp, Artificial Sequence
  Synthetic
agaagatgaaaggucacuttacctttut

SEQ ID NO: 5553 - DNA, 26 bp, Artificial Sequence
  Synthetic
caacttgtttcugtaggtaggugaca

SEQ ID NO: 5554 - DNA, 24 bp, Artificial Sequence
  Synthetic
cccatgaggaaucgatctgaucac

SEQ ID NO: 5555 - DNA, 25 bp, Artificial Sequence
  Synthetic
aattttctgatugggcctaagcuct

SEQ ID NO: 5556 - DNA, 21 bp, Artificial Sequence
  Synthetic
cgtcaatgguggaccacauct

SEQ ID NO: 5557 - DNA, 22 bp, Artificial Sequence
  Synthetic
gggtgggatugcactcttgtut

SEQ ID NO: 5558 - DNA, 25 bp, Artificial Sequence
  Synthetic
gctcatagaagucaaacagguccat

SEQ ID NO: 5559 - DNA, 23 bp, Artificial Sequence
  Synthetic
tcacccautgcttgauaacagca

SEQ ID NO: 5560 - DNA, 21 bp, Artificial Sequence
  Synthetic
aattgctgguctcagctguca

SEQ ID NO: 5561 - DNA, 22 bp, Artificial Sequence
  Synthetic
ccaacccaugtgcatgaguaca

SEQ ID NO: 5562 - DNA, 24 bp, Artificial Sequence
  Synthetic
cgtcctctucatcatcctctucat

SEQ ID NO: 5563 - DNA, 20 bp, Artificial Sequence
  Synthetic
gcaggugaaatgcugccaag

SEQ ID NO: 5564 - DNA, 31 bp, Artificial Sequence
  Synthetic
tgcagctauaggagcaaautaaattactaua

SEQ ID NO: 5565 - DNA, 21 bp, Artificial Sequence
  Synthetic
gccatggcugcattgaaugat

SEQ ID NO: 5566 - DNA, 22 bp, Artificial Sequence
  Synthetic
ggtggcaguagtttcagtgcut

SEQ ID NO: 5567 - DNA, 29 bp, Artificial Sequence
  Synthetic
cacaagaatagaautcagtgaaccattug

SEQ ID NO: 5568 - DNA, 22 bp, Artificial Sequence
  Synthetic
gguactggtagugaacggagac

SEQ ID NO: 5569 - DNA, 24 bp, Artificial Sequence
  Synthetic
gccagacutgaagcatgucaaaaa

SEQ ID NO: 5570 - DNA, 25 bp, Artificial Sequence
  Synthetic
tcaatctctuctggcaataauggct

SEQ ID NO: 5571 - DNA, 25 bp, Artificial Sequence
  Synthetic
cagtccugaaagagacacatgauga

SEQ ID NO: 5572 - DNA, 23 bp, Artificial Sequence
  Synthetic
cacaguagtaatugcaggcccat

SEQ ID NO: 5573 - DNA, 22 bp, Artificial Sequence
  Synthetic
ggcaugatcuccagagaagcag

SEQ ID NO: 5574 - DNA, 18 bp, Artificial Sequence
  Synthetic
gggagacggcugcactua

SEQ ID NO: 5575 - DNA, 18 bp, Artificial Sequence
  Synthetic
tctcuccgaggtgugggt

SEQ ID NO: 5576 - DNA, 28 bp, Artificial Sequence
  Synthetic
tgtctgggatgauaattcttttctgugt

SEQ ID NO: 5577 - DNA, 24 bp, Artificial Sequence
  Synthetic
gtggagacugaataactgauggct

SEQ ID NO: 5578 - DNA, 28 bp, Artificial Sequence
  Synthetic
tttgaatgacutatcttctgaugcacca

SEQ ID NO: 5579 - DNA, 28 bp, Artificial Sequence
  Synthetic
ctatactgtccacugctagtttgguaaa

SEQ ID NO: 5580 - DNA, 29 bp, Artificial Sequence
  Synthetic
gaatcaagttgcaaugtttctgtctuaca

SEQ ID NO: 5581 - DNA, 23 bp, Artificial Sequence
  Synthetic
ggaggaugccataacaacuccag

SEQ ID NO: 5582 - DNA, 27 bp, Artificial Sequence
  Synthetic
ggacctttacugccacaaatcagatua

SEQ ID NO: 5583 - DNA, 23 bp, Artificial Sequence
  Synthetic
tctgtagttgcuttcaggcagut

SEQ ID NO: 5584 - DNA, 22 bp, Artificial Sequence
  Synthetic
gctgtactccugcaggtaguct

SEQ ID NO: 5585 - DNA, 22 bp, Artificial Sequence
  Synthetic
gtaccucaacaccttugccaac

SEQ ID NO: 5586 - DNA, 20 bp, Artificial Sequence
  Synthetic
ggtcagcacugtacctcugg

SEQ ID NO: 5587 - DNA, 20 bp, Artificial Sequence
  Synthetic
gcccuacagagccccaacua

SEQ ID NO: 5588 - DNA, 29 bp, Artificial Sequence
  Synthetic
catccatcatatcutccaaatcctctuca

SEQ ID NO: 5589 - DNA, 27 bp, Artificial Sequence
  Synthetic
agaatcatatutgtgtctgaugggcaa

SEQ ID NO: 5590 - DNA, 29 bp, Artificial Sequence
  Synthetic
aggcaaacgtuctcctttctctaauaaat

SEQ ID NO: 5591 - DNA, 25 bp, Artificial Sequence
  Synthetic
tggtatagugctggtttgtucaaca

SEQ ID NO: 5592 - DNA, 22 bp, Artificial Sequence
  Synthetic
tggcuagcccaaaatctgugat

SEQ ID NO: 5593 - DNA, 23 bp, Artificial Sequence
  Synthetic
atgggaaaaccugggcatuaact

SEQ ID NO: 5594 - DNA, 28 bp, Artificial Sequence
  Synthetic
gtaagttgtggaguttggttttgtttug

SEQ ID NO: 5595 - DNA, 27 bp, Artificial Sequence
  Synthetic
actgtgaagatucctgtggctatuaag

SEQ ID NO: 5596 - DNA, 26 bp, Artificial Sequence
  Synthetic
ccttctaaaccugatgaaaaucccca

SEQ ID NO: 5597 - DNA, 25 bp, Artificial Sequence
  Synthetic
gagtaattggugggctcttcatuct

SEQ ID NO: 5598 - DNA, 27 bp, Artificial Sequence
  Synthetic
gcatacttgaaaaugaaactgttugcc

SEQ ID NO: 5599 - DNA, 25 bp, Artificial Sequence
  Synthetic
cattccagaggaaaugacaccacut

SEQ ID NO: 5600 - DNA, 30 bp, Artificial Sequence
  Synthetic
ccggatgttatutttaattgtttgguccaa

SEQ ID NO: 5601 - DNA, 28 bp, Artificial Sequence
  Synthetic
cataccattaacuggacaacactctuca

SEQ ID NO: 5602 - DNA, 25 bp, Artificial Sequence
  Synthetic
accaatggucaccaggtuagaaaaa

SEQ ID NO: 5603 - DNA, 32 bp, Artificial Sequence
  Synthetic
caactttcaacacautttcaccatattucaag

SEQ ID NO: 5604 - DNA, 32 bp, Artificial Sequence
  Synthetic
tgaattaaaaaccttgutatataggcccagut

SEQ ID NO: 5605 - DNA, 21 bp, Artificial Sequence
  Synthetic
gcctgcccuagttccaagaug

SEQ ID NO: 5606 - DNA, 26 bp, Artificial Sequence
  Synthetic
gtatgccugaatcaaauagggaagga

SEQ ID NO: 5607 - DNA, 22 bp, Artificial Sequence
  Synthetic
gatgcuacggaccttacgucag

SEQ ID NO: 5608 - DNA, 24 bp, Artificial Sequence
  Synthetic
ggtuccgaacaatatctugccaat

SEQ ID NO: 5609 - DNA, 32 bp, Artificial Sequence
  Synthetic
ttaagagcaaatcacutttgttgattacctut

SEQ ID NO: 5610 - DNA, 22 bp, Artificial Sequence
  Synthetic
gttatctccaggutgcccauga

SEQ ID NO: 5611 - DNA, 30 bp, Artificial Sequence
  Synthetic
aaaggttatgtaatutcacgtgtatctuct

SEQ ID NO: 5612 - DNA, 25 bp, Artificial Sequence
  Synthetic
acagtctauaaaccagcucgaagga

SEQ ID NO: 5613 - DNA, 24 bp, Artificial Sequence
  Synthetic
ctcagaccaucaatacagucgcat

SEQ ID NO: 5614 - DNA, 28 bp, Artificial Sequence
  Synthetic
gtggacctucaggaatttcatactttuc

SEQ ID NO: 5615 - DNA, 27 bp, Artificial Sequence
  Synthetic
atgagagagatauagtgctcactugat

SEQ ID NO: 5616 - DNA, 28 bp, Artificial Sequence
  Synthetic
aatgtaagcaatuggtcaaatggaaaut

SEQ ID NO: 5617 - DNA, 28 bp, Artificial Sequence
  Synthetic
tgaaagtatgaaaucgctattgctgcua

SEQ ID NO: 5618 - DNA, 31 bp, Artificial Sequence
  Synthetic
acacagaaagaaugagaauaaaaaccagaca

SEQ ID NO: 5619 - DNA, 30 bp, Artificial Sequence
  Synthetic
ccttaatgcttttuaatttccgttttgtuc

SEQ ID NO: 5620 - DNA, 27 bp, Artificial Sequence
  Synthetic
catctctuagaaatgggacuggaaagt

SEQ ID NO: 5621 - DNA, 26 bp, Artificial Sequence
  Synthetic
tgagcaaatagaguctccagacacua

SEQ ID NO: 5622 - DNA, 23 bp, Artificial Sequence
  Synthetic
agaaacatcugcaggaggactug

SEQ ID NO: 5623 - DNA, 32 bp, Artificial Sequence
  Synthetic
caggaaacaagaagaautcaattaaaatgugg

SEQ ID NO: 5624 - DNA, 32 bp, Artificial Sequence
  Synthetic
atatacatcaaaccguaattacttaccuacag

SEQ ID NO: 5625 - DNA, 32 bp, Artificial Sequence
  Synthetic
gagatgtttatcuaacaatgactcaaatctug

SEQ ID NO: 5626 - DNA, 27 bp, Artificial Sequence
  Synthetic
atctgaccttacugatcctgcttagua

SEQ ID NO: 5627 - DNA, 22 bp, Artificial Sequence
  Synthetic
cctcctugagttcctucaccag

SEQ ID NO: 5628 - DNA, 26 bp, Artificial Sequence
  Synthetic
tgcaggtatcugatggtataatugcc

SEQ ID NO: 5629 - DNA, 27 bp, Artificial Sequence
  Synthetic
agcaaattaccgcutcaaacatgaaut

SEQ ID NO: 5630 - DNA, 26 bp, Artificial Sequence
  Synthetic
tcctttugagaagaaagtgtcttugg

SEQ ID NO: 5631 - DNA, 22 bp, Artificial Sequence
  Synthetic
catcgaaagcacutgtggaugg

SEQ ID NO: 5632 - DNA, 27 bp, Artificial Sequence
  Synthetic
tgcaggttttuacataaaatcgcgtut

SEQ ID NO: 5633 - DNA, 20 bp, Artificial Sequence
  Synthetic
atgatucccagttcgucgca

SEQ ID NO: 5634 - DNA, 26 bp, Artificial Sequence
  Synthetic
gaataaccacgugtctucaaaaccat

SEQ ID NO: 5635 - DNA, 27 bp, Artificial Sequence
  Synthetic
ttgatttttcutgtcttgacucggaga

SEQ ID NO: 5636 - DNA, 29 bp, Artificial Sequence
  Synthetic
tcttggacagtauaattggctttcctaug

SEQ ID NO: 5637 - DNA, 18 bp, Artificial Sequence
  Synthetic
acacgccugtgcagcuat

SEQ ID NO: 5638 - DNA, 24 bp, Artificial Sequence
  Synthetic
ttcttattcgcuaagctgctugaa

SEQ ID NO: 5639 - DNA, 22 bp, Artificial Sequence
  Synthetic
gtatgcacaaugatgccctugg

SEQ ID NO: 5640 - DNA, 21 bp, Artificial Sequence
  Synthetic
gggcacutttggcauagacga

SEQ ID NO: 5641 - DNA, 25 bp, Artificial Sequence
  Synthetic
acagacaagcucagcacttaatuct

SEQ ID NO: 5642 - DNA, 21 bp, Artificial Sequence
  Synthetic
ttccggaaagutcgaagctug

SEQ ID NO: 5643 - DNA, 19 bp, Artificial Sequence
  Synthetic
agtgagcccguatcccuga

SEQ ID NO: 5644 - DNA, 24 bp, Artificial Sequence
  Synthetic
aaaatggacaaagguggctctgua

SEQ ID NO: 5645 - DNA, 29 bp, Artificial Sequence
  Synthetic
gtgcttctugtgtaaactattucagaaac

SEQ ID NO: 5646 - DNA, 25 bp, Artificial Sequence
  Synthetic
acugaactagcucgaaagaaaggac

SEQ ID NO: 5647 - DNA, 25 bp, Artificial Sequence
  Synthetic
aatgcatguaagtactctctuccca

SEQ ID NO: 5648 - DNA, 25 bp, Artificial Sequence
  Synthetic
ctgcttctgucgtttcactgtatug

SEQ ID NO: 5649 - DNA, 24 bp, Artificial Sequence
  Synthetic
ctgcattcaucacattttccccut

SEQ ID NO: 5650 - DNA, 27 bp, Artificial Sequence
  Synthetic
cacacacaguaaatataggtcucacca

SEQ ID NO: 5651 - DNA, 26 bp, Artificial Sequence
  Synthetic
gcatggctgutgtttcattagtaucc

SEQ ID NO: 5652 - DNA, 21 bp, Artificial Sequence
  Synthetic
agcaaagutcccauccccaat

SEQ ID NO: 5653 - DNA, 23 bp, Artificial Sequence
  Synthetic
gagatgaccaaccugcaaagcua

SEQ ID NO: 5654 - DNA, 24 bp, Artificial Sequence
  Synthetic
gtcctctttctugtccatgctcut

SEQ ID NO: 5655 - DNA, 24 bp, Artificial Sequence
  Synthetic
gtatgatguggagaagctggugag

SEQ ID NO: 5656 - DNA, 19 bp, Artificial Sequence
  Synthetic
ccctcccccacutcttcug

SEQ ID NO: 5657 - DNA, 21 bp, Artificial Sequence
  Synthetic
caggctgtutagcaaggcuct

SEQ ID NO: 5658 - DNA, 28 bp, Artificial Sequence
  Synthetic
ccagtgactuaggagtattaaucaagct

SEQ ID NO: 5659 - DNA, 25 bp, Artificial Sequence
  Synthetic
gcagagccccaautcagtaacuaaa

SEQ ID NO: 5660 - DNA, 27 bp, Artificial Sequence
  Synthetic
agcaaatactuaggtaaatgcugaact

SEQ ID NO: 5661 - DNA, 23 bp, Artificial Sequence
  Synthetic
gcatgcccucatctaatgtcuca

SEQ ID NO: 5662 - DNA, 20 bp, Artificial Sequence
  Synthetic
ccagacacgcuatcaugcgt

SEQ ID NO: 5663 - DNA, 19 bp, Artificial Sequence
  Synthetic
gccaguaagcccucacgat

SEQ ID NO: 5664 - DNA, 24 bp, Artificial Sequence
  Synthetic
gutgccttgcucaacaaaacaaat

SEQ ID NO: 5665 - DNA, 24 bp, Artificial Sequence
  Synthetic
ttaggaacacugcatggaaugaca

SEQ ID NO: 5666 - DNA, 28 bp, Artificial Sequence
  Synthetic
gtgcttgtacugaccatctgtttttauc

SEQ ID NO: 5667 - DNA, 29 bp, Artificial Sequence
  Synthetic
ttggcagaccaucatcttgttcttauaat

SEQ ID NO: 5668 - DNA, 23 bp, Artificial Sequence
  Synthetic
gccattccacgacuagttcagut

SEQ ID NO: 5669 - DNA, 27 bp, Artificial Sequence
  Synthetic
accaaagaaagaagutcaggatcctut

SEQ ID NO: 5670 - DNA, 22 bp, Artificial Sequence
  Synthetic
gtcctctgugaacttgcucagg

SEQ ID NO: 5671 - DNA, 27 bp, Artificial Sequence
  Synthetic
ctgagacttcaaugtacacatctgcua

SEQ ID NO: 5672 - DNA, 24 bp, Artificial Sequence
  Synthetic
tcttgccuattttgtugacaccct

SEQ ID NO: 5673 - DNA, 20 bp, Artificial Sequence
  Synthetic
cagatcuggcagcccaucaa

SEQ ID NO: 5674 - DNA, 18 bp, Artificial Sequence
  Synthetic
cagtccucactggcgcut

SEQ ID NO: 5675 - DNA, 21 bp, Artificial Sequence
  Synthetic
cctgcucaagggtctcuacct

SEQ ID NO: 5676 - DNA, 20 bp, Artificial Sequence
  Synthetic
caccatccccgucttctcuc

SEQ ID NO: 5677 - DNA, 22 bp, Artificial Sequence
  Synthetic
acaaagtgucctgcactcugat

SEQ ID NO: 5678 - DNA, 19 bp, Artificial Sequence
  Synthetic
gcacugccgatcucagagg

SEQ ID NO: 5679 - DNA, 22 bp, Artificial Sequence
  Synthetic
cgtcttggcugagaagcucaaa

SEQ ID NO: 5680 - DNA, 27 bp, Artificial Sequence
  Synthetic
gagaatcaaguagagaatccugcaagg

SEQ ID NO: 5681 - DNA, 23 bp, Artificial Sequence
  Synthetic
acaaacccaagcuagtggugaag

SEQ ID NO: 5682 - DNA, 19 bp, Artificial Sequence
  Synthetic
ggaaugcagggagggtugg

SEQ ID NO: 5683 - DNA, 22 bp, Artificial Sequence
  Synthetic
cgaccgcaggaucaagtaugag

SEQ ID NO: 5684 - DNA, 20 bp, Artificial Sequence
  Synthetic
aaagagccggccugtgauag

SEQ ID NO: 5685 - DNA, 21 bp, Artificial Sequence
  Synthetic
tttttgggcccugactctgut

SEQ ID NO: 5686 - DNA, 24 bp, Artificial Sequence
  Synthetic
catccaccaagguagagaccttuc

SEQ ID NO: 5687 - DNA, 24 bp, Artificial Sequence
  Synthetic
aatgctgattgucttctcccctut

SEQ ID NO: 5688 - DNA, 17 bp, Artificial Sequence
  Synthetic
gcugcacucccaagcct

SEQ ID NO: 5689 - DNA, 24 bp, Artificial Sequence
  Synthetic
tccagtauccccacgtctaaauct

SEQ ID NO: 5690 - DNA, 27 bp, Artificial Sequence
  Synthetic
atgaauaagaaggtgttcugaaaagca

SEQ ID NO: 5691 - DNA, 27 bp, Artificial Sequence
  Synthetic
ctagaaggtuaccaggtgaaaatguca

SEQ ID NO: 5692 - DNA, 25 bp, Artificial Sequence
  Synthetic
aaggtttcaaccuaatggagggaug

SEQ ID NO: 5693 - DNA, 28 bp, Artificial Sequence
  Synthetic
aggttttgtgttaucctctaggagaugt

SEQ ID NO: 5694 - DNA, 24 bp, Artificial Sequence
  Synthetic
gcttaugcagatgtaaguggcaaa

SEQ ID NO: 5695 - DNA, 27 bp, Artificial Sequence
  Synthetic
cttucagagaaaauaagagacccagua

SEQ ID NO: 5696 - DNA, 25 bp, Artificial Sequence
  Synthetic
acttcccaaccutttatgctacuga

SEQ ID NO: 5697 - DNA, 21 bp, Artificial Sequence
  Synthetic
acagtagagugggctcugacc

SEQ ID NO: 5698 - DNA, 22 bp, Artificial Sequence
  Synthetic
tctacctttggugaacccgtug

SEQ ID NO: 5699 - DNA, 22 bp, Artificial Sequence
  Synthetic
agtcacaucaccaggatccuct

SEQ ID NO: 5700 - DNA, 30 bp, Artificial Sequence
  Synthetic
tcctaaaccautaagaaaacugaaaagaga

SEQ ID NO: 5701 - DNA, 28 bp, Artificial Sequence
  Synthetic
tctgtaagattugtgcagagaaugacaa

SEQ ID NO: 5702 - DNA, 24 bp, Artificial Sequence
  Synthetic
gcugacttactuaggaacaaacca

SEQ ID NO: 5703 - DNA, 30 bp, Artificial Sequence
  Synthetic
atatgatgaagtuaaagcacgacuacagaa

SEQ ID NO: 5704 - DNA, 22 bp, Artificial Sequence
  Synthetic
tccaacuggagggaggauacag

SEQ ID NO: 5705 - DNA, 24 bp, Artificial Sequence
  Synthetic
caaagcaatcuttcccaatgguca

SEQ ID NO: 5706 - DNA, 28 bp, Artificial Sequence
  Synthetic
ggcaagtttcuggttgtcatcatattua

SEQ ID NO: 5707 - DNA, 27 bp, Artificial Sequence
  Synthetic
tctttgttttuaggtaagactgugcca

SEQ ID NO: 5708 - DNA, 20 bp, Artificial Sequence
  Synthetic
aaccttuggccagugaagag

SEQ ID NO: 5709 - DNA, 26 bp, Artificial Sequence
  Synthetic
agcaagacaagugaagtcaactgtua

SEQ ID NO: 5710 - DNA, 30 bp, Artificial Sequence
  Synthetic
accagtcttgauactaacaaatacugaagt

SEQ ID NO: 5711 - DNA, 22 bp, Artificial Sequence
  Synthetic
tgcttcaagugtggacgatcug

SEQ ID NO: 5712 - DNA, 20 bp, Artificial Sequence
  Synthetic
aggaacggacgcuggttauc

SEQ ID NO: 5713 - DNA, 26 bp, Artificial Sequence
  Synthetic
acttaggaauacctcgttctctuccc

SEQ ID NO: 5714 - DNA, 22 bp, Artificial Sequence
  Synthetic
ctgacaccuccaaacctcuacc

SEQ ID NO: 5715 - DNA, 28 bp, Artificial Sequence
  Synthetic
acacagaatttgutaagcaacgtaguct

SEQ ID NO: 5716 - DNA, 23 bp, Artificial Sequence
  Synthetic
ctgacattugccgatggtaacug

SEQ ID NO: 5717 - DNA, 24 bp, Artificial Sequence
  Synthetic
ctagtccccagugctcaatcauag

SEQ ID NO: 5718 - DNA, 22 bp, Artificial Sequence
  Synthetic
gattctgaugggtgggugagag

SEQ ID NO: 5719 - DNA, 22 bp, Artificial Sequence
  Synthetic
tgcaaacuagctttctgcugga

SEQ ID NO: 5720 - DNA, 27 bp, Artificial Sequence
  Synthetic
gaaaataggacauccatgaaactugcc

SEQ ID NO: 5721 - DNA, 27 bp, Artificial Sequence
  Synthetic
tcttctcccuagcgaaagaaataucct

SEQ ID NO: 5722 - DNA, 19 bp, Artificial Sequence
  Synthetic
aaggguggctttgctucca

SEQ ID NO: 5723 - DNA, 25 bp, Artificial Sequence
  Synthetic
aaggaagagccgutcaaaagacuaa

SEQ ID NO: 5724 - DNA, 21 bp, Artificial Sequence
  Synthetic
caccugagggcacctacuact

SEQ ID NO: 5725 - DNA, 21 bp, Artificial Sequence
  Synthetic
gtacggaggcaccaauctcug

SEQ ID NO: 5726 - DNA, 24 bp, Artificial Sequence
  Synthetic
cgtutcccttccauacagaaaggt

SEQ ID NO: 5727 - DNA, 21 bp, Artificial Sequence
  Synthetic
cgctggcauctggaagtcauc

SEQ ID NO: 5728 - DNA, 27 bp, Artificial Sequence
  Synthetic
aggtaaagatugtgatctccauaccct

SEQ ID NO: 5729 - DNA, 27 bp, Artificial Sequence
  Synthetic
atgtgacttcucacgatgacatatucc

SEQ ID NO: 5730 - DNA, 22 bp, Artificial Sequence
  Synthetic
gggcagtaagaugtggtctcug

SEQ ID NO: 5731 - DNA, 28 bp, Artificial Sequence
  Synthetic
cttcatgtttgaugtttctttgcucact

SEQ ID NO: 5732 - DNA, 21 bp, Artificial Sequence
  Synthetic
accaugcgcagagcaagauag

SEQ ID NO: 5733 - DNA, 22 bp, Artificial Sequence
  Synthetic
cctggaccaugaagcactucaa

SEQ ID NO: 5734 - DNA, 21 bp, Artificial Sequence
  Synthetic
cctcccgucttagaagcucac

SEQ ID NO: 5735 - DNA, 28 bp, Artificial Sequence
  Synthetic
ggttgtctccutttgatattttcuccct

SEQ ID NO: 5736 - DNA, 23 bp, Artificial Sequence
  Synthetic
ttctccccaaggaugaggtatuc

SEQ ID NO: 5737 - DNA, 26 bp, Artificial Sequence
  Synthetic
gcctgggttgguctttaaatcttcut

SEQ ID NO: 5738 - DNA, 23 bp, Artificial Sequence
  Synthetic
tgggtcatatugtttgaggcucc

SEQ ID NO: 5739 - DNA, 22 bp, Artificial Sequence
  Synthetic
gcagcuccaacataaacauggt

SEQ ID NO: 5740 - DNA, 19 bp, Artificial Sequence
  Synthetic
ggcgcugagtggttttucg

SEQ ID NO: 5741 - DNA, 20 bp, Artificial Sequence
  Synthetic
ctccgugccatccactauca

SEQ ID NO: 5742 - DNA, 26 bp, Artificial Sequence
  Synthetic
tgttccaaauggaatacatggtguga

SEQ ID NO: 5743 - DNA, 23 bp, Artificial Sequence
  Synthetic
ctcaatcuccaactgtugcagga

SEQ ID NO: 5744 - DNA, 22 bp, Artificial Sequence
  Synthetic
cacccgggagagugtttgauat

SEQ ID NO: 5745 - DNA, 31 bp, Artificial Sequence
  Synthetic
aaagtcatactgucatttctagatctacuca

SEQ ID NO: 5746 - DNA, 26 bp, Artificial Sequence
  Synthetic
autcgaattctggugaaaaaggaaga

SEQ ID NO: 5747 - DNA, 24 bp, Artificial Sequence
  Synthetic
tgcaaaaaccaagacauggtccua

SEQ ID NO: 5748 - DNA, 21 bp, Artificial Sequence
  Synthetic
catgagggaautccggucagg

SEQ ID NO: 5749 - DNA, 21 bp, Artificial Sequence
  Synthetic
tccaaauagcccaagtuggca

SEQ ID NO: 5750 - DNA, 26 bp, Artificial Sequence
  Synthetic
cccatgaatguggctgaccttattua

SEQ ID NO: 5751 - DNA, 29 bp, Artificial Sequence
  Synthetic
tctgtatttctgauccgttatgagcatug

SEQ ID NO: 5752 - DNA, 19 bp, Artificial Sequence
  Synthetic
gucagagagcggccucaag

SEQ ID NO: 5753 - DNA, 24 bp, Artificial Sequence
  Synthetic
tgagaagcccuatccctgugaaat

SEQ ID NO: 5754 - DNA, 20 bp, Artificial Sequence
  Synthetic
tccctgtccugccccaauaa

SEQ ID NO: 5755 - DNA, 20 bp, Artificial Sequence
  Synthetic
cugcagacccacagugacaa

SEQ ID NO: 5756 - DNA, 23 bp, Artificial Sequence
  Synthetic
tcagacccagacaguctcugaaa

SEQ ID NO: 5757 - DNA, 21 bp, Artificial Sequence
  Synthetic
atggagccugagaacctugac

SEQ ID NO: 5758 - DNA, 20 bp, Artificial Sequence
  Synthetic
gctcgaaaugcagggcaauc

SEQ ID NO: 5759 - DNA, 24 bp, Artificial Sequence
  Synthetic
gcacgaagugatatgcacuacagt

SEQ ID NO: 5760 - DNA, 20 bp, Artificial Sequence
  Synthetic
gttcuccaccaccucacgac

SEQ ID NO: 5761 - DNA, 21 bp, Artificial Sequence
  Synthetic
ggccggtguctttcctcttut

SEQ ID NO: 5762 - DNA, 21 bp, Artificial Sequence
  Synthetic
caccaucaccccacttugact

SEQ ID NO: 5763 - DNA, 27 bp, Artificial Sequence
  Synthetic
atgttcttcucaaccttaatcgtcucc

SEQ ID NO: 5764 - DNA, 30 bp, Artificial Sequence
  Synthetic
taatcauggaaagaataagaucagaagcaa

SEQ ID NO: 5765 - DNA, 21 bp, Artificial Sequence
  Synthetic
gctgugcttgcatuggagact

SEQ ID NO: 5766 - DNA, 23 bp, Artificial Sequence
  Synthetic
ggccacatacugcaacctaaugt

SEQ ID NO: 5767 - DNA, 26 bp, Artificial Sequence
  Synthetic
aggtagcucctgaagaattuaaagcc

SEQ ID NO: 5768 - DNA, 18 bp, Artificial Sequence
  Synthetic
ggcuccgccaaatgguga

SEQ ID NO: 5769 - DNA, 23 bp, Artificial Sequence
  Synthetic
acgaacgcguttgaaaagttuct

SEQ ID NO: 5770 - DNA, 20 bp, Artificial Sequence
  Synthetic
ctcacacucatcgccuggat

SEQ ID NO: 5771 - DNA, 21 bp, Artificial Sequence
  Synthetic
gagtgtgaauggactgguggt

SEQ ID NO: 5772 - DNA, 21 bp, Artificial Sequence
  Synthetic
cagttcccccuttgtcaccua

SEQ ID NO: 5773 - DNA, 27 bp, Artificial Sequence
  Synthetic
gggtctctttaucatggactttcacug

SEQ ID NO: 5774 - DNA, 24 bp, Artificial Sequence
  Synthetic
agtaccatcacucttgactcuggt

SEQ ID NO: 5775 - DNA, 27 bp, Artificial Sequence
  Synthetic
tggatgtacgccuacctacttaaauat

SEQ ID NO: 5776 - DNA, 29 bp, Artificial Sequence
  Synthetic
tggtcagtuaacacttttctttcttucct

SEQ ID NO: 5777 - DNA, 19 bp, Artificial Sequence
  Synthetic
gctgcugcccttactcuct

SEQ ID NO: 5778 - DNA, 17 bp, Artificial Sequence
  Synthetic
gccagggcutctuccct

SEQ ID NO: 5779 - DNA, 24 bp, Artificial Sequence
  Synthetic
tcttgtgctucttcttctcacugg

SEQ ID NO: 5780 - DNA, 22 bp, Artificial Sequence
  Synthetic
caaagacagacucccatugcct

SEQ ID NO: 5781 - DNA, 26 bp, Artificial Sequence
  Synthetic
gctgtttatctuctgctttcctcugg

SEQ ID NO: 5782 - DNA, 22 bp, Artificial Sequence
  Synthetic
gaagccgcutgatgtgtactut

SEQ ID NO: 5783 - DNA, 21 bp, Artificial Sequence
  Synthetic
acctcttaagugcaggctugg

SEQ ID NO: 5784 - DNA, 23 bp, Artificial Sequence
  Synthetic
gaagggttctuccggagatacug

SEQ ID NO: 5785 - DNA, 29 bp, Artificial Sequence
  Synthetic
acaaaacagaguaagaagaaaucatcuga

SEQ ID NO: 5786 - DNA, 28 bp, Artificial Sequence
  Synthetic
ctgcctttgttuaaaacctgatgtacut

SEQ ID NO: 5787 - DNA, 28 bp, Artificial Sequence
  Synthetic
acaaaggaaaauacgcaccauaaaacag

SEQ ID NO: 5788 - DNA, 18 bp, Artificial Sequence
  Synthetic
gggtggcugccactauca

SEQ ID NO: 5789 - DNA, 28 bp, Artificial Sequence
  Synthetic
ccagtaatuaccaccauaaagccattua

SEQ ID NO: 5790 - DNA, 32 bp, Artificial Sequence
  Synthetic
tttaacaggaaguacttaaacaacuacaagga

SEQ ID NO: 5791 - DNA, 29 bp, Artificial Sequence
  Synthetic
cacctaaagaugacaatttgagctuaaaa

SEQ ID NO: 5792 - DNA, 29 bp, Artificial Sequence
  Synthetic
gcugatctugauaaagaagaaaaggaaaa

SEQ ID NO: 5793 - DNA, 30 bp, Artificial Sequence
  Synthetic
taaagtttcaaauaagttgtacugccaagt

SEQ ID NO: 5794 - DNA, 23 bp, Artificial Sequence
  Synthetic
ccttgggcuaagaaagccuacac

SEQ ID NO: 5795 - DNA, 23 bp, Artificial Sequence
  Synthetic
tcccactccutgaccttcatuct

SEQ ID NO: 5796 - DNA, 30 bp, Artificial Sequence
  Synthetic
ggcttttggatautaaagtcgtaatttugt

SEQ ID NO: 5797 - DNA, 23 bp, Artificial Sequence
  Synthetic
tgtcgcatggauatacagctguc

SEQ ID NO: 5798 - DNA, 30 bp, Artificial Sequence
  Synthetic
attgctcttcaaauaacaaagcattauggt

SEQ ID NO: 5799 - DNA, 27 bp, Artificial Sequence
  Synthetic
tgcatgtctaugctcttcatcaaauga

SEQ ID NO: 5800 - DNA, 32 bp, Artificial Sequence
  Synthetic
caagttgtcttttuaatgatcctctattcugt

SEQ ID NO: 5801 - DNA, 31 bp, Artificial Sequence
  Synthetic
ggtgaaattctaaauagtacctgctguaagt

SEQ ID NO: 5802 - DNA, 28 bp, Artificial Sequence
  Synthetic
cgtattgagtgccutatggaatttguca

SEQ ID NO: 5803 - DNA, 24 bp, Artificial Sequence
  Synthetic
acattccgtaauatcccaccucca

SEQ ID NO: 5804 - DNA, 29 bp, Artificial Sequence
  Synthetic
aagaaccucattcatucaaagcacaaaat

SEQ ID NO: 5805 - DNA, 24 bp, Artificial Sequence
  Synthetic
tgcttcuagggctttttgttucct

SEQ ID NO: 5806 - DNA, 23 bp, Artificial Sequence
  Synthetic
gcggaattgguctaggcaacuac

SEQ ID NO: 5807 - DNA, 24 bp, Artificial Sequence
  Synthetic
tggtagacccagaacutctgtcut

SEQ ID NO: 5808 - DNA, 26 bp, Artificial Sequence
  Synthetic
ccgaccuagcccataaaatacauagt

SEQ ID NO: 5809 - DNA, 27 bp, Artificial Sequence
  Synthetic
tcttctattatgugtttgggtctugcc

SEQ ID NO: 5810 - DNA, 27 bp, Artificial Sequence
  Synthetic
gttactcugaagaagaacagcaugaag

SEQ ID NO: 5811 - DNA, 31 bp, Artificial Sequence
  Synthetic
agatgaactcttugagaatgaaaatgacugt

SEQ ID NO: 5812 - DNA, 29 bp, Artificial Sequence
  Synthetic
gtcatcagctgaagaugaaataggatgua

SEQ ID NO: 5813 - DNA, 23 bp, Artificial Sequence
  Synthetic
gatttggttcuagggtgctguga

SEQ ID NO: 5814 - DNA, 21 bp, Artificial Sequence
  Synthetic
agcccuggacaaaccaugcca

SEQ ID NO: 5815 - DNA, 26 bp, Artificial Sequence
  Synthetic
gcagcatttacugcagcttgctuagg

SEQ ID NO: 5816 - DNA, 32 bp, Artificial Sequence
  Synthetic
ggacctattagatgautcagatgatgatgaua

SEQ ID NO: 5817 - DNA, 21 bp, Artificial Sequence
  Synthetic
tgtacacaggcagcugactug

SEQ ID NO: 5818 - DNA, 27 bp, Artificial Sequence
  Synthetic
ctgtaaccauacctgaattggaugaca

SEQ ID NO: 5819 - DNA, 21 bp, Artificial Sequence
  Synthetic
cttgctggaccuggtccatua

SEQ ID NO: 5820 - DNA, 26 bp, Artificial Sequence
  Synthetic
acctcatcatuacacgcctatugaag

SEQ ID NO: 5821 - DNA, 22 bp, Artificial Sequence
  Synthetic
ggctggtaacuttagcctcuga

SEQ ID NO: 5822 - DNA, 27 bp, Artificial Sequence
  Synthetic
aaatgaacctaucaaagagacugagcc

SEQ ID NO: 5823 - DNA, 26 bp, Artificial Sequence
  Synthetic
gcaacaggtcaucttcagagtcaaua

SEQ ID NO: 5824 - DNA, 25 bp, Artificial Sequence
  Synthetic
aagcttcguctgattcagatuccat

SEQ ID NO: 5825 - DNA, 25 bp, Artificial Sequence
  Synthetic
ccaatgtactttuctcccctggtut

SEQ ID NO: 5826 - DNA, 22 bp, Artificial Sequence
  Synthetic
ctccaaaagcccuagugaaggt

SEQ ID NO: 5827 - DNA, 24 bp, Artificial Sequence
  Synthetic
ctagaaggugctttactugaccca

SEQ ID NO: 5828 - DNA, 24 bp, Artificial Sequence
  Synthetic
tctgccuccaaaggactaaaucag

SEQ ID NO: 5829 - DNA, 23 bp, Artificial Sequence
  Synthetic
ggcttggagcutctttgaugaaa

SEQ ID NO: 5830 - DNA, 20 bp, Artificial Sequence
  Synthetic
ggaaccuggaaacgugagca

SEQ ID NO: 5831 - DNA, 29 bp, Artificial Sequence
  Synthetic
ctttgtttggtucctgaaatagagtucac

SEQ ID NO: 5832 - DNA, 30 bp, Artificial Sequence
  Synthetic
caaaagataaucaggcaaaacaaaatgugg

SEQ ID NO: 5833 - DNA, 28 bp, Artificial Sequence
  Synthetic
agtctctgauacagggacaggattatut

SEQ ID NO: 5834 - DNA, 23 bp, Artificial Sequence
  Synthetic
gccattctgggucttaccttgug

SEQ ID NO: 5835 - DNA, 32 bp, Artificial Sequence
  Synthetic
aaccctctaacaagaaucaaacctattuacaa

SEQ ID NO: 5836 - DNA, 26 bp, Artificial Sequence
  Synthetic
gtactctctcagcucaggtctctuag

SEQ ID NO: 5837 - DNA, 29 bp, Artificial Sequence
  Synthetic
ttcctgttaaagaugttttctgcattugg

SEQ ID NO: 5838 - DNA, 23 bp, Artificial Sequence
  Synthetic
taatctggguttttcagcaugcc

SEQ ID NO: 5839 - DNA, 22 bp, Artificial Sequence
  Synthetic
gtugcacccgagaagatugaga

SEQ ID NO: 5840 - DNA, 22 bp, Artificial Sequence
  Synthetic
ctggcugcttttacuccacagt

SEQ ID NO: 5841 - DNA, 25 bp, Artificial Sequence
  Synthetic
tgtggcttcugtgttttgttugaag

SEQ ID NO: 5842 - DNA, 21 bp, Artificial Sequence
  Synthetic
aagcaaataugcagccccuca

SEQ ID NO: 5843 - DNA, 22 bp, Artificial Sequence
  Synthetic
agggagatauccgccttctcuc

SEQ ID NO: 5844 - DNA, 22 bp, Artificial Sequence
  Synthetic
aggutgtccucaagagacacct

SEQ ID NO: 5845 - DNA, 27 bp, Artificial Sequence
  Synthetic
gcccttgaguttccaactaattugact

SEQ ID NO: 5846 - DNA, 17 bp, Artificial Sequence
  Synthetic
gggtggcagugggctua

SEQ ID NO: 5847 - DNA, 20 bp, Artificial Sequence
  Synthetic
cgccucatgtgtcuccacag

SEQ ID NO: 5848 - DNA, 23 bp, Artificial Sequence
  Synthetic
acccttcucacctgagatgcuaa

SEQ ID NO: 5849 - DNA, 20 bp, Artificial Sequence
  Synthetic
ctacctgccucagccaacut

SEQ ID NO: 5850 - DNA, 24 bp, Artificial Sequence
  Synthetic
tgtgacacagugttguggagaaaa

SEQ ID NO: 5851 - DNA, 29 bp, Artificial Sequence
  Synthetic
caagcatcaugacagatctagttcgtuat

SEQ ID NO: 5852 - DNA, 27 bp, Artificial Sequence
  Synthetic
accatactcauttcacttttatugcca

SEQ ID NO: 5853 - DNA, 28 bp, Artificial Sequence
  Synthetic
gtggtggttttugttgttgttaaguaca

SEQ ID NO: 5854 - DNA, 22 bp, Artificial Sequence
  Synthetic
gggatttggautcctgagcaut

SEQ ID NO: 5855 - DNA, 27 bp, Artificial Sequence
  Synthetic
tcttctgatgtutgtagccataguaga

SEQ ID NO: 5856 - DNA, 28 bp, Artificial Sequence
  Synthetic
catatatuaacaacactggcaugcaaca

SEQ ID NO: 5857 - DNA, 28 bp, Artificial Sequence
  Synthetic
atcagaccacgguttctatttttcauct

SEQ ID NO: 5858 - DNA, 22 bp, Artificial Sequence
  Synthetic
ctccacugaggagggttuaaca

SEQ ID NO: 5859 - DNA, 30 bp, Artificial Sequence
  Synthetic
agtcaacaagtaaaucttcccagaaaucaa

SEQ ID NO: 5860 - DNA, 24 bp, Artificial Sequence
  Synthetic
gcctacagtucttctctgtgtugt

SEQ ID NO: 5861 - DNA, 26 bp, Artificial Sequence
  Synthetic
gctacactgauacaagtggaccuaaa

SEQ ID NO: 5862 - DNA, 26 bp, Artificial Sequence
  Synthetic
tcactggaacuactttcactctcuga

SEQ ID NO: 5863 - DNA, 30 bp, Artificial Sequence
  Synthetic
catctcttttaguaactctgaacctucaca

SEQ ID NO: 5864 - DNA, 27 bp, Artificial Sequence
  Synthetic
cagtgggtttcugtaacattgaatugg

SEQ ID NO: 5865 - DNA, 19 bp, Artificial Sequence
  Synthetic
atcaccucgggacccugat

SEQ ID NO: 5866 - DNA, 24 bp, Artificial Sequence
  Synthetic
gaccgtttcugagactgagaagug

SEQ ID NO: 5867 - DNA, 23 bp, Artificial Sequence
  Synthetic
ttgcaatucccaagcctacagua

SEQ ID NO: 5868 - DNA, 17 bp, Artificial Sequence
  Synthetic
ccgcgugagtgctcugg

SEQ ID NO: 5869 - DNA, 20 bp, Artificial Sequence
  Synthetic
ttgagcgtcuctcggaagug

SEQ ID NO: 5870 - DNA, 22 bp, Artificial Sequence
  Synthetic
catgacacuccttccaccucat

SEQ ID NO: 5871 - DNA, 23 bp, Artificial Sequence
  Synthetic
actatcugggaccaagaguagcc

SEQ ID NO: 5872 - DNA, 23 bp, Artificial Sequence
  Synthetic
tcggaatgcuatccttggguagt

SEQ ID NO: 5873 - DNA, 25 bp, Artificial Sequence
  Synthetic
cctgcaccutgaagacatatuccag

SEQ ID NO: 5874 - DNA, 27 bp, Artificial Sequence
  Synthetic
aaaaagatgaaggagaaucccctugag

SEQ ID NO: 5875 - DNA, 25 bp, Artificial Sequence
  Synthetic
cttctagguaagaggcctgaguaca

SEQ ID NO: 5876 - DNA, 23 bp, Artificial Sequence
  Synthetic
caccaatcuctctacatguggca

SEQ ID NO: 5877 - DNA, 29 bp, Artificial Sequence
  Synthetic
ttgctctactuccctgaattgttactuac

SEQ ID NO: 5878 - DNA, 29 bp, Artificial Sequence
  Synthetic
ttgucttttcttcatttuagaccccaaga

SEQ ID NO: 5879 - DNA, 22 bp, Artificial Sequence
  Synthetic
cactcugccttgcaaauggaaa

SEQ ID NO: 5880 - DNA, 22 bp, Artificial Sequence
  Synthetic
cctgtttucttcccaguccaca

SEQ ID NO: 5881 - DNA, 22 bp, Artificial Sequence
  Synthetic
gtcacugctcttctuccgagac

SEQ ID NO: 5882 - DNA, 21 bp, Artificial Sequence
  Synthetic
ttccctgtgugctgacaagut

SEQ ID NO: 5883 - DNA, 20 bp, Artificial Sequence
  Synthetic
aaacccugcaacagaccuga

SEQ ID NO: 5884 - DNA, 23 bp, Artificial Sequence
  Synthetic
gccatctctuctcgctttctcuc

SEQ ID NO: 5885 - DNA, 26 bp, Artificial Sequence
  Synthetic
gataccatguaaagctcagcagtuct

SEQ ID NO: 5886 - DNA, 19 bp, Artificial Sequence
  Synthetic
caagggcugggcgataucc

SEQ ID NO: 5887 - DNA, 24 bp, Artificial Sequence
  Synthetic
ctgatggatcuggactgacagtut

SEQ ID NO: 5888 - DNA, 19 bp, Artificial Sequence
  Synthetic
accagacgucgctcugaac

SEQ ID NO: 5889 - DNA, 22 bp, Artificial Sequence
  Synthetic
tgtcaagggcaaugtaagugct

SEQ ID NO: 5890 - DNA, 25 bp, Artificial Sequence
  Synthetic
cccttctccutttcccttgttauca

SEQ ID NO: 5891 - DNA, 23 bp, Artificial Sequence
  Synthetic
ccccaacccuctctcctatguag

SEQ ID NO: 5892 - DNA, 23 bp, Artificial Sequence
  Synthetic
agaaggttgacgaugttctcgug

SEQ ID NO: 5893 - DNA, 23 bp, Artificial Sequence
  Synthetic
catttgguccccatgtatctgug

SEQ ID NO: 5894 - DNA, 23 bp, Artificial Sequence
  Synthetic
gtaccauccaaatctggcucact

SEQ ID NO: 5895 - DNA, 21 bp, Artificial Sequence
  Synthetic
ctcttcacaccaguggtgguc

SEQ ID NO: 5896 - DNA, 18 bp, Artificial Sequence
  Synthetic
cccucccacucacagggt

SEQ ID NO: 5897 - DNA, 24 bp, Artificial Sequence
  Synthetic
cgtcatauggacattcaucaacgg

SEQ ID NO: 5898 - DNA, 21 bp, Artificial Sequence
  Synthetic
cttgctgaagcauaccccauc

SEQ ID NO: 5899 - DNA, 22 bp, Artificial Sequence
  Synthetic
ccaggccugcaaggtttuaact

SEQ ID NO: 5900 - DNA, 20 bp, Artificial Sequence
  Synthetic
gacuccaccaugggaaacct

SEQ ID NO: 5901 - DNA, 18 bp, Artificial Sequence
  Synthetic
gagctggugcggatucga

SEQ ID NO: 5902 - DNA, 20 bp, Artificial Sequence
  Synthetic
gugagcagauagggcaguag

SEQ ID NO: 5903 - DNA, 24 bp, Artificial Sequence
  Synthetic
ctctgagctuccttgtcacctaug

SEQ ID NO: 5904 - DNA, 21 bp, Artificial Sequence
  Synthetic
gucttctccaucacaccccaa

SEQ ID NO: 5905 - DNA, 20 bp, Artificial Sequence
  Synthetic
gtagcugagagctctgugcc

SEQ ID NO: 5906 - DNA, 22 bp, Artificial Sequence
  Synthetic
ctagtcctucctggtcctcuga

SEQ ID NO: 5907 - DNA, 23 bp, Artificial Sequence
  Synthetic
ctatctgccacuccagtgctaug

SEQ ID NO: 5908 - DNA, 21 bp, Artificial Sequence
  Synthetic
ggtatacaggccutggagcut

SEQ ID NO: 5909 - DNA, 23 bp, Artificial Sequence
  Synthetic
ccttctgutacttccucccacag

SEQ ID NO: 5910 - DNA, 19 bp, Artificial Sequence
  Synthetic
caggatcggugtgccctut

SEQ ID NO: 5911 - DNA, 23 bp, Artificial Sequence
  Synthetic
gggaagaucagaagccagtcaug

SEQ ID NO: 5912 - DNA, 26 bp, Artificial Sequence
  Synthetic
tcattgtgacutcttccaagtuagca

SEQ ID NO: 5913 - DNA, 27 bp, Artificial Sequence
  Synthetic
aagtgagtcugaggatagttcagauga

SEQ ID NO: 5914 - DNA, 29 bp, Artificial Sequence
  Synthetic
atcatctgaagacucttccttgttttuct

SEQ ID NO: 5915 - DNA, 21 bp, Artificial Sequence
  Synthetic
gcagccatugccgaaatcuaa

SEQ ID NO: 5916 - DNA, 28 bp, Artificial Sequence
  Synthetic
ctggcccgaaugtgatttaacatuaaaa

SEQ ID NO: 5917 - DNA, 28 bp, Artificial Sequence
  Synthetic
ctcattaaagaagaaugtgggtcagtuc

SEQ ID NO: 5918 - DNA, 26 bp, Artificial Sequence
  Synthetic
ggtctgaaaaautcatcagtugggat

SEQ ID NO: 5919 - DNA, 22 bp, Artificial Sequence
  Synthetic
guccgagaaagaauccgaaaug

SEQ ID NO: 5920 - DNA, 18 bp, Artificial Sequence
  Synthetic
cctcuccagggcuacagg

SEQ ID NO: 5921 - DNA, 20 bp, Artificial Sequence
  Synthetic
agatcgaagcugcacucagg

SEQ ID NO: 5922 - DNA, 23 bp, Artificial Sequence
  Synthetic
gcaaaaatgugcatagggctcut

SEQ ID NO: 5923 - DNA, 24 bp, Artificial Sequence
  Synthetic
gctgtgatugcacatgatttccug

SEQ ID NO: 5924 - DNA, 17 bp, Artificial Sequence
  Synthetic
gcaacugcgccttucgg

SEQ ID NO: 5925 - DNA, 18 bp, Artificial Sequence
  Synthetic
cuccagacccagcaguga

SEQ ID NO: 5926 - DNA, 18 bp, Artificial Sequence
  Synthetic
gttccaccguggcguaca

SEQ ID NO: 5927 - DNA, 17 bp, Artificial Sequence
  Synthetic
cutgcagccuccccaca

SEQ ID NO: 5928 - DNA, 19 bp, Artificial Sequence
  Synthetic
gatgcatucgaacgcgtug

SEQ ID NO: 5929 - DNA, 20 bp, Artificial Sequence
  Synthetic
agugggatggucaacccaag

SEQ ID NO: 5930 - DNA, 18 bp, Artificial Sequence
  Synthetic
aggctcccuagcggacuc

SEQ ID NO: 5931 - DNA, 26 bp, Artificial Sequence
  Synthetic
tttagaaguggaagcaaaacagucct

SEQ ID NO: 5932 - DNA, 21 bp, Artificial Sequence
  Synthetic
ggtcauggtctgugaaagggt

SEQ ID NO: 5933 - DNA, 20 bp, Artificial Sequence
  Synthetic
tccggcugaacctgaacauc

SEQ ID NO: 5934 - DNA, 17 bp, Artificial Sequence
  Synthetic
agcagggugagcuggga

SEQ ID NO: 5935 - DNA, 20 bp, Artificial Sequence
  Synthetic
cttttcagcccagcugccua

SEQ ID NO: 5936 - DNA, 18 bp, Artificial Sequence
  Synthetic
aagcccagucctcccuca

SEQ ID NO: 5937 - DNA, 22 bp, Artificial Sequence
  Synthetic
cgtgtgtgugtctgtgtcugaa

SEQ ID NO: 5938 - DNA, 18 bp, Artificial Sequence
  Synthetic
ccacctgguccaggtugt

SEQ ID NO: 5939 - DNA, 28 bp, Artificial Sequence
  Synthetic
gcttaaucgaaaaggacaaguacaggaa

SEQ ID NO: 5940 - DNA, 20 bp, Artificial Sequence
  Synthetic
cctgcugacacacaccacug

SEQ ID NO: 5941 - DNA, 22 bp, Artificial Sequence
  Synthetic
aggagctggucaacaggatcua

SEQ ID NO: 5942 - DNA, 28 bp, Artificial Sequence
  Synthetic
gttttagagactgauttctctccagcut

SEQ ID NO: 5943 - DNA, 23 bp, Artificial Sequence
  Synthetic
cgttgccttutctgagtgttuct

SEQ ID NO: 5944 - DNA, 21 bp, Artificial Sequence
  Synthetic
caggtcctuggccttcatcug

SEQ ID NO: 5945 - DNA, 22 bp, Artificial Sequence
  Synthetic
cctcctutttccactucccagt

SEQ ID NO: 5946 - DNA, 21 bp, Artificial Sequence
  Synthetic
cagggttgauatagcggcuga

SEQ ID NO: 5947 - DNA, 24 bp, Artificial Sequence
  Synthetic
gctgttccagugagactgcttuat

SEQ ID NO: 5948 - DNA, 21 bp, Artificial Sequence
  Synthetic
cacgtagccutcgttguaggg

SEQ ID NO: 5949 - DNA, 24 bp, Artificial Sequence
  Synthetic
tccatggccuttccagataaucag

SEQ ID NO: 5950 - DNA, 30 bp, Artificial Sequence
  Synthetic
ctattaaactaaccucttcaggctcaauca

SEQ ID NO: 5951 - DNA, 20 bp, Artificial Sequence
  Synthetic
ccaacggcgaggaucactuc

SEQ ID NO: 5952 - DNA, 24 bp, Artificial Sequence
  Synthetic
aaatggtcaggagcuacctaguct

SEQ ID NO: 5953 - DNA, 24 bp, Artificial Sequence
  Synthetic
gctttcccccucctctgatgatua

SEQ ID NO: 5954 - DNA, 19 bp, Artificial Sequence
  Synthetic
ccggtcagguttcggtgua

SEQ ID NO: 5955 - DNA, 28 bp, Artificial Sequence
  Synthetic
gctccaaagaaagaaaugttctctctuc

SEQ ID NO: 5956 - DNA, 25 bp, Artificial Sequence
  Synthetic
actttcagccugatagtctgguaca

SEQ ID NO: 5957 - DNA, 25 bp, Artificial Sequence
  Synthetic
ctcagcccaagaagaucttactuga

SEQ ID NO: 5958 - DNA, 30 bp, Artificial Sequence
  Synthetic
catgagccagauctctgttaatgaatttuc

SEQ ID NO: 5959 - DNA, 28 bp, Artificial Sequence
  Synthetic
tgtgtgtgatcugaggtttacattctut

SEQ ID NO: 5960 - DNA, 22 bp, Artificial Sequence
  Synthetic
cguccagtattgaucgggagag

SEQ ID NO: 5961 - DNA, 22 bp, Artificial Sequence
  Synthetic
gagacacgcccutacctttcut

SEQ ID NO: 5962 - DNA, 26 bp, Artificial Sequence
  Synthetic
cctgcagatcaucagaggaaataugt

SEQ ID NO: 5963 - DNA, 23 bp, Artificial Sequence
  Synthetic
cggaactgcugtctgcatttaug

SEQ ID NO: 5964 - DNA, 21 bp, Artificial Sequence
  Synthetic
tccctgggaaaugatccuacc

SEQ ID NO: 5965 - DNA, 19 bp, Artificial Sequence
  Synthetic
cctgcagcacacuggtugt

SEQ ID NO: 5966 - DNA, 22 bp, Artificial Sequence
  Synthetic
ccaccgtcaucaccttccttuc

SEQ ID NO: 5967 - DNA, 22 bp, Artificial Sequence
  Synthetic
gcccttcgcacutcttacacut

SEQ ID NO: 5968 - DNA, 29 bp, Artificial Sequence
  Synthetic
tgatcaataatcacccugttgtttgttuc

SEQ ID NO: 5969 - DNA, 30 bp, Artificial Sequence
  Synthetic
gttctctctcuaaaacactgatttcccaut

SEQ ID NO: 5970 - DNA, 24 bp, Artificial Sequence
  Synthetic
cgtcagccugaacataacatccut

SEQ ID NO: 5971 - DNA, 22 bp, Artificial Sequence
  Synthetic
tuttggttttcugaccggaggt

SEQ ID NO: 5972 - DNA, 22 bp, Artificial Sequence
  Synthetic
gggtttccucttcctcctcuca

SEQ ID NO: 5973 - DNA, 23 bp, Artificial Sequence
  Synthetic
catgaaauggacgtggauagcag

SEQ ID NO: 5974 - DNA, 26 bp, Artificial Sequence
  Synthetic
ccaggcctcucacatattgaaatgua

SEQ ID NO: 5975 - DNA, 20 bp, Artificial Sequence
  Synthetic
gggacacgcugccatcatua

SEQ ID NO: 5976 - DNA, 30 bp, Artificial Sequence
  Synthetic
tatgccaaagaaguagaatgagaaaaaugt

SEQ ID NO: 5977 - DNA, 23 bp, Artificial Sequence
  Synthetic
cattctugacgaggtccatguga

SEQ ID NO: 5978 - DNA, 27 bp, Artificial Sequence
  Synthetic
ctcttgaggaucttgaaggaaacugaa

SEQ ID NO: 5979 - DNA, 26 bp, Artificial Sequence
  Synthetic
tggaaatatacagcutgcaaggacuc

SEQ ID NO: 5980 - DNA, 20 bp, Artificial Sequence
  Synthetic
cacgcagcucatgccctucg

SEQ ID NO: 5981 - DNA, 24 bp, Artificial Sequence
  Synthetic
ctccttatcucccctccccgtauc

SEQ ID NO: 5982 - DNA, 27 bp, Artificial Sequence
  Synthetic
aagggattgugattgttcattcaugat

SEQ ID NO: 5983 - DNA, 20 bp, Artificial Sequence
  Synthetic
aggauggaggagatcucgct

SEQ ID NO: 5984 - DNA, 21 bp, Artificial Sequence
  Synthetic
aacttctaccgugccctgaug

SEQ ID NO: 5985 - DNA, 29 bp, Artificial Sequence
  Synthetic
gagagagagagagagauagagauttcaua

SEQ ID NO: 5986 - DNA, 20 bp, Artificial Sequence
  Synthetic
accaguccgtucccaaaagg

SEQ ID NO: 5987 - DNA, 20 bp, Artificial Sequence
  Synthetic
tgtgctgtugacacaggugg

SEQ ID NO: 5988 - DNA, 23 bp, Artificial Sequence
  Synthetic
gacgaggcaacaautaggcttug

SEQ ID NO: 5989 - DNA, 19 bp, Artificial Sequence
  Synthetic
ccutaccuccaggccgaga

SEQ ID NO: 5990 - DNA, 29 bp, Artificial Sequence
  Synthetic
ggttggataagtaguagatggataagcug

SEQ ID NO: 5991 - DNA, 21 bp, Artificial Sequence
  Synthetic
ctccctcgcugtctctcaaug

SEQ ID NO: 5992 - DNA, 20 bp, Artificial Sequence
  Synthetic
aggagtguctgcagguacga

SEQ ID NO: 5993 - DNA, 19 bp, Artificial Sequence
  Synthetic
ccagggautccgcacugac

SEQ ID NO: 5994 - DNA, 21 bp, Artificial Sequence
  Synthetic
ctgggaccugaacttgctcuc

SEQ ID NO: 5995 - DNA, 20 bp, Artificial Sequence
  Synthetic
agtggugcatctugaaccgt

SEQ ID NO: 5996 - DNA, 22 bp, Artificial Sequence
  Synthetic
ggagggtccutgggaaacuaca

SEQ ID NO: 5997 - DNA, 20 bp, Artificial Sequence
  Synthetic
ccctgcugggacagatgtua

SEQ ID NO: 5998 - DNA, 21 bp, Artificial Sequence
  Synthetic
ggattccagutgtcccaggug

SEQ ID NO: 5999 - DNA, 26 bp, Artificial Sequence
  Synthetic
agggagaaugcaaaaatttuggcaat

SEQ ID NO: 6000 - DNA, 22 bp, Artificial Sequence
  Synthetic
ggcttcugagggtctctttcut

SEQ ID NO: 6001 - DNA, 20 bp, Artificial Sequence
  Synthetic
cagtttgcccugaggtugga

SEQ ID NO: 6002 - DNA, 22 bp, Artificial Sequence
  Synthetic
cctccatcuctaatcccccuct

SEQ ID NO: 6003 - DNA, 22 bp, Artificial Sequence
  Synthetic
cctaaccagcuctgagatcgut

SEQ ID NO: 6004 - DNA, 26 bp, Artificial Sequence
  Synthetic
tcagaaauggaacactcatttuccct

SEQ ID NO: 6005 - DNA, 24 bp, Artificial Sequence
  Synthetic
ggcactctguactggttagatucc

SEQ ID NO: 6006 - DNA, 21 bp, Artificial Sequence
  Synthetic
gcagggataucagggcctcut

SEQ ID NO: 6007 - DNA, 21 bp, Artificial Sequence
  Synthetic
gctgaggacuacguagcagag

SEQ ID NO: 6008 - DNA, 17 bp, Artificial Sequence
  Synthetic
cggaccgaaucggcuct

SEQ ID NO: 6009 - DNA, 22 bp, Artificial Sequence
  Synthetic
agcttcttcugtctctccucgt

SEQ ID NO: 6010 - DNA, 28 bp, Artificial Sequence
  Synthetic
gtcagcacaccaugatttgaatatugat

SEQ ID NO: 6011 - DNA, 29 bp, Artificial Sequence
  Synthetic
ctcatgactggtuatttctccactatgua

SEQ ID NO: 6012 - DNA, 28 bp, Artificial Sequence
  Synthetic
tctgttcccuaatacagtcactucagaa

SEQ ID NO: 6013 - DNA, 27 bp, Artificial Sequence
  Synthetic
tctgttgtttggcutgtagtaagtcug

SEQ ID NO: 6014 - DNA, 28 bp, Artificial Sequence
  Synthetic
guacaacgaauggaacaagaaacacaaa

SEQ ID NO: 6015 - DNA, 22 bp, Artificial Sequence
  Synthetic
atttcctccauctgtgccaugt

SEQ ID NO: 6016 - DNA, 27 bp, Artificial Sequence
  Synthetic
gaccttgtugaagaattgagctttuca

SEQ ID NO: 6017 - DNA, 28 bp, Artificial Sequence
  Synthetic
gcagaaacaatcucagctttcaaatcut

SEQ ID NO: 6018 - DNA, 31 bp, Artificial Sequence
  Synthetic
ccaaacugaaggaagatttagaaatugaaca

SEQ ID NO: 6019 - DNA, 26 bp, Artificial Sequence
  Synthetic
aaattgtccttutcaaactgcauggt

SEQ ID NO: 6020 - DNA, 28 bp, Artificial Sequence
  Synthetic
acaacttgaaguagagaauagcattcut

SEQ ID NO: 6021 - DNA, 28 bp, Artificial Sequence
  Synthetic
gtctttggattuggacttaatggaguct

SEQ ID NO: 6022 - DNA, 22 bp, Artificial Sequence
  Synthetic
gaggagtaugcttgccttcuca

SEQ ID NO: 6023 - DNA, 30 bp, Artificial Sequence
  Synthetic
acagaacttttcautttcactgtagtugga

SEQ ID NO: 6024 - DNA, 26 bp, Artificial Sequence
  Synthetic
ctgtcacagagacugtctgatcttuc

SEQ ID NO: 6025 - DNA, 29 bp, Artificial Sequence
  Synthetic
tgccctgttguggttaataatgatttcua

SEQ ID NO: 6026 - DNA, 28 bp, Artificial Sequence
  Synthetic
ggagaagaaaguaagcaagaacagtuga

SEQ ID NO: 6027 - DNA, 29 bp, Artificial Sequence
  Synthetic
atgaagaagtaaacauacctgttctgaut

SEQ ID NO: 6028 - DNA, 29 bp, Artificial Sequence
  Synthetic
gatgcagactttuactgtgaagtgaaaut

SEQ ID NO: 6029 - DNA, 23 bp, Artificial Sequence
  Synthetic
ccatcucacagaccttgctuagt

SEQ ID NO: 6030 - DNA, 28 bp, Artificial Sequence
  Synthetic
atgtagttttcuggtgaatttggaguga

SEQ ID NO: 6031 - DNA, 31 bp, Artificial Sequence
  Synthetic
aaggctcaaagggaauataaaccaagauaat

SEQ ID NO: 6032 - DNA, 30 bp, Artificial Sequence
  Synthetic
agagttaggagaacauggaaaggaaattut

SEQ ID NO: 6033 - DNA, 26 bp, Artificial Sequence
  Synthetic
aaggaggcatacutacagactgtcua

SEQ ID NO: 6034 - DNA, 30 bp, Artificial Sequence
  Synthetic
cttctcctctctucctttacacaaactuaa

SEQ ID NO: 6035 - DNA, 27 bp, Artificial Sequence
  Synthetic
cautagacaaaatcucaggaggcacat

SEQ ID NO: 6036 - DNA, 27 bp, Artificial Sequence
  Synthetic
aacatgtggucaaaagtaacugaggaa

SEQ ID NO: 6037 - DNA, 26 bp, Artificial Sequence
  Synthetic
gcttgtagucgagagctaatgtucag

SEQ ID NO: 6038 - DNA, 28 bp, Artificial Sequence
  Synthetic
tgtattataggcgucattgatggctaug

SEQ ID NO: 6039 - DNA, 22 bp, Artificial Sequence
  Synthetic
cctccaattcutgcaacctgut

SEQ ID NO: 6040 - DNA, 29 bp, Artificial Sequence
  Synthetic
agcttctctaaauactgtttcttcagcua

SEQ ID NO: 6041 - DNA, 26 bp, Artificial Sequence
  Synthetic
ctggaaucgaggaauaaccttaagut

SEQ ID NO: 6042 - DNA, 24 bp, Artificial Sequence
  Synthetic
agguagaggaucgaaaacacttug

SEQ ID NO: 6043 - DNA, 29 bp, Artificial Sequence
  Synthetic
tcaaaccacgcugtgtcatttaaaaauaa

SEQ ID NO: 6044 - DNA, 28 bp, Artificial Sequence
  Synthetic
tgaaaaactucaacaggaatuggcaaat

SEQ ID NO: 6045 - DNA, 29 bp, Artificial Sequence
  Synthetic
ggtcatttcttcautagcggtttctacut

SEQ ID NO: 6046 - DNA, 29 bp, Artificial Sequence
  Synthetic
ttttgaagaaaauggcaaaggttccauaa

SEQ ID NO: 6047 - DNA, 28 bp, Artificial Sequence
  Synthetic
gccttgttctugcatgtcttttattugt

SEQ ID NO: 6048 - DNA, 28 bp, Artificial Sequence
  Synthetic
gggtcagatataucagcattaacctuga

SEQ ID NO: 6049 - DNA, 30 bp, Artificial Sequence
  Synthetic
tgtagttctagcagcutcttttcttttuct

SEQ ID NO: 6050 - DNA, 23 bp, Artificial Sequence
  Synthetic
ctcgaggcucttagagctgaauc

SEQ ID NO: 6051 - DNA, 30 bp, Artificial Sequence
  Synthetic
ggtagaaatgagugaattaggagctatgut

SEQ ID NO: 6052 - DNA, 28 bp, Artificial Sequence
  Synthetic
gtgaatgttccucagaagaagttacuga

SEQ ID NO: 6053 - DNA, 28 bp, Artificial Sequence
  Synthetic
gcaacatagtgtuccctctttaaggtut

SEQ ID NO: 6054 - DNA, 23 bp, Artificial Sequence
  Synthetic
aggtgctttcuctcactgaguct

SEQ ID NO: 6055 - DNA, 30 bp, Artificial Sequence
  Synthetic
tttgcagttgcauctttgtaattaaaucct

SEQ ID NO: 6056 - DNA, 27 bp, Artificial Sequence
  Synthetic
tgtattgcctutacattgctctucact

SEQ ID NO: 6057 - DNA, 26 bp, Artificial Sequence
  Synthetic
gcagtgccugaatttcagauaacaaa

SEQ ID NO: 6058 - DNA, 25 bp, Artificial Sequence
  Synthetic
tgcttcgucaacatagctttaugga

SEQ ID NO: 6059 - DNA, 20 bp, Artificial Sequence
  Synthetic
gcgtcccaacutggcttuct

SEQ ID NO: 6060 - DNA, 27 bp, Artificial Sequence
  Synthetic
cgaattcgggaaaugagtagtacccua

SEQ ID NO: 6061 - DNA, 26 bp, Artificial Sequence
  Synthetic
ctgtgtttttccuctagctgtttcug

SEQ ID NO: 6062 - DNA, 25 bp, Artificial Sequence
  Synthetic
aggaatcaugcaggaatuccagaag

SEQ ID NO: 6063 - DNA, 22 bp, Artificial Sequence
  Synthetic
taatgaucaaagggctgcagug

SEQ ID NO: 6064 - DNA, 25 bp, Artificial Sequence
  Synthetic
ggtaguaaacacccccaatugagaa

SEQ ID NO: 6065 - DNA, 29 bp, Artificial Sequence
  Synthetic
ctggccagtuaatttctgtagttguaaaa

SEQ ID NO: 6066 - DNA, 28 bp, Artificial Sequence
  Synthetic
tgacttaaggaacauggttatgaagcug

SEQ ID NO: 6067 - DNA, 25 bp, Artificial Sequence
  Synthetic
acagcagaaaugataagcaugcact

SEQ ID NO: 6068 - DNA, 23 bp, Artificial Sequence
  Synthetic
gcagaaagttutcgaaaggcuct

SEQ ID NO: 6069 - DNA, 23 bp, Artificial Sequence
  Synthetic
cacctctagauccgtgaaagcug

SEQ ID NO: 6070 - DNA, 26 bp, Artificial Sequence
  Synthetic
tgggutactttaggugcagaaaagac

SEQ ID NO: 6071 - DNA, 27 bp, Artificial Sequence
  Synthetic
tccaggcaggutttctcatattctuac

SEQ ID NO: 6072 - DNA, 27 bp, Artificial Sequence
  Synthetic
tcaatttcatgcuggcatgagaagaua

SEQ ID NO: 6073 - DNA, 24 bp, Artificial Sequence
  Synthetic
agctgtgttcauattggtcccaut

SEQ ID NO: 6074 - DNA, 25 bp, Artificial Sequence
  Synthetic
gctactgaacugatatttgugccca

SEQ ID NO: 6075 - DNA, 27 bp, Artificial Sequence
  Synthetic
tttcattcaaaatcugcccaaccaaut

SEQ ID NO: 6076 - DNA, 29 bp, Artificial Sequence
  Synthetic
ggacagacugtcattcaaaauaggaaaaa

SEQ ID NO: 6077 - DNA, 27 bp, Artificial Sequence
  Synthetic
cgatcuaaaaccacagaacattcuggt

SEQ ID NO: 6078 - DNA, 17 bp, Artificial Sequence
  Synthetic
tcugccccgcaccttuc

SEQ ID NO: 6079 - DNA, 18 bp, Artificial Sequence
  Synthetic
caugccgctcuccaccat

SEQ ID NO: 6080 - DNA, 18 bp, Artificial Sequence
  Synthetic
acaggccguccttcucca

SEQ ID NO: 6081 - DNA, 22 bp, Artificial Sequence
  Synthetic
ggagcaaguaaagcuagaccga

SEQ ID NO: 6082 - DNA, 31 bp, Artificial Sequence
  Synthetic
tctgtctatgaatgutagtctgttctttugg

SEQ ID NO: 6083 - DNA, 24 bp, Artificial Sequence
  Synthetic
ccagatcucagtaagguacggagt

SEQ ID NO: 6084 - DNA, 30 bp, Artificial Sequence
  Synthetic
gttgagacctucaatgactttctaguaact

SEQ ID NO: 6085 - DNA, 28 bp, Artificial Sequence
  Synthetic
ggtgattttgguctagctacagugaaat

SEQ ID NO: 6086 - DNA, 32 bp, Artificial Sequence
  Synthetic
tcgtgcaatatcuataagtttgatcatcucaa

SEQ ID NO: 6087 - DNA, 28 bp, Artificial Sequence
  Synthetic
gtacaggaaaauacgacaugtgaatauc

SEQ ID NO: 6088 - DNA, 23 bp, Artificial Sequence
  Synthetic
tctttgucccactgtaatcugcc

SEQ ID NO: 6089 - DNA, 25 bp, Artificial Sequence
  Synthetic
tgtatccctcucaggcataagguaa

SEQ ID NO: 6090 - DNA, 31 bp, Artificial Sequence
  Synthetic
tttttagttctagcaaugctggatactuaca

SEQ ID NO: 6091 - DNA, 27 bp, Artificial Sequence
  Synthetic
tctccttcaaaauccattccaatucca

SEQ ID NO: 6092 - DNA, 27 bp, Artificial Sequence
  Synthetic
cagactttuagacatcgtagctucaca

SEQ ID NO: 6093 - DNA, 26 bp, Artificial Sequence
  Synthetic
tccgctgucaaacatgtggttauaaa

SEQ ID NO: 6094 - DNA, 22 bp, Artificial Sequence
  Synthetic
gcacagcacuctgggatuagac

SEQ ID NO: 6095 - DNA, 31 bp, Artificial Sequence
  Synthetic
aatgtaatttgcuccctttacctcttaucaa

SEQ ID NO: 6096 - DNA, 31 bp, Artificial Sequence
  Synthetic
cccacctccuaaaataatcaagattaucagt

SEQ ID NO: 6097 - DNA, 26 bp, Artificial Sequence
  Synthetic
acacaggaacauatagaggccctaut

SEQ ID NO: 6098 - DNA, 17 bp, Artificial Sequence
  Synthetic
cuccggaauggcagggt

SEQ ID NO: 6099 - DNA, 19 bp, Artificial Sequence
  Synthetic
gccccggcuctcggttaua

SEQ ID NO: 6100 - DNA, 24 bp, Artificial Sequence
  Synthetic
tccatcaucacaggacugaaaagg

SEQ ID NO: 6101 - DNA, 22 bp, Artificial Sequence
  Synthetic
ttcactgggcugtgcttactut

SEQ ID NO: 6102 - DNA, 26 bp, Artificial Sequence
  Synthetic
ccagctaaaucatctaaggcaaucct

SEQ ID NO: 6103 - DNA, 20 bp, Artificial Sequence
  Synthetic
gucttacttguggagccgct

SEQ ID NO: 6104 - DNA, 30 bp, Artificial Sequence
  Synthetic
ttgttaagctaauaatgagaggaauggaaa

SEQ ID NO: 6105 - DNA, 23 bp, Artificial Sequence
  Synthetic
ggauttgtagctucccgcagaaa

SEQ ID NO: 6106 - DNA, 26 bp, Artificial Sequence
  Synthetic
acaacacgaacuttcacagaacagua

SEQ ID NO: 6107 - DNA, 25 bp, Artificial Sequence
  Synthetic
gctggaaucaaaggauacagacagt

SEQ ID NO: 6108 - DNA, 26 bp, Artificial Sequence
  Synthetic
ttgtctagagcugtttctgtgttcut

SEQ ID NO: 6109 - DNA, 25 bp, Artificial Sequence
  Synthetic
agtggaacuggaagagugaaaaagt

SEQ ID NO: 6110 - DNA, 24 bp, Artificial Sequence
  Synthetic
gctgtgcccutatctggaaacaut

SEQ ID NO: 6111 - DNA, 33 bp, Artificial Sequence
  Synthetic
tagagacataatugggtagagaaaaugaaagat

SEQ ID NO: 6112 - DNA, 25 bp, Artificial Sequence
  Synthetic
ccccgtgtacuttcccatcataaut

SEQ ID NO: 6113 - DNA, 31 bp, Artificial Sequence
  Synthetic
ttcacatttgatactuagagtaaacctgcut

SEQ ID NO: 6114 - DNA, 24 bp, Artificial Sequence
  Synthetic
cctttacttcaucagctcgtcuga

SEQ ID NO: 6115 - DNA, 27 bp, Artificial Sequence
  Synthetic
gcutttagaataatcaugggccagact

SEQ ID NO: 6116 - DNA, 28 bp, Artificial Sequence
  Synthetic
ttttctgtcuaccctcaguaagaagact

SEQ ID NO: 6117 - DNA, 28 bp, Artificial Sequence
  Synthetic
cctgtttttccaacutaacactcaugaa

SEQ ID NO: 6118 - DNA, 24 bp, Artificial Sequence
  Synthetic
cggagtgaagccauttatgccuac

SEQ ID NO: 6119 - DNA, 28 bp, Artificial Sequence
  Synthetic
gggtgtacagucttaaatatuacagcaa

SEQ ID NO: 6120 - DNA, 23 bp, Artificial Sequence
  Synthetic
cuttatgacctucggcacaaagt

SEQ ID NO: 6121 - DNA, 23 bp, Artificial Sequence
  Synthetic
caaggacaguaactaccauggct

SEQ ID NO: 6122 - DNA, 22 bp, Artificial Sequence
  Synthetic
gcctcatcugagagtggaucag

SEQ ID NO: 6123 - DNA, 24 bp, Artificial Sequence
  Synthetic
catctcaccutgcacttctcucat

SEQ ID NO: 6124 - DNA, 20 bp, Artificial Sequence
  Synthetic
gtatccccaccgcucctuag

SEQ ID NO: 6125 - DNA, 29 bp, Artificial Sequence
  Synthetic
ttgacatttgtuaacactgttgattgcut

SEQ ID NO: 6126 - DNA, 23 bp, Artificial Sequence
  Synthetic
gcatggatgacugcagtgaatut

SEQ ID NO: 6127 - DNA, 21 bp, Artificial Sequence
  Synthetic
ggaacattugctccagcauga

SEQ ID NO: 6128 - DNA, 26 bp, Artificial Sequence
  Synthetic
gagctgacctuttggattcatctuct

SEQ ID NO: 6129 - DNA, 22 bp, Artificial Sequence
  Synthetic
ggatgggagutgccattctcug

SEQ ID NO: 6130 - DNA, 22 bp, Artificial Sequence
  Synthetic
tctgucacagcgagaatcctug

SEQ ID NO: 6131 - DNA, 22 bp, Artificial Sequence
  Synthetic
ctctcaggaaguacatgcuggt

SEQ ID NO: 6132 - DNA, 27 bp, Artificial Sequence
  Synthetic
actttggatcucaaattgtgcacauac

SEQ ID NO: 6133 - DNA, 26 bp, Artificial Sequence
  Synthetic
gagaaaaucgccgaaagtuaccaaaa

SEQ ID NO: 6134 - DNA, 22 bp, Artificial Sequence
  Synthetic
tcctaccgcugtgttcttcuct

SEQ ID NO: 6135 - DNA, 20 bp, Artificial Sequence
  Synthetic
caaucctctugacccaggca

SEQ ID NO: 6136 - DNA, 21 bp, Artificial Sequence
  Synthetic
gctttggaagcuctcagggua

SEQ ID NO: 6137 - DNA, 17 bp, Artificial Sequence
  Synthetic
gtctgcccguggaccug

SEQ ID NO: 6138 - DNA, 21 bp, Artificial Sequence
  Synthetic
cccctucagatcttcucagca

SEQ ID NO: 6139 - DNA, 22 bp, Artificial Sequence
  Synthetic
gcutcgattcuccggaaaaagg

SEQ ID NO: 6140 - DNA, 18 bp, Artificial Sequence
  Synthetic
gccagccccucctcttuc

SEQ ID NO: 6141 - DNA, 24 bp, Artificial Sequence
  Synthetic
gctaagtgcucggagttaauagca

SEQ ID NO: 6142 - DNA, 20 bp, Artificial Sequence
  Synthetic
ggagggucaccaagaaccug

SEQ ID NO: 6143 - DNA, 20 bp, Artificial Sequence
  Synthetic
tgggtcccaguctgcagtua

SEQ ID NO: 6144 - DNA, 18 bp, Artificial Sequence
  Synthetic
ctccucggccaaguccac

SEQ ID NO: 6145 - DNA, 18 bp, Artificial Sequence
  Synthetic
cagacccugccactcuca

SEQ ID NO: 6146 - DNA, 17 bp, Artificial Sequence
  Synthetic
cggctuccaggagcugt

SEQ ID NO: 6147 - DNA, 22 bp, Artificial Sequence
  Synthetic
tttacggccaacgguggatuat

SEQ ID NO: 6148 - DNA, 18 bp, Artificial Sequence
  Synthetic
gcgccuggattgcttcug

SEQ ID NO: 6149 - DNA, 19 bp, Artificial Sequence
  Synthetic
ccctuggcccagcugaaaa

SEQ ID NO: 6150 - DNA, 29 bp, Artificial Sequence
  Synthetic
catgtctttcctcuactgatgatgatcug

SEQ ID NO: 6151 - DNA, 28 bp, Artificial Sequence
  Synthetic
cgtctttagaaagugaaaggtucagaga

SEQ ID NO: 6152 - DNA, 23 bp, Artificial Sequence
  Synthetic
gcttuccagcaaaatugaaggca

SEQ ID NO: 6153 - DNA, 27 bp, Artificial Sequence
  Synthetic
ctttcaaattgaggacucgcaaagaut

SEQ ID NO: 6154 - DNA, 28 bp, Artificial Sequence
  Synthetic
attttcatuggcagaagagguagaaaga

SEQ ID NO: 6155 - DNA, 23 bp, Artificial Sequence
  Synthetic
ctgtttctguaacatggccucct

SEQ ID NO: 6156 - DNA, 27 bp, Artificial Sequence
  Synthetic
accatagaatuaacacgagcatgucag

SEQ ID NO: 6157 - DNA, 23 bp, Artificial Sequence
  Synthetic
cattccatcccaugtgggcttua

SEQ ID NO: 6158 - DNA, 26 bp, Artificial Sequence
  Synthetic
gagcatgguttttaaattugcagcac

SEQ ID NO: 6159 - DNA, 25 bp, Artificial Sequence
  Synthetic
ttagcattgcugctttgctttuaca

SEQ ID NO: 6160 - DNA, 26 bp, Artificial Sequence
  Synthetic
acaacttgaaagucgtttggaugaga

SEQ ID NO: 6161 - DNA, 31 bp, Artificial Sequence
  Synthetic
tttcttttaccagcaauaacactgattuacc

SEQ ID NO: 6162 - DNA, 24 bp, Artificial Sequence
  Synthetic
gcacagtgagggutccatagtuaa

SEQ ID NO: 6163 - DNA, 20 bp, Artificial Sequence
  Synthetic
gttuagccgagcctcuagct

SEQ ID NO: 6164 - DNA, 28 bp, Artificial Sequence
  Synthetic
cgttagtagtgaaaauatgctggcaugt

SEQ ID NO: 6165 - DNA, 23 bp, Artificial Sequence
  Synthetic
ttcuggacgaaccaaaccaucaa

SEQ ID NO: 6166 - DNA, 29 bp, Artificial Sequence
  Synthetic
tcacagaugaattttgauaagaggcaaca

SEQ ID NO: 6167 - DNA, 24 bp, Artificial Sequence
  Synthetic
ccttctcttcaucagcttccugaa

SEQ ID NO: 6168 - DNA, 26 bp, Artificial Sequence
  Synthetic
gaagtccctucatggaactgttauga

SEQ ID NO: 6169 - DNA, 26 bp, Artificial Sequence
  Synthetic
agcaagatcaauaatacaagtugcca

SEQ ID NO: 6170 - DNA, 26 bp, Artificial Sequence
  Synthetic
agacaacaaaggaggcuttgaaaaug

SEQ ID NO: 6171 - DNA, 28 bp, Artificial Sequence
  Synthetic
agaattcctacttutgatgatggtggug

SEQ ID NO: 6172 - DNA, 25 bp, Artificial Sequence
  Synthetic
tttctttgaagaugcagacagugga

SEQ ID NO: 6173 - DNA, 23 bp, Artificial Sequence
  Synthetic
ggguacaggagaaccaucaggaa

SEQ ID NO: 6174 - DNA, 25 bp, Artificial Sequence
  Synthetic
tgtgatgttucagcactgcatttut

SEQ ID NO: 6175 - DNA, 17 bp, Artificial Sequence
  Synthetic
tctccgacugccgctug

SEQ ID NO: 6176 - DNA, 29 bp, Artificial Sequence
  Synthetic
tgtagatgaaautgagtgcatugagaaga

SEQ ID NO: 6177 - DNA, 21 bp, Artificial Sequence
  Synthetic
guaagctgacucacccacact

SEQ ID NO: 6178 - DNA, 26 bp, Artificial Sequence
  Synthetic
agcaaaagacucagacttccaatgut

SEQ ID NO: 6179 - DNA, 21 bp, Artificial Sequence
  Synthetic
gcagatccuaagggacucgga

SEQ ID NO: 6180 - DNA, 24 bp, Artificial Sequence
  Synthetic
ttagggcauaaaaaggaggagcug

SEQ ID NO: 6181 - DNA, 23 bp, Artificial Sequence
  Synthetic
cactgtccuacgactctucagaa

SEQ ID NO: 6182 - DNA, 23 bp, Artificial Sequence
  Synthetic
aaugaacaaagccagtguaccct

SEQ ID NO: 6183 - DNA, 23 bp, Artificial Sequence
  Synthetic
tgccactctauttcccctttcug

SEQ ID NO: 6184 - DNA, 30 bp, Artificial Sequence
  Synthetic
agcaaaauggagcaatcaaactuagaaaag

SEQ ID NO: 6185 - DNA, 24 bp, Artificial Sequence
  Synthetic
cactttcactgutttgctgcctua

SEQ ID NO: 6186 - DNA, 24 bp, Artificial Sequence
  Synthetic
tgggcaaauaggtttgaagacugt

SEQ ID NO: 6187 - DNA, 22 bp, Artificial Sequence
  Synthetic
aggcucacaugagccacaaaat

SEQ ID NO: 6188 - DNA, 24 bp, Artificial Sequence
  Synthetic
gggtcttuggctaaacctacugaa

SEQ ID NO: 6189 - DNA, 21 bp, Artificial Sequence
  Synthetic
gtcaagaacuggtuccgcaga

SEQ ID NO: 6190 - DNA, 25 bp, Artificial Sequence
  Synthetic
ggaaatggcaacaautgaactggua

SEQ ID NO: 6191 - DNA, 20 bp, Artificial Sequence
  Synthetic
gagcccagugagtcctcuct

SEQ ID NO: 6192 - DNA, 25 bp, Artificial Sequence
  Synthetic
cttccatttguagcagcagatgaut

SEQ ID NO: 6193 - DNA, 24 bp, Artificial Sequence
  Synthetic
cccaatgugcccagtatctcauac

SEQ ID NO: 6194 - DNA, 23 bp, Artificial Sequence
  Synthetic
gaaaagaatgccucagccagaug

SEQ ID NO: 6195 - DNA, 25 bp, Artificial Sequence
  Synthetic
acaggcaaaguaaactacaguggag

SEQ ID NO: 6196 - DNA, 21 bp, Artificial Sequence
  Synthetic
ccccuttctctuccagaagcc

SEQ ID NO: 6197 - DNA, 27 bp, Artificial Sequence
  Synthetic
ccacaaaaucatacagugcaacgaaaa

SEQ ID NO: 6198 - DNA, 19 bp, Artificial Sequence
  Synthetic
gcugagcagcgggaucaat

SEQ ID NO: 6199 - DNA, 18 bp, Artificial Sequence
  Synthetic
ctgccaaggguccccuac

SEQ ID NO: 6200 - DNA, 29 bp, Artificial Sequence
  Synthetic
ccactgaaaagcacutcctgaaataatut

SEQ ID NO: 6201 - DNA, 17 bp, Artificial Sequence
  Synthetic
cccgggcutacucacca

SEQ ID NO: 6202 - DNA, 21 bp, Artificial Sequence
  Synthetic
gattttggccugagcaggtug

SEQ ID NO: 6203 - DNA, 22 bp, Artificial Sequence
  Synthetic
agucaggaaggaccactucagt

SEQ ID NO: 6204 - DNA, 24 bp, Artificial Sequence
  Synthetic
ggctgctggauttttgtttctguc

SEQ ID NO: 6205 - DNA, 19 bp, Artificial Sequence
  Synthetic
gcacgtcaguggtgtcuct

SEQ ID NO: 6206 - DNA, 21 bp, Artificial Sequence
  Synthetic
caacttgtucagcgcctugat

SEQ ID NO: 6207 - DNA, 17 bp, Artificial Sequence
  Synthetic
gtgccccgutgctgaug

SEQ ID NO: 6208 - DNA, 24 bp, Artificial Sequence
  Synthetic
gacagtttgacucgtccacattug

SEQ ID NO: 6209 - DNA, 24 bp, Artificial Sequence
  Synthetic
tgtcttugaagacctcaucagcag

SEQ ID NO: 6210 - DNA, 19 bp, Artificial Sequence
  Synthetic
gccgaggaguccagaguga

SEQ ID NO: 6211 - DNA, 18 bp, Artificial Sequence
  Synthetic
gggctttccuccagccut

SEQ ID NO: 6212 - DNA, 19 bp, Artificial Sequence
  Synthetic
accgcctucatccctcuca

SEQ ID NO: 6213 - DNA, 17 bp, Artificial Sequence
  Synthetic
ctggccauctgcucgga

SEQ ID NO: 6214 - DNA, 26 bp, Artificial Sequence
  Synthetic
gaaatcagtgacauagtgcagaggua

SEQ ID NO: 6215 - DNA, 17 bp, Artificial Sequence
  Synthetic
ctgggccaaggugcuga

SEQ ID NO: 6216 - DNA, 18 bp, Artificial Sequence
  Synthetic
cgccagcgguaccttucc

SEQ ID NO: 6217 - DNA, 22 bp, Artificial Sequence
  Synthetic
agtctgagugcccatttgtucc

SEQ ID NO: 6218 - DNA, 20 bp, Artificial Sequence
  Synthetic
caggagccutcttctgcuga

SEQ ID NO: 6219 - DNA, 22 bp, Artificial Sequence
  Synthetic
tcucaggccccaguaaacaaac

SEQ ID NO: 6220 - DNA, 19 bp, Artificial Sequence
  Synthetic
gcgctuaccccacacugag

SEQ ID NO: 6221 - DNA, 19 bp, Artificial Sequence
  Synthetic
tgctgatguccggctgaug

SEQ ID NO: 6222 - DNA, 18 bp, Artificial Sequence
  Synthetic
ccttctugcctgcgugct

SEQ ID NO: 6223 - DNA, 17 bp, Artificial Sequence
  Synthetic
gtcggccaucacugcca

SEQ ID NO: 6224 - DNA, 18 bp, Artificial Sequence
  Synthetic
ctgccccagcucccttua

SEQ ID NO: 6225 - DNA, 27 bp, Artificial Sequence
  Synthetic
ctaatggcccaagcuttagagaaaaut

SEQ ID NO: 6226 - DNA, 22 bp, Artificial Sequence
  Synthetic
tctucaccaccacattcugcat

SEQ ID NO: 6227 - DNA, 17 bp, Artificial Sequence
  Synthetic
gugagcugccggaggat

SEQ ID NO: 6228 - DNA, 21 bp, Artificial Sequence
  Synthetic
accagucactcgatugcagac

SEQ ID NO: 6229 - DNA, 27 bp, Artificial Sequence
  Synthetic
gtgcactcatgugatatttcaactgut

SEQ ID NO: 6230 - DNA, 21 bp, Artificial Sequence
  Synthetic
actgttgcugtatgccugcaa

SEQ ID NO: 6231 - DNA, 24 bp, Artificial Sequence
  Synthetic
aggcagatatcucgacacaacuct

SEQ ID NO: 6232 - DNA, 21 bp, Artificial Sequence
  Synthetic
cacagcaaugggaaugccaat

SEQ ID NO: 6233 - DNA, 22 bp, Artificial Sequence
  Synthetic
ttagtggccutgggtgatuaca

SEQ ID NO: 6234 - DNA, 21 bp, Artificial Sequence
  Synthetic
ggacttggcgguttctgagua

SEQ ID NO: 6235 - DNA, 28 bp, Artificial Sequence
  Synthetic
gtgtuaaaacacuaggagaacaattuga

SEQ ID NO: 6236 - DNA, 25 bp, Artificial Sequence
  Synthetic
tgcaggcuatttacttcttuggcat

SEQ ID NO: 6237 - DNA, 23 bp, Artificial Sequence
  Synthetic
gccaacaaugtactccagtugct

SEQ ID NO: 6238 - DNA, 21 bp, Artificial Sequence
  Synthetic
gtaacatcugcagctcugcca

SEQ ID NO: 6239 - DNA, 17 bp, Artificial Sequence
  Synthetic
gaggugccgucccacaa

SEQ ID NO: 6240 - DNA, 23 bp, Artificial Sequence
  Synthetic
agtcggtaccacuttcaggagua

SEQ ID NO: 6241 - DNA, 22 bp, Artificial Sequence
  Synthetic
caagtcacacggutggttucac

SEQ ID NO: 6242 - DNA, 21 bp, Artificial Sequence
  Synthetic
cttcctcuggagcctcaagut

SEQ ID NO: 6243 - DNA, 23 bp, Artificial Sequence
  Synthetic
ggctgaacugaagtctcctttut

SEQ ID NO: 6244 - DNA, 28 bp, Artificial Sequence
  Synthetic
agaacaagcugagaacgagaaaauacaa

SEQ ID NO: 6245 - DNA, 27 bp, Artificial Sequence
  Synthetic
gaacuagaacagcatctugaacaagag

SEQ ID NO: 6246 - DNA, 19 bp, Artificial Sequence
  Synthetic
cacucacgatggucacgct

SEQ ID NO: 6247 - DNA, 19 bp, Artificial Sequence
  Synthetic
gcattgtcauctcgccgut

SEQ ID NO: 6248 - DNA, 28 bp, Artificial Sequence
  Synthetic
tgaaaattgucacgaaacaatgagctut

SEQ ID NO: 6249 - DNA, 28 bp, Artificial Sequence
  Synthetic
tgctaaggttacuccattttctgactut

SEQ ID NO: 6250 - DNA, 28 bp, Artificial Sequence
  Synthetic
actcttcutttaggattcuccaaaagcc

SEQ ID NO: 6251 - DNA, 26 bp, Artificial Sequence
  Synthetic
acttttctcggcuaacctacctauga

SEQ ID NO: 6252 - DNA, 27 bp, Artificial Sequence
  Synthetic
agaacctcaagguttttcttagggtut

SEQ ID NO: 6253 - DNA, 26 bp, Artificial Sequence
  Synthetic
tccaactggaauaaatgcttcaucct

SEQ ID NO: 6254 - DNA, 28 bp, Artificial Sequence
  Synthetic
cggtgaaaguattctttaccacugaaga

SEQ ID NO: 6255 - DNA, 22 bp, Artificial Sequence
  Synthetic
ggcttccaccugtacctcacua

SEQ ID NO: 6256 - DNA, 24 bp, Artificial Sequence
  Synthetic
ccaccugcacacagaaatttaugg

SEQ ID NO: 6257 - DNA, 24 bp, Artificial Sequence
  Synthetic
caaagaaccacucacctgtugaat

SEQ ID NO: 6258 - DNA, 21 bp, Artificial Sequence
  Synthetic
accgagugatccgtcauacga

SEQ ID NO: 6259 - DNA, 26 bp, Artificial Sequence
  Synthetic
gtgagcagagaauatatttgguggca

SEQ ID NO: 6260 - DNA, 27 bp, Artificial Sequence
  Synthetic
agatattccttguagagcttctccuga

SEQ ID NO: 6261 - DNA, 21 bp, Artificial Sequence
  Synthetic
caggugcagaggagaccaaua

SEQ ID NO: 6262 - DNA, 22 bp, Artificial Sequence
  Synthetic
tctccttgugacacctcuccaa

SEQ ID NO: 6263 - DNA, 23 bp, Artificial Sequence
  Synthetic
gaactgctcugcttctccuacag

SEQ ID NO: 6264 - DNA, 20 bp, Artificial Sequence
  Synthetic
gctttccgggcugccataua

SEQ ID NO: 6265 - DNA, 25 bp, Artificial Sequence
  Synthetic
tgtgtttucaggtctgactucacat

SEQ ID NO: 6266 - DNA, 22 bp, Artificial Sequence
  Synthetic
cgagtgcuacagccatuacaca

SEQ ID NO: 6267 - DNA, 27 bp, Artificial Sequence
  Synthetic
ggctgcaaaaugtcaaagtcacuaaaa

SEQ ID NO: 6268 - DNA, 19 bp, Artificial Sequence
  Synthetic
cttcuaggccactcgcuca

SEQ ID NO: 6269 - DNA, 17 bp, Artificial Sequence
  Synthetic
tggcguccctcgtgtut

SEQ ID NO: 6270 - DNA, 28 bp, Artificial Sequence
  Synthetic
ccttgucaaaacaggaauttagaaauca

SEQ ID NO: 6271 - DNA, 23 bp, Artificial Sequence
  Synthetic
ctacactuggctgtgatgucact

SEQ ID NO: 6272 - DNA, 22 bp, Artificial Sequence
  Synthetic
gcaaagggcucggtttcuagag

SEQ ID NO: 6273 - DNA, 20 bp, Artificial Sequence
  Synthetic
cactccccaaugtctgccut

SEQ ID NO: 6274 - DNA, 20 bp, Artificial Sequence
  Synthetic
ccacggcauctgtgttcucc

SEQ ID NO: 6275 - DNA, 21 bp, Artificial Sequence
  Synthetic
gaccctgaucctgctctcuct

SEQ ID NO: 6276 - DNA, 28 bp, Artificial Sequence
  Synthetic
gtcctcaaaugactggaatguagagaag

SEQ ID NO: 6277 - DNA, 26 bp, Artificial Sequence
  Synthetic
acaccttgatttugttctttgggtug

SEQ ID NO: 6278 - DNA, 26 bp, Artificial Sequence
  Synthetic
gggatccttgauagttgttgtcuagt

SEQ ID NO: 6279 - DNA, 25 bp, Artificial Sequence
  Synthetic
catccagggcugtgttataatcugg

SEQ ID NO: 6280 - DNA, 24 bp, Artificial Sequence
  Synthetic
ccttgacuaacataccagcugcaa

SEQ ID NO: 6281 - DNA, 29 bp, Artificial Sequence
  Synthetic
gcatttatcgaguactaacactgactcuc

SEQ ID NO: 6282 - DNA, 24 bp, Artificial Sequence
  Synthetic
tgtgaagggcugtgtgtatguaaa

SEQ ID NO: 6283 - DNA, 21 bp, Artificial Sequence
  Synthetic
catgtcaccuccccaagacut

SEQ ID NO: 6284 - DNA, 20 bp, Artificial Sequence
  Synthetic
aagggtucaccgccataguc

SEQ ID NO: 6285 - DNA, 23 bp, Artificial Sequence
  Synthetic
tgagagaggcacuaaggcttcut

SEQ ID NO: 6286 - DNA, 24 bp, Artificial Sequence
  Synthetic
ttgctgtcugaattgggactugat

SEQ ID NO: 6287 - DNA, 23 bp, Artificial Sequence
  Synthetic
tgagcaccauggacacttcatuc

SEQ ID NO: 6288 - DNA, 30 bp, Artificial Sequence
  Synthetic
ttatctctcaaccucttgaacatactauct

SEQ ID NO: 6289 - DNA, 20 bp, Artificial Sequence
  Synthetic
ggucccgaagacugaagcaa

SEQ ID NO: 6290 - DNA, 22 bp, Artificial Sequence
  Synthetic
ctccctccaugatcttcgcaua

SEQ ID NO: 6291 - DNA, 21 bp, Artificial Sequence
  Synthetic
ggactccugctcctcttgtuc

SEQ ID NO: 6292 - DNA, 23 bp, Artificial Sequence
  Synthetic
atccaugaaggaggcagagatug

SEQ ID NO: 6293 - DNA, 30 bp, Artificial Sequence
  Synthetic
ccttttgtaatauccggtaagaauccagag

SEQ ID NO: 6294 - DNA, 21 bp, Artificial Sequence
  Synthetic
ccucctcaauggagggaacaa

SEQ ID NO: 6295 - DNA, 23 bp, Artificial Sequence
  Synthetic
taaggaaaugggatctggaugct

SEQ ID NO: 6296 - DNA, 19 bp, Artificial Sequence
  Synthetic
gccacagccuccgtagauc

SEQ ID NO: 6297 - DNA, 24 bp, Artificial Sequence
  Synthetic
ggagagatgagguctgggatauca

SEQ ID NO: 6298 - DNA, 26 bp, Artificial Sequence
  Synthetic
tgtaccccutatgaatugaggacgat

SEQ ID NO: 6299 - DNA, 27 bp, Artificial Sequence
  Synthetic
gtcacttttggucaataaggtaggtug

SEQ ID NO: 6300 - DNA, 24 bp, Artificial Sequence
  Synthetic
gccccatuggatgtttttguaaca

SEQ ID NO: 6301 - DNA, 28 bp, Artificial Sequence
  Synthetic
gtttctcgctcuagttcaaatttagugg

SEQ ID NO: 6302 - DNA, 20 bp, Artificial Sequence
  Synthetic
ggtccccgagugatgguagt

SEQ ID NO: 6303 - DNA, 20 bp, Artificial Sequence
  Synthetic
tgguaccagggauggacaca

SEQ ID NO: 6304 - DNA, 23 bp, Artificial Sequence
  Synthetic
gagtggcugtgtcatuaacacct

SEQ ID NO: 6305 - DNA, 22 bp, Artificial Sequence
  Synthetic
ggaggtcccguttcagttcaut

SEQ ID NO: 6306 - DNA, 22 bp, Artificial Sequence
  Synthetic
caccaccuactgagtgtuagca

SEQ ID NO: 6307 - DNA, 24 bp, Artificial Sequence
  Synthetic
gagaaggaagutcttaggcagugg

SEQ ID NO: 6308 - DNA, 20 bp, Artificial Sequence
  Synthetic
ccctcggugtcctactucaa

SEQ ID NO: 6309 - DNA, 22 bp, Artificial Sequence
  Synthetic
gggtgaguagcaaagaaacgug

SEQ ID NO: 6310 - DNA, 26 bp, Artificial Sequence
  Synthetic
cattgaacactucctctccaaaaugc

SEQ ID NO: 6311 - DNA, 19 bp, Artificial Sequence
  Synthetic
ggccagggucaccuaagga

SEQ ID NO: 6312 - DNA, 19 bp, Artificial Sequence
  Synthetic
cugccaggagcagaucgaa

SEQ ID NO: 6313 - DNA, 19 bp, Artificial Sequence
  Synthetic
gccctcagaugtccacguc

SEQ ID NO: 6314 - DNA, 26 bp, Artificial Sequence
  Synthetic
ctagtccctttucttccccattcaut

SEQ ID NO: 6315 - DNA, 27 bp, Artificial Sequence
  Synthetic
aaagtggaatacguagacattcgguac

SEQ ID NO: 6316 - DNA, 27 bp, Artificial Sequence
  Synthetic
ggatatttccguggctcttatucaaac

SEQ ID NO: 6317 - DNA, 27 bp, Artificial Sequence
  Synthetic
tcaatggccatguctgaaaagtaagua

SEQ ID NO: 6318 - DNA, 23 bp, Artificial Sequence
  Synthetic
gcagcccgcuttaaaacattcut

SEQ ID NO: 6319 - DNA, 28 bp, Artificial Sequence
  Synthetic
acttatgaauacacataattugcccact

SEQ ID NO: 6320 - DNA, 28 bp, Artificial Sequence
  Synthetic
agttatccautttgaaccuggagaagac

SEQ ID NO: 6321 - DNA, 28 bp, Artificial Sequence
  Synthetic
gctaggatttttcuctgaactgtctgut

SEQ ID NO: 6322 - DNA, 28 bp, Artificial Sequence
  Synthetic
acttgtgtaatuccaatcctggataguc

SEQ ID NO: 6323 - DNA, 30 bp, Artificial Sequence
  Synthetic
ggctgcaatatutccttttactaaaaucgt

SEQ ID NO: 6324 - DNA, 26 bp, Artificial Sequence
  Synthetic
aautgcggagacuacaagaagaaaga

SEQ ID NO: 6325 - DNA, 29 bp, Artificial Sequence
  Synthetic
aaauaggacactttctuaaagaaggagca

SEQ ID NO: 6326 - DNA, 27 bp, Artificial Sequence
  Synthetic
acagaaugtctgagaauagcaaaacca

SEQ ID NO: 6327 - DNA, 23 bp, Artificial Sequence
  Synthetic
acgcgacaguaatctgtuaagcc

SEQ ID NO: 6328 - DNA, 28 bp, Artificial Sequence
  Synthetic
tggctagaauaattcatgctgtuaccaa

SEQ ID NO: 6329 - DNA, 32 bp, Artificial Sequence
  Synthetic
cttgcaagaucaaaagtatttcaauacaaaac

SEQ ID NO: 6330 - DNA, 22 bp, Artificial Sequence
  Synthetic
tgtgggagcuagcagtguaaac

SEQ ID NO: 6331 - DNA, 33 bp, Artificial Sequence
  Synthetic
aagaatactttcctcuacttcctatatgactua

SEQ ID NO: 6332 - DNA, 33 bp, Artificial Sequence
  Synthetic
ccttttagtttgttaaugtgatggaatagttut

SEQ ID NO: 6333 - DNA, 23 bp, Artificial Sequence
  Synthetic
cagtaauggagacagcucacagt

SEQ ID NO: 6334 - DNA, 26 bp, Artificial Sequence
  Synthetic
tgatagataaaguctttgccccucca

SEQ ID NO: 6335 - DNA, 24 bp, Artificial Sequence
  Synthetic
cccattttuaccgttccuggaact

SEQ ID NO: 6336 - DNA, 29 bp, Artificial Sequence
  Synthetic
cttgtactggagaaaautcttgtgaguct

SEQ ID NO: 6337 - DNA, 21 bp, Artificial Sequence
  Synthetic
agaugcagctacuacccagct

SEQ ID NO: 6338 - DNA, 32 bp, Artificial Sequence
  Synthetic
ctttaagattacaaautcagaaactcttgucc

SEQ ID NO: 6339 - DNA, 29 bp, Artificial Sequence
  Synthetic
ccttggctttcuggaataattctgactua

SEQ ID NO: 6340 - DNA, 26 bp, Artificial Sequence
  Synthetic
atttctttgttgcutggttctttgut

SEQ ID NO: 6341 - DNA, 30 bp, Artificial Sequence
  Synthetic
aatatgauagcaaaauaggaagcatactua

SEQ ID NO: 6342 - DNA, 26 bp, Artificial Sequence
  Synthetic
gctcaagttctugtgtttgtgtguaa

SEQ ID NO: 6343 - DNA, 29 bp, Artificial Sequence
  Synthetic
tccaagagcttcutcatttaacgtaacuc

SEQ ID NO: 6344 - DNA, 30 bp, Artificial Sequence
  Synthetic
tcaggcatcuaacaaaggagaggaaataua

SEQ ID NO: 6345 - DNA, 30 bp, Artificial Sequence
  Synthetic
gactgctttaaaatuttcaatggagatcut

SEQ ID NO: 6346 - DNA, 26 bp, Artificial Sequence
  Synthetic
aggttacugaaagcacttccttugaa

SEQ ID NO: 6347 - DNA, 31 bp, Artificial Sequence
  Synthetic
tgggatattcauagcaagcatatgauaacag

SEQ ID NO: 6348 - DNA, 28 bp, Artificial Sequence
  Synthetic
acgtttagaagacuttatggcatcucat

SEQ ID NO: 6349 - DNA, 33 bp, Artificial Sequence
  Synthetic
tgtcatgtataaactuacctatagaaatccuca

SEQ ID NO: 6350 - DNA, 23 bp, Artificial Sequence
  Synthetic
ccuatgaggguaccagagacagt

SEQ ID NO: 6351 - DNA, 31 bp, Artificial Sequence
  Synthetic
gggaatgaaaaguacataaaaatugaagcca

SEQ ID NO: 6352 - DNA, 27 bp, Artificial Sequence
  Synthetic
attttccaucgcatgtgatuaaagcaa

SEQ ID NO: 6353 - DNA, 33 bp, Artificial Sequence
  Synthetic
agaaggaatgttcuattattaaactcatcaugt

SEQ ID NO: 6354 - DNA, 26 bp, Artificial Sequence
  Synthetic
tccagaacttacuggttgttgttgut

SEQ ID NO: 6355 - DNA, 29 bp, Artificial Sequence
  Synthetic
atgaagatggtttuctagagcatcctuac

SEQ ID NO: 6356 - DNA, 29 bp, Artificial Sequence
  Synthetic
agatccttttccugaccatgttgttttua

SEQ ID NO: 6357 - DNA, 30 bp, Artificial Sequence
  Synthetic
ctgctagagcautacagattttugaaaagt

SEQ ID NO: 6358 - DNA, 32 bp, Artificial Sequence
  Synthetic
ttatgtatgatctctuacctatgactctacug

SEQ ID NO: 6359 - DNA, 31 bp, Artificial Sequence
  Synthetic
gatgcatctttacuatgttgtatagctaugg

SEQ ID NO: 6360 - DNA, 26 bp, Artificial Sequence
  Synthetic
gactggacataguttctgggagatut

SEQ ID NO: 6361 - DNA, 25 bp, Artificial Sequence
  Synthetic
caauttaacagtcaugacccacagc

SEQ ID NO: 6362 - DNA, 30 bp, Artificial Sequence
  Synthetic
actcatttttacucaaactattggguggat

SEQ ID NO: 6363 - DNA, 23 bp, Artificial Sequence
  Synthetic
cagctggugaaaaatcccugaac

SEQ ID NO: 6364 - DNA, 32 bp, Artificial Sequence
  Synthetic
taatgatgctttcuggctggatttaaattauc

SEQ ID NO: 6365 - DNA, 32 bp, Artificial Sequence
  Synthetic
ctcttgatcatccauacttttcttatcugcat

SEQ ID NO: 6366 - DNA, 30 bp, Artificial Sequence
  Synthetic
ttccttcttcaatutttgttgtttccaugt

SEQ ID NO: 6367 - DNA, 32 bp, Artificial Sequence
  Synthetic
caatttacctagtaaugggttgtaacatctuc

SEQ ID NO: 6368 - DNA, 31 bp, Artificial Sequence
  Synthetic
ctctggttttcugttgatatctttgatuact

SEQ ID NO: 6369 - DNA, 28 bp, Artificial Sequence
  Synthetic
ctgcttggtaaugaagttcttctagtuc

SEQ ID NO: 6370 - DNA, 31 bp, Artificial Sequence
  Synthetic
tgaaaacctcttcuttattttcagagtguct

SEQ ID NO: 6371 - DNA, 23 bp, Artificial Sequence
  Synthetic
caatgcttuccagctctccaaug

SEQ ID NO: 6372 - DNA, 31 bp, Artificial Sequence
  Synthetic
acaacucacaaagagaatgtatuaaggacat

SEQ ID NO: 6373 - DNA, 32 bp, Artificial Sequence
  Synthetic
taataaaaggaaagucaagaggtaagaugaca

SEQ ID NO: 6374 - DNA, 21 bp, Artificial Sequence
  Synthetic
tgtggcaacuggtuagcagaa

SEQ ID NO: 6375 - DNA, 29 bp, Artificial Sequence
  Synthetic
tgaaaagatgaagcauattcatgcuaagt

SEQ ID NO: 6376 - DNA, 31 bp, Artificial Sequence
  Synthetic
tgtgtgattttguagttctgttaaagtucat

SEQ ID NO: 6377 - DNA, 24 bp, Artificial Sequence
  Synthetic
agcgtttacgaucctctttcagug

SEQ ID NO: 6378 - DNA, 26 bp, Artificial Sequence
  Synthetic
gtagagagacggaaugaagatuccaa

SEQ ID NO: 6379 - DNA, 29 bp, Artificial Sequence
  Synthetic
attgtggtttgautttcaggtttactuac

SEQ ID NO: 6380 - DNA, 28 bp, Artificial Sequence
  Synthetic
tgtactatcagaaguaggagaccucaga

SEQ ID NO: 6381 - DNA, 27 bp, Artificial Sequence
  Synthetic
atatctcuacagagaguaacacagcaa

SEQ ID NO: 6382 - DNA, 21 bp, Artificial Sequence
  Synthetic
tggtttgagugccctttgcua

SEQ ID NO: 6383 - DNA, 29 bp, Artificial Sequence
  Synthetic
cgtgtttctcugcagtaatgtatuacaca

SEQ ID NO: 6384 - DNA, 32 bp, Artificial Sequence
  Synthetic
tcttttgaagagaaauatgaagtcttcaugga

SEQ ID NO: 6385 - DNA, 21 bp, Artificial Sequence
  Synthetic
acacugcgcgtauaagccaat

SEQ ID NO: 6386 - DNA, 26 bp, Artificial Sequence
  Synthetic
catgtggttucttgcctttguaaagt

SEQ ID NO: 6387 - DNA, 29 bp, Artificial Sequence
  Synthetic
cacaatatctcuggtgagtcuaaaaggaa

SEQ ID NO: 6388 - DNA, 26 bp, Artificial Sequence
  Synthetic
ggaccatgaaucctttgaaagcttug

SEQ ID NO: 6389 - DNA, 29 bp, Artificial Sequence
  Synthetic
gccttgggaauaagaaaatcugaaaaact

SEQ ID NO: 6390 - DNA, 23 bp, Artificial Sequence
  Synthetic
cctcttagcugttctgucaggga

SEQ ID NO: 6391 - DNA, 27 bp, Artificial Sequence
  Synthetic
tgatcgctucaacctgaaaagtatuga

SEQ ID NO: 6392 - DNA, 29 bp, Artificial Sequence
  Synthetic
tgtgcaagttcuagttttatactcaccug

SEQ ID NO: 6393 - DNA, 25 bp, Artificial Sequence
  Synthetic
ctcagctucagataaaccagucgat

SEQ ID NO: 6394 - DNA, 24 bp, Artificial Sequence
  Synthetic
agcatactcaaaggucacaggaug

SEQ ID NO: 6395 - DNA, 23 bp, Artificial Sequence
  Synthetic
ctgucacaggattttgugcagat

SEQ ID NO: 6396 - DNA, 31 bp, Artificial Sequence
  Synthetic
cttgtgactaaaauaacagagagctacacua

SEQ ID NO: 6397 - DNA, 24 bp, Artificial Sequence
  Synthetic
acaggtcagucaaatttgcaucca

SEQ ID NO: 6398 - DNA, 28 bp, Artificial Sequence
  Synthetic
gcagaguaaaaagaaaacugtttaaugg

SEQ ID NO: 6399 - DNA, 28 bp, Artificial Sequence
  Synthetic
ctccacaaaaggaaaugagttugaagat

SEQ ID NO: 6400 - DNA, 26 bp, Artificial Sequence
  Synthetic
gctgagtgccautattgattgtgtug

SEQ ID NO: 6401 - DNA, 24 bp, Artificial Sequence
  Synthetic
cctgttataaugggtctguccagt

SEQ ID NO: 6402 - DNA, 21 bp, Artificial Sequence
  Synthetic
caacgugaagaagagctcugg

SEQ ID NO: 6403 - DNA, 23 bp, Artificial Sequence
  Synthetic
agcacttcuccaccatcttctug

SEQ ID NO: 6404 - DNA, 30 bp, Artificial Sequence
  Synthetic
tatggagaattugatgaagaaaacuaagca

SEQ ID NO: 6405 - DNA, 22 bp, Artificial Sequence
  Synthetic
tgttacccautcaggcagucac

SEQ ID NO: 6406 - DNA, 21 bp, Artificial Sequence
  Synthetic
ggaggccauggctctgaaauc

SEQ ID NO: 6407 - DNA, 23 bp, Artificial Sequence
  Synthetic
aaaagcuttctctucaccgaagt

SEQ ID NO: 6408 - DNA, 23 bp, Artificial Sequence
  Synthetic
gggaacatuctccagacaauccc

SEQ ID NO: 6409 - DNA, 29 bp, Artificial Sequence
  Synthetic
tgcagtttaagaaaccuggaataaaguca

SEQ ID NO: 6410 - DNA, 28 bp, Artificial Sequence
  Synthetic
gatgcatctgtuactatcttttgctuct

SEQ ID NO: 6411 - DNA, 20 bp, Artificial Sequence
  Synthetic
ctctgcuccttgccucaaca

SEQ ID NO: 6412 - DNA, 28 bp, Artificial Sequence
  Synthetic
cattactgcaguttttggattcttugct

SEQ ID NO: 6413 - DNA, 20 bp, Artificial Sequence
  Synthetic
gaatauggccggtcuggagg

SEQ ID NO: 6414 - DNA, 21 bp, Artificial Sequence
  Synthetic
cagaggcucagctgtgguaag

SEQ ID NO: 6415 - DNA, 23 bp, Artificial Sequence
  Synthetic
gcattggcagaugaggaaggtut

SEQ ID NO: 6416 - DNA, 27 bp, Artificial Sequence
  Synthetic
ttccaaagatcautatggcacttucct

SEQ ID NO: 6417 - DNA, 31 bp, Artificial Sequence
  Synthetic
caatgattttuaaagtagcagaauggcaact

SEQ ID NO: 6418 - DNA, 24 bp, Artificial Sequence
  Synthetic
gaatcaactcugaacggaaagcug

SEQ ID NO: 6419 - DNA, 23 bp, Artificial Sequence
  Synthetic
gttgttcugggcaaugaccaaag

SEQ ID NO: 6420 - DNA, 27 bp, Artificial Sequence
  Synthetic
tccccttacatugtctccatatttuct

SEQ ID NO: 6421 - DNA, 28 bp, Artificial Sequence
  Synthetic
caaggctgaatuagctacattagctuac

SEQ ID NO: 6422 - DNA, 21 bp, Artificial Sequence
  Synthetic
ccttcccutcccttttuccgt

SEQ ID NO: 6423 - DNA, 23 bp, Artificial Sequence
  Synthetic
aggagaugtcatgaugggagaca

SEQ ID NO: 6424 - DNA, 22 bp, Artificial Sequence
  Synthetic
tgtgcgcgugtttttcttucat

SEQ ID NO: 6425 - DNA, 21 bp, Artificial Sequence
  Synthetic
ctccactgcuacagtcagucc

SEQ ID NO: 6426 - DNA, 22 bp, Artificial Sequence
  Synthetic
caatcactugtcggaaguccct

SEQ ID NO: 6427 - DNA, 28 bp, Artificial Sequence
  Synthetic
gcaacaaatcagauattgcagaaaguaa

SEQ ID NO: 6428 - DNA, 29 bp, Artificial Sequence
  Synthetic
agctctgttatcuctattcagacctguat

SEQ ID NO: 6429 - DNA, 23 bp, Artificial Sequence
  Synthetic
gcaggaggacaauaattccaugt

SEQ ID NO: 6430 - DNA, 25 bp, Artificial Sequence
  Synthetic
tccccagaaugaggtagtttttcut

SEQ ID NO: 6431 - DNA, 23 bp, Artificial Sequence
  Synthetic
ctccaaagucaatcggtcctugt

SEQ ID NO: 6432 - DNA, 25 bp, Artificial Sequence
  Synthetic
cacccagccgcaauacagattatua

SEQ ID NO: 6433 - DNA, 21 bp, Artificial Sequence
  Synthetic
cttggcagagucctgaggtuc

SEQ ID NO: 6434 - DNA, 23 bp, Artificial Sequence
  Synthetic
cttagauggcacacctcgtacuc

SEQ ID NO: 6435 - DNA, 28 bp, Artificial Sequence
  Synthetic
agtaatgcccuaagcttctcuaagagat

SEQ ID NO: 6436 - DNA, 27 bp, Artificial Sequence
  Synthetic
gatcaagtgttcuatcagcgagtaucc

SEQ ID NO: 6437 - DNA, 29 bp, Artificial Sequence
  Synthetic
actcacaatcttutctctattggaaaugt

SEQ ID NO: 6438 - DNA, 29 bp, Artificial Sequence
  Synthetic
attttaggatgcugaaagtaatccacugt

SEQ ID NO: 6439 - DNA, 24 bp, Artificial Sequence
  Synthetic
tgctgtaccugtgtattuggcaat

SEQ ID NO: 6440 - DNA, 26 bp, Artificial Sequence
  Synthetic
gataatcatgtuactgagtgctugga

SEQ ID NO: 6441 - DNA, 30 bp, Artificial Sequence
  Synthetic
ccccaaaacuaaaagacaatatcagaccua

SEQ ID NO: 6442 - DNA, 27 bp, Artificial Sequence
  Synthetic
tggatttcttuccaactttcugaagct

SEQ ID NO: 6443 - DNA, 26 bp, Artificial Sequence
  Synthetic
cctactacaaugcaaaggaacacuca

SEQ ID NO: 6444 - DNA, 28 bp, Artificial Sequence
  Synthetic
ggacactaaaggaagutggagaagatua

SEQ ID NO: 6445 - DNA, 24 bp, Artificial Sequence
  Synthetic
gggatggcacaugagtgtcauact

SEQ ID NO: 6446 - DNA, 23 bp, Artificial Sequence
  Synthetic
caggauagccaggcaaguaacat

SEQ ID NO: 6447 - DNA, 27 bp, Artificial Sequence
  Synthetic
gatggattctcaucactatgtgctuca

SEQ ID NO: 6448 - DNA, 24 bp, Artificial Sequence
  Synthetic
tcctcagaauactcactccgaugg

SEQ ID NO: 6449 - DNA, 27 bp, Artificial Sequence
  Synthetic
cttatgaatguactccatgatcuggct

SEQ ID NO: 6450 - DNA, 29 bp, Artificial Sequence
  Synthetic
ttttggatgagucatgtttaatcttugga

SEQ ID NO: 6451 - DNA, 27 bp, Artificial Sequence
  Synthetic
gcttcatatcuacaatcttcacugcga

SEQ ID NO: 6452 - DNA, 28 bp, Artificial Sequence
  Synthetic
cttcaaatuaagaagctatgtggtugct

SEQ ID NO: 6453 - DNA, 26 bp, Artificial Sequence
  Synthetic
ccatgagttgauggaagaatctcuga

SEQ ID NO: 6454 - DNA, 29 bp, Artificial Sequence
  Synthetic
ttgaacaagatgtguggtactttaccaua

SEQ ID NO: 6455 - DNA, 20 bp, Artificial Sequence
  Synthetic
cucttaccuccagcgagcat

SEQ ID NO: 6456 - DNA, 22 bp, Artificial Sequence
  Synthetic
ttcaagtugccagttgggtuaa

SEQ ID NO: 6457 - DNA, 25 bp, Artificial Sequence
  Synthetic
cttagaaaatccacugggagacuct

SEQ ID NO: 6458 - DNA, 28 bp, Artificial Sequence
  Synthetic
ggccttcaugcaaaataattttaaguca

SEQ ID NO: 6459 - DNA, 28 bp, Artificial Sequence
  Synthetic
gataagatttguctgcatccaattuggt

SEQ ID NO: 6460 - DNA, 29 bp, Artificial Sequence
  Synthetic
tctaatatagggugatggattggagtuca

SEQ ID NO: 6461 - DNA, 26 bp, Artificial Sequence
  Synthetic
actatatucaccaggatuccccagag

SEQ ID NO: 6462 - DNA, 21 bp, Artificial Sequence
  Synthetic
tcaccgucgaaccaacaguac

SEQ ID NO: 6463 - DNA, 26 bp, Artificial Sequence
  Synthetic
gctuttaggtgtttcugaacccacat

SEQ ID NO: 6464 - DNA, 27 bp, Artificial Sequence
  Synthetic
aatgaatagcaucaagaccttcuggag

SEQ ID NO: 6465 - DNA, 26 bp, Artificial Sequence
  Synthetic
tcagccaataaagguaaacacacgua

SEQ ID NO: 6466 - DNA, 26 bp, Artificial Sequence
  Synthetic
aatgctcgggaugaatccatuaagaa

SEQ ID NO: 6467 - DNA, 26 bp, Artificial Sequence
  Synthetic
tgttctctttutccttctgcuccaaa

SEQ ID NO: 6468 - DNA, 28 bp, Artificial Sequence
  Synthetic
gttattcagcttutctgggtttttguga

SEQ ID NO: 6469 - DNA, 27 bp, Artificial Sequence
  Synthetic
tcttcttcccuttcctcagtacucaaa

SEQ ID NO: 6470 - DNA, 21 bp, Artificial Sequence
  Synthetic
ccaggugaaacaggagctguc

SEQ ID NO: 6471 - DNA, 24 bp, Artificial Sequence
  Synthetic
ttagcagucaaggactcctucaac

SEQ ID NO: 6472 - DNA, 25 bp, Artificial Sequence
  Synthetic
aaccctgagcuatctgtttucaaat

SEQ ID NO: 6473 - DNA, 24 bp, Artificial Sequence
  Synthetic
tttcaagctgcucatctgctttuc

SEQ ID NO: 6474 - DNA, 31 bp, Artificial Sequence
  Synthetic
agagaagcaagaggaaautgataacuacaaa

SEQ ID NO: 6475 - DNA, 24 bp, Artificial Sequence
  Synthetic
acaccaacauacagacacaugcaa

SEQ ID NO: 6476 - DNA, 23 bp, Artificial Sequence
  Synthetic
cactuggagagagagaucaccag

SEQ ID NO: 6477 - DNA, 22 bp, Artificial Sequence
  Synthetic
cctcauaagccccaatcagcut

SEQ ID NO: 6478 - DNA, 27 bp, Artificial Sequence
  Synthetic
ctggaagaagcacuaagagaaagtgua

SEQ ID NO: 6479 - DNA, 28 bp, Artificial Sequence
  Synthetic
cctaaactatacuggttgtgtgtuacct

SEQ ID NO: 6480 - DNA, 26 bp, Artificial Sequence
  Synthetic
cuaagaagaagauccaagaggaagug

SEQ ID NO: 6481 - DNA, 25 bp, Artificial Sequence
  Synthetic
agacctuaaagtacaagcuggcaaa

SEQ ID NO: 6482 - DNA, 20 bp, Artificial Sequence
  Synthetic
tggacaccugacaacccuct

SEQ ID NO: 6483 - DNA, 26 bp, Artificial Sequence
  Synthetic
tcacaggcucttttcaaagttugagt

SEQ ID NO: 6484 - DNA, 25 bp, Artificial Sequence
  Synthetic
ctattuagucaaaggaaggagguca

SEQ ID NO: 6485 - DNA, 17 bp, Artificial Sequence
  Synthetic
gtccaccucguggcaca

SEQ ID NO: 6486 - DNA, 21 bp, Artificial Sequence
  Synthetic
tgcgaagaagagguctuccct

SEQ ID NO: 6487 - DNA, 22 bp, Artificial Sequence
  Synthetic
cggtgtaaaugcacagcttcuc

SEQ ID NO: 6488 - DNA, 21 bp, Artificial Sequence
  Synthetic
ccctgaccutctgcctcucat

SEQ ID NO: 6489 - DNA, 21 bp, Artificial Sequence
  Synthetic
ggtgatctuagccagcagcuc

SEQ ID NO: 6490 - DNA, 17 bp, Artificial Sequence
  Synthetic
ggcugccgggagagaug

SEQ ID NO: 6491 - DNA, 21 bp, Artificial Sequence
  Synthetic
acacugagcaggagtcucaga

SEQ ID NO: 6492 - DNA, 24 bp, Artificial Sequence
  Synthetic
ccttctccctutattccagctguc

SEQ ID NO: 6493 - DNA, 26 bp, Artificial Sequence
  Synthetic
gttgctgucaattggcctuaaagaaa

SEQ ID NO: 6494 - DNA, 22 bp, Artificial Sequence
  Synthetic
gggtctgugattgtcttuccct

SEQ ID NO: 6495 - DNA, 21 bp, Artificial Sequence
  Synthetic
ggagaaggccggugatttguc

SEQ ID NO: 6496 - DNA, 21 bp, Artificial Sequence
  Synthetic
ccatcaugcaccctctgaucc

SEQ ID NO: 6497 - DNA, 23 bp, Artificial Sequence
  Synthetic
gatguggttcatguaagccaggt

SEQ ID NO: 6498 - DNA, 22 bp, Artificial Sequence
  Synthetic
gcagtgccutttctgaggtuca

SEQ ID NO: 6499 - DNA, 23 bp, Artificial Sequence
  Synthetic
cctggctccutcctgataatgut

SEQ ID NO: 6500 - DNA, 28 bp, Artificial Sequence
  Synthetic
gtugattatggaagatucccacaagagt

SEQ ID NO: 6501 - DNA, 23 bp, Artificial Sequence
  Synthetic
caagctcaguattttggccaguc

SEQ ID NO: 6502 - DNA, 25 bp, Artificial Sequence
  Synthetic
ggctttttgccacucctttgaatua

SEQ ID NO: 6503 - DNA, 23 bp, Artificial Sequence
  Synthetic
gaagtccctguactccatctgug

SEQ ID NO: 6504 - DNA, 23 bp, Artificial Sequence
  Synthetic
tcagcuacttctcugccacaaac

SEQ ID NO: 6505 - DNA, 30 bp, Artificial Sequence
  Synthetic
aaaacattacccatuctggtactacgatut

SEQ ID NO: 6506 - DNA, 22 bp, Artificial Sequence
  Synthetic
acttcugggaaaggtggguagt

SEQ ID NO: 6507 - DNA, 23 bp, Artificial Sequence
  Synthetic
ctgaagagaaugaacggcucaag

SEQ ID NO: 6508 - DNA, 25 bp, Artificial Sequence
  Synthetic
gaaaggtaacauccccctttagcut

SEQ ID NO: 6509 - DNA, 21 bp, Artificial Sequence
  Synthetic
ctttctcctucgggacacugt

SEQ ID NO: 6510 - DNA, 23 bp, Artificial Sequence
  Synthetic
gccctgcauactgctctattuct

SEQ ID NO: 6511 - DNA, 19 bp, Artificial Sequence
  Synthetic
gatgtatcccugccccgug

SEQ ID NO: 6512 - DNA, 24 bp, Artificial Sequence
  Synthetic
ccagaacccautttggtaccauct

SEQ ID NO: 6513 - DNA, 23 bp, Artificial Sequence
  Synthetic
tttccttcaugccaattgcaucg

SEQ ID NO: 6514 - DNA, 23 bp, Artificial Sequence
  Synthetic
cccacctauaggctgtctttucc

SEQ ID NO: 6515 - DNA, 21 bp, Artificial Sequence
  Synthetic
catcagcacagutcgugaggt

SEQ ID NO: 6516 - DNA, 30 bp, Artificial Sequence
  Synthetic
atccatccacagacuatatcttaaccugat

SEQ ID NO: 6517 - DNA, 22 bp, Artificial Sequence
  Synthetic
guagcacucaaaacagcaccaa

SEQ ID NO: 6518 - DNA, 20 bp, Artificial Sequence
  Synthetic
ggactcugacccagggaugt

SEQ ID NO: 6519 - DNA, 20 bp, Artificial Sequence
  Synthetic
cuccaagtttcuccgcacca

SEQ ID NO: 6520 - DNA, 18 bp, Artificial Sequence
  Synthetic
gtctgugcgcgagugagt

SEQ ID NO: 6521 - DNA, 17 bp, Artificial Sequence
  Synthetic
cggcucgaaccgaccug

SEQ ID NO: 6522 - DNA, 17 bp, Artificial Sequence
  Synthetic
cctacccgucctuggca

SEQ ID NO: 6523 - DNA, 20 bp, Artificial Sequence
  Synthetic
ctggagtugctgctgttcuc

SEQ ID NO: 6524 - DNA, 23 bp, Artificial Sequence
  Synthetic
cccattaaccugtgttcccctut

SEQ ID NO: 6525 - DNA, 23 bp, Artificial Sequence
  Synthetic
ggaacatggaucggaggcttuaa

SEQ ID NO: 6526 - DNA, 19 bp, Artificial Sequence
  Synthetic
cugaggctugcagggaaga

SEQ ID NO: 6527 - DNA, 26 bp, Artificial Sequence
  Synthetic
aaaucaacaagaagaagtugcagcag

SEQ ID NO: 6528 - DNA, 17 bp, Artificial Sequence
  Synthetic
ggcgcagccuctgctua

SEQ ID NO: 6529 - DNA, 18 bp, Artificial Sequence
  Synthetic
gcugcaaacgcucaaccc

SEQ ID NO: 6530 - DNA, 18 bp, Artificial Sequence
  Synthetic
gcgctguccaagtucgct

SEQ ID NO: 6531 - DNA, 20 bp, Artificial Sequence
  Synthetic
agcatguaccctagcuccgt

SEQ ID NO: 6532 - DNA, 31 bp, Artificial Sequence
  Synthetic
ggaatatcgtagguaaaaatgcctatuggat

SEQ ID NO: 6533 - DNA, 23 bp, Artificial Sequence
  Synthetic
tgtgacguactgggttttuagca

SEQ ID NO: 6534 - DNA, 33 bp, Artificial Sequence
  Synthetic
atccagagtatatacautctcactgaattatug

SEQ ID NO: 6535 - DNA, 28 bp, Artificial Sequence
  Synthetic
tttagaaguggacaggaaauatcatcug

SEQ ID NO: 6536 - DNA, 29 bp, Artificial Sequence
  Synthetic
atgtgcattgagaguttttatactaguga

SEQ ID NO: 6537 - DNA, 24 bp, Artificial Sequence
  Synthetic
cactgtctgucacagaagcgauaa

SEQ ID NO: 6538 - DNA, 32 bp, Artificial Sequence
  Synthetic
ccaaatgtccuagaagatgaagtataugaaac

SEQ ID NO: 6539 - DNA, 24 bp, Artificial Sequence
  Synthetic
atcagcguttgcttcauggaaaat

SEQ ID NO: 6540 - DNA, 32 bp, Artificial Sequence
  Synthetic
cttcatgugaccaaaatattucagaaaaagac

SEQ ID NO: 6541 - DNA, 28 bp, Artificial Sequence
  Synthetic
atgctgctctucatctctcttattuacc

SEQ ID NO: 6542 - DNA, 28 bp, Artificial Sequence
  Synthetic
ggaaatacauactgtttgcucacagaag

SEQ ID NO: 6543 - DNA, 30 bp, Artificial Sequence
  Synthetic
tctttttcaaaguggatattaaaccugcat

SEQ ID NO: 6544 - DNA, 28 bp, Artificial Sequence
  Synthetic
accaactttgtccutaactagctcttut

SEQ ID NO: 6545 - DNA, 23 bp, Artificial Sequence
  Synthetic
atgacagagaaucagcttcuggg

SEQ ID NO: 6546 - DNA, 29 bp, Artificial Sequence
  Synthetic
caaacctagucatgatttcuagaggcaaa

SEQ ID NO: 6547 - DNA, 30 bp, Artificial Sequence
  Synthetic
gcaacagcucaacgtttttataatttucat

SEQ ID NO: 6548 - DNA, 26 bp, Artificial Sequence
  Synthetic
gacttgtguaaacgaacccatttuca

SEQ ID NO: 6549 - DNA, 30 bp, Artificial Sequence
  Synthetic
ttgacctagagtcauttttatatgctgcut

SEQ ID NO: 6550 - DNA, 30 bp, Artificial Sequence
  Synthetic
ttgtgttgaaattguaaataccttggcaut

SEQ ID NO: 6551 - DNA, 30 bp, Artificial Sequence
  Synthetic
ttaaaatcctgctuggaaaataacatcuga

SEQ ID NO: 6552 - DNA, 25 bp, Artificial Sequence
  Synthetic
gcaagcaattugaaggtacagtuga

SEQ ID NO: 6553 - DNA, 27 bp, Artificial Sequence
  Synthetic
gcagagcttcaguagaaacattcagut

SEQ ID NO: 6554 - DNA, 30 bp, Artificial Sequence
  Synthetic
acaaaataatatugaaatgactacuggcac

SEQ ID NO: 6555 - DNA, 31 bp, Artificial Sequence
  Synthetic
aatcactgccaucaaattctaagttaugaga

SEQ ID NO: 6556 - DNA, 22 bp, Artificial Sequence
  Synthetic
tttcagacugcaagugggaaaa

SEQ ID NO: 6557 - DNA, 32 bp, Artificial Sequence
  Synthetic
ctgtttcctcataacutagaatgtccatttug

SEQ ID NO: 6558 - DNA, 29 bp, Artificial Sequence
  Synthetic
tttgatgaaaaagaguaagguactaguga

SEQ ID NO: 6559 - DNA, 30 bp, Artificial Sequence
  Synthetic
gagagaattctgcauttctttacacttugg

SEQ ID NO: 6560 - DNA, 29 bp, Artificial Sequence
  Synthetic
aaatcagtccccutattcagtcatugaaa

SEQ ID NO: 6561 - DNA, 32 bp, Artificial Sequence
  Synthetic
tcctacataatcugcagtatttattctttcug

SEQ ID NO: 6562 - DNA, 31 bp, Artificial Sequence
  Synthetic
gccagtatugaagaatgttgaagaucaaaaa

SEQ ID NO: 6563 - DNA, 22 bp, Artificial Sequence
  Synthetic
tttgcagggugaagagctaguc

SEQ ID NO: 6564 - DNA, 32 bp, Artificial Sequence
  Synthetic
gcattggatgatucagaggatattcttcauaa

SEQ ID NO: 6565 - DNA, 28 bp, Artificial Sequence
  Synthetic
actttctccaauccagacatatttuggt

SEQ ID NO: 6566 - DNA, 23 bp, Artificial Sequence
  Synthetic
acatucagaccagcucacaagag

SEQ ID NO: 6567 - DNA, 26 bp, Artificial Sequence
  Synthetic
tccacttgcugtactaaauccagaga

SEQ ID NO: 6568 - DNA, 32 bp, Artificial Sequence
  Synthetic
aggtggttctucagaaaataatcactctatua

SEQ ID NO: 6569 - DNA, 23 bp, Artificial Sequence
  Synthetic
gtgaagccugttctttucccaaa

SEQ ID NO: 6570 - DNA, 30 bp, Artificial Sequence
  Synthetic
aatatttcttttuaggagaaccctcaauca

SEQ ID NO: 6571 - DNA, 32 bp, Artificial Sequence
  Synthetic
accatacctauagagggagaacagatauaaat

SEQ ID NO: 6572 - DNA, 28 bp, Artificial Sequence
  Synthetic
aaaatgagacacutgattacuacaggca

SEQ ID NO: 6573 - DNA, 27 bp, Artificial Sequence
  Synthetic
tgcttttgtctgutttcctccaagtua

SEQ ID NO: 6574 - DNA, 23 bp, Artificial Sequence
  Synthetic
aaaacatccacuctgccucgaat

SEQ ID NO: 6575 - DNA, 32 bp, Artificial Sequence
  Synthetic
ataaaattacactcugtcataaaagccaucag

SEQ ID NO: 6576 - DNA, 31 bp, Artificial Sequence
  Synthetic
gtgtggatccaaagcutatttctagaattug

SEQ ID NO: 6577 - DNA, 21 bp, Artificial Sequence
  Synthetic
gaagcacccuttctgggctua

SEQ ID NO: 6578 - DNA, 29 bp, Artificial Sequence
  Synthetic
agcgcaaatauatctgaaacttcuagcaa

SEQ ID NO: 6579 - DNA, 28 bp, Artificial Sequence
  Synthetic
gaataatcttcugaccaactgtcaguct

SEQ ID NO: 6580 - DNA, 23 bp, Artificial Sequence
  Synthetic
ttcctgacccuagacctttucct

SEQ ID NO: 6581 - DNA, 33 bp, Artificial Sequence
  Synthetic
tatggtaagtttcaagaauacatcatacctgua

SEQ ID NO: 6582 - DNA, 22 bp, Artificial Sequence
  Synthetic
caagacagcaagutcgtgctut

SEQ ID NO: 6583 - DNA, 26 bp, Artificial Sequence
  Synthetic
aaacagcttcucaccttgaataauca

SEQ ID NO: 6584 - DNA, 26 bp, Artificial Sequence
  Synthetic
tcacttcttccautgcatctttcuca

SEQ ID NO: 6585 - DNA, 30 bp, Artificial Sequence
  Synthetic
actgtatgttagcuctttcagatttactut

SEQ ID NO: 6586 - DNA, 22 bp, Artificial Sequence
  Synthetic
tccattctaggacutgccccut

SEQ ID NO: 6587 - DNA, 26 bp, Artificial Sequence
  Synthetic
agtaagaaggccugatttggattcug

SEQ ID NO: 6588 - DNA, 32 bp, Artificial Sequence
  Synthetic
ttttatcagatgucttctcctaattgugagat

SEQ ID NO: 6589 - DNA, 28 bp, Artificial Sequence
  Synthetic
ctctttttgcagutcttttggtcaucaa

SEQ ID NO: 6590 - DNA, 28 bp, Artificial Sequence
  Synthetic
gctgacgaagaacutgcattgataaaua

SEQ ID NO: 6591 - DNA, 24 bp, Artificial Sequence
  Synthetic
agtacaacgucgtttcagtcugag

SEQ ID NO: 6592 - DNA, 29 bp, Artificial Sequence
  Synthetic
cgtcgtagaagaautagagtagaagtugt

SEQ ID NO: 6593 - DNA, 20 bp, Artificial Sequence
  Synthetic
ccaacgcggcgutaaggaua

SEQ ID NO: 6594 - DNA, 21 bp, Artificial Sequence
  Synthetic
aggactuagcgtccagugact

SEQ ID NO: 6595 - DNA, 27 bp, Artificial Sequence
  Synthetic
cgcaggaaaucaagacaaaaatcacut

SEQ ID NO: 6596 - DNA, 28 bp, Artificial Sequence
  Synthetic
catggtgcugtgattttatcttuacagg

SEQ ID NO: 6597 - DNA, 28 bp, Artificial Sequence
  Synthetic
cttggtgaacuctttcatatcagucaag

SEQ ID NO: 6598 - DNA, 27 bp, Artificial Sequence
  Synthetic
ccagcauatagaacatguccaaaagga

SEQ ID NO: 6599 - DNA, 24 bp, Artificial Sequence
  Synthetic
tgaagtgtctucagagaccacuct

SEQ ID NO: 6600 - DNA, 21 bp, Artificial Sequence
  Synthetic
cctgcugggaagtagcucaga

SEQ ID NO: 6601 - DNA, 24 bp, Artificial Sequence
  Synthetic
cagcacacacutttacatctucgt

SEQ ID NO: 6602 - DNA, 22 bp, Artificial Sequence
  Synthetic
ggutagacatagugacgcacct

SEQ ID NO: 6603 - DNA, 21 bp, Artificial Sequence
  Synthetic
gcaaagttcgutctgctgcuc

SEQ ID NO: 6604 - DNA, 24 bp, Artificial Sequence
  Synthetic
aagctcttgaugattgcaggauca

SEQ ID NO: 6605 - DNA, 22 bp, Artificial Sequence
  Synthetic
ttcctctucgccttgttcugag

SEQ ID NO: 6606 - DNA, 23 bp, Artificial Sequence
  Synthetic
gagutggaaactcuggagagcaa

SEQ ID NO: 6607 - DNA, 23 bp, Artificial Sequence
  Synthetic
gggtcugaagaaggtgguaaagg

SEQ ID NO: 6608 - DNA, 25 bp, Artificial Sequence
  Synthetic
gttacuctttaggatuggaccggaa

SEQ ID NO: 6609 - DNA, 27 bp, Artificial Sequence
  Synthetic
cttacgagaatuttaggagaggtucca

SEQ ID NO: 6610 - DNA, 24 bp, Artificial Sequence
  Synthetic
acagggaauggaatcaagaauggg

SEQ ID NO: 6611 - DNA, 28 bp, Artificial Sequence
  Synthetic
cgagutgctttaauacaggaaacagaga

SEQ ID NO: 6612 - DNA, 26 bp, Artificial Sequence
  Synthetic
cagcgaaauagaagcagtttctgtug

SEQ ID NO: 6613 - DNA, 26 bp, Artificial Sequence
  Synthetic
cctctttcttutcaggcttgaugact

SEQ ID NO: 6614 - DNA, 23 bp, Artificial Sequence
  Synthetic
gauggagggaaagagaagauggt

SEQ ID NO: 6615 - DNA, 29 bp, Artificial Sequence
  Synthetic
cgacaaattcatuacaaatggctgtcaua

SEQ ID NO: 6616 - DNA, 22 bp, Artificial Sequence
  Synthetic
tggaagugggcagagcagtaua

SEQ ID NO: 6617 - DNA, 21 bp, Artificial Sequence
  Synthetic
tgaaggcacccutgaaccauc

SEQ ID NO: 6618 - DNA, 26 bp, Artificial Sequence
  Synthetic
tgaaggaaagacacuagaagtuccca

SEQ ID NO: 6619 - DNA, 25 bp, Artificial Sequence
  Synthetic
gaccagagaucgtgttggacatuag

SEQ ID NO: 6620 - DNA, 31 bp, Artificial Sequence
  Synthetic
tgttatcaaccaaacuttaaattctgcctuc

SEQ ID NO: 6621 - DNA, 24 bp, Artificial Sequence
  Synthetic
aaagctaaucaacctcaggtuccc

SEQ ID NO: 6622 - DNA, 25 bp, Artificial Sequence
  Synthetic
ctaaatttggcaguttctggtucca

SEQ ID NO: 6623 - DNA, 27 bp, Artificial Sequence
  Synthetic
ggtattgtuggctcccttuagaaagaa

SEQ ID NO: 6624 - DNA, 23 bp, Artificial Sequence
  Synthetic
cucaggagagacagcttugaagt

SEQ ID NO: 6625 - DNA, 25 bp, Artificial Sequence
  Synthetic
gagatgcgatuttggactaccucat

SEQ ID NO: 6626 - DNA, 28 bp, Artificial Sequence
  Synthetic
tgattcagtgtuttatctgcatcuggat

SEQ ID NO: 6627 - DNA, 24 bp, Artificial Sequence
  Synthetic
cctacucgggagaattucaacagc

SEQ ID NO: 6628 - DNA, 22 bp, Artificial Sequence
  Synthetic
gcatcccaagagcugtagucaa

SEQ ID NO: 6629 - DNA, 29 bp, Artificial Sequence
  Synthetic
ggtcaggagcutttgtaaagaaaatcuct

SEQ ID NO: 6630 - DNA, 24 bp, Artificial Sequence
  Synthetic
cauaaccaggaggaagucaatuca

SEQ ID NO: 6631 - DNA, 30 bp, Artificial Sequence
  Synthetic
aattccagcagugatcatttatggauaagt

SEQ ID NO: 6632 - DNA, 32 bp, Artificial Sequence
  Synthetic
gtagatttgttagcauttccatcaaggtatut

SEQ ID NO: 6633 - DNA, 28 bp, Artificial Sequence
  Synthetic
gacttttgccaaggaaaucagctaaaut

SEQ ID NO: 6634 - DNA, 32 bp, Artificial Sequence
  Synthetic
aattgtgctgtgcutacagtaattatcattut

SEQ ID NO: 6635 - DNA, 22 bp, Artificial Sequence
  Synthetic
gctctcagccuagctgtttuga

SEQ ID NO: 6636 - DNA, 22 bp, Artificial Sequence
  Synthetic
cactgctuaaaggaagcgctut

SEQ ID NO: 6637 - DNA, 27 bp, Artificial Sequence
  Synthetic
ggtttttggagaaucacugtgaataug

SEQ ID NO: 6638 - DNA, 30 bp, Artificial Sequence
  Synthetic
aatgataacggcaucttggtaatcttcuaa

SEQ ID NO: 6639 - DNA, 28 bp, Artificial Sequence
  Synthetic
actccagcactutggatattgacttuaa

SEQ ID NO: 6640 - DNA, 28 bp, Artificial Sequence
  Synthetic
accagacttctucaactcaatggataug

SEQ ID NO: 6641 - DNA, 29 bp, Artificial Sequence
  Synthetic
tatttctccacuagaaagcatcatttcug

SEQ ID NO: 6642 - DNA, 31 bp, Artificial Sequence
  Synthetic
tcatgcaaatcaagcucctcttcatattuaa

SEQ ID NO: 6643 - DNA, 28 bp, Artificial Sequence
  Synthetic
cttttccagguccttctaacatagtuct

SEQ ID NO: 6644 - DNA, 25 bp, Artificial Sequence
  Synthetic
agacttaaacugtgcaacatuccca

SEQ ID NO: 6645 - DNA, 25 bp, Artificial Sequence
  Synthetic
gactgacatugatcctgtcauggat

SEQ ID NO: 6646 - DNA, 27 bp, Artificial Sequence
  Synthetic
tgcattttggtauatcaacaccctcut

SEQ ID NO: 6647 - DNA, 31 bp, Artificial Sequence
  Synthetic
agaaattttcttagaagugcttttcttggug

SEQ ID NO: 6648 - DNA, 30 bp, Artificial Sequence
  Synthetic
gaaaatttgtctcuggcttctctttttcut

SEQ ID NO: 6649 - DNA, 28 bp, Artificial Sequence
  Synthetic
caaactgctcgaaaucttacgcaaauat

SEQ ID NO: 6650 - DNA, 33 bp, Artificial Sequence
  Synthetic
gctttcaaaatataaucactatacctactuggt

SEQ ID NO: 6651 - DNA, 28 bp, Artificial Sequence
  Synthetic
atttactgacagaagugggctttaugaa

SEQ ID NO: 6652 - DNA, 21 bp, Artificial Sequence
  Synthetic
gggtgguctaggatugcaaga

SEQ ID NO: 6653 - DNA, 31 bp, Artificial Sequence
  Synthetic
gtgaatgctatguttgtttactgatgtugat

SEQ ID NO: 6654 - DNA, 23 bp, Artificial Sequence
  Synthetic
tctccccugatctgauaggacag

SEQ ID NO: 6655 - DNA, 25 bp, Artificial Sequence
  Synthetic
ccatgtttcuaggttgaactgctug

SEQ ID NO: 6656 - DNA, 23 bp, Artificial Sequence
  Synthetic
cctgctcgautttgacgtcgtua

SEQ ID NO: 6657 - DNA, 21 bp, Artificial Sequence
  Synthetic
cagaucggcaaggaggtguac

SEQ ID NO: 6658 - DNA, 18 bp, Artificial Sequence
  Synthetic
gtacucgcacgtgucgct

SEQ ID NO: 6659 - DNA, 17 bp, Artificial Sequence
  Synthetic
agccugcgcttcuccac

SEQ ID NO: 6660 - DNA, 18 bp, Artificial Sequence
  Synthetic
gctcagcuccgaguccat

SEQ ID NO: 6661 - DNA, 17 bp, Artificial Sequence
  Synthetic
cggccgacggugactuc

SEQ ID NO: 6662 - DNA, 18 bp, Artificial Sequence
  Synthetic
cgcacgacutgctctugg

SEQ ID NO: 6663 - DNA, 17 bp, Artificial Sequence
  Synthetic
cctaugcaccggcucct

SEQ ID NO: 6664 - DNA, 18 bp, Artificial Sequence
  Synthetic
tcaugcgcagcaggtuga

SEQ ID NO: 6665 - DNA, 20 bp, Artificial Sequence
  Synthetic
gcttccgcauctaccuggag

SEQ ID NO: 6666 - DNA, 22 bp, Artificial Sequence
  Synthetic
acaacugacactggcauccaaa

SEQ ID NO: 6667 - DNA, 20 bp, Artificial Sequence
  Synthetic
tcctcccacccucactcauc

SEQ ID NO: 6668 - DNA, 20 bp, Artificial Sequence
  Synthetic
cutgtcauagcaggcaccca

SEQ ID NO: 6669 - DNA, 23 bp, Artificial Sequence
  Synthetic
guctggagauagaggagccaagt

SEQ ID NO: 6670 - DNA, 23 bp, Artificial Sequence
  Synthetic
tcugagtguggagagaaaaggga

SEQ ID NO: 6671 - DNA, 19 bp, Artificial Sequence
  Synthetic
gtcacgucggagacugaca

SEQ ID NO: 6672 - DNA, 25 bp, Artificial Sequence
  Synthetic
atgaggatgagcucaaaaagctuct

SEQ ID NO: 6673 - DNA, 18 bp, Artificial Sequence
  Synthetic
cccttgaugccgagucct

SEQ ID NO: 6674 - DNA, 21 bp, Artificial Sequence
  Synthetic
cttctccgagugcaggtaguc

SEQ ID NO: 6675 - DNA, 17 bp, Artificial Sequence
  Synthetic
cggctgugcctcaggut

SEQ ID NO: 6676 - DNA, 18 bp, Artificial Sequence
  Synthetic
gcctguggccttctccut

SEQ ID NO: 6677 - DNA, 17 bp, Artificial Sequence
  Synthetic
gaccagcugggcacugt

SEQ ID NO: 6678 - DNA, 19 bp, Artificial Sequence
  Synthetic
gccgcuccttguagccaat

SEQ ID NO: 6679 - DNA, 20 bp, Artificial Sequence
  Synthetic
cgaggguctgacggguagag

SEQ ID NO: 6680 - DNA, 26 bp, Artificial Sequence
  Synthetic
tctggtcttcutttctcctacuccat

SEQ ID NO: 6681 - DNA, 23 bp, Artificial Sequence
  Synthetic
ggtcagaagutggugggagaaag

SEQ ID NO: 6682 - DNA, 19 bp, Artificial Sequence
  Synthetic
gggtccugcacctccatut

SEQ ID NO: 6683 - DNA, 19 bp, Artificial Sequence
  Synthetic
cccuggccaagcttttucc

SEQ ID NO: 6684 - DNA, 21 bp, Artificial Sequence
  Synthetic
gttttagcccagugcttcgut

SEQ ID NO: 6685 - DNA, 23 bp, Artificial Sequence
  Synthetic
tccctcaggagaaugaaggtuca

SEQ ID NO: 6686 - DNA, 20 bp, Artificial Sequence
  Synthetic
cagagaccucctgctccuga

SEQ ID NO: 6687 - DNA, 23 bp, Artificial Sequence
  Synthetic
ggatacatcccutcctcctccug

SEQ ID NO: 6688 - DNA, 22 bp, Artificial Sequence
  Synthetic
ccacctcttucacaaccacgua

SEQ ID NO: 6689 - DNA, 26 bp, Artificial Sequence
  Synthetic
aucttcatccucaacagaaccagaag

SEQ ID NO: 6690 - DNA, 25 bp, Artificial Sequence
  Synthetic
ggagagggtcugggaaggttauaaa

SEQ ID NO: 6691 - DNA, 21 bp, Artificial Sequence
  Synthetic
catccaaacugggagtgcuct

SEQ ID NO: 6692 - DNA, 22 bp, Artificial Sequence
  Synthetic
gtgagatggaugctgtaggcut

SEQ ID NO: 6693 - DNA, 20 bp, Artificial Sequence
  Synthetic
gggaaatgutgccccuggag

SEQ ID NO: 6694 - DNA, 23 bp, Artificial Sequence
  Synthetic
ggtctuccaaagaaaccctucca

SEQ ID NO: 6695 - DNA, 25 bp, Artificial Sequence
  Synthetic
acaggutctatggttuccaacagag

SEQ ID NO: 6696 - DNA, 27 bp, Artificial Sequence
  Synthetic
ccatagtuccgagagaaauttctgtua

SEQ ID NO: 6697 - DNA, 23 bp, Artificial Sequence
  Synthetic
ggcuaagttuagaggccaagagg

SEQ ID NO: 6698 - DNA, 20 bp, Artificial Sequence
  Synthetic
gutttgucacgggcagaagg

SEQ ID NO: 6699 - DNA, 28 bp, Artificial Sequence
  Synthetic
caaaacaacatugggatgagatucaaca

SEQ ID NO: 6700 - DNA, 21 bp, Artificial Sequence
  Synthetic
ggatcatguccacgctucagg

SEQ ID NO: 6701 - DNA, 21 bp, Artificial Sequence
  Synthetic
tcuctcatggauccacaccca

SEQ ID NO: 6702 - DNA, 25 bp, Artificial Sequence
  Synthetic
atctccagtgautgtttggcaacua

SEQ ID NO: 6703 - DNA, 28 bp, Artificial Sequence
  Synthetic
cttggttgtgcaaguaactgtacatauc

SEQ ID NO: 6704 - DNA, 26 bp, Artificial Sequence
  Synthetic
gaggaggaaguttttgagtcttcugt

SEQ ID NO: 6705 - DNA, 27 bp, Artificial Sequence
  Synthetic
cgtttaacaaacutaccctugagagca

SEQ ID NO: 6706 - DNA, 21 bp, Artificial Sequence
  Synthetic
ctgatagctguacccgctgug

SEQ ID NO: 6707 - DNA, 25 bp, Artificial Sequence
  Synthetic
aactgccttugggaagtagaauagg

SEQ ID NO: 6708 - DNA, 22 bp, Artificial Sequence
  Synthetic
gagatgagcuccaaaggcagut

SEQ ID NO: 6709 - DNA, 26 bp, Artificial Sequence
  Synthetic
caatctgtttcugcatttctgctcuc

SEQ ID NO: 6710 - DNA, 25 bp, Artificial Sequence
  Synthetic
cagttctttcugtgggtatugagca

SEQ ID NO: 6711 - DNA, 27 bp, Artificial Sequence
  Synthetic
tcttctcaaggcugtcaaatacaacuc

SEQ ID NO: 6712 - DNA, 23 bp, Artificial Sequence
  Synthetic
aagacacutgtgacttugccaga

SEQ ID NO: 6713 - DNA, 23 bp, Artificial Sequence
  Synthetic
gctggtccucagaggtcttuaca

SEQ ID NO: 6714 - DNA, 18 bp, Artificial Sequence
  Synthetic
ctttcccucccacuggca

SEQ ID NO: 6715 - DNA, 26 bp, Artificial Sequence
  Synthetic
tctcaattuccaacttaggcatuggt

SEQ ID NO: 6716 - DNA, 28 bp, Artificial Sequence
  Synthetic
cagccataaccauagacttaacugaact

SEQ ID NO: 6717 - DNA, 29 bp, Artificial Sequence
  Synthetic
acagctgcaaaaaugatcaaaatctucat

SEQ ID NO: 6718 - DNA, 26 bp, Artificial Sequence
  Synthetic
tggagatgcuacacaaagcagaaaua

SEQ ID NO: 6719 - DNA, 28 bp, Artificial Sequence
  Synthetic
aagtggcaacuatccatgtttuaagaga

SEQ ID NO: 6720 - DNA, 29 bp, Artificial Sequence
  Synthetic
ttcatatgcctaaucttgatggaaauggt

SEQ ID NO: 6721 - DNA, 22 bp, Artificial Sequence
  Synthetic
accccatucatttctgcugcaa

SEQ ID NO: 6722 - DNA, 31 bp, Artificial Sequence
  Synthetic
tcaacacagacuataaaucaacaccaaaaga

SEQ ID NO: 6723 - DNA, 28 bp, Artificial Sequence
  Synthetic
cttaccttccauttctgactttcucact

SEQ ID NO: 6724 - DNA, 29 bp, Artificial Sequence
  Synthetic
cctgacatcaagucacactgtaatgatua

SEQ ID NO: 6725 - DNA, 23 bp, Artificial Sequence
  Synthetic
cattcttgagucctcggtgugaa

SEQ ID NO: 6726 - DNA, 28 bp, Artificial Sequence
  Synthetic
ggctcttuagagaaaaagatgaugggat

SEQ ID NO: 6727 - DNA, 28 bp, Artificial Sequence
  Synthetic
caaagtgtggtuaaatgtcaagtccaua

SEQ ID NO: 6728 - DNA, 22 bp, Artificial Sequence
  Synthetic
gggcagaaacucacatagtcuc

SEQ ID NO: 6729 - DNA, 28 bp, Artificial Sequence
  Synthetic
ggtcatttccauggcatcattacaacua

SEQ ID NO: 6730 - DNA, 28 bp, Artificial Sequence
  Synthetic
acattaccaagagucatacagtugcaat

SEQ ID NO: 6731 - DNA, 26 bp, Artificial Sequence
  Synthetic
tcattttcccaucttctgatgtgguc

SEQ ID NO: 6732 - DNA, 23 bp, Artificial Sequence
  Synthetic
tgaaccatutcagcgaucagaca

SEQ ID NO: 6733 - DNA, 25 bp, Artificial Sequence
  Synthetic
tggcttgttgcuatctcctgatuac

SEQ ID NO: 6734 - DNA, 31 bp, Artificial Sequence
  Synthetic
caagaugattatatgtucagaggaagagcaa

SEQ ID NO: 6735 - DNA, 27 bp, Artificial Sequence
  Synthetic
ctggccaguagtgtgttctaaatuagt

SEQ ID NO: 6736 - DNA, 28 bp, Artificial Sequence
  Synthetic
agtgttgguggaccaaaaattgauaaga

SEQ ID NO: 6737 - DNA, 19 bp, Artificial Sequence
  Synthetic
tccugccaauggcaccaaa

SEQ ID NO: 6738 - DNA, 22 bp, Artificial Sequence
  Synthetic
gccuaggaacaccaacagugat

SEQ ID NO: 6739 - DNA, 27 bp, Artificial Sequence
  Synthetic
cccctattatuagaccattccuccaga

SEQ ID NO: 6740 - DNA, 23 bp, Artificial Sequence
  Synthetic
gccctggaggauaaagaggacut

SEQ ID NO: 6741 - DNA, 25 bp, Artificial Sequence
  Synthetic
auagctatttcattuggcaggagag

SEQ ID NO: 6742 - DNA, 29 bp, Artificial Sequence
  Synthetic
aacaactcttugctgctactaauagaact

SEQ ID NO: 6743 - DNA, 22 bp, Artificial Sequence
  Synthetic
acagctttcaacutgcgcttut

SEQ ID NO: 6744 - DNA, 24 bp, Artificial Sequence
  Synthetic
ctctctgctccutgtcctttgtua

SEQ ID NO: 6745 - DNA, 28 bp, Artificial Sequence
  Synthetic
tcatctcccccagaucttgactatauac

SEQ ID NO: 6746 - DNA, 29 bp, Artificial Sequence
  Synthetic
gaaaacaagcccaaaauactcaataguga

SEQ ID NO: 6747 - DNA, 25 bp, Artificial Sequence
  Synthetic
ttctccagcautgacatgagttuga

SEQ ID NO: 6748 - DNA, 30 bp, Artificial Sequence
  Synthetic
gcaatgcuaaagatagtagagaugaggaaa

SEQ ID NO: 6749 - DNA, 27 bp, Artificial Sequence
  Synthetic
actacaatttctcutgttgggcaauct

SEQ ID NO: 6750 - DNA, 25 bp, Artificial Sequence
  Synthetic
aaaggcctugattgagacauaccaa

SEQ ID NO: 6751 - DNA, 28 bp, Artificial Sequence
  Synthetic
ccgatcttgtgucgtatcactaaactua

SEQ ID NO: 6752 - DNA, 24 bp, Artificial Sequence
  Synthetic
tggttttguctgcaagauaccagt

SEQ ID NO: 6753 - DNA, 28 bp, Artificial Sequence
  Synthetic
gacgagccucacaatcttctctauaaat

SEQ ID NO: 6754 - DNA, 29 bp, Artificial Sequence
  Synthetic
ctgaaggccuttggaatttatctuaacaa

SEQ ID NO: 6755 - DNA, 25 bp, Artificial Sequence
  Synthetic
ctgtctcaaautacctgagcugact

SEQ ID NO: 6756 - DNA, 23 bp, Artificial Sequence
  Synthetic
actgttugggtggtaucagaagt

SEQ ID NO: 6757 - DNA, 30 bp, Artificial Sequence
  Synthetic
tgtcataaacaaaggugaatacagctugat

SEQ ID NO: 6758 - DNA, 22 bp, Artificial Sequence
  Synthetic
ccgcagcauttgcaaagttuga

SEQ ID NO: 6759 - DNA, 23 bp, Artificial Sequence
  Synthetic
agaaguagcccagagtctuaccc

SEQ ID NO: 6760 - DNA, 30 bp, Artificial Sequence
  Synthetic
tctgtaacuaatgtgtcaguagcaaaaaca

SEQ ID NO: 6761 - DNA, 21 bp, Artificial Sequence
  Synthetic
cctgtccugctggagcattut

SEQ ID NO: 6762 - DNA, 23 bp, Artificial Sequence
  Synthetic
gttacacuaccccaaagucacut

SEQ ID NO: 6763 - DNA, 24 bp, Artificial Sequence
  Synthetic
tctattugctcgcttucagaggag

SEQ ID NO: 6764 - DNA, 29 bp, Artificial Sequence
  Synthetic
ctgaattacatucaactgagaaagtucca

SEQ ID NO: 6765 - DNA, 28 bp, Artificial Sequence
  Synthetic
tttaccuaaggcatttugaagaggaaga

SEQ ID NO: 6766 - DNA, 30 bp, Artificial Sequence
  Synthetic
cctgatgataaacugaaacttttggatugt

SEQ ID NO: 6767 - DNA, 25 bp, Artificial Sequence
  Synthetic
cattttgcccugtccattttucact

SEQ ID NO: 6768 - DNA, 27 bp, Artificial Sequence
  Synthetic
aaggcctttatucaatacccattuaca

SEQ ID NO: 6769 - DNA, 30 bp, Artificial Sequence
  Synthetic
gcagtatgttuattctgatcttucacagca

SEQ ID NO: 6770 - DNA, 24 bp, Artificial Sequence
  Synthetic
ggcaagggaaaugctaaagctgua

SEQ ID NO: 6771 - DNA, 24 bp, Artificial Sequence
  Synthetic
ctttggaaacgcucatgttucaga

SEQ ID NO: 6772 - DNA, 25 bp, Artificial Sequence
  Synthetic
gtcactgttgucatttctccctuga

SEQ ID NO: 6773 - DNA, 31 bp, Artificial Sequence
  Synthetic
aaggttatucagaggacugaaatttaatugt

SEQ ID NO: 6774 - DNA, 21 bp, Artificial Sequence
  Synthetic
tctuacggccacagctaaucc

SEQ ID NO: 6775 - DNA, 25 bp, Artificial Sequence
  Synthetic
aggtgattcuaacatgtagcagcuc

SEQ ID NO: 6776 - DNA, 25 bp, Artificial Sequence
  Synthetic
ttccttcaaguctgtgccttaugaa

SEQ ID NO: 6777 - DNA, 23 bp, Artificial Sequence
  Synthetic
cagctcugccagattcttgguag

SEQ ID NO: 6778 - DNA, 30 bp, Artificial Sequence
  Synthetic
ggattauaaaacaagagatgtgacugacga

SEQ ID NO: 6779 - DNA, 25 bp, Artificial Sequence
  Synthetic
ccaagaaaatgucgaccagcataut

SEQ ID NO: 6780 - DNA, 25 bp, Artificial Sequence
  Synthetic
gatctgcttatucacgacacaaugc

SEQ ID NO: 6781 - DNA, 22 bp, Artificial Sequence
  Synthetic
tgggctttauttccgagcauca

SEQ ID NO: 6782 - DNA, 28 bp, Artificial Sequence
  Synthetic
tggtgttacugaagacaaacuggaaaaa

SEQ ID NO: 6783 - DNA, 26 bp, Artificial Sequence
  Synthetic
tcacacaacugcatccttctaatuca

SEQ ID NO: 6784 - DNA, 23 bp, Artificial Sequence
  Synthetic
gcaggtugagaggaaggtcatuc

SEQ ID NO: 6785 - DNA, 24 bp, Artificial Sequence
  Synthetic
gaagtatgugaggctgaacuggat

SEQ ID NO: 6786 - DNA, 22 bp, Artificial Sequence
  Synthetic
ctgtgaggugactgagcatugt

SEQ ID NO: 6787 - DNA, 21 bp, Artificial Sequence
  Synthetic
ctcttcttcuccagccagguc

SEQ ID NO: 6788 - DNA, 24 bp, Artificial Sequence
  Synthetic
actcacctugggctttcattgaut

SEQ ID NO: 6789 - DNA, 21 bp, Artificial Sequence
  Synthetic
aaggcuaggttggaucaggga

SEQ ID NO: 6790 - DNA, 22 bp, Artificial Sequence
  Synthetic
agaaucgcaaacacaggtgcua

SEQ ID NO: 6791 - DNA, 21 bp, Artificial Sequence
  Synthetic
agccucagagattugccagag

SEQ ID NO: 6792 - DNA, 23 bp, Artificial Sequence
  Synthetic
ggtaacccucaccctaaatcugg

SEQ ID NO: 6793 - DNA, 21 bp, Artificial Sequence
  Synthetic
agagagaucccgcatcacuca

SEQ ID NO: 6794 - DNA, 19 bp, Artificial Sequence
  Synthetic
gattgcugtgcugggcaaa

SEQ ID NO: 6795 - DNA, 19 bp, Artificial Sequence
  Synthetic
cctgcaggccauaggcauc

SEQ ID NO: 6796 - DNA, 22 bp, Artificial Sequence
  Synthetic
ctatttgagcugtccggctuct

SEQ ID NO: 6797 - DNA, 19 bp, Artificial Sequence
  Synthetic
cggcacaaaguagggcugt

SEQ ID NO: 6798 - DNA, 20 bp, Artificial Sequence
  Synthetic
agcttccucctgcaatgcut

SEQ ID NO: 6799 - DNA, 21 bp, Artificial Sequence
  Synthetic
cctccagccagutgtcauagg

SEQ ID NO: 6800 - DNA, 17 bp, Artificial Sequence
  Synthetic
gccucacgcctccugat

SEQ ID NO: 6801 - DNA, 18 bp, Artificial Sequence
  Synthetic
ctuccccaagccccucac

SEQ ID NO: 6802 - DNA, 22 bp, Artificial Sequence
  Synthetic
tgtgactgugactggaggtcut

SEQ ID NO: 6803 - DNA, 22 bp, Artificial Sequence
  Synthetic
gggtcccagaguctatacucac

SEQ ID NO: 6804 - DNA, 19 bp, Artificial Sequence
  Synthetic
gtggcttcuggaaggcuga

SEQ ID NO: 6805 - DNA, 19 bp, Artificial Sequence
  Synthetic
cccagacucccacacucac

SEQ ID NO: 6806 - DNA, 20 bp, Artificial Sequence
  Synthetic
tgagtucggcctactcucca

SEQ ID NO: 6807 - DNA, 20 bp, Artificial Sequence
  Synthetic
tcagtgucgagcagtuccag

SEQ ID NO: 6808 - DNA, 26 bp, Artificial Sequence
  Synthetic
gctgaagauagaaggagtugaacacc

SEQ ID NO: 6809 - DNA, 27 bp, Artificial Sequence
  Synthetic
tcagtcaagaagucaaccacaagtauc

SEQ ID NO: 6810 - DNA, 28 bp, Artificial Sequence
  Synthetic
tcatgtggaaagagugatgagaaatcut

SEQ ID NO: 6811 - DNA, 28 bp, Artificial Sequence
  Synthetic
gtgcaactaagutacagtagatcucaca

SEQ ID NO: 6812 - DNA, 28 bp, Artificial Sequence
  Synthetic
tcttgttttagacaauccgccattauct

SEQ ID NO: 6813 - DNA, 29 bp, Artificial Sequence
  Synthetic
gctctcagagautccagaagatuaagaaa

SEQ ID NO: 6814 - DNA, 26 bp, Artificial Sequence
  Synthetic
tatgtactgaugctcgtgttatcugt

SEQ ID NO: 6815 - DNA, 20 bp, Artificial Sequence
  Synthetic
agtcagtgccucccacttug

SEQ ID NO: 6816 - DNA, 29 bp, Artificial Sequence
  Synthetic
ggaaggaagacagutcaaagagaatuagg

SEQ ID NO: 6817 - DNA, 23 bp, Artificial Sequence
  Synthetic
cttcctctuccagttctucaggt

SEQ ID NO: 6818 - DNA, 22 bp, Artificial Sequence
  Synthetic
gcgctcuaggttgctgattuca

SEQ ID NO: 6819 - DNA, 23 bp, Artificial Sequence
  Synthetic
cutccttttcttuccgcaaagca

SEQ ID NO: 6820 - DNA, 25 bp, Artificial Sequence
  Synthetic
agttgtggauatgcgtgaattucga

SEQ ID NO: 6821 - DNA, 23 bp, Artificial Sequence
  Synthetic
ggccgttattuaaagagccgaut

SEQ ID NO: 6822 - DNA, 25 bp, Artificial Sequence
  Synthetic
agagaagtauaatcctgguccccaa

SEQ ID NO: 6823 - DNA, 21 bp, Artificial Sequence
  Synthetic
gtttggcauttgcagcatucc

SEQ ID NO: 6824 - DNA, 31 bp, Artificial Sequence
  Synthetic
gttcttaaggccaaauttgtatcgttatugt

SEQ ID NO: 6825 - DNA, 26 bp, Artificial Sequence
  Synthetic
caccacagatucagacttggactaug

SEQ ID NO: 6826 - DNA, 27 bp, Artificial Sequence
  Synthetic
cacccccttcaucatcataagtaauga

SEQ ID NO: 6827 - DNA, 27 bp, Artificial Sequence
  Synthetic
agaagaacccaggaauactggactuaa

SEQ ID NO: 6828 - DNA, 24 bp, Artificial Sequence
  Synthetic
tgctatgcaaugtaaacgccatut

SEQ ID NO: 6829 - DNA, 20 bp, Artificial Sequence
  Synthetic
caaggaugacacggccaaug

SEQ ID NO: 6830 - DNA, 30 bp, Artificial Sequence
  Synthetic
ggtaaagtagaaucaaaaccaugaggagaa

SEQ ID NO: 6831 - DNA, 27 bp, Artificial Sequence
  Synthetic
cactgaccucgacagatttttcacuat

SEQ ID NO: 6832 - DNA, 21 bp, Artificial Sequence
  Synthetic
gtgtcctugaaagggccatug

SEQ ID NO: 6833 - DNA, 28 bp, Artificial Sequence
  Synthetic
caatcgggtctutctcttccattatuct

SEQ ID NO: 6834 - DNA, 25 bp, Artificial Sequence
  Synthetic
ggaauaggtuagaggagggagagag

SEQ ID NO: 6835 - DNA, 23 bp, Artificial Sequence
  Synthetic
caaggacaugggtggacataugg

SEQ ID NO: 6836 - DNA, 17 bp, Artificial Sequence
  Synthetic
aggccucccacaccgua

SEQ ID NO: 6837 - DNA, 18 bp, Artificial Sequence
  Synthetic
accaaucggccacuggag

SEQ ID NO: 6838 - DNA, 17 bp, Artificial Sequence
  Synthetic
gcaccugcccctcctug

SEQ ID NO: 6839 - DNA, 21 bp, Artificial Sequence
  Synthetic
tctcctgugcctaccacguaa

SEQ ID NO: 6840 - DNA, 29 bp, Artificial Sequence
  Synthetic
gcataatttatgtaaugtcctgctccuga

SEQ ID NO: 6841 - DNA, 22 bp, Artificial Sequence
  Synthetic
gctaggtgtutgtcgctgtuct

SEQ ID NO: 6842 - DNA, 28 bp, Artificial Sequence
  Synthetic
cgaatttgaagauagagacaggtcucat

SEQ ID NO: 6843 - DNA, 26 bp, Artificial Sequence
  Synthetic
agcattaugcacaaacaucacaaaca

SEQ ID NO: 6844 - DNA, 18 bp, Artificial Sequence
  Synthetic
agggaacccuccgaguca

SEQ ID NO: 6845 - DNA, 18 bp, Artificial Sequence
  Synthetic
cucacctcugcccaggac

SEQ ID NO: 6846 - DNA, 25 bp, Artificial Sequence
  Synthetic
ggactccaccuacagaaagtttucc

SEQ ID NO: 6847 - DNA, 22 bp, Artificial Sequence
  Synthetic
cctggatuagacagcgcacuaa

SEQ ID NO: 6848 - DNA, 28 bp, Artificial Sequence
  Synthetic
ccccctgtuggtgtctttattatugaaa

SEQ ID NO: 6849 - DNA, 20 bp, Artificial Sequence
  Synthetic
gtggatgtuaccccggtguc

SEQ ID NO: 6850 - DNA, 22 bp, Artificial Sequence
  Synthetic
gctuacaccatccucagccaag

SEQ ID NO: 6851 - DNA, 23 bp, Artificial Sequence
  Synthetic
ccacgggautgagctaauacaca

SEQ ID NO: 6852 - DNA, 21 bp, Artificial Sequence
  Synthetic
gtgggaggcugtauacaccat

SEQ ID NO: 6853 - DNA, 22 bp, Artificial Sequence
  Synthetic
caagggtaugaacagctgugag

SEQ ID NO: 6854 - DNA, 25 bp, Artificial Sequence
  Synthetic
ggtcctattcuaaaagccagagcut

SEQ ID NO: 6855 - DNA, 22 bp, Artificial Sequence
  Synthetic
ctgtgtacgugctgttctucac

SEQ ID NO: 6856 - DNA, 23 bp, Artificial Sequence
  Synthetic
tgatgcagaccutcctcccaaua

SEQ ID NO: 6857 - DNA, 22 bp, Artificial Sequence
  Synthetic
catggcagtuggagcaaagtug

SEQ ID NO: 6858 - DNA, 22 bp, Artificial Sequence
  Synthetic
ggtggucaaagagcccttacug

SEQ ID NO: 6859 - DNA, 29 bp, Artificial Sequence
  Synthetic
aaatgcctacctcutactaatcattgcut

SEQ ID NO: 6860 - DNA, 21 bp, Artificial Sequence
  Synthetic
gttccgaagcugctagtcuga

SEQ ID NO: 6861 - DNA, 20 bp, Artificial Sequence
  Synthetic
ctctcgagucccctagucgt

SEQ ID NO: 6862 - DNA, 20 bp, Artificial Sequence
  Synthetic
gctggtugatgaccgucagg

SEQ ID NO: 6863 - DNA, 20 bp, Artificial Sequence
  Synthetic
catgucggagcugcagaaag

SEQ ID NO: 6864 - DNA, 19 bp, Artificial Sequence
  Synthetic
cccagtggutgagctccuc

SEQ ID NO: 6865 - DNA, 17 bp, Artificial Sequence
  Synthetic
gggagugtctggugcgt

SEQ ID NO: 6866 - DNA, 17 bp, Artificial Sequence
  Synthetic
cgcugggcagggtucag

SEQ ID NO: 6867 - DNA, 21 bp, Artificial Sequence
  Synthetic
tgtccccggutcatcctaugt

SEQ ID NO: 6868 - DNA, 23 bp, Artificial Sequence
  Synthetic
gggttucgcattacctucaggaa

SEQ ID NO: 6869 - DNA, 23 bp, Artificial Sequence
  Synthetic
gctgatgtgaggugggttttcuc

SEQ ID NO: 6870 - DNA, 21 bp, Artificial Sequence
  Synthetic
gaggccugcggtttttgtuat

SEQ ID NO: 6871 - DNA, 27 bp, Artificial Sequence
  Synthetic
acagcgtgttcutcttattttgctuac

SEQ ID NO: 6872 - DNA, 18 bp, Artificial Sequence
  Synthetic
gtgcgtcugggacaugga

SEQ ID NO: 6873 - DNA, 19 bp, Artificial Sequence
  Synthetic
ctgguagaggcctgtccug

SEQ ID NO: 6874 - DNA, 21 bp, Artificial Sequence
  Synthetic
gctcccaugctctgcttgtut

SEQ ID NO: 6875 - DNA, 20 bp, Artificial Sequence
  Synthetic
gcaguggcggtcttctucag

SEQ ID NO: 6876 - DNA, 24 bp, Artificial Sequence
  Synthetic
cactgtgccaugtgatttacaguc

SEQ ID NO: 6877 - DNA, 23 bp, Artificial Sequence
  Synthetic
gcacagaccuctctctugagaca

SEQ ID NO: 6878 - DNA, 24 bp, Artificial Sequence
  Synthetic
aatgtcgauggaacatcagtcucc

SEQ ID NO: 6879 - DNA, 27 bp, Artificial Sequence
  Synthetic
gctcaagatagaucagtttctcctuca

SEQ ID NO: 6880 - DNA, 24 bp, Artificial Sequence
  Synthetic
caaagtgttcuactgctgggagut

SEQ ID NO: 6881 - DNA, 24 bp, Artificial Sequence
  Synthetic
tgtaccatttgutgctggtcugat

SEQ ID NO: 6882 - DNA, 30 bp, Artificial Sequence
  Synthetic
gaagaaaaucaaggagcuttagaaatgaut

SEQ ID NO: 6883 - DNA, 25 bp, Artificial Sequence
  Synthetic
ccattctccauttttagccctucca

SEQ ID NO: 6884 - DNA, 24 bp, Artificial Sequence
  Synthetic
gccuaaagcugcaagaaaaagcat

SEQ ID NO: 6885 - DNA, 19 bp, Artificial Sequence
  Synthetic
ccuggcagaccccactuac

SEQ ID NO: 6886 - DNA, 27 bp, Artificial Sequence
  Synthetic
agactgtattgccutaggtaactccut

SEQ ID NO: 6887 - DNA, 21 bp, Artificial Sequence
  Synthetic
tcccaatcauggcaagagcug

SEQ ID NO: 6888 - DNA, 32 bp, Artificial Sequence
  Synthetic
caagtatatgcuattttgaaguggaacaacat

SEQ ID NO: 6889 - DNA, 24 bp, Artificial Sequence
  Synthetic
tcatcuacctgcatuggagagaca

SEQ ID NO: 6890 - DNA, 25 bp, Artificial Sequence
  Synthetic
cttctccttaccaugtgctcttcut

SEQ ID NO: 6891 - DNA, 20 bp, Artificial Sequence
  Synthetic
agctggaagutggctgaugt

SEQ ID NO: 6892 - DNA, 25 bp, Artificial Sequence
  Synthetic
ggaatctctugttggcattugaagc

SEQ ID NO: 6893 - DNA, 27 bp, Artificial Sequence
  Synthetic
acgagaaactgtutatcagatggcaua

SEQ ID NO: 6894 - DNA, 18 bp, Artificial Sequence
  Synthetic
gcuccgccacctcuacca

SEQ ID NO: 6895 - DNA, 20 bp, Artificial Sequence
  Synthetic
tcttcugccacccacctgua

SEQ ID NO: 6896 - DNA, 21 bp, Artificial Sequence
  Synthetic
gggaaagggucctctgaucat

SEQ ID NO: 6897 - DNA, 24 bp, Artificial Sequence
  Synthetic
ctggttgttcutgtggaagatguc

SEQ ID NO: 6898 - DNA, 19 bp, Artificial Sequence
  Synthetic
cccttugcccaacagugac

SEQ ID NO: 6899 - DNA, 21 bp, Artificial Sequence
  Synthetic
gguagagcacatugggcacaa

SEQ ID NO: 6900 - DNA, 20 bp, Artificial Sequence
  Synthetic
cugcacaaccaagaggugac

SEQ ID NO: 6901 - DNA, 22 bp, Artificial Sequence
  Synthetic
gagggtcugaggaaggauagga

SEQ ID NO: 6902 - DNA, 21 bp, Artificial Sequence
  Synthetic
tgtcctguccccactccttua

SEQ ID NO: 6903 - DNA, 20 bp, Artificial Sequence
  Synthetic
cccctcttuctcagtgcuca

SEQ ID NO: 6904 - DNA, 18 bp, Artificial Sequence
  Synthetic
agacccccucaccacugt

SEQ ID NO: 6905 - DNA, 18 bp, Artificial Sequence
  Synthetic
cccuccacccagctcuga

SEQ ID NO: 6906 - DNA, 21 bp, Artificial Sequence
  Synthetic
caccccaaacuagcccucaat

SEQ ID NO: 6907 - DNA, 23 bp, Artificial Sequence
  Synthetic
cgcutgatgaggaucccaaagac

SEQ ID NO: 6908 - DNA, 20 bp, Artificial Sequence
  Synthetic
cccacgcucttctcacucat

SEQ ID NO: 6909 - DNA, 20 bp, Artificial Sequence
  Synthetic
cctccuagcaggagagggug

SEQ ID NO: 6910 - DNA, 23 bp, Artificial Sequence
  Synthetic
tgcuggtcaagagucccaaccat

SEQ ID NO: 6911 - DNA, 22 bp, Artificial Sequence
  Synthetic
gttctcccaugggcuagacacc

SEQ ID NO: 6912 - DNA, 20 bp, Artificial Sequence
  Synthetic
ctgggacuagcatgcugacc

SEQ ID NO: 6913 - DNA, 22 bp, Artificial Sequence
  Synthetic
ccaguacctggaugaccacaaa

SEQ ID NO: 6914 - DNA, 21 bp, Artificial Sequence
  Synthetic
gtgagugacccccatcaugac

SEQ ID NO: 6915 - DNA, 20 bp, Artificial Sequence
  Synthetic
ccattcccaggucaccauca

SEQ ID NO: 6916 - DNA, 19 bp, Artificial Sequence
  Synthetic
gcccaagacuctcucccca

SEQ ID NO: 6917 - DNA, 24 bp, Artificial Sequence
  Synthetic
cctggtcccaguaatagaggtugt

SEQ ID NO: 6918 - DNA, 20 bp, Artificial Sequence
  Synthetic
ctgtggcuctgtacctgugg

SEQ ID NO: 6919 - DNA, 21 bp, Artificial Sequence
  Synthetic
agcaatugggcagatgtguga

SEQ ID NO: 6920 - DNA, 26 bp, Artificial Sequence
  Synthetic
auactccactatguaagacaaaggct

SEQ ID NO: 6921 - DNA, 24 bp, Artificial Sequence
  Synthetic
cctctctctucctctcttctucca

SEQ ID NO: 6922 - DNA, 26 bp, Artificial Sequence
  Synthetic
agcagaugcaaggtattctguaaagg

SEQ ID NO: 6923 - DNA, 32 bp, Artificial Sequence
  Synthetic
gctagaggtaacucatgataatggaatattug

SEQ ID NO: 6924 - DNA, 29 bp, Artificial Sequence
  Synthetic
atgtaggatucagagtaaaatcaaagugt

SEQ ID NO: 6925 - DNA, 24 bp, Artificial Sequence
  Synthetic
acccatcucaagaggagctcatua

SEQ ID NO: 6926 - DNA, 23 bp, Artificial Sequence
  Synthetic
gccagaaccaccauctttcagua

SEQ ID NO: 6927 - DNA, 24 bp, Artificial Sequence
  Synthetic
cccgttcccutgatgtctacaaut

SEQ ID NO: 6928 - DNA, 22 bp, Artificial Sequence
  Synthetic
actctgagaggauagcccugag

SEQ ID NO: 6929 - DNA, 25 bp, Artificial Sequence
  Synthetic
aaagtaaatccagucctgccaauga

SEQ ID NO: 6930 - DNA, 32 bp, Artificial Sequence
  Synthetic
tgataataaattcucctctgtgttctuagaca

SEQ ID NO: 6931 - DNA, 27 bp, Artificial Sequence
  Synthetic
ccaagaaautagagtccucagaagaga

SEQ ID NO: 6932 - DNA, 32 bp, Artificial Sequence
  Synthetic
gtctgaactacttcutcatattcttgctttut

SEQ ID NO: 6933 - DNA, 27 bp, Artificial Sequence
  Synthetic
cagugatgaaaacatucaagcagaact

SEQ ID NO: 6934 - DNA, 30 bp, Artificial Sequence
  Synthetic
tggtggtatacgauatgggttttguaaaag

SEQ ID NO: 6935 - DNA, 29 bp, Artificial Sequence
  Synthetic
tggtcagaaagauaagccagttgataaug

SEQ ID NO: 6936 - DNA, 25 bp, Artificial Sequence
  Synthetic
ctgtggttaacutcatgtcccaaug

SEQ ID NO: 6937 - DNA, 25 bp, Artificial Sequence
  Synthetic
gutagcactcuagggaaggcaaaaa

SEQ ID NO: 6938 - DNA, 23 bp, Artificial Sequence
  Synthetic
gggaaagtaucgctgtcatguct

SEQ ID NO: 6939 - DNA, 32 bp, Artificial Sequence
  Synthetic
gatagttgttcuagcagtgaagagauaaagaa

SEQ ID NO: 6940 - DNA, 30 bp, Artificial Sequence
  Synthetic
aatcacctttugttttattctcaugaccac

SEQ ID NO: 6941 - DNA, 22 bp, Artificial Sequence
  Synthetic
acctacaucaggccttcaucct

SEQ ID NO: 6942 - DNA, 31 bp, Artificial Sequence
  Synthetic
ctgaagaaccagaauattcatctacctcaut

SEQ ID NO: 6943 - DNA, 31 bp, Artificial Sequence
  Synthetic
ggataacacuaaatagcagcatucagaaagt

SEQ ID NO: 6944 - DNA, 32 bp, Artificial Sequence
  Synthetic
gtctttagtgaguaataaactgctgttcucat

SEQ ID NO: 6945 - DNA, 31 bp, Artificial Sequence
  Synthetic
cagtaataatgauttgaacaccacugagaag

SEQ ID NO: 6946 - DNA, 22 bp, Artificial Sequence
  Synthetic
ttttgaggtugtatccgcugct

SEQ ID NO: 6947 - DNA, 25 bp, Artificial Sequence
  Synthetic
tttgtccatggugtcaagtttcuct

SEQ ID NO: 6948 - DNA, 24 bp, Artificial Sequence
  Synthetic
ttttcctacugtggttgctuccaa

SEQ ID NO: 6949 - DNA, 30 bp, Artificial Sequence
  Synthetic
atttatagattttgcaugctgaaacttcuc

SEQ ID NO: 6950 - DNA, 19 bp, Artificial Sequence
  Synthetic
aguctgggcuagggcaact

SEQ ID NO: 6951 - DNA, 23 bp, Artificial Sequence
  Synthetic
cccaaggguggctactcttacua

SEQ ID NO: 6952 - DNA, 20 bp, Artificial Sequence
  Synthetic
caccaccutgtcccuagacc

SEQ ID NO: 6953 - DNA, 26 bp, Artificial Sequence
  Synthetic
gtagcatctcuaccccaaaactgtut

SEQ ID NO: 6954 - DNA, 19 bp, Artificial Sequence
  Synthetic
ccccaacauggagggctug

SEQ ID NO: 6955 - DNA, 22 bp, Artificial Sequence
  Synthetic
cacttctcacaucacccctuct

SEQ ID NO: 6956 - DNA, 22 bp, Artificial Sequence
  Synthetic
agtgggttuccctgtctcctua

SEQ ID NO: 6957 - DNA, 19 bp, Artificial Sequence
  Synthetic
cttggacagucgccccuac

SEQ ID NO: 6958 - DNA, 28 bp, Artificial Sequence
  Synthetic
ctgctctcttgugattctctatcctaug

SEQ ID NO: 6959 - DNA, 25 bp, Artificial Sequence
  Synthetic
caaactcaccuctgacttctctcug

SEQ ID NO: 6960 - DNA, 21 bp, Artificial Sequence
  Synthetic
ggcacttgcuggtccaaguat

SEQ ID NO: 6961 - DNA, 17 bp, Artificial Sequence
  Synthetic
ccuggacggtgugcgaa

SEQ ID NO: 6962 - DNA, 19 bp, Artificial Sequence
  Synthetic
gcacuatggccuggccaaa

SEQ ID NO: 6963 - DNA, 19 bp, Artificial Sequence
  Synthetic
ccucaagaaggccctgcuc

SEQ ID NO: 6964 - DNA, 21 bp, Artificial Sequence
  Synthetic
aaccagacaugcctcttgucc

SEQ ID NO: 6965 - DNA, 21 bp, Artificial Sequence
  Synthetic
tgcaaccuggatgccaucaaa

SEQ ID NO: 6966 - DNA, 21 bp, Artificial Sequence
  Synthetic
cgtgagccutctcttgaggug

SEQ ID NO: 6967 - DNA, 20 bp, Artificial Sequence
  Synthetic
aaagcactuggatgccggua

SEQ ID NO: 6968 - DNA, 20 bp, Artificial Sequence
  Synthetic
cccucctaucccacagcaca

SEQ ID NO: 6969 - DNA, 21 bp, Artificial Sequence
  Synthetic
gtggugacaagggugagacag

SEQ ID NO: 6970 - DNA, 21 bp, Artificial Sequence
  Synthetic
tggtcatggagugttgccauc

SEQ ID NO: 6971 - DNA, 20 bp, Artificial Sequence
  Synthetic
gccattguggccttgccuaa

SEQ ID NO: 6972 - DNA, 18 bp, Artificial Sequence
  Synthetic
cccagctcugcacaccuc

SEQ ID NO: 6973 - DNA, 20 bp, Artificial Sequence
  Synthetic
ctggacgucctggtgaagut

SEQ ID NO: 6974 - DNA, 19 bp, Artificial Sequence
  Synthetic
cagaggcaucaagccugga

SEQ ID NO: 6975 - DNA, 20 bp, Artificial Sequence
  Synthetic
gcuaaaggcgaacctgguga

SEQ ID NO: 6976 - DNA, 22 bp, Artificial Sequence
  Synthetic
ctgctgaggaggcuatgtgtua

SEQ ID NO: 6977 - DNA, 21 bp, Artificial Sequence
  Synthetic
ccaaaggtgcugatggctcuc

SEQ ID NO: 6978 - DNA, 18 bp, Artificial Sequence
  Synthetic
actugccagagcccctuc

SEQ ID NO: 6979 - DNA, 20 bp, Artificial Sequence
  Synthetic
tgccctguccttcccttcua

SEQ ID NO: 6980 - DNA, 21 bp, Artificial Sequence
  Synthetic
ctgagggtguctcccctttuc

SEQ ID NO: 6981 - DNA, 22 bp, Artificial Sequence
  Synthetic
tcctaacccugagttcccctut

SEQ ID NO: 6982 - DNA, 19 bp, Artificial Sequence
  Synthetic
cgcctcaucccagacccua

SEQ ID NO: 6983 - DNA, 17 bp, Artificial Sequence
  Synthetic
gggucccgctggugaac

SEQ ID NO: 6984 - DNA, 17 bp, Artificial Sequence
  Synthetic
gtccgggutcaccucga

SEQ ID NO: 6985 - DNA, 18 bp, Artificial Sequence
  Synthetic
cugaggcuggcacaggat

SEQ ID NO: 6986 - DNA, 23 bp, Artificial Sequence
  Synthetic
tgaggutagaaaguggcaaaggg

SEQ ID NO: 6987 - DNA, 27 bp, Artificial Sequence
  Synthetic
gatatgtccuttcttctgatucagggt

SEQ ID NO: 6988 - DNA, 20 bp, Artificial Sequence
  Synthetic
ctctggaacugggcacacuc

SEQ ID NO: 6989 - DNA, 20 bp, Artificial Sequence
  Synthetic
tcctccacauccccagaguc

SEQ ID NO: 6990 - DNA, 23 bp, Artificial Sequence
  Synthetic
gggtcagauggtatcttctugct

SEQ ID NO: 6991 - DNA, 20 bp, Artificial Sequence
  Synthetic
ccttcaaucccagcctuccc

SEQ ID NO: 6992 - DNA, 32 bp, Artificial Sequence
  Synthetic
tcaaagtataaaautatgtcatcugccaaaaa

SEQ ID NO: 6993 - DNA, 19 bp, Artificial Sequence
  Synthetic
cctggacagccuggactuc

SEQ ID NO: 6994 - DNA, 21 bp, Artificial Sequence
  Synthetic
gaucacgtcaucgcacaacac

SEQ ID NO: 6995 - DNA, 22 bp, Artificial Sequence
  Synthetic
gggttgcagucactacugacaa

SEQ ID NO: 6996 - DNA, 30 bp, Artificial Sequence
  Synthetic
ggatttgtgttgaugagcatatatgaaugt

SEQ ID NO: 6997 - DNA, 27 bp, Artificial Sequence
  Synthetic
tgcagatgaattugtcagactccauag

SEQ ID NO: 6998 - DNA, 30 bp, Artificial Sequence
  Synthetic
tgaaaagtaaaaugaaggctcataccauga

SEQ ID NO: 6999 - DNA, 22 bp, Artificial Sequence
  Synthetic
gcaaggcuagaatggcgaucaa

SEQ ID NO: 7000 - DNA, 22 bp, Artificial Sequence
  Synthetic
aggcagtggaugtcttcttucc

SEQ ID NO: 7001 - DNA, 30 bp, Artificial Sequence
  Synthetic
atctaccatgaauagtctttgggttaatut

SEQ ID NO: 7002 - DNA, 29 bp, Artificial Sequence
  Synthetic
tcagtgtgtguggaagaagaaaacauaat

SEQ ID NO: 7003 - DNA, 23 bp, Artificial Sequence
  Synthetic
tcccugggcaaaaagagcatuaa

SEQ ID NO: 7004 - DNA, 28 bp, Artificial Sequence
  Synthetic
agtgtcaacugctcatttcuaaaacagt

SEQ ID NO: 7005 - DNA, 26 bp, Artificial Sequence
  Synthetic
gaatgactttauttgggacgtuagcc

SEQ ID NO: 7006 - DNA, 22 bp, Artificial Sequence
  Synthetic
agcagtguactgcattctugct

SEQ ID NO: 7007 - DNA, 27 bp, Artificial Sequence
  Synthetic
atgttggaaacaugcctaaaaagcaut

SEQ ID NO: 7008 - DNA, 28 bp, Artificial Sequence
  Synthetic
ctttggttcctuatcagtagaagacucc

SEQ ID NO: 7009 - DNA, 26 bp, Artificial Sequence
  Synthetic
aatcagagacugagttgacagttgut

SEQ ID NO: 7010 - DNA, 26 bp, Artificial Sequence
  Synthetic
tgtgtgatcgauttgactttguccat

SEQ ID NO: 7011 - DNA, 30 bp, Artificial Sequence
  Synthetic
gagtttcaaaaggauttccagaataugaga

SEQ ID NO: 7012 - DNA, 22 bp, Artificial Sequence
  Synthetic
caacccggagagauttctucgt

SEQ ID NO: 7013 - DNA, 26 bp, Artificial Sequence
  Synthetic
cagcttctcuacatattcagcuagca

SEQ ID NO: 7014 - DNA, 24 bp, Artificial Sequence
  Synthetic
ctccgttagucacagtggttatut

SEQ ID NO: 7015 - DNA, 22 bp, Artificial Sequence
  Synthetic
gtgtacggucagccttaatugc

SEQ ID NO: 7016 - DNA, 25 bp, Artificial Sequence
  Synthetic
atattggaaactuggatcgggcaua

SEQ ID NO: 7017 - DNA, 30 bp, Artificial Sequence
  Synthetic
gaggaaggatcauctgctttgatauaagaa

SEQ ID NO: 7018 - DNA, 29 bp, Artificial Sequence
  Synthetic
gaggattaagcucacactaatatctugct

SEQ ID NO: 7019 - DNA, 25 bp, Artificial Sequence
  Synthetic
ggtagaugccaaacgtccaaaatug

SEQ ID NO: 7020 - DNA, 28 bp, Artificial Sequence
  Synthetic
agctcacatgggaaugtttactgaatua

SEQ ID NO: 7021 - DNA, 28 bp, Artificial Sequence
  Synthetic
agcattagttttaacuacacagttgcut

SEQ ID NO: 7022 - DNA, 27 bp, Artificial Sequence
  Synthetic
gttgttaaatgauttgctgatggugct

SEQ ID NO: 7023 - DNA, 23 bp, Artificial Sequence
  Synthetic
autgaagucccagggacaaaagt

SEQ ID NO: 7024 - DNA, 26 bp, Artificial Sequence
  Synthetic
attgagttcaggagaautgctgctua

SEQ ID NO: 7025 - DNA, 24 bp, Artificial Sequence
  Synthetic
ttgtaacaccautttaggccuggt

SEQ ID NO: 7026 - DNA, 27 bp, Artificial Sequence
  Synthetic
ctccaggtggauaaattagatgctuca

SEQ ID NO: 7027 - DNA, 27 bp, Artificial Sequence
  Synthetic
ttgtattctatttugaggcacagtcuc

SEQ ID NO: 7028 - DNA, 33 bp, Artificial Sequence
  Synthetic
attacttacaacagaguttaacataagcaugat

SEQ ID NO: 7029 - DNA, 27 bp, Artificial Sequence
  Synthetic
tggataaaugaactggaacugggaaaa

SEQ ID NO: 7030 - DNA, 28 bp, Artificial Sequence
  Synthetic
cacttctctggcugaatctacttcttut

SEQ ID NO: 7031 - DNA, 30 bp, Artificial Sequence
  Synthetic
acctgaactttaugatcctgaagauacaga

SEQ ID NO: 7032 - DNA, 28 bp, Artificial Sequence
  Synthetic
ggcaaaacagtuttactttccatctuct

SEQ ID NO: 7033 - DNA, 29 bp, Artificial Sequence
  Synthetic
ggtcaagctttaautctttgggacaguat

SEQ ID NO: 7034 - DNA, 26 bp, Artificial Sequence
  Synthetic
acactgtagtucctggacacatauct

SEQ ID NO: 7035 - DNA, 29 bp, Artificial Sequence
  Synthetic
cauaaaggacagaaccaatauacaggaca

SEQ ID NO: 7036 - DNA, 27 bp, Artificial Sequence
  Synthetic
gggatcccugcaattaactttauacaa

SEQ ID NO: 7037 - DNA, 24 bp, Artificial Sequence
  Synthetic
gtgagggtcuggatttctcagaug

SEQ ID NO: 7038 - DNA, 23 bp, Artificial Sequence
  Synthetic
accctaggaagcutactgtggua

SEQ ID NO: 7039 - DNA, 24 bp, Artificial Sequence
  Synthetic
gggagcactuttgttatctgtgug

SEQ ID NO: 7040 - DNA, 25 bp, Artificial Sequence
  Synthetic
ccagctggauagtaaatguaacacc

SEQ ID NO: 7041 - DNA, 27 bp, Artificial Sequence
  Synthetic
ttgcccagccucttctaaagataatut

SEQ ID NO: 7042 - DNA, 29 bp, Artificial Sequence
  Synthetic
tcctttaagcautatttgagttgaugcac

SEQ ID NO: 7043 - DNA, 22 bp, Artificial Sequence
  Synthetic
aattcccucccaacccctcuat

SEQ ID NO: 7044 - DNA, 24 bp, Artificial Sequence
  Synthetic
caaaccgaagcugaacttctgtua

SEQ ID NO: 7045 - DNA, 30 bp, Artificial Sequence
  Synthetic
tgctgttgttaaauctattttgccaaaugt

SEQ ID NO: 7046 - DNA, 26 bp, Artificial Sequence
  Synthetic
tttactcacguttttcccatcuagca

SEQ ID NO: 7047 - DNA, 23 bp, Artificial Sequence
  Synthetic
gattacuagagagcuccggagga

SEQ ID NO: 7048 - DNA, 28 bp, Artificial Sequence
  Synthetic
agtggagagtugagttttacagtcttuc

SEQ ID NO: 7049 - DNA, 23 bp, Artificial Sequence
  Synthetic
gagctgtuttggccttugagaac

SEQ ID NO: 7050 - DNA, 31 bp, Artificial Sequence
  Synthetic
tggttcatgtcatugtttgtaaaatccttug

SEQ ID NO: 7051 - DNA, 25 bp, Artificial Sequence
  Synthetic
ctgggctguagagaatgattgaugt

SEQ ID NO: 7052 - DNA, 17 bp, Artificial Sequence
  Synthetic
ctctggugggccagcut

SEQ ID NO: 7053 - DNA, 19 bp, Artificial Sequence
  Synthetic
guctgtaggugagcaccca

SEQ ID NO: 7054 - DNA, 21 bp, Artificial Sequence
  Synthetic
caugaccaucaccacaagagg

SEQ ID NO: 7055 - DNA, 25 bp, Artificial Sequence
  Synthetic
ttgaggacaauggcatctacttcug

SEQ ID NO: 7056 - DNA, 21 bp, Artificial Sequence
  Synthetic
gaggcuactgaccttugggat

SEQ ID NO: 7057 - DNA, 20 bp, Artificial Sequence
  Synthetic
ggaacauagagggcaugcag

SEQ ID NO: 7058 - DNA, 30 bp, Artificial Sequence
  Synthetic
ttctgcaatucccatgtttcttaaauaact

SEQ ID NO: 7059 - DNA, 22 bp, Artificial Sequence
  Synthetic
gcagctgcaccuatgattggut

SEQ ID NO: 7060 - DNA, 25 bp, Artificial Sequence
  Synthetic
aggtattaaauccacccctttugcc

SEQ ID NO: 7061 - DNA, 29 bp, Artificial Sequence
  Synthetic
agatctgtttcttuctgtccacaatgaut

SEQ ID NO: 7062 - DNA, 29 bp, Artificial Sequence
  Synthetic
gagcagaattcuagctaggttaaguaagg

SEQ ID NO: 7063 - DNA, 23 bp, Artificial Sequence
  Synthetic
ttttaactuaggtggccugccat

SEQ ID NO: 7064 - DNA, 28 bp, Artificial Sequence
  Synthetic
caccaactgaaauaacctaaaacaacuc

SEQ ID NO: 7065 - DNA, 24 bp, Artificial Sequence
  Synthetic
gagugcaaaccacaacattctuca

SEQ ID NO: 7066 - DNA, 28 bp, Artificial Sequence
  Synthetic
ggttcaaagcccauatcaagcattcuat

SEQ ID NO: 7067 - DNA, 25 bp, Artificial Sequence
  Synthetic
aggtguggaaatctgtatugcaaca

SEQ ID NO: 7068 - DNA, 28 bp, Artificial Sequence
  Synthetic
accaccacaaaugattacatcttuagct

SEQ ID NO: 7069 - DNA, 21 bp, Artificial Sequence
  Synthetic
ttcctgccautgtccacauca

SEQ ID NO: 7070 - DNA, 22 bp, Artificial Sequence
  Synthetic
cgatcgagtuacagcctgauga

SEQ ID NO: 7071 - DNA, 27 bp, Artificial Sequence
  Synthetic
ccttatcuggaaagaagttuggaaacc

SEQ ID NO: 7072 - DNA, 17 bp, Artificial Sequence
  Synthetic
gcccacuggccgatuct

SEQ ID NO: 7073 - DNA, 21 bp, Artificial Sequence
  Synthetic
aaagtggagcggaucgatuga

SEQ ID NO: 7074 - DNA, 24 bp, Artificial Sequence
  Synthetic
gguatggaatttctuccccacaga

SEQ ID NO: 7075 - DNA, 23 bp, Artificial Sequence
  Synthetic
gcacgtgugtgtttgcttuagat

SEQ ID NO: 7076 - DNA, 17 bp, Artificial Sequence
  Synthetic
tgagccagcgugtuggg

SEQ ID NO: 7077 - DNA, 19 bp, Artificial Sequence
  Synthetic
aaggccuacccctuggagt

SEQ ID NO: 7078 - DNA, 19 bp, Artificial Sequence
  Synthetic
ctccgtgccuttcccatug

SEQ ID NO: 7079 - DNA, 26 bp, Artificial Sequence
  Synthetic
acttgctgaautgtctgattcuagga

SEQ ID NO: 7080 - DNA, 22 bp, Artificial Sequence
  Synthetic
tctgcttggucacaaagcctut

SEQ ID NO: 7081 - DNA, 18 bp, Artificial Sequence
  Synthetic
caggcguaggccgctaua

SEQ ID NO: 7082 - DNA, 22 bp, Artificial Sequence
  Synthetic
tccaactccagcutcagcttut

SEQ ID NO: 7083 - DNA, 19 bp, Artificial Sequence
  Synthetic
ccaccuagcctgcugaacg

SEQ ID NO: 7084 - DNA, 19 bp, Artificial Sequence
  Synthetic
cgcccccgucaaagtctua

SEQ ID NO: 7085 - DNA, 25 bp, Artificial Sequence
  Synthetic
accttgaaugaagaagaggagugga

SEQ ID NO: 7086 - DNA, 24 bp, Artificial Sequence
  Synthetic
tcgctttggcuactcgtaaagtut

SEQ ID NO: 7087 - DNA, 21 bp, Artificial Sequence
  Synthetic
aagacggugcttacctgtucc

SEQ ID NO: 7088 - DNA, 22 bp, Artificial Sequence
  Synthetic
gtcaccaacauagcgctacuca

SEQ ID NO: 7089 - DNA, 22 bp, Artificial Sequence
  Synthetic
ccccctuccttttcttuccaga

SEQ ID NO: 7090 - DNA, 18 bp, Artificial Sequence
  Synthetic
gcgatgucgccgaaguca

SEQ ID NO: 7091 - DNA, 22 bp, Artificial Sequence
  Synthetic
aggctaccucatccatgaguct

SEQ ID NO: 7092 - DNA, 22 bp, Artificial Sequence
  Synthetic
cccacaccuccataaaaccuca

SEQ ID NO: 7093 - DNA, 25 bp, Artificial Sequence
  Synthetic
gagctatccgaccugattgtttuca

SEQ ID NO: 7094 - DNA, 20 bp, Artificial Sequence
  Synthetic
cagttgugtgcattgugggt

SEQ ID NO: 7095 - DNA, 18 bp, Artificial Sequence
  Synthetic
ctggcguccaugaccaag

SEQ ID NO: 7096 - DNA, 25 bp, Artificial Sequence
  Synthetic
gctgttgccgauaaagttgttugac

SEQ ID NO: 7097 - DNA, 17 bp, Artificial Sequence
  Synthetic
gctcggcgucacctuca

SEQ ID NO: 7098 - DNA, 23 bp, Artificial Sequence
  Synthetic
ctgagcagaguctucagagacag

SEQ ID NO: 7099 - DNA, 24 bp, Artificial Sequence
  Synthetic
tggcattctcugctctctctcuaa

SEQ ID NO: 7100 - DNA, 20 bp, Artificial Sequence
  Synthetic
gacgctcuccacacacauga

SEQ ID NO: 7101 - DNA, 19 bp, Artificial Sequence
  Synthetic
cgactucgccgagatgucc

SEQ ID NO: 7102 - DNA, 25 bp, Artificial Sequence
  Synthetic
ctctgcgacagcutataatggaugt

SEQ ID NO: 7103 - DNA, 29 bp, Artificial Sequence
  Synthetic
tggattataacucctcttctttctcuggg

SEQ ID NO: 7104 - DNA, 18 bp, Artificial Sequence
  Synthetic
aggctccaguccccctut

SEQ ID NO: 7105 - DNA, 17 bp, Artificial Sequence
  Synthetic
agccccaguccatgcug

SEQ ID NO: 7106 - DNA, 21 bp, Artificial Sequence
  Synthetic
ccttctcacgcucctcttuct

SEQ ID NO: 7107 - DNA, 20 bp, Artificial Sequence
  Synthetic
ccaccccaaccuctctgtuc

SEQ ID NO: 7108 - DNA, 17 bp, Artificial Sequence
  Synthetic
ctcuccgggtgctuggg

SEQ ID NO: 7109 - DNA, 17 bp, Artificial Sequence
  Synthetic
cgctgugcctgugccat

SEQ ID NO: 7110 - DNA, 21 bp, Artificial Sequence
  Synthetic
ccactuaccggttgaguaggg

SEQ ID NO: 7111 - DNA, 22 bp, Artificial Sequence
  Synthetic
agtttuccacccacauccaaca

SEQ ID NO: 7112 - DNA, 20 bp, Artificial Sequence
  Synthetic
gtttgggucaaggctgguga

SEQ ID NO: 7113 - DNA, 20 bp, Artificial Sequence
  Synthetic
cgcctcggugttgtgttcut

SEQ ID NO: 7114 - DNA, 20 bp, Artificial Sequence
  Synthetic
cagggcuctgaggaatucca

SEQ ID NO: 7115 - DNA, 23 bp, Artificial Sequence
  Synthetic
ctggtttcuctctccctcuacgt

SEQ ID NO: 7116 - DNA, 22 bp, Artificial Sequence
  Synthetic
gcttgttgaugtccaagcugag

SEQ ID NO: 7117 - DNA, 22 bp, Artificial Sequence
  Synthetic
ccgttctugatggtgtcugcat

SEQ ID NO: 7118 - DNA, 22 bp, Artificial Sequence
  Synthetic
tcatggucaggagggttguact

SEQ ID NO: 7119 - DNA, 22 bp, Artificial Sequence
  Synthetic
gccacttcuccatggtcacaug

SEQ ID NO: 7120 - DNA, 19 bp, Artificial Sequence
  Synthetic
ccagctuggtggtctuggg

SEQ ID NO: 7121 - DNA, 17 bp, Artificial Sequence
  Synthetic
ccggcugccacttcuga

SEQ ID NO: 7122 - DNA, 20 bp, Artificial Sequence
  Synthetic
cugcacaggaggaggatucg

SEQ ID NO: 7123 - DNA, 23 bp, Artificial Sequence
  Synthetic
tgtggatgucagcatggtctcua

SEQ ID NO: 7124 - DNA, 29 bp, Artificial Sequence
  Synthetic
gatacattccugagcattccagtaauagt

SEQ ID NO: 7125 - DNA, 23 bp, Artificial Sequence
  Synthetic
gcctaggugacactggactttug

SEQ ID NO: 7126 - DNA, 17 bp, Artificial Sequence
  Synthetic
gcggugctggcucagat

SEQ ID NO: 7127 - DNA, 17 bp, Artificial Sequence
  Synthetic
ctgcaggcutggcccua

SEQ ID NO: 7128 - DNA, 18 bp, Artificial Sequence
  Synthetic
gcgucgagctgggugaac

SEQ ID NO: 7129 - DNA, 19 bp, Artificial Sequence
  Synthetic
tggccccuctctcctgtut

SEQ ID NO: 7130 - DNA, 25 bp, Artificial Sequence
  Synthetic
gtctttgtgctucttggacttctuc

SEQ ID NO: 7131 - DNA, 18 bp, Artificial Sequence
  Synthetic
gcaaugaccugggccaca

SEQ ID NO: 7132 - DNA, 18 bp, Artificial Sequence
  Synthetic
ctgcaggugctugggaca

SEQ ID NO: 7133 - DNA, 17 bp, Artificial Sequence
  Synthetic
cctgccuctcctucgca

SEQ ID NO: 7134 - DNA, 20 bp, Artificial Sequence
  Synthetic
tggcaccacucttcctgaug

SEQ ID NO: 7135 - DNA, 21 bp, Artificial Sequence
  Synthetic
cgccctcuctgttcccuaaag

SEQ ID NO: 7136 - DNA, 19 bp, Artificial Sequence
  Synthetic
ggccgatgutggagaggua

SEQ ID NO: 7137 - DNA, 22 bp, Artificial Sequence
  Synthetic
ggactcaugcaggaagaugcag

SEQ ID NO: 7138 - DNA, 20 bp, Artificial Sequence
  Synthetic
ggaggcaccggaauctccua

SEQ ID NO: 7139 - DNA, 20 bp, Artificial Sequence
  Synthetic
ccagagagcuccttggucaa

SEQ ID NO: 7140 - DNA, 21 bp, Artificial Sequence
  Synthetic
cattgtcacuggtcagcucca

SEQ ID NO: 7141 - DNA, 23 bp, Artificial Sequence
  Synthetic
guggacaagaauagcaacgagua

SEQ ID NO: 7142 - DNA, 17 bp, Artificial Sequence
  Synthetic
cgtcucgtgcucgcaga

SEQ ID NO: 7143 - DNA, 18 bp, Artificial Sequence
  Synthetic
ccgaugagcagccaccug

SEQ ID NO: 7144 - DNA, 22 bp, Artificial Sequence
  Synthetic
gccctcctugagaagtgagtua

SEQ ID NO: 7145 - DNA, 25 bp, Artificial Sequence
  Synthetic
cgacacaagguacttcgatgaugaa

SEQ ID NO: 7146 - DNA, 22 bp, Artificial Sequence
  Synthetic
ccatgaggaugagcucgaagag

SEQ ID NO: 7147 - DNA, 23 bp, Artificial Sequence
  Synthetic
cctcatttcucctccatccucag

SEQ ID NO: 7148 - DNA, 25 bp, Artificial Sequence
  Synthetic
ccgagacaauctctgcaccauaaaa

SEQ ID NO: 7149 - DNA, 18 bp, Artificial Sequence
  Synthetic
accacaucactgcgcugg

SEQ ID NO: 7150 - DNA, 19 bp, Artificial Sequence
  Synthetic
ccgcaccaggaugacttug

SEQ ID NO: 7151 - DNA, 25 bp, Artificial Sequence
  Synthetic
ggcaacagugtcttttggtttucct

SEQ ID NO: 7152 - DNA, 22 bp, Artificial Sequence
  Synthetic
ggaaggtccuctcgatgacugt

SEQ ID NO: 7153 - DNA, 19 bp, Artificial Sequence
  Synthetic
gcaggcuagcagggctauc

SEQ ID NO: 7154 - DNA, 27 bp, Artificial Sequence
  Synthetic
cttctttgaugacagacacctcatuca

SEQ ID NO: 7155 - DNA, 21 bp, Artificial Sequence
  Synthetic
cctgaccagcucctctctugt

SEQ ID NO: 7156 - DNA, 21 bp, Artificial Sequence
  Synthetic
agcatcautgatggugagcct

SEQ ID NO: 7157 - DNA, 23 bp, Artificial Sequence
  Synthetic
tctggatgaucagcgtaccatug

SEQ ID NO: 7158 - DNA, 22 bp, Artificial Sequence
  Synthetic
agccatacuacctcctugcaga

SEQ ID NO: 7159 - DNA, 19 bp, Artificial Sequence
  Synthetic
ggctgacucagagguccga

SEQ ID NO: 7160 - DNA, 17 bp, Artificial Sequence
  Synthetic
cugcgccggaccatgua

SEQ ID NO: 7161 - DNA, 20 bp, Artificial Sequence
  Synthetic
ccgttacuccgcactuagca

SEQ ID NO: 7162 - DNA, 19 bp, Artificial Sequence
  Synthetic
ggcagcugttgctcaugaa

SEQ ID NO: 7163 - DNA, 17 bp, Artificial Sequence
  Synthetic
cctcctccuccgtggug

SEQ ID NO: 7164 - DNA, 21 bp, Artificial Sequence
  Synthetic
ccgctcugggctgtgttuaat

SEQ ID NO: 7165 - DNA, 19 bp, Artificial Sequence
  Synthetic
ccagggcauaccaccacuc

SEQ ID NO: 7166 - DNA, 21 bp, Artificial Sequence
  Synthetic
ctggugacaggcttacugact

SEQ ID NO: 7167 - DNA, 21 bp, Artificial Sequence
  Synthetic
caactgtgtguagccgttcug

SEQ ID NO: 7168 - DNA, 22 bp, Artificial Sequence
  Synthetic
cccaaagccutctacccaguat

SEQ ID NO: 7169 - DNA, 19 bp, Artificial Sequence
  Synthetic
gcgctccucatcactcguc

SEQ ID NO: 7170 - DNA, 19 bp, Artificial Sequence
  Synthetic
cccccggaucctcctguag

SEQ ID NO: 7171 - DNA, 19 bp, Artificial Sequence
  Synthetic
cagactccugggcctugaa

SEQ ID NO: 7172 - DNA, 17 bp, Artificial Sequence
  Synthetic
ctccccugtcccgucct

SEQ ID NO: 7173 - DNA, 22 bp, Artificial Sequence
  Synthetic
acctgcugtgtcattuggagac

SEQ ID NO: 7174 - DNA, 20 bp, Artificial Sequence
  Synthetic
cccctgcugtccagttcaut

SEQ ID NO: 7175 - DNA, 24 bp, Artificial Sequence
  Synthetic
gatgtactguacctgggtgatucc

SEQ ID NO: 7176 - DNA, 20 bp, Artificial Sequence
  Synthetic
ggccauagtcctgttuggct

SEQ ID NO: 7177 - DNA, 19 bp, Artificial Sequence
  Synthetic
cccgcacugacatgcuagg

SEQ ID NO: 7178 - DNA, 23 bp, Artificial Sequence
  Synthetic
gcagaatcaccuatgtgcaguca

SEQ ID NO: 7179 - DNA, 18 bp, Artificial Sequence
  Synthetic
ccagcgaggugaagccua

SEQ ID NO: 7180 - DNA, 20 bp, Artificial Sequence
  Synthetic
ccaagccuggtctacacugt

SEQ ID NO: 7181 - DNA, 21 bp, Artificial Sequence
  Synthetic
caactcactcugctctgggut

SEQ ID NO: 7182 - DNA, 19 bp, Artificial Sequence
  Synthetic
ccugccagagaccuggact

SEQ ID NO: 7183 - DNA, 17 bp, Artificial Sequence
  Synthetic
gccaaguggcaguggga

SEQ ID NO: 7184 - DNA, 20 bp, Artificial Sequence
  Synthetic
cttgguggagcgtgtuaggg

SEQ ID NO: 7185 - DNA, 20 bp, Artificial Sequence
  Synthetic
ctccucaggccgaaacucag

SEQ ID NO: 7186 - DNA, 18 bp, Artificial Sequence
  Synthetic
ttgggugggcacucagac

SEQ ID NO: 7187 - DNA, 23 bp, Artificial Sequence
  Synthetic
gaggagtauggcaccttgtcaua

SEQ ID NO: 7188 - DNA, 17 bp, Artificial Sequence
  Synthetic
ccuccacagcugccaca

SEQ ID NO: 7189 - DNA, 18 bp, Artificial Sequence
  Synthetic
atuccgccccaaacugga

SEQ ID NO: 7190 - DNA, 22 bp, Artificial Sequence
  Synthetic
atgcctgtgautccttcacucc

SEQ ID NO: 7191 - DNA, 19 bp, Artificial Sequence
  Synthetic
acctgccguaggttgtugt

SEQ ID NO: 7192 - DNA, 19 bp, Artificial Sequence
  Synthetic
caacgugaacgcgcaaaug

SEQ ID NO: 7193 - DNA, 20 bp, Artificial Sequence
  Synthetic
cgtgtcgtugtggcagtuct

SEQ ID NO: 7194 - DNA, 22 bp, Artificial Sequence
  Synthetic
ccatggctccucccaatttcut

SEQ ID NO: 7195 - DNA, 23 bp, Artificial Sequence
  Synthetic
cctcctcaugagtccaagatcug

SEQ ID NO: 7196 - DNA, 17 bp, Artificial Sequence
  Synthetic
gccgggcagucaggaug

SEQ ID NO: 7197 - DNA, 18 bp, Artificial Sequence
  Synthetic
cgagaaugggccaccuct

SEQ ID NO: 7198 - DNA, 21 bp, Artificial Sequence
  Synthetic
cccaaggauagccagagucct

SEQ ID NO: 7199 - DNA, 25 bp, Artificial Sequence
  Synthetic
ggtacatgtguccacagtacttucc

SEQ ID NO: 7200 - DNA, 22 bp, Artificial Sequence
  Synthetic
ctcgagcccuagggactactua

SEQ ID NO: 7201 - DNA, 23 bp, Artificial Sequence
  Synthetic
cataggugaggaaggccatguag

SEQ ID NO: 7202 - DNA, 17 bp, Artificial Sequence
  Synthetic
cccccaguccccctcuc

SEQ ID NO: 7203 - DNA, 17 bp, Artificial Sequence
  Synthetic
guggcagggucagggaa

SEQ ID NO: 7204 - DNA, 17 bp, Artificial Sequence
  Synthetic
gaccucccccagcacuc

SEQ ID NO: 7205 - DNA, 17 bp, Artificial Sequence
  Synthetic
tgccccagcuccaacuc

SEQ ID NO: 7206 - DNA, 22 bp, Artificial Sequence
  Synthetic
tgccttcucctgcgatuaaagg

SEQ ID NO: 7207 - DNA, 21 bp, Artificial Sequence
  Synthetic
cagattgcucagcagctcuga

SEQ ID NO: 7208 - DNA, 20 bp, Artificial Sequence
  Synthetic
gttctuggagcctgggaugg

SEQ ID NO: 7209 - DNA, 24 bp, Artificial Sequence
  Synthetic
accagttccagautcgtgagaaug

SEQ ID NO: 7210 - DNA, 20 bp, Artificial Sequence
  Synthetic
ccgagacgcaagutagguca

SEQ ID NO: 7211 - DNA, 25 bp, Artificial Sequence
  Synthetic
ccutgagaacauccagaggaacaag

SEQ ID NO: 7212 - DNA, 22 bp, Artificial Sequence
  Synthetic
ctgatacaccucccctctugga

SEQ ID NO: 7213 - DNA, 23 bp, Artificial Sequence
  Synthetic
cttatcgtgaccuctgttgcuct

SEQ ID NO: 7214 - DNA, 24 bp, Artificial Sequence
  Synthetic
cagggacagaaaaaggugagctua

SEQ ID NO: 7215 - DNA, 17 bp, Artificial Sequence
  Synthetic
cgaccccguctctccuc

SEQ ID NO: 7216 - DNA, 17 bp, Artificial Sequence
  Synthetic
ccaccugagcaccguct

SEQ ID NO: 7217 - DNA, 18 bp, Artificial Sequence
  Synthetic
gccagccccuctgaguga

SEQ ID NO: 7218 - DNA, 23 bp, Artificial Sequence
  Synthetic
gcaucaaattccugggacaagag

SEQ ID NO: 7219 - DNA, 20 bp, Artificial Sequence
  Synthetic
agccucacagcctcctaugt

SEQ ID NO: 7220 - DNA, 21 bp, Artificial Sequence
  Synthetic
ggaccaauagggccuagggaa

SEQ ID NO: 7221 - DNA, 22 bp, Artificial Sequence
  Synthetic
gggactgaguccgcttgttauc

SEQ ID NO: 7222 - DNA, 17 bp, Artificial Sequence
  Synthetic
agcccguccacgtugag

SEQ ID NO: 7223 - DNA, 20 bp, Artificial Sequence
  Synthetic
ctcctgaggaccugagggut

SEQ ID NO: 7224 - DNA, 23 bp, Artificial Sequence
  Synthetic
ctgagttguaccttgctgucaca

SEQ ID NO: 7225 - DNA, 25 bp, Artificial Sequence
  Synthetic
cacccatccautaaagggtcctuac

SEQ ID NO: 7226 - DNA, 20 bp, Artificial Sequence
  Synthetic
gctgtgccutcagggttcuc

SEQ ID NO: 7227 - DNA, 18 bp, Artificial Sequence
  Synthetic
tcacctguggctggctuc

SEQ ID NO: 7228 - DNA, 24 bp, Artificial Sequence
  Synthetic
gggtgggcutctgttctctttuaa

SEQ ID NO: 7229 - DNA, 21 bp, Artificial Sequence
  Synthetic
tctgagccgcauggguaaaaa

SEQ ID NO: 7230 - DNA, 24 bp, Artificial Sequence
  Synthetic
aggaggaggcugaaatcaaaagug

SEQ ID NO: 7231 - DNA, 21 bp, Artificial Sequence
  Synthetic
attccttcuggctctggtucg

SEQ ID NO: 7232 - DNA, 22 bp, Artificial Sequence
  Synthetic
tggaucaggaacccaaggauca

SEQ ID NO: 7233 - DNA, 22 bp, Artificial Sequence
  Synthetic
ggcttttcggugtgaacactut

SEQ ID NO: 7234 - DNA, 21 bp, Artificial Sequence
  Synthetic
agacatuaaagcccgtgcuct

SEQ ID NO: 7235 - DNA, 19 bp, Artificial Sequence
  Synthetic
accaccaucaccactgcug

SEQ ID NO: 7236 - DNA, 22 bp, Artificial Sequence
  Synthetic
actgtccucccaaacctcagua

SEQ ID NO: 7237 - DNA, 20 bp, Artificial Sequence
  Synthetic
ccautgtcugcaggaacggt

SEQ ID NO: 7238 - DNA, 23 bp, Artificial Sequence
  Synthetic
gugaaacaguccaaaccagaauc

SEQ ID NO: 7239 - DNA, 23 bp, Artificial Sequence
  Synthetic
acaguccagagtgaaguaaggct

SEQ ID NO: 7240 - DNA, 23 bp, Artificial Sequence
  Synthetic
ctgtccaaggugaatggugacat

SEQ ID NO: 7241 - DNA, 21 bp, Artificial Sequence
  Synthetic
ctcagtacuggccagcaguag

SEQ ID NO: 7242 - DNA, 22 bp, Artificial Sequence
  Synthetic
tgccagauagctgugaaacagg

SEQ ID NO: 7243 - DNA, 28 bp, Artificial Sequence
  Synthetic
ggaatccatttcutccagtttccuagag

SEQ ID NO: 7244 - DNA, 22 bp, Artificial Sequence
  Synthetic
gatcccuccagttttucccagt

SEQ ID NO: 7245 - DNA, 26 bp, Artificial Sequence
  Synthetic
acaaaagtcutctcattctugacgct

SEQ ID NO: 7246 - DNA, 20 bp, Artificial Sequence
  Synthetic
aaaggcctugctggaagugt

SEQ ID NO: 7247 - DNA, 19 bp, Artificial Sequence
  Synthetic
tcatggcuttcaggcugca

SEQ ID NO: 7248 - DNA, 24 bp, Artificial Sequence
  Synthetic
tggtgaatuccagtatgggttugg

SEQ ID NO: 7249 - DNA, 23 bp, Artificial Sequence
  Synthetic
ctgtacaaguaccccucagacct

SEQ ID NO: 7250 - DNA, 26 bp, Artificial Sequence
  Synthetic
gttcagtugaaggaatttcucaccaa

SEQ ID NO: 7251 - DNA, 24 bp, Artificial Sequence
  Synthetic
agattctuggaccaacaaguagcc

SEQ ID NO: 7252 - DNA, 21 bp, Artificial Sequence
  Synthetic
acggatcucagcaggacauct

SEQ ID NO: 7253 - DNA, 28 bp, Artificial Sequence
  Synthetic
ttcacatgtttguctttccttttgtcug

SEQ ID NO: 7254 - DNA, 19 bp, Artificial Sequence
  Synthetic
ctcccugaggctcagccua

SEQ ID NO: 7255 - DNA, 22 bp, Artificial Sequence
  Synthetic
agacaccgtugggatgaacuac

SEQ ID NO: 7256 - DNA, 27 bp, Artificial Sequence
  Synthetic
auctgccttgauaaaggaaaccaaaga

SEQ ID NO: 7257 - DNA, 28 bp, Artificial Sequence
  Synthetic
ctactttctggucagagagaagcaauaa

SEQ ID NO: 7258 - DNA, 19 bp, Artificial Sequence
  Synthetic
agagtcacugccagggtug

SEQ ID NO: 7259 - DNA, 18 bp, Artificial Sequence
  Synthetic
cttcgcccagacauggug

SEQ ID NO: 7260 - DNA, 20 bp, Artificial Sequence
  Synthetic
gcccaccagutattgcccut

SEQ ID NO: 7261 - DNA, 20 bp, Artificial Sequence
  Synthetic
cagtgucccatcccucacag

SEQ ID NO: 7262 - DNA, 24 bp, Artificial Sequence
  Synthetic
aaaagaaactgacugtccaggugt

SEQ ID NO: 7263 - DNA, 20 bp, Artificial Sequence
  Synthetic
gggacugaccctcagcttug

SEQ ID NO: 7264 - DNA, 25 bp, Artificial Sequence
  Synthetic
ggcttgaattuggagtagaggaugg

SEQ ID NO: 7265 - DNA, 21 bp, Artificial Sequence
  Synthetic
caggaggcaugcaatcacuct

SEQ ID NO: 7266 - DNA, 23 bp, Artificial Sequence
  Synthetic
ggcgggcaaagutagaaacatug

SEQ ID NO: 7267 - DNA, 28 bp, Artificial Sequence
  Synthetic
ccatctaggaacutaaaagcaactcugg

SEQ ID NO: 7268 - DNA, 23 bp, Artificial Sequence
  Synthetic
acttcttgctucagccaggttut

SEQ ID NO: 7269 - DNA, 22 bp, Artificial Sequence
  Synthetic
cccagcuccagaaagattuggt

SEQ ID NO: 7270 - DNA, 24 bp, Artificial Sequence
  Synthetic
cagatgtttugaatctgcctgugt

SEQ ID NO: 7271 - DNA, 24 bp, Artificial Sequence
  Synthetic
cctgaagagatutcggtcactguc

SEQ ID NO: 7272 - DNA, 20 bp, Artificial Sequence
  Synthetic
gcagcucagcacatctgcua

SEQ ID NO: 7273 - DNA, 22 bp, Artificial Sequence
  Synthetic
agtgcttccugagagagaaugc

SEQ ID NO: 7274 - DNA, 25 bp, Artificial Sequence
  Synthetic
ctgtcctcucactgccatgatuaag

SEQ ID NO: 7275 - DNA, 21 bp, Artificial Sequence
  Synthetic
cacgtcguaggaggcttcuaa

SEQ ID NO: 7276 - DNA, 22 bp, Artificial Sequence
  Synthetic
ctgtctuacaggcagccugaat

SEQ ID NO: 7277 - DNA, 25 bp, Artificial Sequence
  Synthetic
ggcaggtgtuacaaggacaaaaaug

SEQ ID NO: 7278 - DNA, 23 bp, Artificial Sequence
  Synthetic
gccctcttgaugtcatagagguc

SEQ ID NO: 7279 - DNA, 22 bp, Artificial Sequence
  Synthetic
ttctcaccgaacuccctgttuc

SEQ ID NO: 7280 - DNA, 26 bp, Artificial Sequence
  Synthetic
ctttaaaaucagcaaccacucaacca

SEQ ID NO: 7281 - DNA, 25 bp, Artificial Sequence
  Synthetic
gtgauccagtgtttugcagaaacag

SEQ ID NO: 7282 - DNA, 18 bp, Artificial Sequence
  Synthetic
gcgagggutctccgggua

SEQ ID NO: 7283 - DNA, 17 bp, Artificial Sequence
  Synthetic
ccauggccctugcggat

SEQ ID NO: 7284 - DNA, 17 bp, Artificial Sequence
  Synthetic
gcgucgacggcgacuac

SEQ ID NO: 7285 - DNA, 18 bp, Artificial Sequence
  Synthetic
tcaugcccccgacguaga

SEQ ID NO: 7286 - DNA, 19 bp, Artificial Sequence
  Synthetic
accaccuaccgcatgtucc

SEQ ID NO: 7287 - DNA, 17 bp, Artificial Sequence
  Synthetic
gatgguggccucggaca

SEQ ID NO: 7288 - DNA, 23 bp, Artificial Sequence
  Synthetic
ccttccaggcugacttctgtcua

SEQ ID NO: 7289 - DNA, 22 bp, Artificial Sequence
  Synthetic
tcagctcccuaaatcctccuca

SEQ ID NO: 7290 - DNA, 23 bp, Artificial Sequence
  Synthetic
gtctgcatcaucaaagctgctuc

SEQ ID NO: 7291 - DNA, 21 bp, Artificial Sequence
  Synthetic
acctcagcaugcagaacucac

SEQ ID NO: 7292 - DNA, 22 bp, Artificial Sequence
  Synthetic
gacaucagccauagaaggcagt

SEQ ID NO: 7293 - DNA, 23 bp, Artificial Sequence
  Synthetic
ccagttcauccaccatcuggaag

SEQ ID NO: 7294 - DNA, 22 bp, Artificial Sequence
  Synthetic
cggagataacugggtgtgtuct

SEQ ID NO: 7295 - DNA, 21 bp, Artificial Sequence
  Synthetic
gcctggcccuaatggttugaa

SEQ ID NO: 7296 - DNA, 22 bp, Artificial Sequence
  Synthetic
tcagccataacautgacccgut

SEQ ID NO: 7297 - DNA, 28 bp, Artificial Sequence
  Synthetic
ggatcttcgtcutgttgtaacactttuc

SEQ ID NO: 7298 - DNA, 20 bp, Artificial Sequence
  Synthetic
tggaggaggugggcatcuac

SEQ ID NO: 7299 - DNA, 21 bp, Artificial Sequence
  Synthetic
gatctcaucgcggacaccaut

SEQ ID NO: 7300 - DNA, 17 bp, Artificial Sequence
  Synthetic
cccgcugctttggucct

SEQ ID NO: 7301 - DNA, 22 bp, Artificial Sequence
  Synthetic
ccagctgucagtcatggtgaua

SEQ ID NO: 7302 - DNA, 26 bp, Artificial Sequence
  Synthetic
tgtacaucagtgactgugaaaaagca

SEQ ID NO: 7303 - DNA, 18 bp, Artificial Sequence
  Synthetic
agctgtgugtgctgcugt

SEQ ID NO: 7304 - DNA, 22 bp, Artificial Sequence
  Synthetic
tgagacttcugcccagactuca

SEQ ID NO: 7305 - DNA, 21 bp, Artificial Sequence
  Synthetic
ctgaaugccactgagaaugcc

SEQ ID NO: 7306 - DNA, 25 bp, Artificial Sequence
  Synthetic
tcaacuaaaagaaaggcagctguca

SEQ ID NO: 7307 - DNA, 22 bp, Artificial Sequence
  Synthetic
ttgcctugcctttgtgttucag

SEQ ID NO: 7308 - DNA, 28 bp, Artificial Sequence
  Synthetic
accaccaaucacaaatgtatagugaaaa

SEQ ID NO: 7309 - DNA, 31 bp, Artificial Sequence
  Synthetic
tgactgtagatgaucagtcagtttatccuaa

SEQ ID NO: 7310 - DNA, 27 bp, Artificial Sequence
  Synthetic
tgtttcagacttugaatagcagagaut

SEQ ID NO: 7311 - DNA, 25 bp, Artificial Sequence
  Synthetic
tgaugaaccactgcugaaaagaaca

SEQ ID NO: 7312 - DNA, 22 bp, Artificial Sequence
  Synthetic
tggtagaggagcuggataugcc

SEQ ID NO: 7313 - DNA, 23 bp, Artificial Sequence
  Synthetic
actcaccuttgttgtuggacact

SEQ ID NO: 7314 - DNA, 24 bp, Artificial Sequence
  Synthetic
cataugggcaacaaagctauggaa

SEQ ID NO: 7315 - DNA, 23 bp, Artificial Sequence
  Synthetic
cuagccagaaugacccaaaaauc

SEQ ID NO: 7316 - DNA, 22 bp, Artificial Sequence
  Synthetic
ttgctcguagctttgtagcaut

SEQ ID NO: 7317 - DNA, 23 bp, Artificial Sequence
  Synthetic
tgtaacccccugtgctagatuga

SEQ ID NO: 7318 - DNA, 28 bp, Artificial Sequence
  Synthetic
ttctcttctctcuctttcagctatucct

SEQ ID NO: 7319 - DNA, 20 bp, Artificial Sequence
  Synthetic
tggguaactagugggaggct

SEQ ID NO: 7320 - DNA, 25 bp, Artificial Sequence
  Synthetic
cattggctgtuaaacgtggaaacut

SEQ ID NO: 7321 - DNA, 22 bp, Artificial Sequence
  Synthetic
caccgtgtcuagtcccacttut

SEQ ID NO: 7322 - DNA, 30 bp, Artificial Sequence
  Synthetic
aatggtggtataguagatagctatgtgugt

SEQ ID NO: 7323 - DNA, 27 bp, Artificial Sequence
  Synthetic
agcacgataugaagcacaactagaaut

SEQ ID NO: 7324 - DNA, 23 bp, Artificial Sequence
  Synthetic
caacccaugatccacatcuacct

SEQ ID NO: 7325 - DNA, 25 bp, Artificial Sequence
  Synthetic
tccctcaugccatattctauagcca

SEQ ID NO: 7326 - DNA, 22 bp, Artificial Sequence
  Synthetic
gatagaggaggcutcccuccaa

SEQ ID NO: 7327 - DNA, 21 bp, Artificial Sequence
  Synthetic
gtggcttcacucgtaggguat

SEQ ID NO: 7328 - DNA, 22 bp, Artificial Sequence
  Synthetic
ttcctcaccccutcccattcua

SEQ ID NO: 7329 - DNA, 28 bp, Artificial Sequence
  Synthetic
aaataaatctgguagtcaatgcagcuct

SEQ ID NO: 7330 - DNA, 28 bp, Artificial Sequence
  Synthetic
tggttttgtcauactttgacctttguct

SEQ ID NO: 7331 - DNA, 26 bp, Artificial Sequence
  Synthetic
gccaagacttguctgaagctgatuaa

SEQ ID NO: 7332 - DNA, 21 bp, Artificial Sequence
  Synthetic
tgccaugggaaugaacacagg

SEQ ID NO: 7333 - DNA, 20 bp, Artificial Sequence
  Synthetic
acttcccaugcctgggttug

SEQ ID NO: 7334 - DNA, 21 bp, Artificial Sequence
  Synthetic
aaaaaggcagutcctggugga

SEQ ID NO: 7335 - DNA, 28 bp, Artificial Sequence
  Synthetic
caaaucccagcatatauaacagaagggt

SEQ ID NO: 7336 - DNA, 26 bp, Artificial Sequence
  Synthetic
tgttttcutctctttaguggcacact

SEQ ID NO: 7337 - DNA, 28 bp, Artificial Sequence
  Synthetic
caaaagatttcaucacttacgctgtuga

SEQ ID NO: 7338 - DNA, 25 bp, Artificial Sequence
  Synthetic
caaguaaatcagaugccgacacaac

SEQ ID NO: 7339 - DNA, 27 bp, Artificial Sequence
  Synthetic
tgtcatttacugacacaaccaauacca

SEQ ID NO: 7340 - DNA, 28 bp, Artificial Sequence
  Synthetic
aatgctgacaugatattacagtgguagg

SEQ ID NO: 7341 - DNA, 25 bp, Artificial Sequence
  Synthetic
tttgcagattcauacatgtccccut

SEQ ID NO: 7342 - DNA, 25 bp, Artificial Sequence
  Synthetic
ttgtgtgtgcagugagtttttgtut

SEQ ID NO: 7343 - DNA, 25 bp, Artificial Sequence
  Synthetic
gttattcgaggcaucatctggttug

SEQ ID NO: 7344 - DNA, 29 bp, Artificial Sequence
  Synthetic
ctataatgaagcaguttggtgatttgugt

SEQ ID NO: 7345 - DNA, 25 bp, Artificial Sequence
  Synthetic
gacggagucaaagggauatttgtua

SEQ ID NO: 7346 - DNA, 22 bp, Artificial Sequence
  Synthetic
tcaccatacucccccaagcaua

SEQ ID NO: 7347 - DNA, 21 bp, Artificial Sequence
  Synthetic
ggaagttgugttgttgguggt

SEQ ID NO: 7348 - DNA, 22 bp, Artificial Sequence
  Synthetic
agtgaattcucaggccatugct

SEQ ID NO: 7349 - DNA, 25 bp, Artificial Sequence
  Synthetic
tgggttcctauactgaggtccuaac

SEQ ID NO: 7350 - DNA, 23 bp, Artificial Sequence
  Synthetic
aagaacuacgacaggcactgaug

SEQ ID NO: 7351 - DNA, 28 bp, Artificial Sequence
  Synthetic
caaaaguaccaccaaatactuacaggga

SEQ ID NO: 7352 - DNA, 23 bp, Artificial Sequence
  Synthetic
tctagcttguccttaaggccuct

SEQ ID NO: 7353 - DNA, 19 bp, Artificial Sequence
  Synthetic
cacaccuggccaagctuac

SEQ ID NO: 7354 - DNA, 28 bp, Artificial Sequence
  Synthetic
tcaacggtttauctaagttgtguaagca

SEQ ID NO: 7355 - DNA, 29 bp, Artificial Sequence
  Synthetic
ctaggcttcagauaagttttgccaaaaut

SEQ ID NO: 7356 - DNA, 23 bp, Artificial Sequence
  Synthetic
tccuttccauaccgaaccaaagc

SEQ ID NO: 7357 - DNA, 23 bp, Artificial Sequence
  Synthetic
agttggaacucccacacaaaucc

SEQ ID NO: 7358 - DNA, 20 bp, Artificial Sequence
  Synthetic
catguccaccaagugaggga

SEQ ID NO: 7359 - DNA, 20 bp, Artificial Sequence
  Synthetic
gcccctaugtcccaacugac

SEQ ID NO: 7360 - DNA, 27 bp, Artificial Sequence
  Synthetic
accttattttctugtctcctttgugct

SEQ ID NO: 7361 - DNA, 22 bp, Artificial Sequence
  Synthetic
gcatcccggguttcttcttgut

SEQ ID NO: 7362 - DNA, 20 bp, Artificial Sequence
  Synthetic
ggaccgcuttgtcuacacct

SEQ ID NO: 7363 - DNA, 19 bp, Artificial Sequence
  Synthetic
agcaucccacaggcctcua

SEQ ID NO: 7364 - DNA, 20 bp, Artificial Sequence
  Synthetic
ctcattgcccuctgctgcua

SEQ ID NO: 7365 - DNA, 21 bp, Artificial Sequence
  Synthetic
catcctccugcgaagcattug

SEQ ID NO: 7366 - DNA, 20 bp, Artificial Sequence
  Synthetic
ccaccugcagcaguggaaat

SEQ ID NO: 7367 - DNA, 22 bp, Artificial Sequence
  Synthetic
gtcatgggaggugggttcauac

SEQ ID NO: 7368 - DNA, 23 bp, Artificial Sequence
  Synthetic
gtgcutagtatcctucacgccaa

SEQ ID NO: 7369 - DNA, 19 bp, Artificial Sequence
  Synthetic
ctgctgaccuggcatggua

SEQ ID NO: 7370 - DNA, 21 bp, Artificial Sequence
  Synthetic
caggaauaggccctggaaugg

SEQ ID NO: 7371 - DNA, 27 bp, Artificial Sequence
  Synthetic
ctatctgtcccauatttccttgtugca

SEQ ID NO: 7372 - DNA, 18 bp, Artificial Sequence
  Synthetic
cccaaggaugcagccuca

SEQ ID NO: 7373 - DNA, 20 bp, Artificial Sequence
  Synthetic
ttgccatgccuggattgcua

SEQ ID NO: 7374 - DNA, 20 bp, Artificial Sequence
  Synthetic
ccctctccuttgacagguca

SEQ ID NO: 7375 - DNA, 21 bp, Artificial Sequence
  Synthetic
cccagttgcucttccagtuct

SEQ ID NO: 7376 - DNA, 17 bp, Artificial Sequence
  Synthetic
cuggccccacuggaaga

SEQ ID NO: 7377 - DNA, 22 bp, Artificial Sequence
  Synthetic
ctacctcgaguctgatgagcug

SEQ ID NO: 7378 - DNA, 27 bp, Artificial Sequence
  Synthetic
gcaagatcttcaucattgtggaacuca

SEQ ID NO: 7379 - DNA, 23 bp, Artificial Sequence
  Synthetic
gaacctcttutccagcatgucct

SEQ ID NO: 7380 - DNA, 20 bp, Artificial Sequence
  Synthetic
ggtaatuccccggugggaaa

SEQ ID NO: 7381 - DNA, 19 bp, Artificial Sequence
  Synthetic
gcccgagaggutcgttgua

SEQ ID NO: 7382 - DNA, 24 bp, Artificial Sequence
  Synthetic
cttcgaccauggaggtcauaaagg

SEQ ID NO: 7383 - DNA, 25 bp, Artificial Sequence
  Synthetic
tggatttgaggaugattcaggugag

SEQ ID NO: 7384 - DNA, 25 bp, Artificial Sequence
  Synthetic
gggcagttucccacagatattcuaa

SEQ ID NO: 7385 - DNA, 20 bp, Artificial Sequence
  Synthetic
cgaagttccugcctggugac

SEQ ID NO: 7386 - DNA, 27 bp, Artificial Sequence
  Synthetic
ggatctttacaggccautttctcagua

SEQ ID NO: 7387 - DNA, 20 bp, Artificial Sequence
  Synthetic
tcatgagcacgugagcucag

SEQ ID NO: 7388 - DNA, 22 bp, Artificial Sequence
  Synthetic
gggaaatuggcagggtaacuca

SEQ ID NO: 7389 - DNA, 21 bp, Artificial Sequence
  Synthetic
gcagcuccaagaaaggtcuca

SEQ ID NO: 7390 - DNA, 23 bp, Artificial Sequence
  Synthetic
ttttgggtcuccatgatgauggg

SEQ ID NO: 7391 - DNA, 24 bp, Artificial Sequence
  Synthetic
ctggatgctugctcactagtauct

SEQ ID NO: 7392 - DNA, 20 bp, Artificial Sequence
  Synthetic
gaaggcucggattgugggaa

SEQ ID NO: 7393 - DNA, 24 bp, Artificial Sequence
  Synthetic
ctcctatgtucagggtatggugac

SEQ ID NO: 7394 - DNA, 21 bp, Artificial Sequence
  Synthetic
tgtcttggaaacuggcgtuca

SEQ ID NO: 7395 - DNA, 19 bp, Artificial Sequence
  Synthetic
tgcagacgaucccacugac

SEQ ID NO: 7396 - DNA, 21 bp, Artificial Sequence
  Synthetic
ggcagauctggaugagaccct

SEQ ID NO: 7397 - DNA, 24 bp, Artificial Sequence
  Synthetic
ggtgtaccaguttaaggagaugcc

SEQ ID NO: 7398 - DNA, 24 bp, Artificial Sequence
  Synthetic
aggugtttctgtctugcagaagag

SEQ ID NO: 7399 - DNA, 19 bp, Artificial Sequence
  Synthetic
acagcugggactcagguga

SEQ ID NO: 7400 - DNA, 20 bp, Artificial Sequence
  Synthetic
gccttgagutcaggcacugg

SEQ ID NO: 7401 - DNA, 24 bp, Artificial Sequence
  Synthetic
acttttcutctctccucccaccat

SEQ ID NO: 7402 - DNA, 21 bp, Artificial Sequence
  Synthetic
tgggctguagggtaauagcca

SEQ ID NO: 7403 - DNA, 21 bp, Artificial Sequence
  Synthetic
agctctcuccaccccctatut

SEQ ID NO: 7404 - DNA, 22 bp, Artificial Sequence
  Synthetic
ccugaagaacucgaacgggaac

SEQ ID NO: 7405 - DNA, 17 bp, Artificial Sequence
  Synthetic
ggtugcccgaagccgua

SEQ ID NO: 7406 - DNA, 20 bp, Artificial Sequence
  Synthetic
cacccucaaccaactgcuca

SEQ ID NO: 7407 - DNA, 18 bp, Artificial Sequence
  Synthetic
aacacugcgaggccaugt

SEQ ID NO: 7408 - DNA, 21 bp, Artificial Sequence
  Synthetic
gggacuaacccatacucgcag

SEQ ID NO: 7409 - DNA, 26 bp, Artificial Sequence
  Synthetic
catctaccugctgtgtauaagagagg

SEQ ID NO: 7410 - DNA, 21 bp, Artificial Sequence
  Synthetic
ctctcagccuccatacuccca

SEQ ID NO: 7411 - DNA, 18 bp, Artificial Sequence
  Synthetic
gctgcugaggttgcugct

SEQ ID NO: 7412 - DNA, 33 bp, Artificial Sequence
  Synthetic
atctttctgcctaauattactaatccatgtuct

SEQ ID NO: 7413 - DNA, 23 bp, Artificial Sequence
  Synthetic
agctggattacuctgctctccut

SEQ ID NO: 7414 - DNA, 21 bp, Artificial Sequence
  Synthetic
gatggagagcauttgtucgca

SEQ ID NO: 7415 - DNA, 22 bp, Artificial Sequence
  Synthetic
gtgtguatctgtccuccggaag

SEQ ID NO: 7416 - DNA, 22 bp, Artificial Sequence
  Synthetic
cctaacauggccaataugccac

SEQ ID NO: 7417 - DNA, 22 bp, Artificial Sequence
  Synthetic
tttcttgcacugacaccctcuc

SEQ ID NO: 7418 - DNA, 24 bp, Artificial Sequence
  Synthetic
gggatguaaagttaacuccagcca

SEQ ID NO: 7419 - DNA, 29 bp, Artificial Sequence
  Synthetic
tcactgaaaaagauaggacacaaagtuga

SEQ ID NO: 7420 - DNA, 27 bp, Artificial Sequence
  Synthetic
cagctcctugaaaaagcagtataucca

SEQ ID NO: 7421 - DNA, 19 bp, Artificial Sequence
  Synthetic
ccgcugaccccatcctuac

SEQ ID NO: 7422 - DNA, 22 bp, Artificial Sequence
  Synthetic
acatuccagaagcggaatucca

SEQ ID NO: 7423 - DNA, 21 bp, Artificial Sequence
  Synthetic
cccugtcttuacgagcacaag

SEQ ID NO: 7424 - DNA, 21 bp, Artificial Sequence
  Synthetic
ccgaatcucatgcctuccaac

SEQ ID NO: 7425 - DNA, 19 bp, Artificial Sequence
  Synthetic
gtggcgaagccugauccat

SEQ ID NO: 7426 - DNA, 23 bp, Artificial Sequence
  Synthetic
ccttccccucagcaagatgtaua

SEQ ID NO: 7427 - DNA, 21 bp, Artificial Sequence
  Synthetic
atgttttgcugggcattggug

SEQ ID NO: 7428 - DNA, 21 bp, Artificial Sequence
  Synthetic
aaggcccccuccatctaacua

SEQ ID NO: 7429 - DNA, 22 bp, Artificial Sequence
  Synthetic
cagagtgcaggaauggagacut

SEQ ID NO: 7430 - DNA, 21 bp, Artificial Sequence
  Synthetic
gcagagagcacaugggcatua

SEQ ID NO: 7431 - DNA, 27 bp, Artificial Sequence
  Synthetic
acattcccautgtctacacuaagaaga

SEQ ID NO: 7432 - DNA, 29 bp, Artificial Sequence
  Synthetic
aagaggaaguagttgaaaatgaugaggag

SEQ ID NO: 7433 - DNA, 26 bp, Artificial Sequence
  Synthetic
tccaccacaaauggatcattcttcug

SEQ ID NO: 7434 - DNA, 21 bp, Artificial Sequence
  Synthetic
ctagcacctugaccgaggaug

SEQ ID NO: 7435 - DNA, 20 bp, Artificial Sequence
  Synthetic
cctgccaguccagaagggua

SEQ ID NO: 7436 - DNA, 21 bp, Artificial Sequence
  Synthetic
cutggagatgcuccgggaaaa

SEQ ID NO: 7437 - DNA, 19 bp, Artificial Sequence
  Synthetic
tcagcugaagggcaaacug

SEQ ID NO: 7438 - DNA, 18 bp, Artificial Sequence
  Synthetic
cagctcgugccatugcag

SEQ ID NO: 7439 - DNA, 18 bp, Artificial Sequence
  Synthetic
cgccgcaucatguccaca

SEQ ID NO: 7440 - DNA, 19 bp, Artificial Sequence
  Synthetic
gccatcaugcagcctggut

SEQ ID NO: 7441 - DNA, 28 bp, Artificial Sequence
  Synthetic
gcaacaaactaguaagttgctctagguc

SEQ ID NO: 7442 - DNA, 24 bp, Artificial Sequence
  Synthetic
actttgcuggagtttcaagcugat

SEQ ID NO: 7443 - DNA, 20 bp, Artificial Sequence
  Synthetic
ccccttauggttccgaugcc

SEQ ID NO: 7444 - DNA, 28 bp, Artificial Sequence
  Synthetic
gttgccaaagaauaagagaautctucat

SEQ ID NO: 7445 - DNA, 27 bp, Artificial Sequence
  Synthetic
ccctctgaagaagauatgatcgaaugg

SEQ ID NO: 7446 - DNA, 26 bp, Artificial Sequence
  Synthetic
cagtttaaagggaucaggagaaucca

SEQ ID NO: 7447 - DNA, 25 bp, Artificial Sequence
  Synthetic
tcctcuacccacagtactttaaugc

SEQ ID NO: 7448 - DNA, 20 bp, Artificial Sequence
  Synthetic
cctgaaucgcttgcugcaac

SEQ ID NO: 7449 - DNA, 23 bp, Artificial Sequence
  Synthetic
ggtgatgagguttcagctgugaa

SEQ ID NO: 7450 - DNA, 28 bp, Artificial Sequence
  Synthetic
gctattgaaacugaagccttgaatccut

SEQ ID NO: 7451 - DNA, 23 bp, Artificial Sequence
  Synthetic
gtagacucaagttcgcugacagg

SEQ ID NO: 7452 - DNA, 22 bp, Artificial Sequence
  Synthetic
ggctcagacuctaggttgcuct

SEQ ID NO: 7453 - DNA, 24 bp, Artificial Sequence
  Synthetic
gtcagttaaautggtgcaguagcc

SEQ ID NO: 7454 - DNA, 27 bp, Artificial Sequence
  Synthetic
ttcatctuaagucaggaaaagcaacua

SEQ ID NO: 7455 - DNA, 24 bp, Artificial Sequence
  Synthetic
tgaugaactggaugagcagaaagc

SEQ ID NO: 7456 - DNA, 27 bp, Artificial Sequence
  Synthetic
ggttatccatccucctaatcctgaauc

SEQ ID NO: 7457 - DNA, 30 bp, Artificial Sequence
  Synthetic
ttcaccacatttuagtgagaaagcaattut

SEQ ID NO: 7458 - DNA, 27 bp, Artificial Sequence
  Synthetic
gcagaaacuggaattgauacaaaacca

SEQ ID NO: 7459 - DNA, 30 bp, Artificial Sequence
  Synthetic
cctgaaaactgauaaagatatggacggaut

SEQ ID NO: 7460 - DNA, 23 bp, Artificial Sequence
  Synthetic
tgcaaacucatctctgucaagca

SEQ ID NO: 7461 - DNA, 30 bp, Artificial Sequence
  Synthetic
accattcctagcucataaactttctttuct

SEQ ID NO: 7462 - DNA, 27 bp, Artificial Sequence
  Synthetic
gcatttctuacaaatcttgguggagga

SEQ ID NO: 7463 - DNA, 26 bp, Artificial Sequence
  Synthetic
gttgguagagggagaatgctctuaac

SEQ ID NO: 7464 - DNA, 23 bp, Artificial Sequence
  Synthetic
agtatcaagtcuggaagcccuga

SEQ ID NO: 7465 - DNA, 27 bp, Artificial Sequence
  Synthetic
atggaaggcagguaaatggtgataaut

SEQ ID NO: 7466 - DNA, 26 bp, Artificial Sequence
  Synthetic
agagtttgcacaagutccttcttcut

SEQ ID NO: 7467 - DNA, 26 bp, Artificial Sequence
  Synthetic
cctgttctagaaguaggcagaacuga

SEQ ID NO: 7468 - DNA, 23 bp, Artificial Sequence
  Synthetic
tccagaccttutgggttttccug

SEQ ID NO: 7469 - DNA, 28 bp, Artificial Sequence
  Synthetic
agagacatttugatcatctacgugcaaa

SEQ ID NO: 7470 - DNA, 27 bp, Artificial Sequence
  Synthetic
aaaggttctcuggagagttaucaaagc

SEQ ID NO: 7471 - DNA, 26 bp, Artificial Sequence
  Synthetic
tgcaagactgaauttcaaatgcgaut

SEQ ID NO: 7472 - DNA, 21 bp, Artificial Sequence
  Synthetic
gcgcuccattaacgucacaag

SEQ ID NO: 7473 - DNA, 27 bp, Artificial Sequence
  Synthetic
tcattctgugcttaacttuggaaaaca

SEQ ID NO: 7474 - DNA, 19 bp, Artificial Sequence
  Synthetic
ggucggaagugcagaggac

SEQ ID NO: 7475 - DNA, 25 bp, Artificial Sequence
  Synthetic
aguctctgaagagaugaggaggaac

SEQ ID NO: 7476 - DNA, 17 bp, Artificial Sequence
  Synthetic
ctcgcccutgucccact

SEQ ID NO: 7477 - DNA, 18 bp, Artificial Sequence
  Synthetic
ccucatgugcccagggaa

SEQ ID NO: 7478 - DNA, 24 bp, Artificial Sequence
  Synthetic
actgacgttcuccctgaaaatucc

SEQ ID NO: 7479 - DNA, 30 bp, Artificial Sequence
  Synthetic
acatttccatccuatgtgtcttttactuca

SEQ ID NO: 7480 - DNA, 19 bp, Artificial Sequence
  Synthetic
gtcgcagaacugtccggut

SEQ ID NO: 7481 - DNA, 24 bp, Artificial Sequence
  Synthetic
cctactccucactcaccttttugt

SEQ ID NO: 7482 - DNA, 29 bp, Artificial Sequence
  Synthetic
cactagtgaaatuacagaagttaccugaa

SEQ ID NO: 7483 - DNA, 22 bp, Artificial Sequence
  Synthetic
tcctcccauaaggtcctgugat

SEQ ID NO: 7484 - DNA, 19 bp, Artificial Sequence
  Synthetic
gcagcugtttctgcugcaa

SEQ ID NO: 7485 - DNA, 22 bp, Artificial Sequence
  Synthetic
cctctgtgugtttcctgaugga

SEQ ID NO: 7486 - DNA, 21 bp, Artificial Sequence
  Synthetic
ggccataccccuaaagcacuc

SEQ ID NO: 7487 - DNA, 22 bp, Artificial Sequence
  Synthetic
gtttggagucccaggatctcuc

SEQ ID NO: 7488 - DNA, 20 bp, Artificial Sequence
  Synthetic
atggccaaacuacugccaca

SEQ ID NO: 7489 - DNA, 22 bp, Artificial Sequence
  Synthetic
aauttagguccccagacaagcc

SEQ ID NO: 7490 - DNA, 22 bp, Artificial Sequence
  Synthetic
accaggaccagaautctuccca

SEQ ID NO: 7491 - DNA, 28 bp, Artificial Sequence
  Synthetic
acttcctacagaaggaaucagtttgtut

SEQ ID NO: 7492 - DNA, 25 bp, Artificial Sequence
  Synthetic
gcatgctutttcctgaugagaaaga

SEQ ID NO: 7493 - DNA, 23 bp, Artificial Sequence
  Synthetic
cttacctaggcuttgggatuggg

SEQ ID NO: 7494 - DNA, 20 bp, Artificial Sequence
  Synthetic
gttguccagcagtgtuccct

SEQ ID NO: 7495 - DNA, 21 bp, Artificial Sequence
  Synthetic
gcagagaaugtggcatgtuga

SEQ ID NO: 7496 - DNA, 26 bp, Artificial Sequence
  Synthetic
ggattgtcugaagagatgttucagca

SEQ ID NO: 7497 - DNA, 21 bp, Artificial Sequence
  Synthetic
ggttatucccaggctccaugt

SEQ ID NO: 7498 - DNA, 21 bp, Artificial Sequence
  Synthetic
cctgcucagcagaagatggug

SEQ ID NO: 7499 - DNA, 19 bp, Artificial Sequence
  Synthetic
cggctgutagtcctcuggt

SEQ ID NO: 7500 - DNA, 22 bp, Artificial Sequence
  Synthetic
ctgctgcugcttccattaaguc

SEQ ID NO: 7501 - DNA, 23 bp, Artificial Sequence
  Synthetic
ggtgcuttatggttuggagggat

SEQ ID NO: 7502 - DNA, 23 bp, Artificial Sequence
  Synthetic
gttccaccccgutataccaugat

SEQ ID NO: 7503 - DNA, 25 bp, Artificial Sequence
  Synthetic
caagaggttuctctttggtcuagca

SEQ ID NO: 7504 - DNA, 20 bp, Artificial Sequence
  Synthetic
ccaguacagtcucccccaca

SEQ ID NO: 7505 - DNA, 19 bp, Artificial Sequence
  Synthetic
gccuccaggctugcaaagt

SEQ ID NO: 7506 - DNA, 21 bp, Artificial Sequence
  Synthetic
ggaactccggacauccctcut

SEQ ID NO: 7507 - DNA, 20 bp, Artificial Sequence
  Synthetic
gctggautgctcaucagggt

SEQ ID NO: 7508 - DNA, 25 bp, Artificial Sequence
  Synthetic
gcaacccaggaaacaugatgtttua

SEQ ID NO: 7509 - DNA, 17 bp, Artificial Sequence
  Synthetic
gcagcccucgggtcuct

SEQ ID NO: 7510 - DNA, 21 bp, Artificial Sequence
  Synthetic
gcggttgutgaacatgtugct

SEQ ID NO: 7511 - DNA, 28 bp, Artificial Sequence
  Synthetic
agattggagtugtttattcttcctugct

SEQ ID NO: 7512 - DNA, 21 bp, Artificial Sequence
  Synthetic
ggaaatcugggccaacatcug

SEQ ID NO: 7513 - DNA, 29 bp, Artificial Sequence
  Synthetic
attcctagcttcugtgataaatctaucct

SEQ ID NO: 7514 - DNA, 27 bp, Artificial Sequence
  Synthetic
cggagaacactucctaagtaaatacuc

SEQ ID NO: 7515 - DNA, 26 bp, Artificial Sequence
  Synthetic
ttctatttgtctugtcaactggccut

SEQ ID NO: 7516 - DNA, 23 bp, Artificial Sequence
  Synthetic
gtaaaggagcuggttctcaucca

SEQ ID NO: 7517 - DNA, 27 bp, Artificial Sequence
  Synthetic
aattttctatgagutccactgauggca

SEQ ID NO: 7518 - DNA, 23 bp, Artificial Sequence
  Synthetic
tgugaggaaccaactguaccaag

SEQ ID NO: 7519 - DNA, 28 bp, Artificial Sequence
  Synthetic
aaactcctgtaacucttctaggaaugga

SEQ ID NO: 7520 - DNA, 21 bp, Artificial Sequence
  Synthetic
catcatcugggtgcaccugat

SEQ ID NO: 7521 - DNA, 27 bp, Artificial Sequence
  Synthetic
tggctttctgtutattgtctcatguga

SEQ ID NO: 7522 - DNA, 28 bp, Artificial Sequence
  Synthetic
ttcagcaacuaaagttggtttauaggag

SEQ ID NO: 7523 - DNA, 23 bp, Artificial Sequence
  Synthetic
ctggaaactcuggacctggaaut

SEQ ID NO: 7524 - DNA, 22 bp, Artificial Sequence
  Synthetic
cttgcattautggttgguggca

SEQ ID NO: 7525 - DNA, 31 bp, Artificial Sequence
  Synthetic
tctagcatatagcugagtaatagccatgtua

SEQ ID NO: 7526 - DNA, 23 bp, Artificial Sequence
  Synthetic
tttgcccccaugtacaagaucaa

SEQ ID NO: 7527 - DNA, 25 bp, Artificial Sequence
  Synthetic
atauccacacagaaaacctguaccc

SEQ ID NO: 7528 - DNA, 24 bp, Artificial Sequence
  Synthetic
tctccttttccucctcttctccug

SEQ ID NO: 7529 - DNA, 21 bp, Artificial Sequence
  Synthetic
aatguagccattgguggcact

SEQ ID NO: 7530 - DNA, 24 bp, Artificial Sequence
  Synthetic
agtgccaucaagtgtcaauaccat

SEQ ID NO: 7531 - DNA, 22 bp, Artificial Sequence
  Synthetic
atgtgcatucctccttcaucac

SEQ ID NO: 7532 - DNA, 22 bp, Artificial Sequence
  Synthetic
ccaacatgccuttctcctugct

SEQ ID NO: 7533 - DNA, 22 bp, Artificial Sequence
  Synthetic
gggaaagaugcgatcgtaaguc

SEQ ID NO: 7534 - DNA, 22 bp, Artificial Sequence
  Synthetic
aggaaaagaugtggctguggag

SEQ ID NO: 7535 - DNA, 26 bp, Artificial Sequence
  Synthetic
actgatcattttuatccaaccaccut

SEQ ID NO: 7536 - DNA, 28 bp, Artificial Sequence
  Synthetic
aaacatcatccauctattagctgtgugt

SEQ ID NO: 7537 - DNA, 22 bp, Artificial Sequence
  Synthetic
gagaaggaagaccuggcttgut

SEQ ID NO: 7538 - DNA, 26 bp, Artificial Sequence
  Synthetic
gaaatttaacagggugttgttgugca

SEQ ID NO: 7539 - DNA, 24 bp, Artificial Sequence
  Synthetic
gttcatcugacagctgggaauagg

SEQ ID NO: 7540 - DNA, 20 bp, Artificial Sequence
  Synthetic
ctucaacaaggcgacgagug

SEQ ID NO: 7541 - DNA, 23 bp, Artificial Sequence
  Synthetic
caaacaagccuctgtctcucagt

SEQ ID NO: 7542 - DNA, 21 bp, Artificial Sequence
  Synthetic
gatgcaguccacatagccuga

SEQ ID NO: 7543 - DNA, 25 bp, Artificial Sequence
  Synthetic
cucagcagacaaaaucagcaaagag

SEQ ID NO: 7544 - DNA, 20 bp, Artificial Sequence
  Synthetic
ggtcgguccttgtcuccaga

SEQ ID NO: 7545 - DNA, 24 bp, Artificial Sequence
  Synthetic
cacaaagugccagtccttatcuca

SEQ ID NO: 7546 - DNA, 22 bp, Artificial Sequence
  Synthetic
ggagcagcacuttcctctgaut

SEQ ID NO: 7547 - DNA, 22 bp, Artificial Sequence
  Synthetic
gcttccagagcaggauaggaug

SEQ ID NO: 7548 - DNA, 25 bp, Artificial Sequence
  Synthetic
gagaagttacccgugagttcgtaut

SEQ ID NO: 7549 - DNA, 22 bp, Artificial Sequence
  Synthetic
gcctcutggaagaugccaaaga

SEQ ID NO: 7550 - DNA, 31 bp, Artificial Sequence
  Synthetic
ctccacaaaagtugatcatttttgaaatgua

SEQ ID NO: 7551 - DNA, 23 bp, Artificial Sequence
  Synthetic
gataggcccucttttgcugaaac

SEQ ID NO: 7552 - DNA, 28 bp, Artificial Sequence
  Synthetic
gtaagagaagcuctaaagaaucaaggca

SEQ ID NO: 7553 - DNA, 23 bp, Artificial Sequence
  Synthetic
tcatgcuggagccaaatttccua

SEQ ID NO: 7554 - DNA, 27 bp, Artificial Sequence
  Synthetic
caagcattttuggaggaaatctauggt

SEQ ID NO: 7555 - DNA, 28 bp, Artificial Sequence
  Synthetic
cctctcgttttcutctttcttaccttuc

SEQ ID NO: 7556 - DNA, 23 bp, Artificial Sequence
  Synthetic
gtagccaguccatgctuaaaggt

SEQ ID NO: 7557 - DNA, 23 bp, Artificial Sequence
  Synthetic
gcagtctaaucaatggcagctuc

SEQ ID NO: 7558 - DNA, 29 bp, Artificial Sequence
  Synthetic
gcuacaaaatcataaagugcaacgaagag

SEQ ID NO: 7559 - DNA, 28 bp, Artificial Sequence
  Synthetic
gaattcccttcccutcttatgtcttuca

SEQ ID NO: 7560 - DNA, 24 bp, Artificial Sequence
  Synthetic
gaagatatugaagccggtctcugt

SEQ ID NO: 7561 - DNA, 19 bp, Artificial Sequence
  Synthetic
guacgcgagaguagggaug

SEQ ID NO: 7562 - DNA, 28 bp, Artificial Sequence
  Synthetic
cgtgaatcuttttatgtctucagcaaca

SEQ ID NO: 7563 - DNA, 24 bp, Artificial Sequence
  Synthetic
tggaatgggcutctgaaagtucaa

SEQ ID NO: 7564 - DNA, 27 bp, Artificial Sequence
  Synthetic
gcaatucttcaatctguaaaagccaga

SEQ ID NO: 7565 - DNA, 27 bp, Artificial Sequence
  Synthetic
cactgcaatataaguggcaacttcaut

SEQ ID NO: 7566 - DNA, 27 bp, Artificial Sequence
  Synthetic
tcccattttcaucacgtggaatacaut

SEQ ID NO: 7567 - DNA, 31 bp, Artificial Sequence
  Synthetic
gcatctggtcutttcttctttgtatuagagt

SEQ ID NO: 7568 - DNA, 21 bp, Artificial Sequence
  Synthetic
gcatggcagutcaaaggtugg

SEQ ID NO: 7569 - DNA, 26 bp, Artificial Sequence
  Synthetic
cgcagaactataugactgtttctcut

SEQ ID NO: 7570 - DNA, 29 bp, Artificial Sequence
  Synthetic
gtaaagcataaaucgcacttgagattcug

SEQ ID NO: 7571 - DNA, 26 bp, Artificial Sequence
  Synthetic
agguatcatctcctugaagcacaaag

SEQ ID NO: 7572 - DNA, 24 bp, Artificial Sequence
  Synthetic
caacaggacugagagtacuccaga

SEQ ID NO: 7573 - DNA, 26 bp, Artificial Sequence
  Synthetic
ttgggttattugtgtgctgttucaag

SEQ ID NO: 7574 - DNA, 26 bp, Artificial Sequence
  Synthetic
ggcaaataaaugaaagcaatggugac

SEQ ID NO: 7575 - DNA, 19 bp, Artificial Sequence
  Synthetic
gggutagaacuggcaccca

SEQ ID NO: 7576 - DNA, 21 bp, Artificial Sequence
  Synthetic
ctuccagggaagguagtttug

SEQ ID NO: 7577 - DNA, 26 bp, Artificial Sequence
  Synthetic
accatctgucatcaaatttgucacga

SEQ ID NO: 7578 - DNA, 28 bp, Artificial Sequence
  Synthetic
ctgtcattggauccatgttcaaaatcuc

SEQ ID NO: 7579 - DNA, 27 bp, Artificial Sequence
  Synthetic
gccagctttttcaugaactatgggaua

SEQ ID NO: 7580 - DNA, 20 bp, Artificial Sequence
  Synthetic
aggttcuagacgcuggagct

SEQ ID NO: 7581 - DNA, 26 bp, Artificial Sequence
  Synthetic
cgctgttauccaggtttctgttgtua

SEQ ID NO: 7582 - DNA, 26 bp, Artificial Sequence
  Synthetic
cagaaatauccaaggaggaagccuat

SEQ ID NO: 7583 - DNA, 21 bp, Artificial Sequence
  Synthetic
ccattcgauctggtgatuggg

SEQ ID NO: 7584 - DNA, 17 bp, Artificial Sequence
  Synthetic
ctggcucccccatccug

SEQ ID NO: 7585 - DNA, 22 bp, Artificial Sequence
  Synthetic
acctgttgugctcactgctuag

SEQ ID NO: 7586 - DNA, 17 bp, Artificial Sequence
  Synthetic
gccucaacggcaccuct

SEQ ID NO: 7587 - DNA, 19 bp, Artificial Sequence
  Synthetic
tcgguggtacucaccccat

SEQ ID NO: 7588 - DNA, 19 bp, Artificial Sequence
  Synthetic
aaagctgggugccctcaut

SEQ ID NO: 7589 - DNA, 22 bp, Artificial Sequence
  Synthetic
cgatgagagugacacugccaag

SEQ ID NO: 7590 - DNA, 18 bp, Artificial Sequence
  Synthetic
gggtgccutcagctgcuc

SEQ ID NO: 7591 - DNA, 17 bp, Artificial Sequence
  Synthetic
ggcctcgugaccacugt

SEQ ID NO: 7592 - DNA, 28 bp, Artificial Sequence
  Synthetic
atcccaccaacaaautaauaagccaaac

SEQ ID NO: 7593 - DNA, 31 bp, Artificial Sequence
  Synthetic
gagctaagtatcaaggauttcattctcctut

SEQ ID NO: 7594 - DNA, 21 bp, Artificial Sequence
  Synthetic
ccacccgugtccttcttcuag

SEQ ID NO: 7595 - DNA, 23 bp, Artificial Sequence
  Synthetic
aacgaactgguccctttgttcut

SEQ ID NO: 7596 - DNA, 21 bp, Artificial Sequence
  Synthetic
cgcttcuccaagtccccatug

SEQ ID NO: 7597 - DNA, 23 bp, Artificial Sequence
  Synthetic
cccactgatcuaaccctcctcut

SEQ ID NO: 7598 - DNA, 26 bp, Artificial Sequence
  Synthetic
tggtactucaaaataggtuggcacaa

SEQ ID NO: 7599 - DNA, 23 bp, Artificial Sequence
  Synthetic
gcaagaauagcaugaaccagcct

SEQ ID NO: 7600 - DNA, 30 bp, Artificial Sequence
  Synthetic
gctataggattatuctttttggtgggttuc

SEQ ID NO: 7601 - DNA, 25 bp, Artificial Sequence
  Synthetic
aatatggcautctctcaguccaacc

SEQ ID NO: 7602 - DNA, 31 bp, Artificial Sequence
  Synthetic
tgccatctttaagacugtttcatatagagua

SEQ ID NO: 7603 - DNA, 21 bp, Artificial Sequence
  Synthetic
tggcaacaucagccugaagac

SEQ ID NO: 7604 - DNA, 22 bp, Artificial Sequence
  Synthetic
gcagggauacctggaggaugat

SEQ ID NO: 7605 - DNA, 25 bp, Artificial Sequence
  Synthetic
ctagtttggtuttcctctcctuccc

SEQ ID NO: 7606 - DNA, 22 bp, Artificial Sequence
  Synthetic
tgagcuccagcaggaugaaccg

SEQ ID NO: 7607 - DNA, 26 bp, Artificial Sequence
  Synthetic
cctgttccucccagtttaagattugc

SEQ ID NO: 7608 - DNA, 21 bp, Artificial Sequence
  Synthetic
ggtctugccagcaaagcagua

SEQ ID NO: 7609 - DNA, 19 bp, Artificial Sequence
  Synthetic
ccatgutgcagcugaccac

SEQ ID NO: 7610 - DNA, 23 bp, Artificial Sequence
  Synthetic
gctttcaggguccatgtgacaut

SEQ ID NO: 7611 - DNA, 24 bp, Artificial Sequence
  Synthetic
gaccaccuggagacatagtacuga

SEQ ID NO: 7612 - DNA, 18 bp, Artificial Sequence
  Synthetic
cacgctugcagcgcttua

SEQ ID NO: 7613 - DNA, 19 bp, Artificial Sequence
  Synthetic
gtgccccugatcatugcag

SEQ ID NO: 7614 - DNA, 21 bp, Artificial Sequence
  Synthetic
aggaggagggugttgagtgut

SEQ ID NO: 7615 - DNA, 20 bp, Artificial Sequence
  Synthetic
tgctgggcaucttcaaccug

SEQ ID NO: 7616 - DNA, 23 bp, Artificial Sequence
  Synthetic
ctttcttcugcctttugcaacaa

SEQ ID NO: 7617 - DNA, 23 bp, Artificial Sequence
  Synthetic
agcacccaaaucaagaaaccugt

SEQ ID NO: 7618 - DNA, 25 bp, Artificial Sequence
  Synthetic
agctgauagaggagaagggtatugg

SEQ ID NO: 7619 - DNA, 24 bp, Artificial Sequence
  Synthetic
ccutggtgctaguggagaacaaaa

SEQ ID NO: 7620 - DNA, 22 bp, Artificial Sequence
  Synthetic
catcctttagggucctgaccug

SEQ ID NO: 7621 - DNA, 27 bp, Artificial Sequence
  Synthetic
gcatattttgccuttagtggtccugaa

SEQ ID NO: 7622 - DNA, 24 bp, Artificial Sequence
  Synthetic
ggtttccacuggagatgtatucca

SEQ ID NO: 7623 - DNA, 27 bp, Artificial Sequence
  Synthetic
aggcctaattcucatatctgtttcuct

SEQ ID NO: 7624 - DNA, 19 bp, Artificial Sequence
  Synthetic
cugacccauccaggacauc

SEQ ID NO: 7625 - DNA, 21 bp, Artificial Sequence
  Synthetic
ggagtatucccctccacugca

SEQ ID NO: 7626 - DNA, 30 bp, Artificial Sequence
  Synthetic
gttgcatatcaaugtgactaaaaacacuaa

SEQ ID NO: 7627 - DNA, 20 bp, Artificial Sequence
  Synthetic
agaagaaggcgucggaagug

SEQ ID NO: 7628 - DNA, 18 bp, Artificial Sequence
  Synthetic
cctucagcacccuggaca

SEQ ID NO: 7629 - DNA, 18 bp, Artificial Sequence
  Synthetic
gctgccaccaucctccuc

SEQ ID NO: 7630 - DNA, 17 bp, Artificial Sequence
  Synthetic
agcugccguggaaagca

SEQ ID NO: 7631 - DNA, 19 bp, Artificial Sequence
  Synthetic
gctggguaccaaggacugt

SEQ ID NO: 7632 - DNA, 23 bp, Artificial Sequence
  Synthetic
cccctcctuccaaatggactuaa

SEQ ID NO: 7633 - DNA, 23 bp, Artificial Sequence
  Synthetic
gacttggutttctgttugcacca

SEQ ID NO: 7634 - DNA, 23 bp, Artificial Sequence
  Synthetic
ccatcaccagcugaaaagucaca

SEQ ID NO: 7635 - DNA, 27 bp, Artificial Sequence
  Synthetic
gcaatacttactugtctgcagtttugg

SEQ ID NO: 7636 - DNA, 22 bp, Artificial Sequence
  Synthetic
ggtcggccaautaccatgtuca

SEQ ID NO: 7637 - DNA, 26 bp, Artificial Sequence
  Synthetic
gcaaatgaattugctgtcatgguaga

SEQ ID NO: 7638 - DNA, 29 bp, Artificial Sequence
  Synthetic
caaaggtattcugttgtttcatgttucct

SEQ ID NO: 7639 - DNA, 26 bp, Artificial Sequence
  Synthetic
tctctagguacagaaggcauaacact

SEQ ID NO: 7640 - DNA, 30 bp, Artificial Sequence
  Synthetic
tgacttttctttaggautcaggtgttcaut

SEQ ID NO: 7641 - DNA, 25 bp, Artificial Sequence
  Synthetic
acctgcaaaacaaguaacgtacuct

SEQ ID NO: 7642 - DNA, 25 bp, Artificial Sequence
  Synthetic
gcaucaagttgtcauggcaaaaaga

SEQ ID NO: 7643 - DNA, 24 bp, Artificial Sequence
  Synthetic
ggctctacaguagttttgcuccat

SEQ ID NO: 7644 - DNA, 25 bp, Artificial Sequence
  Synthetic
ttacagctauaaatgcaggctucga

SEQ ID NO: 7645 - DNA, 27 bp, Artificial Sequence
  Synthetic
gcctactaaaaautgatctgccttucc

SEQ ID NO: 7646 - DNA, 21 bp, Artificial Sequence
  Synthetic
gctactguccccauagggaga

SEQ ID NO: 7647 - DNA, 28 bp, Artificial Sequence
  Synthetic
caccacttcagautactcagttcactua

SEQ ID NO: 7648 - DNA, 26 bp, Artificial Sequence
  Synthetic
gacattccaaauggctgcaaacuaat

SEQ ID NO: 7649 - DNA, 25 bp, Artificial Sequence
  Synthetic
acccacaaaccacutctttacauca

SEQ ID NO: 7650 - DNA, 27 bp, Artificial Sequence
  Synthetic
acaatgacagucacctgatatcaacug

SEQ ID NO: 7651 - DNA, 24 bp, Artificial Sequence
  Synthetic
cggtgugggagtattagatuggat

SEQ ID NO: 7652 - DNA, 18 bp, Artificial Sequence
  Synthetic
cccttcgcccucgtccua

SEQ ID NO: 7653 - DNA, 31 bp, Artificial Sequence
  Synthetic
actatugaagaaaacaaatcacauggaaacc

SEQ ID NO: 7654 - DNA, 17 bp, Artificial Sequence
  Synthetic
gggugtcaggugggagt

SEQ ID NO: 7655 - DNA, 28 bp, Artificial Sequence
  Synthetic
gaaatttgtaagaugccttttagcgugt

SEQ ID NO: 7656 - DNA, 24 bp, Artificial Sequence
  Synthetic
tttcccacaguactcacaagtguc

SEQ ID NO: 7657 - DNA, 20 bp, Artificial Sequence
  Synthetic
ggagttugcgcttcuccaca

SEQ ID NO: 7658 - DNA, 18 bp, Artificial Sequence
  Synthetic
cggccautaacagugcca

SEQ ID NO: 7659 - DNA, 18 bp, Artificial Sequence
  Synthetic
ctcagcuccaugcagcac

SEQ ID NO: 7660 - DNA, 22 bp, Artificial Sequence
  Synthetic
tcgttctcgcucttgaactugg

SEQ ID NO: 7661 - DNA, 19 bp, Artificial Sequence
  Synthetic
agcugaagcgccacaugaa

SEQ ID NO: 7662 - DNA, 23 bp, Artificial Sequence
  Synthetic
ctgccagctcuctaagtctccua

SEQ ID NO: 7663 - DNA, 21 bp, Artificial Sequence
  Synthetic
ccaccaccgagacaucactug

SEQ ID NO: 7664 - DNA, 26 bp, Artificial Sequence
  Synthetic
ttccgtgttcgcuttctaagtagaut

SEQ ID NO: 7665 - DNA, 27 bp, Artificial Sequence
  Synthetic
cctcagtgatuaaacattgatgtuggt

SEQ ID NO: 7666 - DNA, 28 bp, Artificial Sequence
  Synthetic
gctcgauaaaaataagaatgucccccaa

SEQ ID NO: 7667 - DNA, 24 bp, Artificial Sequence
  Synthetic
ttgtgcutttgtttcuccaaccac

SEQ ID NO: 7668 - DNA, 21 bp, Artificial Sequence
  Synthetic
aaacgtugagccatctgugga

SEQ ID NO: 7669 - DNA, 21 bp, Artificial Sequence
  Synthetic
caacgaccuggatctgcucat

SEQ ID NO: 7670 - DNA, 21 bp, Artificial Sequence
  Synthetic
catgcatugtctggctuacgg

SEQ ID NO: 7671 - DNA, 26 bp, Artificial Sequence
  Synthetic
tggcactcacugtcagtgtttttaut

SEQ ID NO: 7672 - DNA, 29 bp, Artificial Sequence
  Synthetic
gagctctactgtutctgaatacatcguat

SEQ ID NO: 7673 - DNA, 26 bp, Artificial Sequence
  Synthetic
actctgttgaucaggtggaaaagtut

SEQ ID NO: 7674 - DNA, 28 bp, Artificial Sequence
  Synthetic
gttttaatugggaaaggaagagcaucaa

SEQ ID NO: 7675 - DNA, 25 bp, Artificial Sequence
  Synthetic
cauctaaacacaaauacaccagcga

SEQ ID NO: 7676 - DNA, 17 bp, Artificial Sequence
  Synthetic
agucagccccaggccua

SEQ ID NO: 7677 - DNA, 20 bp, Artificial Sequence
  Synthetic
guccaggaucccagaacacc

SEQ ID NO: 7678 - DNA, 23 bp, Artificial Sequence
  Synthetic
ctccttcagccuctgatcatucc

SEQ ID NO: 7679 - DNA, 24 bp, Artificial Sequence
  Synthetic
gacagagtcgucatcttcatccuc

SEQ ID NO: 7680 - DNA, 20 bp, Artificial Sequence
  Synthetic
ggacttctgcutcacgccut

SEQ ID NO: 7681 - DNA, 22 bp, Artificial Sequence
  Synthetic
cuacaacccggugaaagaggac

SEQ ID NO: 7682 - DNA, 19 bp, Artificial Sequence
  Synthetic
tcagauccggagctgcuct

SEQ ID NO: 7683 - DNA, 21 bp, Artificial Sequence
  Synthetic
acttggcttuccttccctcug

SEQ ID NO: 7684 - DNA, 21 bp, Artificial Sequence
  Synthetic
tgcatgugaacggtgctgaua

SEQ ID NO: 7685 - DNA, 22 bp, Artificial Sequence
  Synthetic
tgaagucgtctucggaaaccag

SEQ ID NO: 7686 - DNA, 26 bp, Artificial Sequence
  Synthetic
tttagcagauttgtgcaaaucaagca

SEQ ID NO: 7687 - DNA, 21 bp, Artificial Sequence
  Synthetic
agccctcguctatctguagca

SEQ ID NO: 7688 - DNA, 30 bp, Artificial Sequence
  Synthetic
gagagtaactagaautaaacgtgccaucat

SEQ ID NO: 7689 - DNA, 28 bp, Artificial Sequence
  Synthetic
acagtttaatttgugtgtgtggttgtuc

SEQ ID NO: 7690 - DNA, 21 bp, Artificial Sequence
  Synthetic
cgaaguaccctgccuaagcat

SEQ ID NO: 7691 - DNA, 24 bp, Artificial Sequence
  Synthetic
ttggcaccaugagttctatgtcug

SEQ ID NO: 7692 - DNA, 21 bp, Artificial Sequence
  Synthetic
gggtaucaagaaggcctuggt

SEQ ID NO: 7693 - DNA, 27 bp, Artificial Sequence
  Synthetic
aatgcctttttcuactcactggtaucc

SEQ ID NO: 7694 - DNA, 19 bp, Artificial Sequence
  Synthetic
cuccaccccataugccaca

SEQ ID NO: 7695 - DNA, 26 bp, Artificial Sequence
  Synthetic
ggtctaacacagcutcattcttcuct

SEQ ID NO: 7696 - DNA, 20 bp, Artificial Sequence
  Synthetic
agctccauccagttggctuc

SEQ ID NO: 7697 - DNA, 23 bp, Artificial Sequence
  Synthetic
gtgaatgcucccattgtttccuc

SEQ ID NO: 7698 - DNA, 25 bp, Artificial Sequence
  Synthetic
cctgaccaccutcttaactctggua

SEQ ID NO: 7699 - DNA, 23 bp, Artificial Sequence
  Synthetic
cggaatgatuctgtcaacccuga

SEQ ID NO: 7700 - DNA, 25 bp, Artificial Sequence
  Synthetic
gctaggttguaagtgctgggtuaaa

SEQ ID NO: 7701 - DNA, 23 bp, Artificial Sequence
  Synthetic
gccgctuaagaaactcugaaggg

SEQ ID NO: 7702 - DNA, 24 bp, Artificial Sequence
  Synthetic
gcatacaaggaguaggcagtuagt

SEQ ID NO: 7703 - DNA, 28 bp, Artificial Sequence
  Synthetic
tgtctgttttguccatttggtatctcuc

SEQ ID NO: 7704 - DNA, 17 bp, Artificial Sequence
  Synthetic
cagtcguggcugagcgt

SEQ ID NO: 7705 - DNA, 19 bp, Artificial Sequence
  Synthetic
ccggatugagccggaaguc

SEQ ID NO: 7706 - DNA, 22 bp, Artificial Sequence
  Synthetic
accaccagtcuctgataccgua

SEQ ID NO: 7707 - DNA, 22 bp, Artificial Sequence
  Synthetic
cagagugacccuccacgaaaag

SEQ ID NO: 7708 - DNA, 24 bp, Artificial Sequence
  Synthetic
aaggtgatuaccaagaggacgtug

SEQ ID NO: 7709 - DNA, 28 bp, Artificial Sequence
  Synthetic
tcaacattatcacuggtgcactuaaact

SEQ ID NO: 7710 - DNA, 22 bp, Artificial Sequence
  Synthetic
tcgtaaggucacagctguacac

SEQ ID NO: 7711 - DNA, 25 bp, Artificial Sequence
  Synthetic
aacactccagaaugctcaaaacuct

SEQ ID NO: 7712 - DNA, 23 bp, Artificial Sequence
  Synthetic
ccatcctggccugtagaatcuct

SEQ ID NO: 7713 - DNA, 25 bp, Artificial Sequence
  Synthetic
tgccaagaugacgataaacccaaut

SEQ ID NO: 7714 - DNA, 21 bp, Artificial Sequence
  Synthetic
agccacaaucaagagctgguc

SEQ ID NO: 7715 - DNA, 19 bp, Artificial Sequence
  Synthetic
tggtggugggacgttgtut

SEQ ID NO: 7716 - DNA, 22 bp, Artificial Sequence
  Synthetic
ctgcactuaccaaacaggguca

SEQ ID NO: 7717 - DNA, 18 bp, Artificial Sequence
  Synthetic
gcaccccacuctcuccga

SEQ ID NO: 7718 - DNA, 25 bp, Artificial Sequence
  Synthetic
cagttcaaguccatggagtcatuca

SEQ ID NO: 7719 - DNA, 29 bp, Artificial Sequence
  Synthetic
ataactagugaaaggagagagatauggct

SEQ ID NO: 7720 - DNA, 20 bp, Artificial Sequence
  Synthetic
ccacugtaacggugccaact

SEQ ID NO: 7721 - DNA, 27 bp, Artificial Sequence
  Synthetic
ctctgaagagaaugcaactattagcut

SEQ ID NO: 7722 - DNA, 21 bp, Artificial Sequence
  Synthetic
gcacccacuagcactatugcc

SEQ ID NO: 7723 - DNA, 26 bp, Artificial Sequence
  Synthetic
gcagaatgugaagacacactuaacac

SEQ ID NO: 7724 - DNA, 31 bp, Artificial Sequence
  Synthetic
cataactatcatugcatctctgtatctucca

SEQ ID NO: 7725 - DNA, 23 bp, Artificial Sequence
  Synthetic
agacaccggaauactgtggtgua

SEQ ID NO: 7726 - DNA, 22 bp, Artificial Sequence
  Synthetic
aggtacucagctttucccaagg

SEQ ID NO: 7727 - DNA, 24 bp, Artificial Sequence
  Synthetic
aatggagaccutcaagcatuggat

SEQ ID NO: 7728 - DNA, 22 bp, Artificial Sequence
  Synthetic
cacaggagcutctggaattgug

SEQ ID NO: 7729 - DNA, 30 bp, Artificial Sequence
  Synthetic
ttttaaactatttcuaacaacgccttcuct

SEQ ID NO: 7730 - DNA, 25 bp, Artificial Sequence
  Synthetic
ctcattttgcagugagtttgccaut

SEQ ID NO: 7731 - DNA, 26 bp, Artificial Sequence
  Synthetic
cctaaatttaaggaacuggctgcuga

SEQ ID NO: 7732 - DNA, 26 bp, Artificial Sequence
  Synthetic
ttgcttuacaagctttaatucgcaaa

SEQ ID NO: 7733 - DNA, 32 bp, Artificial Sequence
  Synthetic
cttacttctctauagatgccaattaaauggat

SEQ ID NO: 7734 - DNA, 30 bp, Artificial Sequence
  Synthetic
catattttcaauatgaaaactgtuccaggt

SEQ ID NO: 7735 - DNA, 25 bp, Artificial Sequence
  Synthetic
acattggaucacaactgctgctuaa

SEQ ID NO: 7736 - DNA, 26 bp, Artificial Sequence
  Synthetic
cttgggaccagutgtctcatuaagaa

SEQ ID NO: 7737 - DNA, 31 bp, Artificial Sequence
  Synthetic
actttgtaagaactuaataggttgagatguc

SEQ ID NO: 7738 - DNA, 23 bp, Artificial Sequence
  Synthetic
gcaaatgucagacccacaaugac

SEQ ID NO: 7739 - DNA, 29 bp, Artificial Sequence
  Synthetic
tgtgaaatguggataatgtcttguacaac

SEQ ID NO: 7740 - DNA, 31 bp, Artificial Sequence
  Synthetic
tcauacatgatactaaauaagccaacacacc

SEQ ID NO: 7741 - DNA, 23 bp, Artificial Sequence
  Synthetic
cctcatguggctgatgtttucac

SEQ ID NO: 7742 - DNA, 28 bp, Artificial Sequence
  Synthetic
ccggattactatuctctggttgattgug

SEQ ID NO: 7743 - DNA, 21 bp, Artificial Sequence
  Synthetic
agggcaucacctctcuacagt

SEQ ID NO: 7744 - DNA, 21 bp, Artificial Sequence
  Synthetic
ttcauagcgcaacagtugcag

SEQ ID NO: 7745 - DNA, 30 bp, Artificial Sequence
  Synthetic
aatttggctacatcucttcttgattttcua

SEQ ID NO: 7746 - DNA, 30 bp, Artificial Sequence
  Synthetic
atgtcagtgcaagguttacacattttaauc

SEQ ID NO: 7747 - DNA, 26 bp, Artificial Sequence
  Synthetic
tgttttgagctugtttgctgaatgut

SEQ ID NO: 7748 - DNA, 21 bp, Artificial Sequence
  Synthetic
acattctcgauggcagcaguc

SEQ ID NO: 7749 - DNA, 23 bp, Artificial Sequence
  Synthetic
acagggugagaaattgtcacucc

SEQ ID NO: 7750 - DNA, 32 bp, Artificial Sequence
  Synthetic
gccttatattgauaatgaaagcatattugcca

SEQ ID NO: 7751 - DNA, 26 bp, Artificial Sequence
  Synthetic
tttacgcautattcgugggacaaaac

SEQ ID NO: 7752 - DNA, 22 bp, Artificial Sequence
  Synthetic
ggaacccaccugactgagaauc

SEQ ID NO: 7753 - DNA, 26 bp, Artificial Sequence
  Synthetic
ccatttggacaugtaattgucagcac

SEQ ID NO: 7754 - DNA, 19 bp, Artificial Sequence
  Synthetic
agaatcggguctcgcaugg

SEQ ID NO: 7755 - DNA, 25 bp, Artificial Sequence
  Synthetic
aaacaccauccaaaggacaacctua

SEQ ID NO: 7756 - DNA, 30 bp, Artificial Sequence
  Synthetic
tcatttcttaautctctcaaauccaacact

SEQ ID NO: 7757 - DNA, 31 bp, Artificial Sequence
  Synthetic
gcttgtatctttctutctcttactgctttut

SEQ ID NO: 7758 - DNA, 27 bp, Artificial Sequence
  Synthetic
ctagctgaggaugattcattcttcuct

SEQ ID NO: 7759 - DNA, 30 bp, Artificial Sequence
  Synthetic
catttgacttactuaaacacatctgcacut

SEQ ID NO: 7760 - DNA, 28 bp, Artificial Sequence
  Synthetic
tgagatggtattucagagtaagcaucct

SEQ ID NO: 7761 - DNA, 29 bp, Artificial Sequence
  Synthetic
ggtacaccaccutctacattaagtagtuc

SEQ ID NO: 7762 - DNA, 24 bp, Artificial Sequence
  Synthetic
ggagtcactacutcattcctgcuc

SEQ ID NO: 7763 - DNA, 26 bp, Artificial Sequence
  Synthetic
ctccagtccucagataaatggugaaa

SEQ ID NO: 7764 - DNA, 26 bp, Artificial Sequence
  Synthetic
tctgactttctuacttcgagggcuaa

SEQ ID NO: 7765 - DNA, 21 bp, Artificial Sequence
  Synthetic
agctccatgugggagcaauaa

SEQ ID NO: 7766 - DNA, 21 bp, Artificial Sequence
  Synthetic
ccccaagaagcuccgtcttua

SEQ ID NO: 7767 - DNA, 17 bp, Artificial Sequence
  Synthetic
aggauccgcuccgggaa

SEQ ID NO: 7768 - DNA, 28 bp, Artificial Sequence
  Synthetic
ggatttataaactugtgcgatgcttuga

SEQ ID NO: 7769 - DNA, 28 bp, Artificial Sequence
  Synthetic
aagaagaaatgccuttcgaacaattcug

SEQ ID NO: 7770 - DNA, 28 bp, Artificial Sequence
  Synthetic
aatgaaaaattugagggaaguggagaga

SEQ ID NO: 7771 - DNA, 26 bp, Artificial Sequence
  Synthetic
taatgacttgucgacgacaccatuat

SEQ ID NO: 7772 - DNA, 24 bp, Artificial Sequence
  Synthetic
aggcaaactautggtggctuagac

SEQ ID NO: 7773 - DNA, 28 bp, Artificial Sequence
  Synthetic
tugaactgaatatuaacacagccgagaa

SEQ ID NO: 7774 - DNA, 23 bp, Artificial Sequence
  Synthetic
gttctgctgcugacaaagttgug

SEQ ID NO: 7775 - DNA, 25 bp, Artificial Sequence
  Synthetic
caccuacacauaagcaagccaaaaa

SEQ ID NO: 7776 - DNA, 30 bp, Artificial Sequence
  Synthetic
agctaaaacataccaucaaccctattctut

SEQ ID NO: 7777 - DNA, 26 bp, Artificial Sequence
  Synthetic
caggttttgaauttacaggcttugct

SEQ ID NO: 7778 - DNA, 26 bp, Artificial Sequence
  Synthetic
tggattacagaugttgggucagaaac

SEQ ID NO: 7779 - DNA, 29 bp, Artificial Sequence
  Synthetic
tccagaagauaagaaagtctacauacgct

SEQ ID NO: 7780 - DNA, 23 bp, Artificial Sequence
  Synthetic
tcaucactgttgauggaaagcca

SEQ ID NO: 7781 - DNA, 23 bp, Artificial Sequence
  Synthetic
tggagaaugtggucaccagaaag

SEQ ID NO: 7782 - DNA, 21 bp, Artificial Sequence
  Synthetic
ggatauttgcctcuggcccat

SEQ ID NO: 7783 - DNA, 26 bp, Artificial Sequence
  Synthetic
ttcaagucacagacactgaactuacc

SEQ ID NO: 7784 - DNA, 24 bp, Artificial Sequence
  Synthetic
gcagcgattcaugaacatctgtut

SEQ ID NO: 7785 - DNA, 20 bp, Artificial Sequence
  Synthetic
cgtctggcaucacacuccag

SEQ ID NO: 7786 - DNA, 23 bp, Artificial Sequence
  Synthetic
ttgttttccccuctccaccttuc

SEQ ID NO: 7787 - DNA, 25 bp, Artificial Sequence
  Synthetic
gaattccacgutcttacctgttugc

SEQ ID NO: 7788 - DNA, 28 bp, Artificial Sequence
  Synthetic
tccagtaaaaatucgtttgagtccugaa

SEQ ID NO: 7789 - DNA, 27 bp, Artificial Sequence
  Synthetic
agcaaactgaugccagaagagaauaat

SEQ ID NO: 7790 - DNA, 21 bp, Artificial Sequence
  Synthetic
gtgugaggaagccccaaauct

SEQ ID NO: 7791 - DNA, 24 bp, Artificial Sequence
  Synthetic
tctatatcctgcugtgtggcttuc

SEQ ID NO: 7792 - DNA, 26 bp, Artificial Sequence
  Synthetic
tcccatatcaucaaaagtcaaggcut

SEQ ID NO: 7793 - DNA, 25 bp, Artificial Sequence
  Synthetic
agaccttttugacgccatcauagaa

SEQ ID NO: 7794 - DNA, 20 bp, Artificial Sequence
  Synthetic
cctcgtctugggctccttut

SEQ ID NO: 7795 - DNA, 20 bp, Artificial Sequence
  Synthetic
cuttgagaagcuccgcagga

SEQ ID NO: 7796 - DNA, 21 bp, Artificial Sequence
  Synthetic
cctccccacutgcaggattug

SEQ ID NO: 7797 - DNA, 20 bp, Artificial Sequence
  Synthetic
gagcgugagaggctttcuct

SEQ ID NO: 7798 - DNA, 19 bp, Artificial Sequence
  Synthetic
cacagcgguggtctcctut

SEQ ID NO: 7799 - DNA, 23 bp, Artificial Sequence
  Synthetic
ccactgacacugaagagcatuca

SEQ ID NO: 7800 - DNA, 32 bp, Artificial Sequence
  Synthetic
catttccaatctacuaatgctaatactgttuc

SEQ ID NO: 7801 - DNA, 24 bp, Artificial Sequence
  Synthetic
ggattccagaguccagguaagact

SEQ ID NO: 7802 - DNA, 21 bp, Artificial Sequence
  Synthetic
gggtacgagcugctatgtucc

SEQ ID NO: 7803 - DNA, 28 bp, Artificial Sequence
  Synthetic
ggcaagttctgcaucatcttgatagtua

SEQ ID NO: 7804 - DNA, 23 bp, Artificial Sequence
  Synthetic
ggacctugcataaccttucccat

SEQ ID NO: 7805 - DNA, 30 bp, Artificial Sequence
  Synthetic
ctcttctacttttuagcttcaagcattcug

SEQ ID NO: 7806 - DNA, 27 bp, Artificial Sequence
  Synthetic
tcttctcagacaugtgatcaagatucc

SEQ ID NO: 7807 - DNA, 28 bp, Artificial Sequence
  Synthetic
gtggtccacaguagtttttcgtaaguat

SEQ ID NO: 7808 - DNA, 28 bp, Artificial Sequence
  Synthetic
tggaattcttuctaacctcactugcaat

SEQ ID NO: 7809 - DNA, 19 bp, Artificial Sequence
  Synthetic
cttcttggugtcggcuggt

SEQ ID NO: 7810 - DNA, 25 bp, Artificial Sequence
  Synthetic
ttgtucctcaaacttuacagaggag

SEQ ID NO: 7811 - DNA, 22 bp, Artificial Sequence
  Synthetic
tgtgaacaucccgagcuaggat

SEQ ID NO: 7812 - DNA, 26 bp, Artificial Sequence
  Synthetic
tctaggaatgaaggugtgggtaagua

SEQ ID NO: 7813 - DNA, 24 bp, Artificial Sequence
  Synthetic
ttgtaatcttguggcttgtccuca

SEQ ID NO: 7814 - DNA, 20 bp, Artificial Sequence
  Synthetic
caccctggugctgactaucc

SEQ ID NO: 7815 - DNA, 32 bp, Artificial Sequence
  Synthetic
tggctttttaaaacutcttacctaaaggauga

SEQ ID NO: 7816 - DNA, 21 bp, Artificial Sequence
  Synthetic
ctcagcagggcautccagtua

SEQ ID NO: 7817 - DNA, 26 bp, Artificial Sequence
  Synthetic
gctctcagtcutcttctctccuacag

SEQ ID NO: 7818 - DNA, 19 bp, Artificial Sequence
  Synthetic
ccagugagccaguccaagg

SEQ ID NO: 7819 - DNA, 23 bp, Artificial Sequence
  Synthetic
cgtgttgacugcatacgcuacaa

SEQ ID NO: 7820 - DNA, 23 bp, Artificial Sequence
  Synthetic
ggaattgagagguccttcuggga

SEQ ID NO: 7821 - DNA, 23 bp, Artificial Sequence
  Synthetic
cgttccctugcttcacatctuct

SEQ ID NO: 7822 - DNA, 19 bp, Artificial Sequence
  Synthetic
gaaccccautgaggcugct

SEQ ID NO: 7823 - DNA, 25 bp, Artificial Sequence
  Synthetic
actgtgagcutttcttggagaucct

SEQ ID NO: 7824 - DNA, 23 bp, Artificial Sequence
  Synthetic
gcagagccuctagtactgtcuga

SEQ ID NO: 7825 - DNA, 17 bp, Artificial Sequence
  Synthetic
ggcugtgacugcaggga

SEQ ID NO: 7826 - DNA, 24 bp, Artificial Sequence
  Synthetic
aaaatgatacuccccctacuccca

SEQ ID NO: 7827 - DNA, 23 bp, Artificial Sequence
  Synthetic
cggccttattutcttccccguag

SEQ ID NO: 7828 - DNA, 19 bp, Artificial Sequence
  Synthetic
ccccagcacuctgggtgua

SEQ ID NO: 7829 - DNA, 24 bp, Artificial Sequence
  Synthetic
ccctactgctutcctttcctcauc

SEQ ID NO: 7830 - DNA, 27 bp, Artificial Sequence
  Synthetic
gctttccatttuggtgtctacagtuct

SEQ ID NO: 7831 - DNA, 27 bp, Artificial Sequence
  Synthetic
gagccttagagauagcccagaataaug

SEQ ID NO: 7832 - DNA, 29 bp, Artificial Sequence
  Synthetic
gatcatagtcctgugatgttctgttagut

SEQ ID NO: 7833 - DNA, 25 bp, Artificial Sequence
  Synthetic
cagccaaucaacagagatcatccut

SEQ ID NO: 7834 - DNA, 22 bp, Artificial Sequence
  Synthetic
ctttggattgucccgagtugga

SEQ ID NO: 7835 - DNA, 28 bp, Artificial Sequence
  Synthetic
acatcttaauggtcagaattuaaaggca

SEQ ID NO: 7836 - DNA, 28 bp, Artificial Sequence
  Synthetic
ggaatcttgtautcatcatcatctucct

SEQ ID NO: 7837 - DNA, 28 bp, Artificial Sequence
  Synthetic
tttgacttgaataugtcacatcagacut

SEQ ID NO: 7838 - DNA, 22 bp, Artificial Sequence
  Synthetic
tctgtgtutccgcauaagcact

SEQ ID NO: 7839 - DNA, 21 bp, Artificial Sequence
  Synthetic
caatgccucttgaagcauggt

SEQ ID NO: 7840 - DNA, 21 bp, Artificial Sequence
  Synthetic
tcaggctguggctttcttcuc

SEQ ID NO: 7841 - DNA, 26 bp, Artificial Sequence
  Synthetic
agaacactcugcacagctaauaaaca

SEQ ID NO: 7842 - DNA, 22 bp, Artificial Sequence
  Synthetic
caaaugcccacaaggctcaauc

SEQ ID NO: 7843 - DNA, 23 bp, Artificial Sequence
  Synthetic
attactttcuccctccuccccaa

SEQ ID NO: 7844 - DNA, 26 bp, Artificial Sequence
  Synthetic
gctaaaaagtctuaccttccgggtut

SEQ ID NO: 7845 - DNA, 27 bp, Artificial Sequence
  Synthetic
gctctatttugcggaattggaattuct

SEQ ID NO: 7846 - DNA, 27 bp, Artificial Sequence
  Synthetic
tgtgatacgaaagutatctcccuggaa

SEQ ID NO: 7847 - DNA, 30 bp, Artificial Sequence
  Synthetic
tgcatgcatcuaggtgtttatttcttauct

SEQ ID NO: 7848 - DNA, 24 bp, Artificial Sequence
  Synthetic
tcuggagaaaccauagacaaagug

SEQ ID NO: 7849 - DNA, 21 bp, Artificial Sequence
  Synthetic
cagtuggacccccuaagcaag

SEQ ID NO: 7850 - DNA, 18 bp, Artificial Sequence
  Synthetic
gcaaggugccctgacucg

SEQ ID NO: 7851 - DNA, 21 bp, Artificial Sequence
  Synthetic
tttgttctgcauggtgacugt

SEQ ID NO: 7852 - DNA, 21 bp, Artificial Sequence
  Synthetic
gccaauccagagacagctugg

SEQ ID NO: 7853 - DNA, 22 bp, Artificial Sequence
  Synthetic
tgccgaaggcuttgcttacuaa

SEQ ID NO: 7854 - DNA, 21 bp, Artificial Sequence
  Synthetic
agagaccagagugggcuaagg

SEQ ID NO: 7855 - DNA, 25 bp, Artificial Sequence
  Synthetic
attgctcttcacuttcctgtctcut

SEQ ID NO: 7856 - DNA, 25 bp, Artificial Sequence
  Synthetic
aggaaagaaaagcaggutcctuacc

SEQ ID NO: 7857 - DNA, 26 bp, Artificial Sequence
  Synthetic
tgcagaaactautgacaggattgugt

SEQ ID NO: 7858 - DNA, 27 bp, Artificial Sequence
  Synthetic
ggaacctgguaaataagacaaacugct

SEQ ID NO: 7859 - DNA, 23 bp, Artificial Sequence
  Synthetic
ccaaagaugatgccugaaaacca

SEQ ID NO: 7860 - DNA, 22 bp, Artificial Sequence
  Synthetic
ggtctgcugggtaaguaacact

SEQ ID NO: 7861 - DNA, 20 bp, Artificial Sequence
  Synthetic
gcaggcucttggtgcuaact

SEQ ID NO: 7862 - DNA, 27 bp, Artificial Sequence
  Synthetic
gccacaacataaucagggaaagcttua

SEQ ID NO: 7863 - DNA, 24 bp, Artificial Sequence
  Synthetic
tcactttctgutggcctcttucag

SEQ ID NO: 7864 - DNA, 21 bp, Artificial Sequence
  Synthetic
tggtttagcuggtgttuggca

SEQ ID NO: 7865 - DNA, 27 bp, Artificial Sequence
  Synthetic
cactaattcatttcugcctctttgcut

SEQ ID NO: 7866 - DNA, 22 bp, Artificial Sequence
  Synthetic
gcccggtucttcttgttttcuc

SEQ ID NO: 7867 - DNA, 21 bp, Artificial Sequence
  Synthetic
gggttgugacacacugaggac

SEQ ID NO: 7868 - DNA, 22 bp, Artificial Sequence
  Synthetic
ccgttttccacutcctctcugg

SEQ ID NO: 7869 - DNA, 21 bp, Artificial Sequence
  Synthetic
tttctgctguggtggcaaaug

SEQ ID NO: 7870 - DNA, 19 bp, Artificial Sequence
  Synthetic
tgagtcgugtcgcccuagt

SEQ ID NO: 7871 - DNA, 32 bp, Artificial Sequence
  Synthetic
gaagcagagctaauttctttttcttttaccut

SEQ ID NO: 7872 - DNA, 21 bp, Artificial Sequence
  Synthetic
gatattcacugctccugggct

SEQ ID NO: 7873 - DNA, 21 bp, Artificial Sequence
  Synthetic
ggaactccuccgtcaagtgug

SEQ ID NO: 7874 - DNA, 23 bp, Artificial Sequence
  Synthetic
cagaagttgcaguaggttggtut

SEQ ID NO: 7875 - DNA, 31 bp, Artificial Sequence
  Synthetic
ctaaatgagaugaaaaggaagaacaugcaag

SEQ ID NO: 7876 - DNA, 23 bp, Artificial Sequence
  Synthetic
cctttcucaggtccaugagggat

SEQ ID NO: 7877 - DNA, 20 bp, Artificial Sequence
  Synthetic
gccauccgcgcttctuagag

SEQ ID NO: 7878 - DNA, 20 bp, Artificial Sequence
  Synthetic
gcgcaaggucttcccatcut

SEQ ID NO: 7879 - DNA, 21 bp, Artificial Sequence
  Synthetic
ctgagcacucacctcttccug

SEQ ID NO: 7880 - DNA, 27 bp, Artificial Sequence
  Synthetic
gctatgcttuccagaaatgatttcucc

SEQ ID NO: 7881 - DNA, 25 bp, Artificial Sequence
  Synthetic
gccctttagccacucacataaagut

SEQ ID NO: 7882 - DNA, 20 bp, Artificial Sequence
  Synthetic
ctaacgtgcugagacgggut

SEQ ID NO: 7883 - DNA, 24 bp, Artificial Sequence
  Synthetic
cttcaagauccacaaccgtttcut

SEQ ID NO: 7884 - DNA, 25 bp, Artificial Sequence
  Synthetic
caagacagccacauttgctattucc

SEQ ID NO: 7885 - DNA, 24 bp, Artificial Sequence
  Synthetic
tcacagtugtgaaaccugaaacct

SEQ ID NO: 7886 - DNA, 28 bp, Artificial Sequence
  Synthetic
agtatgactttguttctaacagcuccaa

SEQ ID NO: 7887 - DNA, 26 bp, Artificial Sequence
  Synthetic
gggtgaagtaaugcttacctgaauac

SEQ ID NO: 7888 - DNA, 24 bp, Artificial Sequence
  Synthetic
tggctggcccagaaugaattttua

SEQ ID NO: 7889 - DNA, 19 bp, Artificial Sequence
  Synthetic
ccacctugcgcctcgtaut

SEQ ID NO: 7890 - DNA, 20 bp, Artificial Sequence
  Synthetic
gtggccuacatgacaggugt

SEQ ID NO: 7891 - DNA, 20 bp, Artificial Sequence
  Synthetic
gccaagaugctggcttcuca

SEQ ID NO: 7892 - DNA, 21 bp, Artificial Sequence
  Synthetic
aacccccagcuatgattugca

SEQ ID NO: 7893 - DNA, 17 bp, Artificial Sequence
  Synthetic
cuccggagcuccccaaa

SEQ ID NO: 7894 - DNA, 20 bp, Artificial Sequence
  Synthetic
caggtggcucttcagaguct

SEQ ID NO: 7895 - DNA, 21 bp, Artificial Sequence
  Synthetic
ccagaagaccuctcatgccut

SEQ ID NO: 7896 - DNA, 20 bp, Artificial Sequence
  Synthetic
gcagcggucacacttguagg

SEQ ID NO: 7897 - DNA, 21 bp, Artificial Sequence
  Synthetic
cttcctcgugctgacttuggt

SEQ ID NO: 7898 - DNA, 19 bp, Artificial Sequence
  Synthetic
tggcacucagcttggtugg

SEQ ID NO: 7899 - DNA, 20 bp, Artificial Sequence
  Synthetic
atcgtgcucaacagccucaa

SEQ ID NO: 7900 - DNA, 18 bp, Artificial Sequence
  Synthetic
gttugaggcccucagcca

SEQ ID NO: 7901 - DNA, 20 bp, Artificial Sequence
  Synthetic
cgggcacucccatgtgauag

SEQ ID NO: 7902 - DNA, 20 bp, Artificial Sequence
  Synthetic
tcucttccatcuccgacgct

SEQ ID NO: 7903 - DNA, 25 bp, Artificial Sequence
  Synthetic
tcatgtacacauctcggctcaatut

SEQ ID NO: 7904 - DNA, 25 bp, Artificial Sequence
  Synthetic
aacatcagtcaagaugtctcgacuc

SEQ ID NO: 7905 - DNA, 23 bp, Artificial Sequence
  Synthetic
aggaaacaggutctggaggacua

SEQ ID NO: 7906 - DNA, 29 bp, Artificial Sequence
  Synthetic
atgttattcgttucacatttcctttugct

SEQ ID NO: 7907 - DNA, 23 bp, Artificial Sequence
  Synthetic
gaaagguggacaaatgggtuagt

SEQ ID NO: 7908 - DNA, 17 bp, Artificial Sequence
  Synthetic
ccctccuccgggcctua

SEQ ID NO: 7909 - DNA, 18 bp, Artificial Sequence
  Synthetic
gctcggaggcucaggaug

SEQ ID NO: 7910 - DNA, 28 bp, Artificial Sequence
  Synthetic
gttttcattctuttgtggcatcugaaac

SEQ ID NO: 7911 - DNA, 26 bp, Artificial Sequence
  Synthetic
gggaatctttucaggaaatgcctcut

SEQ ID NO: 7912 - DNA, 22 bp, Artificial Sequence
  Synthetic
catccagcuccttccacacuag

SEQ ID NO: 7913 - DNA, 22 bp, Artificial Sequence
  Synthetic
tggagactuggcattggtucag

SEQ ID NO: 7914 - DNA, 22 bp, Artificial Sequence
  Synthetic
agccaaatcucccaaggaccua

SEQ ID NO: 7915 - DNA, 23 bp, Artificial Sequence
  Synthetic
gctgcatugcaacacttttugag

SEQ ID NO: 7916 - DNA, 29 bp, Artificial Sequence
  Synthetic
aatatctttccaggaaaugacccatucat

SEQ ID NO: 7917 - DNA, 24 bp, Artificial Sequence
  Synthetic
gcaatgccugccatactttuaagg

SEQ ID NO: 7918 - DNA, 21 bp, Artificial Sequence
  Synthetic
acaactggcugaccaaaguca

SEQ ID NO: 7919 - DNA, 21 bp, Artificial Sequence
  Synthetic
ggctttgcuggagctttuagg

SEQ ID NO: 7920 - DNA, 19 bp, Artificial Sequence
  Synthetic
tcccuatggcucccgagac

SEQ ID NO: 7921 - DNA, 20 bp, Artificial Sequence
  Synthetic
gggccugagagagcctuaga

SEQ ID NO: 7922 - DNA, 18 bp, Artificial Sequence
  Synthetic
tcucggauaccccagcct

SEQ ID NO: 7923 - DNA, 19 bp, Artificial Sequence
  Synthetic
gcagtcuccccacacucac

SEQ ID NO: 7924 - DNA, 25 bp, Artificial Sequence
  Synthetic
acagtccucaaagaaggaaatgcuc

SEQ ID NO: 7925 - DNA, 24 bp, Artificial Sequence
  Synthetic
gggaatggaagaguctttgtggut

SEQ ID NO: 7926 - DNA, 28 bp, Artificial Sequence
  Synthetic
tgccctagtcuagtaatttttggcucat

SEQ ID NO: 7927 - DNA, 30 bp, Artificial Sequence
  Synthetic
tctaccaaagagauaaagggccaatacuaa

SEQ ID NO: 7928 - DNA, 26 bp, Artificial Sequence
  Synthetic
atggctgcttutctgtagtatgauag

SEQ ID NO: 7929 - DNA, 29 bp, Artificial Sequence
  Synthetic
actttggaagaacuctcgaagtgtttaut

SEQ ID NO: 7930 - DNA, 21 bp, Artificial Sequence
  Synthetic
cagaattcttugctcggcuca

SEQ ID NO: 7931 - DNA, 22 bp, Artificial Sequence
  Synthetic
tcccaaggcautgaaucaacct

SEQ ID NO: 7932 - DNA, 30 bp, Artificial Sequence
  Synthetic
gactgctuaaagcaattgttgtauaaaaac

SEQ ID NO: 7933 - DNA, 21 bp, Artificial Sequence
  Synthetic
acaggacugcactcuccagaa

SEQ ID NO: 7934 - DNA, 30 bp, Artificial Sequence
  Synthetic
ttgtggttutagttttcctuacaaacagat

SEQ ID NO: 7935 - DNA, 28 bp, Artificial Sequence
  Synthetic
agctcttcgcugttttatcactuagaaa

SEQ ID NO: 7936 - DNA, 21 bp, Artificial Sequence
  Synthetic
gcatgaaaccggcucacauga

SEQ ID NO: 7937 - DNA, 31 bp, Artificial Sequence
  Synthetic
agatcattctuagaaccatcttgcttcauac

SEQ ID NO: 7938 - DNA, 23 bp, Artificial Sequence
  Synthetic
ttgctagcuatgtctagcuccca

SEQ ID NO: 7939 - DNA, 21 bp, Artificial Sequence
  Synthetic
ctctttacugccccgggaaut

SEQ ID NO: 7940 - DNA, 24 bp, Artificial Sequence
  Synthetic
tgtcctgctgugtgtgttctaaug

SEQ ID NO: 7941 - DNA, 29 bp, Artificial Sequence
  Synthetic
accatgatttaaaaauccaccagtaatug

SEQ ID NO: 7942 - DNA, 27 bp, Artificial Sequence
  Synthetic
tgattaatttgcaggutattgcgagug

SEQ ID NO: 7943 - DNA, 28 bp, Artificial Sequence
  Synthetic
aggtaccuttttaacttcuaaagcacat

SEQ ID NO: 7944 - DNA, 29 bp, Artificial Sequence
  Synthetic
ccagacaaacacuttagccattatugaaa

SEQ ID NO: 7945 - DNA, 31 bp, Artificial Sequence
  Synthetic
taggtcttttugagagtatgaattctguact

SEQ ID NO: 7946 - DNA, 23 bp, Artificial Sequence
  Synthetic
tcaagctugccatctcttcaugt

SEQ ID NO: 7947 - DNA, 29 bp, Artificial Sequence
  Synthetic
aacataatcaccauagagactttgctugt

SEQ ID NO: 7948 - DNA, 24 bp, Artificial Sequence
  Synthetic
gtgtcagccautcatacctcucag

SEQ ID NO: 7949 - DNA, 30 bp, Artificial Sequence
  Synthetic
acatgtcctattugaattttccgactuagt

SEQ ID NO: 7950 - DNA, 26 bp, Artificial Sequence
  Synthetic
gcaaagtccutcacagaaugaaagat

SEQ ID NO: 7951 - DNA, 23 bp, Artificial Sequence
  Synthetic
tgtggttggaacutgaggtgtut

SEQ ID NO: 7952 - DNA, 25 bp, Artificial Sequence
  Synthetic
gccacagauattccttcaucacaga

SEQ ID NO: 7953 - DNA, 25 bp, Artificial Sequence
  Synthetic
ctgattctgccucttggcatuagat

SEQ ID NO: 7954 - DNA, 23 bp, Artificial Sequence
  Synthetic
cctgugagcgaagtuccagcagt

SEQ ID NO: 7955 - DNA, 25 bp, Artificial Sequence
  Synthetic
tttgggtgtcugagcaccactttug

SEQ ID NO: 7956 - DNA, 28 bp, Artificial Sequence
  Synthetic
cacctactgcugaaaagagagagagugg

SEQ ID NO: 7957 - DNA, 22 bp, Artificial Sequence
  Synthetic
gctcagagcacucaggcuggat

SEQ ID NO: 7958 - DNA, 21 bp, Artificial Sequence
  Synthetic
attaccuccacctguggcaag

SEQ ID NO: 7959 - DNA, 29 bp, Artificial Sequence
  Synthetic
gagatgtagcugtggaaaagtttauaggt

SEQ ID NO: 7960 - DNA, 23 bp, Artificial Sequence
  Synthetic
acaagccuttccgtgugaaaaag

SEQ ID NO: 7961 - DNA, 32 bp, Artificial Sequence
  Synthetic
tttcttacacgtgucctatattcagtatttug

SEQ ID NO: 7962 - DNA, 32 bp, Artificial Sequence
  Synthetic
gctgaatuaagaaaggcaaaagaaaauaagga

SEQ ID NO: 7963 - DNA, 27 bp, Artificial Sequence
  Synthetic
aaagtggattguttctgaagtaugggt

SEQ ID NO: 7964 - DNA, 30 bp, Artificial Sequence
  Synthetic
tctcaagaaacagtuctctcagttctctua

SEQ ID NO: 7965 - DNA, 23 bp, Artificial Sequence
  Synthetic
gccacccauatttctgggacuat

SEQ ID NO: 7966 - DNA, 26 bp, Artificial Sequence
  Synthetic
acaagtaauaaaggcccacgaatuct

SEQ ID NO: 7967 - DNA, 23 bp, Artificial Sequence
  Synthetic
ggctgttucatttggccugaaat

SEQ ID NO: 7968 - DNA, 22 bp, Artificial Sequence
  Synthetic
gccaggcagacaucccaaauag

SEQ ID NO: 7969 - DNA, 29 bp, Artificial Sequence
  Synthetic
gttaggaggacutattccatttcuaccag

SEQ ID NO: 7970 - DNA, 25 bp, Artificial Sequence
  Synthetic
agacctgtatuagtacgccagucaa

SEQ ID NO: 7971 - DNA, 25 bp, Artificial Sequence
  Synthetic
ggacttaaaacuggagtttgugcct

SEQ ID NO: 7972 - DNA, 30 bp, Artificial Sequence
  Synthetic
tgaaaaagcaaaaagugaggaugaaaaaca

SEQ ID NO: 7973 - DNA, 22 bp, Artificial Sequence
  Synthetic
caccattugtagcaccugagga

SEQ ID NO: 7974 - DNA, 28 bp, Artificial Sequence
  Synthetic
caaaaaggaacugagauaaaaccaggac

SEQ ID NO: 7975 - DNA, 21 bp, Artificial Sequence
  Synthetic
agcaacagucccactagguga

SEQ ID NO: 7976 - DNA, 26 bp, Artificial Sequence
  Synthetic
gggtcttacctugtgacatctgttua

SEQ ID NO: 7977 - DNA, 23 bp, Artificial Sequence
  Synthetic
ggctuccagaacaaaaacccuct

SEQ ID NO: 7978 - DNA, 21 bp, Artificial Sequence
  Synthetic
ctgccugaagggttguaacga

SEQ ID NO: 7979 - DNA, 30 bp, Artificial Sequence
  Synthetic
ctccattttgaaaugtgttcttgtcttgua

SEQ ID NO: 7980 - DNA, 21 bp, Artificial Sequence
  Synthetic
ggttggcuccggatgtagaug

SEQ ID NO: 7981 - DNA, 22 bp, Artificial Sequence
  Synthetic
agcaaaggutcaggctugagag

SEQ ID NO: 7982 - DNA, 25 bp, Artificial Sequence
  Synthetic
caagggaggauacacaaugacaaua

SEQ ID NO: 7983 - DNA, 26 bp, Artificial Sequence
  Synthetic
aaaatttggcagcucttctttctucc

SEQ ID NO: 7984 - DNA, 23 bp, Artificial Sequence
  Synthetic
gggcatagagccutcatgtcauc

SEQ ID NO: 7985 - DNA, 21 bp, Artificial Sequence
  Synthetic
tggactaucgccagtagugac

SEQ ID NO: 7986 - DNA, 19 bp, Artificial Sequence
  Synthetic
cagggaagggugcagguag

SEQ ID NO: 7987 - DNA, 24 bp, Artificial Sequence
  Synthetic
ctccctaacacacucctcttcuca

SEQ ID NO: 7988 - DNA, 23 bp, Artificial Sequence
  Synthetic
cccacgaauccctcuaaaaccag

SEQ ID NO: 7989 - DNA, 22 bp, Artificial Sequence
  Synthetic
catcactuccccacatctgugt

SEQ ID NO: 7990 - DNA, 19 bp, Artificial Sequence
  Synthetic
cgcaguggaacgtctccua

SEQ ID NO: 7991 - DNA, 20 bp, Artificial Sequence
  Synthetic
acagttttuccgcagccuct

SEQ ID NO: 7992 - DNA, 27 bp, Artificial Sequence
  Synthetic
cagttcaagataucaacttggcaucct

SEQ ID NO: 7993 - DNA, 29 bp, Artificial Sequence
  Synthetic
gttttctagaatuctttgctgaacuggat

SEQ ID NO: 7994 - DNA, 21 bp, Artificial Sequence
  Synthetic
tguctccuaggaaacggacct

SEQ ID NO: 7995 - DNA, 25 bp, Artificial Sequence
  Synthetic
gtaaataagccgcccutttccatug

SEQ ID NO: 7996 - DNA, 24 bp, Artificial Sequence
  Synthetic
tggaaaagucacatggcaagtuga

SEQ ID NO: 7997 - DNA, 26 bp, Artificial Sequence
  Synthetic
gcaaaaacagutcctccacaucaaag

SEQ ID NO: 7998 - DNA, 28 bp, Artificial Sequence
  Synthetic
acaacaaaaacccutcacaaaccttaug

SEQ ID NO: 7999 - DNA, 30 bp, Artificial Sequence
  Synthetic
ctagaauaccaggaaagcctuacaaagaaa

SEQ ID NO: 8000 - DNA, 28 bp, Artificial Sequence
  Synthetic
tctgaatctgaggaugaggtatctgtut

SEQ ID NO: 8001 - DNA, 31 bp, Artificial Sequence
  Synthetic
gaaacccaatauaaagaaggagtctaaguct

SEQ ID NO: 8002 - DNA, 20 bp, Artificial Sequence
  Synthetic
cggaguagcggaactcgtut

SEQ ID NO: 8003 - DNA, 24 bp, Artificial Sequence
  Synthetic
agtgaacccacauaaagtgucacc

SEQ ID NO: 8004 - DNA, 28 bp, Artificial Sequence
  Synthetic
ccttagtuggaaaaggaaattuggaagg

SEQ ID NO: 8005 - DNA, 25 bp, Artificial Sequence
  Synthetic
ccttgacctggutgaaaacaaacug

SEQ ID NO: 8006 - DNA, 25 bp, Artificial Sequence
  Synthetic
aaaaagguacacgggaaggagaauc

SEQ ID NO: 8007 - DNA, 22 bp, Artificial Sequence
  Synthetic
aaaccccaggcugtttctucat

SEQ ID NO: 8008 - DNA, 27 bp, Artificial Sequence
  Synthetic
gggttagatttutcatctgctgauggt

SEQ ID NO: 8009 - DNA, 26 bp, Artificial Sequence
  Synthetic
caagtcgtatucagagtatgctugga

SEQ ID NO: 8010 - DNA, 20 bp, Artificial Sequence
  Synthetic
gactgcugcctcgatagucc

SEQ ID NO: 8011 - DNA, 17 bp, Artificial Sequence
  Synthetic
gggcucgggacacucac

SEQ ID NO: 8012 - DNA, 30 bp, Artificial Sequence
  Synthetic
taattctttactgauactgcttttgtguct

SEQ ID NO: 8013 - DNA, 25 bp, Artificial Sequence
  Synthetic
cagaccaaagcutgcaaaattcuca

SEQ ID NO: 8014 - DNA, 25 bp, Artificial Sequence
  Synthetic
tccggcagcauttctatgaagtauc

SEQ ID NO: 8015 - DNA, 29 bp, Artificial Sequence
  Synthetic
atgagggatgaauatatgggtacatcaut

SEQ ID NO: 8016 - DNA, 28 bp, Artificial Sequence
  Synthetic
tcatgatgtauagcatacagtggaaugt

SEQ ID NO: 8017 - DNA, 26 bp, Artificial Sequence
  Synthetic
ggtaccatggugatttgtttggaauc

SEQ ID NO: 8018 - DNA, 21 bp, Artificial Sequence
  Synthetic
cagtgaaccuataggguggca

SEQ ID NO: 8019 - DNA, 23 bp, Artificial Sequence
  Synthetic
ctggctguagaaggtuacccaag

SEQ ID NO: 8020 - DNA, 25 bp, Artificial Sequence
  Synthetic
gatattaccuccctccttccttugc

SEQ ID NO: 8021 - DNA, 26 bp, Artificial Sequence
  Synthetic
gggtaagaaaaaggcuagtaatuggt

SEQ ID NO: 8022 - DNA, 25 bp, Artificial Sequence
  Synthetic
cagatatttaacaccgugcccgaua

SEQ ID NO: 8023 - DNA, 21 bp, Artificial Sequence
  Synthetic
ccctaugcagcaaagacucac

SEQ ID NO: 8024 - DNA, 19 bp, Artificial Sequence
  Synthetic
ccacguccagcgactcauc

SEQ ID NO: 8025 - DNA, 21 bp, Artificial Sequence
  Synthetic
guttggauggcagggaacaaa

SEQ ID NO: 8026 - DNA, 26 bp, Artificial Sequence
  Synthetic
cctgagaattacguggagttcctcua

SEQ ID NO: 8027 - DNA, 26 bp, Artificial Sequence
  Synthetic
tcacagaaacautcatgtugacaggt

SEQ ID NO: 8028 - DNA, 18 bp, Artificial Sequence
  Synthetic
ccaagccucaccccacuc

SEQ ID NO: 8029 - DNA, 22 bp, Artificial Sequence
  Synthetic
tgggcatccuctgtcctatcuc

SEQ ID NO: 8030 - DNA, 21 bp, Artificial Sequence
  Synthetic
tgggatgacaguccccagtua

SEQ ID NO: 8031 - DNA, 22 bp, Artificial Sequence
  Synthetic
ctgttgaccaauggtcatgugg

SEQ ID NO: 8032 - DNA, 23 bp, Artificial Sequence
  Synthetic
acctggcctutttcttgtcctut

SEQ ID NO: 8033 - DNA, 20 bp, Artificial Sequence
  Synthetic
tttcugcgaaggaaggcuga

SEQ ID NO: 8034 - DNA, 19 bp, Artificial Sequence
  Synthetic
cctcaucccctccccucac

SEQ ID NO: 8035 - DNA, 21 bp, Artificial Sequence
  Synthetic
ctttggugcccagggactuaa

SEQ ID NO: 8036 - DNA, 27 bp, Artificial Sequence
  Synthetic
gcutatacttgtacaauagcagcagga

SEQ ID NO: 8037 - DNA, 21 bp, Artificial Sequence
  Synthetic
ctgctcacugctttgctucat

SEQ ID NO: 8038 - DNA, 19 bp, Artificial Sequence
  Synthetic
actgcagccaugtcacgut

SEQ ID NO: 8039 - DNA, 23 bp, Artificial Sequence
  Synthetic
agtaggtacugggagatugggag

SEQ ID NO: 8040 - DNA, 22 bp, Artificial Sequence
  Synthetic
gtcagaaaagggucccagguag

SEQ ID NO: 8041 - DNA, 22 bp, Artificial Sequence
  Synthetic
cagatgcttgugtgttctgcut

SEQ ID NO: 8042 - DNA, 19 bp, Artificial Sequence
  Synthetic
tggcugagcacacgatcug

SEQ ID NO: 8043 - DNA, 26 bp, Artificial Sequence
  Synthetic
agcaatatcuctatcatgtucaggga

SEQ ID NO: 8044 - DNA, 28 bp, Artificial Sequence
  Synthetic
gattgttaatttuagggcccattguagt

SEQ ID NO: 8045 - DNA, 23 bp, Artificial Sequence
  Synthetic
caacaacgcuacctuccaaaaca

SEQ ID NO: 8046 - DNA, 21 bp, Artificial Sequence
  Synthetic
ctcttaccaugccaagctgug

SEQ ID NO: 8047 - DNA, 20 bp, Artificial Sequence
  Synthetic
gaggaacgugtgtccagugt

SEQ ID NO: 8048 - DNA, 19 bp, Artificial Sequence
  Synthetic
ccagcaguagccgatgcuc

SEQ ID NO: 8049 - DNA, 21 bp, Artificial Sequence
  Synthetic
tgtgtcctcaucatgcctguc

SEQ ID NO: 8050 - DNA, 19 bp, Artificial Sequence
  Synthetic
ctccauccaggcgggauaa

SEQ ID NO: 8051 - DNA, 22 bp, Artificial Sequence
  Synthetic
cacacttacccucgttcctguc

SEQ ID NO: 8052 - DNA, 20 bp, Artificial Sequence
  Synthetic
gataaggucgcgctggucat

SEQ ID NO: 8053 - DNA, 20 bp, Artificial Sequence
  Synthetic
tggccttcugtggacgaauc

SEQ ID NO: 8054 - DNA, 30 bp, Artificial Sequence
  Synthetic
ctcccacacacutaaatactatguacaaca

SEQ ID NO: 8055 - DNA, 26 bp, Artificial Sequence
  Synthetic
tgaaaagugccaatgtuaagaaagca

SEQ ID NO: 8056 - DNA, 28 bp, Artificial Sequence
  Synthetic
cctttttactgccuttgctacaagttut

SEQ ID NO: 8057 - DNA, 29 bp, Artificial Sequence
  Synthetic
tcttgagagaggaauaagaaattgagtug

SEQ ID NO: 8058 - DNA, 26 bp, Artificial Sequence
  Synthetic
ctttttcaaauggaaagccacugaac

SEQ ID NO: 8059 - DNA, 29 bp, Artificial Sequence
  Synthetic
aagatgttgacuttgaattggcttugaat

SEQ ID NO: 8060 - DNA, 20 bp, Artificial Sequence
  Synthetic
cccccaccuttttcctccuc

SEQ ID NO: 8061 - DNA, 19 bp, Artificial Sequence
  Synthetic
gcaugcaggtucacagcat

SEQ ID NO: 8062 - DNA, 20 bp, Artificial Sequence
  Synthetic
gtctgagaggcutcccugag

SEQ ID NO: 8063 - DNA, 20 bp, Artificial Sequence
  Synthetic
cacctgcugccagatgcuat

SEQ ID NO: 8064 - DNA, 19 bp, Artificial Sequence
  Synthetic
agccggugcagaaugaagg

SEQ ID NO: 8065 - DNA, 23 bp, Artificial Sequence
  Synthetic
cctgagacuttgagacttcugct

SEQ ID NO: 8066 - DNA, 19 bp, Artificial Sequence
  Synthetic
ggtaccuccagcauccagt

SEQ ID NO: 8067 - DNA, 17 bp, Artificial Sequence
  Synthetic
gggaccagcgugtccug

SEQ ID NO: 8068 - DNA, 20 bp, Artificial Sequence
  Synthetic
cgatccauggaggcttggug

SEQ ID NO: 8069 - DNA, 22 bp, Artificial Sequence
  Synthetic
agtccaacauctaccccaucgt

SEQ ID NO: 8070 - DNA, 20 bp, Artificial Sequence
  Synthetic
gggaagucgtcctggtucat

SEQ ID NO: 8071 - DNA, 18 bp, Artificial Sequence
  Synthetic
ccgugctctucacaccca

SEQ ID NO: 8072 - DNA, 18 bp, Artificial Sequence
  Synthetic
cgguaggtgcuccggaga

SEQ ID NO: 8073 - DNA, 28 bp, Artificial Sequence
  Synthetic
ggcctgactgautgataaattcattuca

SEQ ID NO: 8074 - DNA, 21 bp, Artificial Sequence
  Synthetic
gtcacactucagggacauggt

SEQ ID NO: 8075 - DNA, 23 bp, Artificial Sequence
  Synthetic
ccccatacugatagacagcugga

SEQ ID NO: 8076 - DNA, 18 bp, Artificial Sequence
  Synthetic
cggctuccccttcacugg

SEQ ID NO: 8077 - DNA, 20 bp, Artificial Sequence
  Synthetic
ctactcctucggacccucct

SEQ ID NO: 8078 - DNA, 23 bp, Artificial Sequence
  Synthetic
cgagagagacagagugacagaug

SEQ ID NO: 8079 - DNA, 28 bp, Artificial Sequence
  Synthetic
ctgtttgatttgugtcttgtgtcttgut

SEQ ID NO: 8080 - DNA, 21 bp, Artificial Sequence
  Synthetic
tctcgtcgutcttctccucca

SEQ ID NO: 8081 - DNA, 18 bp, Artificial Sequence
  Synthetic
gccttcgucccgcttcuc

SEQ ID NO: 8082 - DNA, 17 bp, Artificial Sequence
  Synthetic
gcctccucctgcaggut

SEQ ID NO: 8083 - DNA, 17 bp, Artificial Sequence
  Synthetic
cccgacccugacccuct

SEQ ID NO: 8084 - DNA, 22 bp, Artificial Sequence
  Synthetic
tgagcccuggtgacatttgtut

SEQ ID NO: 8085 - DNA, 23 bp, Artificial Sequence
  Synthetic
gtcaaggugaaggacgacaacua

SEQ ID NO: 8086 - DNA, 21 bp, Artificial Sequence
  Synthetic
gccccucctcttagaguccag

SEQ ID NO: 8087 - DNA, 28 bp, Artificial Sequence
  Synthetic
tggagagccuagaattttatuacccaga

SEQ ID NO: 8088 - DNA, 22 bp, Artificial Sequence
  Synthetic
gggataacagaugccgaguacc

SEQ ID NO: 8089 - DNA, 21 bp, Artificial Sequence
  Synthetic
ttcagaucccaagcacugcaa

SEQ ID NO: 8090 - DNA, 22 bp, Artificial Sequence
  Synthetic
catgtctgucttcagcagugga

SEQ ID NO: 8091 - DNA, 22 bp, Artificial Sequence
  Synthetic
gcgatggugaggatgggtttut

SEQ ID NO: 8092 - DNA, 29 bp, Artificial Sequence
  Synthetic
cagtccaggcaauaaaatgagaattugaa

SEQ ID NO: 8093 - DNA, 24 bp, Artificial Sequence
  Synthetic
gacaucaaacaagagucaggaaug

SEQ ID NO: 8094 - DNA, 25 bp, Artificial Sequence
  Synthetic
atatgcaaaatcuctgggttccugt

SEQ ID NO: 8095 - DNA, 23 bp, Artificial Sequence
  Synthetic
ctatguaccaacgccagatguct

SEQ ID NO: 8096 - DNA, 29 bp, Artificial Sequence
  Synthetic
agaaccactatccuacatacatacaccug

SEQ ID NO: 8097 - DNA, 23 bp, Artificial Sequence
  Synthetic
ccccacaguccatgtucagaaat

SEQ ID NO: 8098 - DNA, 29 bp, Artificial Sequence
  Synthetic
ctaagcattagauacacacctaacgtuct

SEQ ID NO: 8099 - DNA, 23 bp, Artificial Sequence
  Synthetic
ggtgttctgguggaggactttuc

SEQ ID NO: 8100 - DNA, 22 bp, Artificial Sequence
  Synthetic
ccccctcccutctcattttcuc

SEQ ID NO: 8101 - DNA, 25 bp, Artificial Sequence
  Synthetic
gcagcauggatggattttaugacca

SEQ ID NO: 8102 - DNA, 30 bp, Artificial Sequence
  Synthetic
tttctgcatttcucagtatttcatgtgaua

SEQ ID NO: 8103 - DNA, 26 bp, Artificial Sequence
  Synthetic
guaatttccaaatucccaaggaccac

SEQ ID NO: 8104 - DNA, 25 bp, Artificial Sequence
  Synthetic
ccttcatgggaauttaaaggagcug

SEQ ID NO: 8105 - DNA, 24 bp, Artificial Sequence
  Synthetic
cgacatgtugctgagaaagucact

SEQ ID NO: 8106 - DNA, 28 bp, Artificial Sequence
  Synthetic
ctctttttcagugaccaaaatcatcugt

SEQ ID NO: 8107 - DNA, 20 bp, Artificial Sequence
  Synthetic
catctuaccaggcagucgct

SEQ ID NO: 8108 - DNA, 23 bp, Artificial Sequence
  Synthetic
ccgacagcuatgagauggaggaa

SEQ ID NO: 8109 - DNA, 18 bp, Artificial Sequence
  Synthetic
augagagcccagccucag

SEQ ID NO: 8110 - DNA, 25 bp, Artificial Sequence
  Synthetic
ccgtaaaggaaaucacaggttugag

SEQ ID NO: 8111 - DNA, 29 bp, Artificial Sequence
  Synthetic
aacatcagccautaacggtaaaattucag

SEQ ID NO: 8112 - DNA, 30 bp, Artificial Sequence
  Synthetic
gtgctatgcaaauacaataaacuggaaaaa

SEQ ID NO: 8113 - DNA, 29 bp, Artificial Sequence
  Synthetic
atacaaauaaaggacccatuagaaccaac

SEQ ID NO: 8114 - DNA, 27 bp, Artificial Sequence
  Synthetic
gaaagagacaugcatgaacattttuct

SEQ ID NO: 8115 - DNA, 24 bp, Artificial Sequence
  Synthetic
tgttgttttcucccatgactccug

SEQ ID NO: 8116 - DNA, 32 bp, Artificial Sequence
  Synthetic
ctgcctttttaaacuatcatcctgtaaucaaa

SEQ ID NO: 8117 - DNA, 20 bp, Artificial Sequence
  Synthetic
ccccaacccagcugaaacuc

SEQ ID NO: 8118 - DNA, 20 bp, Artificial Sequence
  Synthetic
tgccaaggccauggaatcug

SEQ ID NO: 8119 - DNA, 18 bp, Artificial Sequence
  Synthetic
ctuccgaacgatguggcg

SEQ ID NO: 8120 - DNA, 23 bp, Artificial Sequence
  Synthetic
cagcatguggcaccatcucacaa

SEQ ID NO: 8121 - DNA, 27 bp, Artificial Sequence
  Synthetic
tggctttcggagaugttgcttctctua

SEQ ID NO: 8122 - DNA, 22 bp, Artificial Sequence
  Synthetic
gcagagctucttcccatgauga

SEQ ID NO: 8123 - DNA, 26 bp, Artificial Sequence
  Synthetic
ccaaaatctgtgaucttgacatgcug

SEQ ID NO: 8124 - DNA, 22 bp, Artificial Sequence
  Synthetic
caagccauatgacggaauccct

SEQ ID NO: 8125 - DNA, 19 bp, Artificial Sequence
  Synthetic
guggacagauccaccaguc

SEQ ID NO: 8126 - DNA, 23 bp, Artificial Sequence
  Synthetic
acctgcatucaggaaaaguggat

SEQ ID NO: 8127 - DNA, 25 bp, Artificial Sequence
  Synthetic
agccataguggagagctgtaaatuc

SEQ ID NO: 8128 - DNA, 22 bp, Artificial Sequence
  Synthetic
accccgaguatctcaacacugt

SEQ ID NO: 8129 - DNA, 24 bp, Artificial Sequence
  Synthetic
ccttaaagaugccatttggctugg

SEQ ID NO: 8130 - DNA, 19 bp, Artificial Sequence
  Synthetic
cctgctguccatccuccac

SEQ ID NO: 8131 - DNA, 20 bp, Artificial Sequence
  Synthetic
agtucccagggacgaagguc

SEQ ID NO: 8132 - DNA, 21 bp, Artificial Sequence
  Synthetic
ctgatcacagcacugcccuaa

SEQ ID NO: 8133 - DNA, 22 bp, Artificial Sequence
  Synthetic
tctttcttgggugtcagcacuc

SEQ ID NO: 8134 - DNA, 21 bp, Artificial Sequence
  Synthetic
ggctgagcugctgctaguaac

SEQ ID NO: 8135 - DNA, 24 bp, Artificial Sequence
  Synthetic
ggctgctttcutcctatagagucc

SEQ ID NO: 8136 - DNA, 22 bp, Artificial Sequence
  Synthetic
ggtagatctguccacccaggut

SEQ ID NO: 8137 - DNA, 24 bp, Artificial Sequence
  Synthetic
acagtcuagaagggtctcacucac

SEQ ID NO: 8138 - DNA, 21 bp, Artificial Sequence
  Synthetic
ccctctguggctgtgtttuca

SEQ ID NO: 8139 - DNA, 20 bp, Artificial Sequence
  Synthetic
gggtcuccgaggtctaugca

SEQ ID NO: 8140 - DNA, 24 bp, Artificial Sequence
  Synthetic
acagatggguagacagagggauac

SEQ ID NO: 8141 - DNA, 21 bp, Artificial Sequence
  Synthetic
agctgucagcatagcacucac

SEQ ID NO: 8142 - DNA, 25 bp, Artificial Sequence
  Synthetic
agagattactcuctcaccccttcuc

SEQ ID NO: 8143 - DNA, 18 bp, Artificial Sequence
  Synthetic
gcagutctccgugagcca

SEQ ID NO: 8144 - DNA, 19 bp, Artificial Sequence
  Synthetic
ggacuaggctcagcuccct

SEQ ID NO: 8145 - DNA, 20 bp, Artificial Sequence
  Synthetic
accagcaccaacuccaaguc

SEQ ID NO: 8146 - DNA, 21 bp, Artificial Sequence
  Synthetic
agtacagagugcctcccugaa

SEQ ID NO: 8147 - DNA, 20 bp, Artificial Sequence
  Synthetic
gtcagaagcuccucccacac

SEQ ID NO: 8148 - DNA, 21 bp, Artificial Sequence
  Synthetic
cuaccaacccaccaaccugaa

SEQ ID NO: 8149 - DNA, 20 bp, Artificial Sequence
  Synthetic
cttcugagcaggagauggca

SEQ ID NO: 8150 - DNA, 24 bp, Artificial Sequence
  Synthetic
ccuttcctttctauccccaaccac

SEQ ID NO: 8151 - DNA, 17 bp, Artificial Sequence
  Synthetic
ggttgccucgggctcuc

SEQ ID NO: 8152 - DNA, 29 bp, Artificial Sequence
  Synthetic
agttctcagagaguagaatcaactgugat

SEQ ID NO: 8153 - DNA, 27 bp, Artificial Sequence
  Synthetic
gttatgacuactttccaucgagaacca

SEQ ID NO: 8154 - DNA, 27 bp, Artificial Sequence
  Synthetic
gtgaaactcugagaaacagcactcaua

SEQ ID NO: 8155 - DNA, 29 bp, Artificial Sequence
  Synthetic
gcattgtgaagucttctttctttttcuga

SEQ ID NO: 8156 - DNA, 28 bp, Artificial Sequence
  Synthetic
cagcagauagtgcaaaugaaacaagaat

SEQ ID NO: 8157 - DNA, 31 bp, Artificial Sequence
  Synthetic
tgccacattcatuaactttatctgatctuca

SEQ ID NO: 8158 - DNA, 27 bp, Artificial Sequence
  Synthetic
gaagcacataagucccttagtacagug

SEQ ID NO: 8159 - DNA, 28 bp, Artificial Sequence
  Synthetic
cattctgtcuaacacagcattctttuct

SEQ ID NO: 8160 - DNA, 28 bp, Artificial Sequence
  Synthetic
agctaaaagattuacagcagtctctugt

SEQ ID NO: 8161 - DNA, 27 bp, Artificial Sequence
  Synthetic
tgaacttcttgtucaagtgtaccctut

SEQ ID NO: 8162 - DNA, 28 bp, Artificial Sequence
  Synthetic
ctcctgtuagccaagaagaaagatugat

SEQ ID NO: 8163 - DNA, 29 bp, Artificial Sequence
  Synthetic
tgaatacattgttguttgaggtcctcaut

SEQ ID NO: 8164 - DNA, 28 bp, Artificial Sequence
  Synthetic
gcttgccttcucaaagtaaaagatgaut

SEQ ID NO: 8165 - DNA, 30 bp, Artificial Sequence; identical to SEQ ID NO: 6023
  Synthetic

SEQ ID NO: 8166 - DNA, 28 bp, Artificial Sequence
  Synthetic
gcaagagaaagaacaaguttcatugaga

SEQ ID NO: 8167 - DNA, 29 bp, Artificial Sequence
  Synthetic
tgtcatggucacaactccatctaauaaag

SEQ ID NO: 8168 - DNA, 20 bp, Artificial Sequence
  Synthetic
ggcuacagauggaagcccaa

SEQ ID NO: 8169 - DNA, 28 bp, Artificial Sequence
  Synthetic
ttcctctugagcaaaaataagctctuct

SEQ ID NO: 8170 - DNA, 29 bp, Artificial Sequence
  Synthetic
agaacaagttcaagaautagaaagccuca

SEQ ID NO: 8171 - DNA, 22 bp, Artificial Sequence
  Synthetic
ggaaccguggactcacuaacag

SEQ ID NO: 8172 - DNA, 28 bp, Artificial Sequence
  Synthetic
tgtgtcaatgaguatagcatttgcucaa

SEQ ID NO: 8173 - DNA, 28 bp, Artificial Sequence
  Synthetic
agtctgaaaaccaauttgatcctgugat

SEQ ID NO: 8174 - DNA, 26 bp, Artificial Sequence
  Synthetic
tcatgatgagauttcagtgucaagca

SEQ ID NO: 8175 - DNA, 22 bp, Artificial Sequence
  Synthetic
tctctccatutgccgcataugt

SEQ ID NO: 8176 - DNA, 29 bp, Artificial Sequence
  Synthetic
cttctttatctauacaggtatgcacucca

SEQ ID NO: 8177 - DNA, 24 bp, Artificial Sequence
  Synthetic
ggcagatgacuggcttttacuaga

SEQ ID NO: 8178 - DNA, 25 bp, Artificial Sequence
  Synthetic
ttttgcuggaactgaaauagaccct

SEQ ID NO: 8179 - DNA, 28 bp, Artificial Sequence
  Synthetic
gcaatataaggaggutacctgactgcua

SEQ ID NO: 8180 - DNA, 23 bp, Artificial Sequence
  Synthetic
gagcaggagutgttatgugcaag

SEQ ID NO: 8181 - DNA, 27 bp, Artificial Sequence
  Synthetic
cagaggactguttcatacaaattcuga

SEQ ID NO: 8182 - DNA, 30 bp, Artificial Sequence
  Synthetic
catgagagagatguattccaacaggaaaua

SEQ ID NO: 8183 - DNA, 26 bp, Artificial Sequence
  Synthetic
tgtaagtugggcaatatcagugaagt

SEQ ID NO: 8184 - DNA, 26 bp, Artificial Sequence
  Synthetic
tgttccuaggatgacauggagaaact

SEQ ID NO: 8185 - DNA, 28 bp, Artificial Sequence
  Synthetic
ttggtcaatttcuacctctttttccugt

SEQ ID NO: 8186 - DNA, 21 bp, Artificial Sequence
  Synthetic
gaaaagcuggcctuggaacag

SEQ ID NO: 8187 - DNA, 25 bp, Artificial Sequence
  Synthetic
tttccacacttucacgttctctcut

SEQ ID NO: 8188 - DNA, 29 bp, Artificial Sequence
  Synthetic
caaaggacttagaacutacccagtgtuat

SEQ ID NO: 8189 - DNA, 26 bp, Artificial Sequence
  Synthetic
cctcaagtuggatttgacugacaaga

SEQ ID NO: 8190 - DNA, 29 bp, Artificial Sequence
  Synthetic
caggttgttgaaaugcatactagttugat

SEQ ID NO: 8191 - DNA, 28 bp, Artificial Sequence
  Synthetic
ggcttcttttctuttctttctctctcug

SEQ ID NO: 8192 - DNA, 27 bp, Artificial Sequence
  Synthetic
gggaagatttuaactgaatgcccuact

SEQ ID NO: 8193 - DNA, 30 bp, Artificial Sequence
  Synthetic
ttcttgtacctcaguctcatcttcttttuc

SEQ ID NO: 8194 - DNA, 29 bp, Artificial Sequence
  Synthetic
acatggaauccagacatattucagaaact

SEQ ID NO: 8195 - DNA, 28 bp, Artificial Sequence
  Synthetic
ccaaataccuctttacttcucagacact

SEQ ID NO: 8196 - DNA, 27 bp, Artificial Sequence
  Synthetic
attctattcagcagguttcagaaccut

SEQ ID NO: 8197 - DNA, 27 bp, Artificial Sequence
  Synthetic
catagtattcttuggttacctcggcut

SEQ ID NO: 8198 - DNA, 24 bp, Artificial Sequence
  Synthetic
gccuccagaaagcagauagaagga

SEQ ID NO: 8199 - DNA, 28 bp, Artificial Sequence
  Synthetic
tgaaatctttucacctgtttgtguaacc

SEQ ID NO: 8200 - DNA, 21 bp, Artificial Sequence
  Synthetic
ctccagugggcttuggagaaa

SEQ ID NO: 8201 - DNA, 28 bp, Artificial Sequence
  Synthetic
cttaagacccucttctatcattcuggat

SEQ ID NO: 8202 - DNA, 24 bp, Artificial Sequence
  Synthetic
cccucagaggacctacugaaagag

SEQ ID NO: 8203 - DNA, 23 bp, Artificial Sequence
  Synthetic
ttctgtcugcagtgttttccugt

SEQ ID NO: 8204 - DNA, 21 bp, Artificial Sequence
  Synthetic
tcugtccaaaatugccagcca

SEQ ID NO: 8205 - DNA, 28 bp, Artificial Sequence
  Synthetic
ggttcctccuccattcatttcaaucaat

SEQ ID NO: 8206 - DNA, 27 bp, Artificial Sequence
  Synthetic
acagttugaaacagcagatgaugaaga

SEQ ID NO: 8207 - DNA, 29 bp, Artificial Sequence
  Synthetic
atccagtttctautaaatctttgctcuca

SEQ ID NO: 8208 - DNA, 26 bp, Artificial Sequence
  Synthetic
gctcagactttucttcagagactugt

SEQ ID NO: 8209 - DNA, 22 bp, Artificial Sequence
  Synthetic
agcctcugccctttucaaagat

SEQ ID NO: 8210 - DNA, 17 bp, Artificial Sequence
  Synthetic
cctgctugcccggaugg

SEQ ID NO: 8211 - DNA, 27 bp, Artificial Sequence
  Synthetic
aatgcattttccutcaagtcttuacct

SEQ ID NO: 8212 - DNA, 21 bp, Artificial Sequence
  Synthetic
tccuttagguacccaggcact

SEQ ID NO: 8213 - DNA, 27 bp, Artificial Sequence
  Synthetic
tgactgtatagtuccaagtcgtcttug

SEQ ID NO: 8214 - DNA, 20 bp, Artificial Sequence
  Synthetic
ctuggagaagcagagccugt

SEQ ID NO: 8215 - DNA, 20 bp, Artificial Sequence
  Synthetic
cggagcugaatacagccuga

SEQ ID NO: 8216 - DNA, 31 bp, Artificial Sequence
  Synthetic
cctagttcatcgauatctgttacaaactuct

SEQ ID NO: 8217 - DNA, 26 bp, Artificial Sequence
  Synthetic
gctaatgcttatguccatgtgtggut

SEQ ID NO: 8218 - DNA, 22 bp, Artificial Sequence
  Synthetic
gttttatttguccgctgcuggt

SEQ ID NO: 8219 - DNA, 24 bp, Artificial Sequence
  Synthetic
gcaaatgcucaacttccgtttuga

SEQ ID NO: 8220 - DNA, 19 bp, Artificial Sequence
  Synthetic
ggctcaccugaccacgtug

SEQ ID NO: 8221 - DNA, 19 bp, Artificial Sequence
  Synthetic
ccgtttcguggcgtugaag

SEQ ID NO: 8222 - DNA, 22 bp, Artificial Sequence
  Synthetic
accacacaagugttctttggut

SEQ ID NO: 8223 - DNA, 20 bp, Artificial Sequence
  Synthetic
gtgcgttucctgtccacuga

SEQ ID NO: 8224 - DNA, 25 bp, Artificial Sequence
  Synthetic
aatctctucatggctttuggacagt

SEQ ID NO: 8225 - DNA, 32 bp, Artificial Sequence
  Synthetic
caacttatctacaaggutgaattatttcccut

SEQ ID NO: 8226 - DNA, 22 bp, Artificial Sequence
  Synthetic
ctgaugggacccactccaucga

SEQ ID NO: 8227 - DNA, 31 bp, Artificial Sequence
  Synthetic
tctcttacctaaacucttcataatgctugct

SEQ ID NO: 8228 - DNA, 25 bp, Artificial Sequence
  Synthetic
gtaacaatagccagutgtggcttug

SEQ ID NO: 8229 - DNA, 27 bp, Artificial Sequence
  Synthetic
tutctgacaacatttuaccgacagact

SEQ ID NO: 8230 - DNA, 30 bp, Artificial Sequence
  Synthetic
attacatttggcugtgacttcuaagaagaa

SEQ ID NO: 8231 - DNA, 23 bp, Artificial Sequence
  Synthetic
cctcattaccuggctcacuaact

SEQ ID NO: 8232 - DNA, 27 bp, Artificial Sequence
  Synthetic
gcccaaattgauttcgatgatctucat

SEQ ID NO: 8233 - DNA, 32 bp, Artificial Sequence
  Synthetic
cctttatatcgttacuctgaatcttatctucc

SEQ ID NO: 8234 - DNA, 24 bp, Artificial Sequence
  Synthetic
cttctgtacuacaacgctggugaa

SEQ ID NO: 8235 - DNA, 30 bp, Artificial Sequence
  Synthetic
agttttcttgtgaguttttgaaatctcugt

SEQ ID NO: 8236 - DNA, 32 bp, Artificial Sequence
  Synthetic
agaaacagcaaaauggtgatattaaaacugac

SEQ ID NO: 8237 - DNA, 24 bp, Artificial Sequence
  Synthetic
gcctttcagugctaccttcatcuc

SEQ ID NO: 8238 - DNA, 31 bp, Artificial Sequence
  Synthetic
actagatatgatacucaaaagcttaccucca

SEQ ID NO: 8239 - DNA, 30 bp, Artificial Sequence
  Synthetic
aggtgtggaauatcaaacaaatgatuaagt

SEQ ID NO: 8240 - DNA, 28 bp, Artificial Sequence
  Synthetic
tgcaaattcagaauttcaaactgcaugt

SEQ ID NO: 8241 - DNA, 22 bp, Artificial Sequence
  Synthetic
tcggcaucgaaagagaaaugga

SEQ ID NO: 8242 - DNA, 22 bp, Artificial Sequence
  Synthetic
ccacatgcaacucaggaacuca

SEQ ID NO: 8243 - DNA, 31 bp, Artificial Sequence
  Synthetic
ctttatccaaaagaautttctcctgtgtcut

SEQ ID NO: 8244 - DNA, 26 bp, Artificial Sequence
  Synthetic
ggacacattttuactgtcccaauggt

SEQ ID NO: 8245 - DNA, 24 bp, Artificial Sequence
  Synthetic
gaagaaccuccaaacctctctcug

SEQ ID NO: 8246 - DNA, 31 bp, Artificial Sequence
  Synthetic
cagtgtctatcuatgttgacttctcuaagga

SEQ ID NO: 8247 - DNA, 21 bp, Artificial Sequence
  Synthetic
gctctgtgacugtgcctctug

SEQ ID NO: 8248 - DNA, 22 bp, Artificial Sequence
  Synthetic
gtttcagtcccugcttcccuat

SEQ ID NO: 8249 - DNA, 23 bp, Artificial Sequence
  Synthetic
gauaaagacccuaccaaaacguc

SEQ ID NO: 8250 - DNA, 28 bp, Artificial Sequence
  Synthetic
ctccaagcugctttaaaacataatucca

SEQ ID NO: 8251 - DNA, 28 bp, Artificial Sequence
  Synthetic
accaaatgcuaaatctgtucagagagag

SEQ ID NO: 8252 - DNA, 29 bp, Artificial Sequence
  Synthetic
ctaagccctattuctactctttctacugt

SEQ ID NO: 8253 - DNA, 24 bp, Artificial Sequence
  Synthetic
tgatgauggagacgatccugaaga

SEQ ID NO: 8254 - DNA, 25 bp, Artificial Sequence
  Synthetic
gggagaccaagaauacattaugggt

SEQ ID NO: 8255 - DNA, 24 bp, Artificial Sequence
  Synthetic
tgatggcuacagcttaaggttguc

SEQ ID NO: 8256 - DNA, 25 bp, Artificial Sequence
  Synthetic
acaaactggucccttctcagattuc

SEQ ID NO: 8257 - DNA, 23 bp, Artificial Sequence
  Synthetic
agtttgcugcggatuaaaacaca

SEQ ID NO: 8258 - DNA, 29 bp, Artificial Sequence
  Synthetic
tttgtttgctttuagatcctgttcuacct

SEQ ID NO: 8259 - DNA, 23 bp, Artificial Sequence
  Synthetic
cggcaguttttgtaccucaagaa

SEQ ID NO: 8260 - DNA, 24 bp, Artificial Sequence
  Synthetic
agcagtgggaaauatgccctatug

SEQ ID NO: 8261 - DNA, 26 bp, Artificial Sequence
  Synthetic
ctgtctccacutgaagaactuaaggt

SEQ ID NO: 8262 - DNA, 22 bp, Artificial Sequence
  Synthetic
cauccgaggtttuggcaaaact

SEQ ID NO: 8263 - DNA, 21 bp, Artificial Sequence
  Synthetic
cttccagguggccattcucaa

SEQ ID NO: 8264 - DNA, 25 bp, Artificial Sequence
  Synthetic
caagggaagagggcucttctauact

SEQ ID NO: 8265 - DNA, 24 bp, Artificial Sequence
  Synthetic
cctgaagaacauggtggaccaaut

SEQ ID NO: 8266 - DNA, 21 bp, Artificial Sequence
  Synthetic
ctcctcaggcaugggttctua

SEQ ID NO: 8267 - DNA, 23 bp, Artificial Sequence
  Synthetic
ctgcctacutctacttccuccca

SEQ ID NO: 8268 - DNA, 22 bp, Artificial Sequence
  Synthetic
tcaggguaaacaagggcaacuc

SEQ ID NO: 8269 - DNA, 29 bp, Artificial Sequence
  Synthetic
ggacagaatatucaagcacatatcacgua

SEQ ID NO: 8270 - DNA, 24 bp, Artificial Sequence
  Synthetic
gcagcttggutccaattaaucact

SEQ ID NO: 8271 - DNA, 27 bp, Artificial Sequence
  Synthetic
gccagtcatugagtttgtactgattuc

SEQ ID NO: 8272 - DNA, 22 bp, Artificial Sequence
  Synthetic
tcaggtaccucttcccctugaa

SEQ ID NO: 8273 - DNA, 28 bp, Artificial Sequence
  Synthetic
ccaactttgatgtutctattcccctcut

SEQ ID NO: 8274 - DNA, 19 bp, Artificial Sequence
  Synthetic
cctcgauggccgcuagaat

SEQ ID NO: 8275 - DNA, 24 bp, Artificial Sequence
  Synthetic
cagcatcuacaaaggcaagaagug

SEQ ID NO: 8276 - DNA, 26 bp, Artificial Sequence
  Synthetic
tgagagcaggaugaaatagcgtttut

SEQ ID NO: 8277 - DNA, 19 bp, Artificial Sequence
  Synthetic
ggugggagcggagagttug

SEQ ID NO: 8278 - DNA, 20 bp, Artificial Sequence
  Synthetic
cgcagguaccgtgcgacauc

SEQ ID NO: 8279 - DNA, 19 bp, Artificial Sequence
  Synthetic
ctcucacccgacccgugca

SEQ ID NO: 8280 - DNA, 22 bp, Artificial Sequence
  Synthetic
ccutctgaaaacuccccaggaa

SEQ ID NO: 8281 - DNA, 21 bp, Artificial Sequence
  Synthetic
caccgaauagttacggucgga

SEQ ID NO: 8282 - DNA, 21 bp, Artificial Sequence
  Synthetic
ggactttucgagggccttucc

SEQ ID NO: 8283 - DNA, 21 bp, Artificial Sequence
  Synthetic
gggttttcguggttcacaucc

SEQ ID NO: 8284 - DNA, 18 bp, Artificial Sequence
  Synthetic
gccactccugccccctua

SEQ ID NO: 8285 - DNA, 20 bp, Artificial Sequence
  Synthetic
agagccgtuccgagatctug

SEQ ID NO: 8286 - DNA, 17 bp, Artificial Sequence
  Synthetic
cucccgggcagcaucat

SEQ ID NO: 8287 - DNA, 18 bp, Artificial Sequence
  Synthetic
cacccuggctcugaccac

SEQ ID NO: 8288 - DNA, 20 bp, Artificial Sequence
  Synthetic
cttgttctccucgcgcatuc

SEQ ID NO: 8289 - DNA, 20 bp, Artificial Sequence
  Synthetic
aatgaagcugagcccagguc

SEQ ID NO: 8290 - DNA, 27 bp, Artificial Sequence
  Synthetic
agacctgaaggutctagaaagaauagt

SEQ ID NO: 8291 - DNA, 30 bp, Artificial Sequence
  Synthetic
atgatgatggtatcuttgctttggagaaua

SEQ ID NO: 8292 - DNA, 30 bp, Artificial Sequence
  Synthetic
ggagttagatatatuacagaggccctcaut

SEQ ID NO: 8293 - DNA, 26 bp, Artificial Sequence
  Synthetic
gctcagaaatugttggtaaccuacct

SEQ ID NO: 8294 - DNA, 30 bp, Artificial Sequence
  Synthetic
agcaaaattgaaggcauagaaaatatgugt

SEQ ID NO: 8295 - DNA, 27 bp, Artificial Sequence
  Synthetic
acttaccgatgauatcttgttgcctut

SEQ ID NO: 8296 - DNA, 27 bp, Artificial Sequence
  Synthetic
cugaagagctuaagagcaaacaaacaa

SEQ ID NO: 8297 - DNA, 27 bp, Artificial Sequence
  Synthetic
tttaagtcacucttgagttccucacag

SEQ ID NO: 8298 - DNA, 28 bp, Artificial Sequence
  Synthetic
tgaataatgtcauttgactgctuggaga

SEQ ID NO: 8299 - DNA, 29 bp, Artificial Sequence
  Synthetic
ttctcttgtatcuggatttgccaatguaa

SEQ ID NO: 8300 - DNA, 25 bp, Artificial Sequence
  Synthetic
ggagautagattucagaagcaggga

SEQ ID NO: 8301 - DNA, 25 bp, Artificial Sequence
  Synthetic
caggtccttaauctccttctgctut

SEQ ID NO: 8302 - DNA, 26 bp, Artificial Sequence
  Synthetic
tggcttauaacaaaatgcugagcaga

SEQ ID NO: 8303 - DNA, 25 bp, Artificial Sequence
  Synthetic
gcaacccacugataacaccttcuaa

SEQ ID NO: 8304 - DNA, 23 bp, Artificial Sequence
  Synthetic
gagatcucagtgcctaugaagct

SEQ ID NO: 8305 - DNA, 25 bp, Artificial Sequence
  Synthetic
tgatatctuaaggcacagggtccut

SEQ ID NO: 8306 - DNA, 28 bp, Artificial Sequence
  Synthetic
agatttccagaaucaccttaaccatgug

SEQ ID NO: 8307 - DNA, 21 bp, Artificial Sequence
  Synthetic
ttgugaggcccactcuagact

SEQ ID NO: 8308 - DNA, 23 bp, Artificial Sequence
  Synthetic
tccaaggccutacagatcuccaa

SEQ ID NO: 8309 - DNA, 22 bp, Artificial Sequence
  Synthetic
catctcagcugacctagtugcc

SEQ ID NO: 8310 - DNA, 24 bp, Artificial Sequence
  Synthetic
ggtgcctttcucatacttctgucc

SEQ ID NO: 8311 - DNA, 22 bp, Artificial Sequence
  Synthetic
ggtctctggguaccaacacuga

SEQ ID NO: 8312 - DNA, 24 bp, Artificial Sequence
  Synthetic
agcauggcagatccttucaaaaga

SEQ ID NO: 8313 - DNA, 23 bp, Artificial Sequence
  Synthetic
gggacaatgucacactttctuca

SEQ ID NO: 8314 - DNA, 26 bp, Artificial Sequence
  Synthetic
gcctcctccuggatacatgatgtaua

SEQ ID NO: 8315 - DNA, 21 bp, Artificial Sequence
  Synthetic
ggtgggccauaaacaacagug

SEQ ID NO: 8316 - DNA, 24 bp, Artificial Sequence
  Synthetic
ggaagaaagguggatgagagcauc

SEQ ID NO: 8317 - DNA, 28 bp, Artificial Sequence
  Synthetic
ttgacgtttcuggacagttctatguaat

SEQ ID NO: 8318 - DNA, 23 bp, Artificial Sequence
  Synthetic
gtttacauggccagtagctguga

SEQ ID NO: 8319 - DNA, 25 bp, Artificial Sequence
  Synthetic
gctctccuttctaattccucagcat

SEQ ID NO: 8320 - DNA, 23 bp, Artificial Sequence
  Synthetic
cgagtccctuaggatctgctcua

SEQ ID NO: 8321 - DNA, 27 bp, Artificial Sequence
  Synthetic
aagaagcaccucagattcttuaaggac

SEQ ID NO: 8322 - DNA, 29 bp, Artificial Sequence
  Synthetic
aaacacaggaaguaaaatctcttcuggaa

SEQ ID NO: 8323 - DNA, 26 bp, Artificial Sequence
  Synthetic
gacatctgccutaaaacaaccugaag

SEQ ID NO: 8324 - DNA, 22 bp, Artificial Sequence
  Synthetic
attugcagcagataucccagca

SEQ ID NO: 8325 - DNA, 26 bp, Artificial Sequence
  Synthetic
gtcacatttcucttggagatctucct

SEQ ID NO: 8326 - DNA, 23 bp, Artificial Sequence
  Synthetic
acttttugggaatgctaauggga

SEQ ID NO: 8327 - DNA, 25 bp, Artificial Sequence
  Synthetic
cttggacattagcuagttcctccug

SEQ ID NO: 8328 - DNA, 22 bp, Artificial Sequence
  Synthetic
ctgtctcatguccatgcaggut

SEQ ID NO: 8329 - DNA, 29 bp, Artificial Sequence
  Synthetic
agtgtcacttuactggtttctaattugct

SEQ ID NO: 8330 - DNA, 23 bp, Artificial Sequence
  Synthetic
gcagattctaugagggcagacut

SEQ ID NO: 8331 - DNA, 27 bp, Artificial Sequence
  Synthetic
ggtacucacaagaaggtttttcuccag

SEQ ID NO: 8332 - DNA, 23 bp, Artificial Sequence
  Synthetic
acatggcacaucatacagcucaa

SEQ ID NO: 8333 - DNA, 26 bp, Artificial Sequence
  Synthetic
tccttcaccucagatttaagtgucct

SEQ ID NO: 8334 - DNA, 29 bp, Artificial Sequence
  Synthetic
ctgtgtaaaacccuaagtcttaucacact

SEQ ID NO: 8335 - DNA, 21 bp, Artificial Sequence
  Synthetic
cagaggtgcuggtgaccaaut

SEQ ID NO: 8336 - DNA, 26 bp, Artificial Sequence
  Synthetic
gtgattgactucaattgctgactugt

SEQ ID NO: 8337 - DNA, 21 bp, Artificial Sequence
  Synthetic
ccccaaguactttuccaggct

SEQ ID NO: 8338 - DNA, 22 bp, Artificial Sequence
  Synthetic
acccagugaaaaugaccccaac

SEQ ID NO: 8339 - DNA, 23 bp, Artificial Sequence
  Synthetic
accgcaatucccagatttctauc

SEQ ID NO: 8340 - DNA, 20 bp, Artificial Sequence
  Synthetic
cctgtctcugtgggcugaag

SEQ ID NO: 8341 - DNA, 22 bp, Artificial Sequence
  Synthetic
tggataauggagcgtggtgaug

SEQ ID NO: 8342 - DNA, 20 bp, Artificial Sequence
  Synthetic
ccacgtgutgaagtccucgt

SEQ ID NO: 8343 - DNA, 23 bp, Artificial Sequence
  Synthetic
gagatctgaguggccatguacag

SEQ ID NO: 8344 - DNA, 24 bp, Artificial Sequence
  Synthetic
tgctacacatcutgaacagcctut

SEQ ID NO: 8345 - DNA, 22 bp, Artificial Sequence
  Synthetic
ggtagtcctuctctagcagcuc

SEQ ID NO: 8346 - DNA, 19 bp, Artificial Sequence
  Synthetic
cuccaggagagcugcagag

SEQ ID NO: 8347 - DNA, 20 bp, Artificial Sequence
  Synthetic
cattcacagcutcccgtugg

SEQ ID NO: 8348 - DNA, 17 bp, Artificial Sequence
  Synthetic
gggcacuggcttucacc

SEQ ID NO: 8349 - DNA, 18 bp, Artificial Sequence
  Synthetic
ggtcagcgugctggacut

SEQ ID NO: 8350 - DNA, 23 bp, Artificial Sequence
  Synthetic
caggctggugaaaaagaaugagg

SEQ ID NO: 8351 - DNA, 22 bp, Artificial Sequence
  Synthetic
cctttccagcutcttccttgug

SEQ ID NO: 8352 - DNA, 22 bp, Artificial Sequence
  Synthetic
ggaaattguccaggcucaaacc

SEQ ID NO: 8353 - DNA, 19 bp, Artificial Sequence
  Synthetic
ggcagcgucactgtucaca

SEQ ID NO: 8354 - DNA, 19 bp, Artificial Sequence
  Synthetic
tgccucgccatctcuagga

SEQ ID NO: 8355 - DNA, 24 bp, Artificial Sequence
  Synthetic
ggaaggcaaacutgttcctcatut

SEQ ID NO: 8356 - DNA, 24 bp, Artificial Sequence
  Synthetic
ctgaatuaagaagcagaccugcac

SEQ ID NO: 8357 - DNA, 20 bp, Artificial Sequence
  Synthetic
gctcugacagcagtgacuca

SEQ ID NO: 8358 - DNA, 19 bp, Artificial Sequence
  Synthetic
gcuccacgcaggcaactua

SEQ ID NO: 8359 - DNA, 24 bp, Artificial Sequence
  Synthetic
caaccccgacgagauagaaatuga

SEQ ID NO: 8360 - DNA, 19 bp, Artificial Sequence
  Synthetic
gagccaccutggccttcut

SEQ ID NO: 8361 - DNA, 20 bp, Artificial Sequence
  Synthetic
ctgtcucaggccccaguaaa

SEQ ID NO: 8362 - DNA, 26 bp, Artificial Sequence
  Synthetic
gggattgtauttgtagcaatucgaga

SEQ ID NO: 8363 - DNA, 20 bp, Artificial Sequence
  Synthetic
gtguggcagagagtccugat

SEQ ID NO: 8364 - DNA, 19 bp, Artificial Sequence
  Synthetic
ccaccactutggcctgcut

SEQ ID NO: 8365 - DNA, 23 bp, Artificial Sequence
  Synthetic
gggttcacuggttatttcacugt

SEQ ID NO: 8366 - DNA, 24 bp, Artificial Sequence
  Synthetic
gcatcugggccactttttguagaa

SEQ ID NO: 8367 - DNA, 28 bp, Artificial Sequence
  Synthetic
tgagctacaacuaataatgtccttugca

SEQ ID NO: 8368 - DNA, 19 bp, Artificial Sequence
  Synthetic
ctgcagcuggttggtctug

SEQ ID NO: 8369 - DNA, 17 bp, Artificial Sequence
  Synthetic
ccaagccgcugctguga

SEQ ID NO: 8370 - DNA, 26 bp, Artificial Sequence
  Synthetic
ttccttcacaucaactcaatgacugt

SEQ ID NO: 8371 - DNA, 25 bp, Artificial Sequence
  Synthetic
agtggautatgaagaugaggaggct

SEQ ID NO: 8372 - DNA, 25 bp, Artificial Sequence
  Synthetic
ccaccagaagaugtcgaagaaguag

SEQ ID NO: 8373 - DNA, 23 bp, Artificial Sequence
  Synthetic
ctgctttgtuctgccatcuaagg

SEQ ID NO: 8374 - DNA, 22 bp, Artificial Sequence
  Synthetic
gagtttgucgccagtcagtuac

SEQ ID NO: 8375 - DNA, 23 bp, Artificial Sequence
  Synthetic
aacccccaacagutcctaaugac

SEQ ID NO: 8376 - DNA, 21 bp, Artificial Sequence
  Synthetic
ggctcugcagcctctaucaat

SEQ ID NO: 8377 - DNA, 29 bp, Artificial Sequence
  Synthetic
ctgtcctatcggauataacttaccuagca

SEQ ID NO: 8378 - DNA, 22 bp, Artificial Sequence
  Synthetic
cgaagcugagaggcttggauat

SEQ ID NO: 8379 - DNA, 28 bp, Artificial Sequence
  Synthetic
tgttcutatttcaggcuacagacaagag

SEQ ID NO: 8380 - DNA, 29 bp, Artificial Sequence
  Synthetic
atttacaacacaauggatagtgaagccua

SEQ ID NO: 8381 - DNA, 19 bp, Artificial Sequence
  Synthetic
cccctccucccagcctuaa

SEQ ID NO: 8382 - DNA, 23 bp, Artificial Sequence
  Synthetic
cagctctagucagtgaagtuggt

SEQ ID NO: 8383 - DNA, 27 bp, Artificial Sequence
  Synthetic
tgcgatttaaaaccucctagatagtug

SEQ ID NO: 8384 - DNA, 26 bp, Artificial Sequence
  Synthetic
tctacaggcaugaaactagugaaacc

SEQ ID NO: 8385 - DNA, 23 bp, Artificial Sequence
  Synthetic
gctccaccaucgcctagagauat

SEQ ID NO: 8386 - DNA, 27 bp, Artificial Sequence
  Synthetic
tcatcagtttgutgacctgaaatucct

SEQ ID NO: 8387 - DNA, 22 bp, Artificial Sequence
  Synthetic
gccagtgttuccatggcattug

SEQ ID NO: 8388 - DNA, 19 bp, Artificial Sequence
  Synthetic
tgutctcttgcugcagcga

SEQ ID NO: 8389 - DNA, 17 bp, Artificial Sequence
  Synthetic
cgccaugcagtcgucct

SEQ ID NO: 8390 - DNA, 23 bp, Artificial Sequence
  Synthetic
gaugaaatcagacuccgaccaga

SEQ ID NO: 8391 - DNA, 24 bp, Artificial Sequence
  Synthetic
cctaactctuaagaagggcugcat

SEQ ID NO: 8392 - DNA, 29 bp, Artificial Sequence
  Synthetic
tgtcggaccaatutatgtaaccagtatut

SEQ ID NO: 8393 - DNA, 26 bp, Artificial Sequence
  Synthetic
tcaattctagguagcctggttacugt

SEQ ID NO: 8394 - DNA, 25 bp, Artificial Sequence
  Synthetic
acgtcgtuacaatcgtgattuggaa

SEQ ID NO: 8395 - DNA, 28 bp, Artificial Sequence
  Synthetic
gacacattctaaaucaacacaccatuca

SEQ ID NO: 8396 - DNA, 27 bp, Artificial Sequence
  Synthetic
ctcagtatccagaaugagcattactuc

SEQ ID NO: 8397 - DNA, 23 bp, Artificial Sequence
  Synthetic
aauagagctgaguccaggaacct

SEQ ID NO: 8398 - DNA, 23 bp, Artificial Sequence
  Synthetic
tcaacttggaccutggctttcut

SEQ ID NO: 8399 - DNA, 24 bp, Artificial Sequence
  Synthetic
ggaagtggttuttgttcaggctut

SEQ ID NO: 8400 - DNA, 25 bp, Artificial Sequence
  Synthetic
gtccccugaagaagtgattcguaaa

SEQ ID NO: 8401 - DNA, 28 bp, Artificial Sequence
  Synthetic
gtcttcttaattcucaatgctgtgaguc

SEQ ID NO: 8402 - DNA, 23 bp, Artificial Sequence
  Synthetic
tgtcctcccacuttaatgtgguc

SEQ ID NO: 8403 - DNA, 19 bp, Artificial Sequence
  Synthetic
tgccgtgtugcgtgttcua

SEQ ID NO: 8404 - DNA, 20 bp, Artificial Sequence
  Synthetic
gagtggcucccacactctut

SEQ ID NO: 8405 - DNA, 23 bp, Artificial Sequence
  Synthetic
cagctctcagugaaccaaaacug

SEQ ID NO: 8406 - DNA, 23 bp, Artificial Sequence
  Synthetic
cccaaagaaauggcaccacctua

SEQ ID NO: 8407 - DNA, 29 bp, Artificial Sequence
  Synthetic
gaaaagttgccuaaatgctgttaaacuga

SEQ ID NO: 8408 - DNA, 27 bp, Artificial Sequence
  Synthetic
tcaaggcatcuttaatggtgaugaagt

SEQ ID NO: 8409 - DNA, 22 bp, Artificial Sequence
  Synthetic
gccccaguaacacatgactgut

SEQ ID NO: 8410 - DNA, 21 bp, Artificial Sequence
  Synthetic
ggccugcaaagucaacacaac

SEQ ID NO: 8411 - DNA, 21 bp, Artificial Sequence
  Synthetic
agcgaaguttgcttcuagcga

SEQ ID NO: 8412 - DNA, 24 bp, Artificial Sequence
  Synthetic
gcagctuggagaagatggaatugt

SEQ ID NO: 8413 - DNA, 20 bp, Artificial Sequence
  Synthetic
accagcugcacgagatgtuc

SEQ ID NO: 8414 - DNA, 30 bp, Artificial Sequence
  Synthetic
caaattcccttuaccttgtcatcaataucc

SEQ ID NO: 8415 - DNA, 23 bp, Artificial Sequence
  Synthetic
tcgtctggugtggaaatgttugt

SEQ ID NO: 8416 - DNA, 17 bp, Artificial Sequence
  Synthetic
tgcugcccggaggaauc

SEQ ID NO: 8417 - DNA, 19 bp, Artificial Sequence
  Synthetic
agccccuggtagttgccua

SEQ ID NO: 8418 - DNA, 23 bp, Artificial Sequence
  Synthetic
ttttgatgtcuatcgctguggct

SEQ ID NO: 8419 - DNA, 27 bp, Artificial Sequence
  Synthetic
tcagtgtagtagucactgtctgagaug

SEQ ID NO: 8420 - DNA, 25 bp, Artificial Sequence
  Synthetic
gtacgaaucacctgttgtucaacat

SEQ ID NO: 8421 - DNA, 27 bp, Artificial Sequence
  Synthetic
cacatgaacaaaaugatctugaaccca

SEQ ID NO: 8422 - DNA, 21 bp, Artificial Sequence
  Synthetic
gaagcccuccaggucaaacat

SEQ ID NO: 8423 - DNA, 21 bp, Artificial Sequence
  Synthetic
ctgagccttugcgagagguaa

SEQ ID NO: 8424 - DNA, 26 bp, Artificial Sequence
  Synthetic
ataaaggaatuagcctaaccuggagt

SEQ ID NO: 8425 - DNA, 24 bp, Artificial Sequence
  Synthetic
cagggcaauggctttaattgacug

SEQ ID NO: 8426 - DNA, 23 bp, Artificial Sequence
  Synthetic
acaagctgautctcccatcucat

SEQ ID NO: 8427 - DNA, 26 bp, Artificial Sequence
  Synthetic
agtccucacaacttttaauggaaccc

SEQ ID NO: 8428 - DNA, 25 bp, Artificial Sequence
  Synthetic
aagtggaagtaugagtctgagugga

SEQ ID NO: 8429 - DNA, 22 bp, Artificial Sequence
  Synthetic
ctaagccctcutggcaggtaug

SEQ ID NO: 8430 - DNA, 23 bp, Artificial Sequence
  Synthetic
acaggucagagtgcaucaacaag

SEQ ID NO: 8431 - DNA, 21 bp, Artificial Sequence
  Synthetic
acctccaccaaugacacgtut

SEQ ID NO: 8432 - DNA, 26 bp, Artificial Sequence
  Synthetic
cagaagaccuccgagattgtatuacg

SEQ ID NO: 8433 - DNA, 22 bp, Artificial Sequence
  Synthetic
agcacccuaaaaggcggaaaua

SEQ ID NO: 8434 - DNA, 21 bp, Artificial Sequence
  Synthetic
ctccagcaguccttttugcac

SEQ ID NO: 8435 - DNA, 24 bp, Artificial Sequence
  Synthetic
gcatgatatcucccccttuggaac

SEQ ID NO: 8436 - DNA, 23 bp, Artificial Sequence
  Synthetic
gcggcaacagugagtaaauagga

SEQ ID NO: 8437 - DNA, 22 bp, Artificial Sequence
  Synthetic
ccatgtucagcaggatcacgut

SEQ ID NO: 8438 - DNA, 20 bp, Artificial Sequence
  Synthetic
gagggctugtggttcctuca

SEQ ID NO: 8439 - DNA, 19 bp, Artificial Sequence
  Synthetic
cagucccacugggaagcag

SEQ ID NO: 8440 - DNA, 25 bp, Artificial Sequence
  Synthetic
ccaaaagugaccagaaatcaggugt

SEQ ID NO: 8441 - DNA, 26 bp, Artificial Sequence
  Synthetic
caagtcagagacautctcctccuact

SEQ ID NO: 8442 - DNA, 24 bp, Artificial Sequence
  Synthetic
gaggcuaatgaugacaagaagcca

SEQ ID NO: 8443 - DNA, 27 bp, Artificial Sequence
  Synthetic
gcatcaaaggugaatttcttgttucgg

SEQ ID NO: 8444 - DNA, 22 bp, Artificial Sequence
  Synthetic
tcccacttaugtggagcuggat

SEQ ID NO: 8445 - DNA, 25 bp, Artificial Sequence
  Synthetic
gguggaaccaaaatgauacaccaga

SEQ ID NO: 8446 - DNA, 24 bp, Artificial Sequence
  Synthetic
ttgttctggaucaagaacgacugt

SEQ ID NO: 8447 - DNA, 27 bp, Artificial Sequence
  Synthetic
cagcctcggaauccataaaaatacuca

SEQ ID NO: 8448 - DNA, 24 bp, Artificial Sequence
  Synthetic
gagcatcaggugtttactgttcug

SEQ ID NO: 8449 - DNA, 21 bp, Artificial Sequence
  Synthetic
cuctatgucccaggcagcaag

SEQ ID NO: 8450 - DNA, 17 bp, Artificial Sequence
  Synthetic
cgtgccuccgtagguct

SEQ ID NO: 8451 - DNA, 19 bp, Artificial Sequence
  Synthetic
ggccacgaacaugcaagug

SEQ ID NO: 8452 - DNA, 22 bp, Artificial Sequence
  Synthetic
cctccttcccuctctccttcug

SEQ ID NO: 8453 - DNA, 20 bp, Artificial Sequence
  Synthetic
actcuggagaggaagcgugt

SEQ ID NO: 8454 - DNA, 18 bp, Artificial Sequence
  Synthetic
tggaccuggctugcacac

SEQ ID NO: 8455 - DNA, 23 bp, Artificial Sequence
  Synthetic
guatcaaaatgcuccggagagga

SEQ ID NO: 8456 - DNA, 28 bp, Artificial Sequence
  Synthetic
gaactgaaauacgacttgtcatgugaac

SEQ ID NO: 8457 - DNA, 22 bp, Artificial Sequence
  Synthetic
ttccagtuatccagcaucaggc

SEQ ID NO: 8458 - DNA, 26 bp, Artificial Sequence
  Synthetic
gtgcaatgaauaacgaaaaugccaga

SEQ ID NO: 8459 - DNA, 24 bp, Artificial Sequence
  Synthetic
attatcctucggttcccaatugct

SEQ ID NO: 8460 - DNA, 31 bp, Artificial Sequence
  Synthetic
gggcaaattatgugtattcataagtttuggt

SEQ ID NO: 8461 - DNA, 22 bp, Artificial Sequence
  Synthetic
ggaaaccacutggcatgtugaa

SEQ ID NO: 8462 - DNA, 23 bp, Artificial Sequence
  Synthetic
gattaatgcugccgtggaaaugg

SEQ ID NO: 8463 - DNA, 29 bp, Artificial Sequence
  Synthetic
ttctgcatugagtaagtcuaacacaagat

SEQ ID NO: 8464 - DNA, 28 bp, Artificial Sequence
  Synthetic
cgtcttuacaaguaagagaactgatuga

SEQ ID NO: 8465 - DNA, 30 bp, Artificial Sequence
  Synthetic
ttttctatcacucaccaaataaatgcucat

SEQ ID NO: 8466 - DNA, 27 bp, Artificial Sequence
  Synthetic
ccttgtggucatctagtagtaugcaaa

SEQ ID NO: 8467 - DNA, 30 bp, Artificial Sequence
  Synthetic
agtttagacgatgutttggttcttctucat

SEQ ID NO: 8468 - DNA, 28 bp, Artificial Sequence
  Synthetic
agttgccatuccaagtgtcttattttug

SEQ ID NO: 8469 - DNA, 23 bp, Artificial Sequence
  Synthetic
tatgttgcuacaatcagcuccgt

SEQ ID NO: 8470 - DNA, 23 bp, Artificial Sequence
  Synthetic
tgttcccccugttatacccagut

SEQ ID NO: 8471 - DNA, 29 bp, Artificial Sequence
  Synthetic
agaatttcatctccuaattcacacacucg

SEQ ID NO: 8472 - DNA, 29 bp, Artificial Sequence
  Synthetic
acaacttatatgauctgctagtgaaugag

SEQ ID NO: 8473 - DNA, 31 bp, Artificial Sequence
  Synthetic
aacaggaaatttcuaaatgtgacatgaccua

SEQ ID NO: 8474 - DNA, 30 bp, Artificial Sequence
  Synthetic
ttaatatcaaagtaucctgcaagttuacct

SEQ ID NO: 8475 - DNA, 25 bp, Artificial Sequence
  Synthetic
gagctttctagguttgacctctugt

SEQ ID NO: 8476 - DNA, 21 bp, Artificial Sequence
  Synthetic
ctttggcacugaccaccagua

SEQ ID NO: 8477 - DNA, 24 bp, Artificial Sequence
  Synthetic
ggaggcactuctgtgctatttuct

SEQ ID NO: 8478 - DNA, 29 bp, Artificial Sequence
  Synthetic
gctaatacatauaaggcaaagcatuaggt

SEQ ID NO: 8479 - DNA, 28 bp, Artificial Sequence
  Synthetic
tccatcttgucaaaagttgtcugaagaa

SEQ ID NO: 8480 - DNA, 21 bp, Artificial Sequence
  Synthetic
gtgtcctuggctgctactgut

SEQ ID NO: 8481 - DNA, 32 bp, Artificial Sequence
  Synthetic
cacaggaatacauttcattcaaatttauccga

SEQ ID NO: 8482 - DNA, 27 bp, Artificial Sequence
  Synthetic
agccatctugaacatctttgtttcuct

SEQ ID NO: 8483 - DNA, 32 bp, Artificial Sequence
  Synthetic
acactactatcaggguaatcgttaaatagaut

SEQ ID NO: 8484 - DNA, 30 bp, Artificial Sequence
  Synthetic
aactgatgtgtuctgttaagcttauaaagt

SEQ ID NO: 8485 - DNA, 26 bp, Artificial Sequence
  Synthetic
ttctcagaguccatattgcttugacc

SEQ ID NO: 8486 - DNA, 32 bp, Artificial Sequence
  Synthetic
ctctatttcatattuaaccacagttctttucc

SEQ ID NO: 8487 - DNA, 32 bp, Artificial Sequence
  Synthetic
gatgattgucaguaagaaattgtgtaaauact

SEQ ID NO: 8488 - DNA, 28 bp, Artificial Sequence
  Synthetic
tctttttaagucccatagtgcugagaac

SEQ ID NO: 8489 - DNA, 25 bp, Artificial Sequence
  Synthetic
tcuttcacagattuacacagggcaa

SEQ ID NO: 8490 - DNA, 27 bp, Artificial Sequence
  Synthetic
ctggttttggaauggctaaatctucaa

SEQ ID NO: 8491 - DNA, 33 bp, Artificial Sequence
  Synthetic
acaaatttcacataugtcatgtataaactuacc

SEQ ID NO: 8492 - DNA, 30 bp, Artificial Sequence
  Synthetic
acagtcatcgaauacttttggaaauaaggt

SEQ ID NO: 8493 - DNA, 27 bp, Artificial Sequence
  Synthetic
gtcatcaataacuccaccacaatcuct

SEQ ID NO: 8494 - DNA, 30 bp, Artificial Sequence
  Synthetic
attgtagccgaguatctaattaaacaagut

SEQ ID NO: 8495 - DNA, 32 bp, Artificial Sequence
  Synthetic
caggtgatatatttuaagaattctgtgctuct

SEQ ID NO: 8496 - DNA, 20 bp, Artificial Sequence
  Synthetic
gccagacagccgugactuac

SEQ ID NO: 8497 - DNA, 33 bp, Artificial Sequence
  Synthetic
aaataccattttgaagaugagtcagaaaatuac

SEQ ID NO: 8498 - DNA, 30 bp, Artificial Sequence
  Synthetic
gcttaaccaatacgugttaaaagcaagtua

SEQ ID NO: 8499 - DNA, 27 bp, Artificial Sequence
  Synthetic
ctctcataatguccaccatctgatcut

SEQ ID NO: 8500 - DNA, 27 bp, Artificial Sequence
  Synthetic
ggagaagtgggucctatagatttcuct

SEQ ID NO: 8501 - DNA, 24 bp, Artificial Sequence
  Synthetic
gtgtgttatucaggtaggucagca

SEQ ID NO: 8502 - DNA, 32 bp, Artificial Sequence
  Synthetic
aaggtacaatgattuccacttctcttattuac

SEQ ID NO: 8503 - DNA, 32 bp, Artificial Sequence
  Synthetic
tgattttcactuagaggaatccacagattuat

SEQ ID NO: 8504 - DNA, 28 bp, Artificial Sequence
  Synthetic
aatcatggagaaauctgctttcuacaca

SEQ ID NO: 8505 - DNA, 30 bp, Artificial Sequence
  Synthetic
tccatctttctcuagaactgagttuacagt

SEQ ID NO: 8506 - DNA, 31 bp, Artificial Sequence
  Synthetic
tcactttacagcttuactctatgcagaaauc

SEQ ID NO: 8507 - DNA, 28 bp, Artificial Sequence
  Synthetic
actatatacccutattgagacaaugcca

SEQ ID NO: 8508 - DNA, 32 bp, Artificial Sequence
  Synthetic
gttttcaggatcutctcttagaaatcuacaga

SEQ ID NO: 8509 - DNA, 31 bp, Artificial Sequence
  Synthetic
cacacataactccutcataaacagaatuact

SEQ ID NO: 8510 - DNA, 31 bp, Artificial Sequence
  Synthetic
gattggattatgaaaauaaagactggtgucc

SEQ ID NO: 8511 - DNA, 26 bp, Artificial Sequence
  Synthetic
cagtugttgtttagaaugaggagaga

SEQ ID NO: 8512 - DNA, 22 bp, Artificial Sequence
  Synthetic
tcgctctaucccacactuagca

SEQ ID NO: 8513 - DNA, 30 bp, Artificial Sequence
  Synthetic
ttttaaagucactattgguaacagaaaagc

SEQ ID NO: 8514 - DNA, 27 bp, Artificial Sequence
  Synthetic
cccatatgtcautttcatttcagcucc

SEQ ID NO: 8515 - DNA, 22 bp, Artificial Sequence
  Synthetic
gggcaagacuctgctcctttut

SEQ ID NO: 8516 - DNA, 29 bp, Artificial Sequence
  Synthetic
atttaaattggutgtgttttctugaaggc

SEQ ID NO: 8517 - DNA, 28 bp, Artificial Sequence
  Synthetic
gtattgagtatcugaaaaccgggcuaat

SEQ ID NO: 8518 - DNA, 21 bp, Artificial Sequence
  Synthetic
ttggatgaautagcccugcgt

SEQ ID NO: 8519 - DNA, 24 bp, Artificial Sequence
  Synthetic
acuccagaatttucaagccagagg

SEQ ID NO: 8520 - DNA, 33 bp, Artificial Sequence
  Synthetic
tgcataaatctaatagutcttttcttacagcua

SEQ ID NO: 8521 - DNA, 23 bp, Artificial Sequence
  Synthetic
tctggctaccuctggtttaguca

SEQ ID NO: 8522 - DNA, 30 bp, Artificial Sequence
  Synthetic
tgttcctcagttugtcactaaaatctctuc

SEQ ID NO: 8523 - DNA, 32 bp, Artificial Sequence
  Synthetic
caaattacctuaatttccataguagggacaac

SEQ ID NO: 8524 - DNA, 22 bp, Artificial Sequence
  Synthetic
tgtcaugcaacaggtctuccag

SEQ ID NO: 8525 - DNA, 23 bp, Artificial Sequence
  Synthetic
cacccaaccaaauggcatcttut

SEQ ID NO: 8526 - DNA, 26 bp, Artificial Sequence
  Synthetic
tcttggauccagctatttggttugag

SEQ ID NO: 8527 - DNA, 22 bp, Artificial Sequence
  Synthetic
tcccccugcaactcagaatgua

SEQ ID NO: 8528 - DNA, 25 bp, Artificial Sequence
  Synthetic
caaaatcctucctactccugagaca

SEQ ID NO: 8529 - DNA, 22 bp, Artificial Sequence
  Synthetic
tgcccagcccaugtaatttuga

SEQ ID NO: 8530 - DNA, 25 bp, Artificial Sequence
  Synthetic
gaaggtccugttgtcagttttucag

SEQ ID NO: 8531 - DNA, 27 bp, Artificial Sequence
  Synthetic
cttcttccacucctttcagtttctcut

SEQ ID NO: 8532 - DNA, 25 bp, Artificial Sequence
  Synthetic
gtttaatttctgtucccagctgcuc

SEQ ID NO: 8533 - DNA, 28 bp, Artificial Sequence
  Synthetic
tgacttgcacaautcacattgatttuca

SEQ ID NO: 8534 - DNA, 25 bp, Artificial Sequence
  Synthetic
ctcgcugagaggagtuacagaaaat

SEQ ID NO: 8535 - DNA, 25 bp, Artificial Sequence
  Synthetic
tttttgctggutcgtgtttucaaga

SEQ ID NO: 8536 - DNA, 27 bp, Artificial Sequence
  Synthetic
aggtagcgugagaataatatccuccat

SEQ ID NO: 8537 - DNA, 22 bp, Artificial Sequence
  Synthetic
gatgctttugttggatgaugcc

SEQ ID NO: 8538 - DNA, 20 bp, Artificial Sequence
  Synthetic
cctcccaugtgtttgcugac

SEQ ID NO: 8539 - DNA, 25 bp, Artificial Sequence
  Synthetic
gatgtatagcaugttctcccaccuc

SEQ ID NO: 8540 - DNA, 25 bp, Artificial Sequence
  Synthetic
atcagtaacucccgttucaaacagt

SEQ ID NO: 8541 - DNA, 28 bp, Artificial Sequence
  Synthetic
acacagauaaattuaccaaaggacacca

SEQ ID NO: 8542 - DNA, 21 bp, Artificial Sequence
  Synthetic
ggcctcucagctgaccattut

SEQ ID NO: 8543 - DNA, 30 bp, Artificial Sequence
  Synthetic
tcttcatttuggagaguctaataaactgut

SEQ ID NO: 8544 - DNA, 20 bp, Artificial Sequence
  Synthetic
ctcaugaaggacgcctucca

SEQ ID NO: 8545 - DNA, 17 bp, Artificial Sequence
  Synthetic
gcucagccggccttuca

SEQ ID NO: 8546 - DNA, 25 bp, Artificial Sequence
  Synthetic
catcttgtauggtgaatttggugca

SEQ ID NO: 8547 - DNA, 22 bp, Artificial Sequence
  Synthetic
tgtgtctcccugaaagagucca

SEQ ID NO: 8548 - DNA, 23 bp, Artificial Sequence
  Synthetic
tgccctcugagttggttguacat

SEQ ID NO: 8549 - DNA, 24 bp, Artificial Sequence
  Synthetic
agctttcactucgtcatacgucaa

SEQ ID NO: 8550 - DNA, 27 bp, Artificial Sequence
  Synthetic
gcactggcaaautggcttaaauaaaac

SEQ ID NO: 8551 - DNA, 32 bp, Artificial Sequence
  Synthetic
gtgatatggttaucatgtgaaacaaaacucac

SEQ ID NO: 8552 - DNA, 22 bp, Artificial Sequence
  Synthetic
cgtggtagauccgtttgaucct

SEQ ID NO: 8553 - DNA, 23 bp, Artificial Sequence
  Synthetic
ccagtctccuaaactgccatcut

SEQ ID NO: 8554 - DNA, 22 bp, Artificial Sequence
  Synthetic
cutcgagatctuccaccaccac

SEQ ID NO: 8555 - DNA, 19 bp, Artificial Sequence
  Synthetic
agtcuccaaggcggcuaga

SEQ ID NO: 8556 - DNA, 24 bp, Artificial Sequence
  Synthetic
cccattagtagguccagagtguga

SEQ ID NO: 8557 - DNA, 28 bp, Artificial Sequence
  Synthetic
gcaagtaagcuttttacaaguaacaact

SEQ ID NO: 8558 - DNA, 28 bp, Artificial Sequence
  Synthetic
ttgaaatgtatuagaagatgaagugcgt

SEQ ID NO: 8559 - DNA, 23 bp, Artificial Sequence
  Synthetic
gctttgggacaucatacccauca

SEQ ID NO: 8560 - DNA, 24 bp, Artificial Sequence
  Synthetic
tactccuaccaggacauccagaaa

SEQ ID NO: 8561 - DNA, 21 bp, Artificial Sequence
  Synthetic
cuaaaccugcagcagggagat

SEQ ID NO: 8562 - DNA, 29 bp, Artificial Sequence
  Synthetic
gtcttttccttuctctgttttctctucct

SEQ ID NO: 8563 - DNA, 20 bp, Artificial Sequence
  Synthetic
ggattguctccacugaccgt

SEQ ID NO: 8564 - DNA, 23 bp, Artificial Sequence
  Synthetic
cacttgccgacuctgaaguagag

SEQ ID NO: 8565 - DNA, 21 bp, Artificial Sequence
  Synthetic
tccccattcutacccccauga

SEQ ID NO: 8566 - DNA, 25 bp, Artificial Sequence
  Synthetic
cagaaacagaucctggagatguact

SEQ ID NO: 8567 - DNA, 26 bp, Artificial Sequence
  Synthetic
gggctguaaagaagaauacagaagaa

SEQ ID NO: 8568 - DNA, 30 bp, Artificial Sequence
  Synthetic
tgttggagttacugatgcataatcattuct

SEQ ID NO: 8569 - DNA, 26 bp, Artificial Sequence
  Synthetic
agggtcaaatugtgaaactacauggt

SEQ ID NO: 8570 - DNA, 25 bp, Artificial Sequence
  Synthetic
gcgttgtuacaccttttgttugcat

SEQ ID NO: 8571 - DNA, 29 bp, Artificial Sequence
  Synthetic
tgagctgagcuacatatctattaagaugt

SEQ ID NO: 8572 - DNA, 23 bp, Artificial Sequence
  Synthetic
tgacuaaacttgaugcagagcga

SEQ ID NO: 8573 - DNA, 27 bp, Artificial Sequence
  Synthetic
cttcaagcauaactagtatcucagcag

SEQ ID NO: 8574 - DNA, 24 bp, Artificial Sequence
  Synthetic
acttatccacacccucatctguga

SEQ ID NO: 8575 - DNA, 27 bp, Artificial Sequence
  Synthetic
cctgaagcuacagaagacatggaatug

SEQ ID NO: 8576 - DNA, 22 bp, Artificial Sequence
  Synthetic
tgctgttuctcattguccacct

SEQ ID NO: 8577 - DNA, 24 bp, Artificial Sequence
  Synthetic
ttgggtggauctgtctctaaguca

SEQ ID NO: 8578 - DNA, 30 bp, Artificial Sequence
  Synthetic
tgtctacactgaaugtgttactaacgttut

SEQ ID NO: 8579 - DNA, 25 bp, Artificial Sequence
  Synthetic
tccttacccaugtcagcaaatctuc

SEQ ID NO: 8580 - DNA, 30 bp, Artificial Sequence
  Synthetic
tgaaggatattautcccactcaaaugcaaa

SEQ ID NO: 8581 - DNA, 24 bp, Artificial Sequence
  Synthetic
ggatattgggugtttcgttgtugt

SEQ ID NO: 8582 - DNA, 26 bp, Artificial Sequence
  Synthetic
ctagatttauacacgttgctgcugga

SEQ ID NO: 8583 - DNA, 24 bp, Artificial Sequence
  Synthetic
cttaatgacagggcuaaacgtgug

SEQ ID NO: 8584 - DNA, 28 bp, Artificial Sequence
  Synthetic
cgatgatguttagataccucaggaaggt

SEQ ID NO: 8585 - DNA, 24 bp, Artificial Sequence
  Synthetic
tcttcagaagagugtaccuggact

SEQ ID NO: 8586 - DNA, 23 bp, Artificial Sequence
  Synthetic
gcagccugaggttatagttguga

SEQ ID NO: 8587 - DNA, 22 bp, Artificial Sequence
  Synthetic
ggaaatgtugccagtcttccug

SEQ ID NO: 8588 - DNA, 24 bp, Artificial Sequence
  Synthetic
tgatgacaguggagagcactttut

SEQ ID NO: 8589 - DNA, 26 bp, Artificial Sequence
  Synthetic
agtgtgaaagauacttgcctgagaug

SEQ ID NO: 8590 - DNA, 22 bp, Artificial Sequence
  Synthetic
cctcctcutgtgcagatucaca

SEQ ID NO: 8591 - DNA, 24 bp, Artificial Sequence
  Synthetic
tcttccccuctgctaaatgttuct

SEQ ID NO: 8592 - DNA, 27 bp, Artificial Sequence
  Synthetic
gctgtgaauagagtaacugaagaagca

SEQ ID NO: 8593 - DNA, 31 bp, Artificial Sequence
  Synthetic
ctctcctgtgaccauagaattttactacaut

SEQ ID NO: 8594 - DNA, 26 bp, Artificial Sequence
  Synthetic
tttgtttuagagccagacauaggcat

SEQ ID NO: 8595 - DNA, 24 bp, Artificial Sequence
  Synthetic
ccuaagagggaugcagagagaaac

SEQ ID NO: 8596 - DNA, 28 bp, Artificial Sequence
  Synthetic
actgggacttgcuttgtttttagaatug

SEQ ID NO: 8597 - DNA, 30 bp, Artificial Sequence
  Synthetic
caagaaatcggtacuctttcactcaagaua

SEQ ID NO: 8598 - DNA, 21 bp, Artificial Sequence
  Synthetic
gagtcactucaggtggtgugt

SEQ ID NO: 8599 - DNA, 31 bp, Artificial Sequence
  Synthetic
gggaatactacaaucaaaaactactcaauct

SEQ ID NO: 8600 - DNA, 23 bp, Artificial Sequence
  Synthetic
cagcggtuggtcaaaagaaugac

SEQ ID NO: 8601 - DNA, 30 bp, Artificial Sequence
  Synthetic
aaacacacctgatucatacaacttttctuc

SEQ ID NO: 8602 - DNA, 21 bp, Artificial Sequence
  Synthetic
gatttggctucctgccacaug

SEQ ID NO: 8603 - DNA, 26 bp, Artificial Sequence
  Synthetic
tttggauaaacagggaagugaacact

SEQ ID NO: 8604 - DNA, 26 bp, Artificial Sequence
  Synthetic
gccctatgtauctaagtgaccaugaa

SEQ ID NO: 8605 - DNA, 22 bp, Artificial Sequence
  Synthetic
gctauggtgtcacuagcaaccc

SEQ ID NO: 8606 - DNA, 23 bp, Artificial Sequence
  Synthetic
ggctgctcugatttgctactuga

SEQ ID NO: 8607 - DNA, 21 bp, Artificial Sequence
  Synthetic
cagctgatucaggtccctcug

SEQ ID NO: 8608 - DNA, 22 bp, Artificial Sequence
  Synthetic
cacgutcatcaccuagaaagcc

SEQ ID NO: 8609 - DNA, 21 bp, Artificial Sequence
  Synthetic
ggcagagcacguagatucact

SEQ ID NO: 8610 - DNA, 27 bp, Artificial Sequence
  Synthetic
aaattcagatgcugaaatcgaatggug

SEQ ID NO: 8611 - DNA, 26 bp, Artificial Sequence
  Synthetic
atcaaaagtcucacatgccatuacct

SEQ ID NO: 8612 - DNA, 30 bp, Artificial Sequence
  Synthetic
agttctcagataguaaacagcacatugaag

SEQ ID NO: 8613 - DNA, 24 bp, Artificial Sequence
  Synthetic
caaaaacagcacagguaacgctua

SEQ ID NO: 8614 - DNA, 28 bp, Artificial Sequence
  Synthetic
aaaatctucaagagcagctuagagacaa

SEQ ID NO: 8615 - DNA, 22 bp, Artificial Sequence
  Synthetic
ccacucactttctcugcaaggg

SEQ ID NO: 8616 - DNA, 27 bp, Artificial Sequence
  Synthetic
ctagatgtgugttccttctttuaggct

SEQ ID NO: 8617 - DNA, 22 bp, Artificial Sequence
  Synthetic
actcctccutcttctgcuccaa

SEQ ID NO: 8618 - DNA, 24 bp, Artificial Sequence
  Synthetic
ttcagccatuccttattgtcacug

SEQ ID NO: 8619 - DNA, 22 bp, Artificial Sequence
  Synthetic
acctgtuccttgtgctucagat

SEQ ID NO: 8620 - DNA, 24 bp, Artificial Sequence
  Synthetic
gacactctgutgttctcttuccca

SEQ ID NO: 8621 - DNA, 24 bp, Artificial Sequence
  Synthetic
cttctctcugcccgaagattaguc

SEQ ID NO: 8622 - DNA, 30 bp, Artificial Sequence
  Synthetic
actcgttacttuacagtgtgtcauagaaac

SEQ ID NO: 8623 - DNA, 24 bp, Artificial Sequence
  Synthetic
atgggaggatutgaagtggtcauc

SEQ ID NO: 8624 - DNA, 24 bp, Artificial Sequence
  Synthetic
acatacagagugcctttgtcatut

SEQ ID NO: 8625 - DNA, 21 bp, Artificial Sequence
  Synthetic
gttctgcautgtcccgtucac

SEQ ID NO: 8626 - DNA, 21 bp, Artificial Sequence
  Synthetic
tctccccucccctuccaaaaa

SEQ ID NO: 8627 - DNA, 18 bp, Artificial Sequence
  Synthetic
tcgtcucggagcaggtug

SEQ ID NO: 8628 - DNA, 22 bp, Artificial Sequence
  Synthetic
gccuccaaacucaaagagacca

SEQ ID NO: 8629 - DNA, 25 bp, Artificial Sequence
  Synthetic
gcagtggtgauagaaggcatatugt

SEQ ID NO: 8630 - DNA, 21 bp, Artificial Sequence
  Synthetic
gctcacttgugatgcccugac

SEQ ID NO: 8631 - DNA, 23 bp, Artificial Sequence
  Synthetic
aatcaaatccgucgtctcctucc

SEQ ID NO: 8632 - DNA, 23 bp, Artificial Sequence
  Synthetic
tgatctcuctcgctgugagacat

SEQ ID NO: 8633 - DNA, 19 bp, Artificial Sequence
  Synthetic
caacugcaacagcctgcuc

SEQ ID NO: 8634 - DNA, 22 bp, Artificial Sequence
  Synthetic
gctcaagugggctgaaaaugag

SEQ ID NO: 8635 - DNA, 25 bp, Artificial Sequence
  Synthetic
ctaagagacuttccaagtugggcat

SEQ ID NO: 8636 - DNA, 19 bp, Artificial Sequence
  Synthetic
ccgctccaggucacctauc

SEQ ID NO: 8637 - DNA, 22 bp, Artificial Sequence
  Synthetic
gtaggactccuggtggttgtuc

SEQ ID NO: 8638 - DNA, 22 bp, Artificial Sequence
  Synthetic
catcaaccuctctcaucgggaa

SEQ ID NO: 8639 - DNA, 22 bp, Artificial Sequence
  Synthetic
gactttgucaggtccccaugat

SEQ ID NO: 8640 - DNA, 21 bp, Artificial Sequence
  Synthetic
ccugcgccactacuacaaact

SEQ ID NO: 8641 - DNA, 25 bp, Artificial Sequence
  Synthetic
cgataggcagguagagatctuaaca

SEQ ID NO: 8642 - DNA, 22 bp, Artificial Sequence
  Synthetic
tcccaccugcattgttcaucat

SEQ ID NO: 8643 - DNA, 25 bp, Artificial Sequence
  Synthetic
gggcttcauacaagagagtacucac

SEQ ID NO: 8644 - DNA, 22 bp, Artificial Sequence
  Synthetic
gccttacagutggcaaguccag

SEQ ID NO: 8645 - DNA, 25 bp, Artificial Sequence
  Synthetic
cacaagtatcugctgtccaucagag

SEQ ID NO: 8646 - DNA, 31 bp, Artificial Sequence
  Synthetic
cggaaaattacugaagaacatttaccattua

SEQ ID NO: 8647 - DNA, 20 bp, Artificial Sequence
  Synthetic
ccaggacugcaactcggtut

SEQ ID NO: 8648 - DNA, 20 bp, Artificial Sequence
  Synthetic
cgagucgcctctactuccct

SEQ ID NO: 8649 - DNA, 22 bp, Artificial Sequence
  Synthetic
cggaaacagaguggtcatuccc

SEQ ID NO: 8650 - DNA, 22 bp, Artificial Sequence
  Synthetic
ctcttgcaggucctcauaccag

SEQ ID NO: 8651 - DNA, 24 bp, Artificial Sequence
  Synthetic
tggcatagacugtttgctacaugg

SEQ ID NO: 8652 - DNA, 22 bp, Artificial Sequence
  Synthetic
gactccuccatctcagguacca

SEQ ID NO: 8653 - DNA, 21 bp, Artificial Sequence
  Synthetic
tcctgaccagagutctccugt

SEQ ID NO: 8654 - DNA, 21 bp, Artificial Sequence
  Synthetic
tctggctucagatctcgguga

SEQ ID NO: 8655 - DNA, 23 bp, Artificial Sequence
  Synthetic
agaggtggatugggacctttgua

SEQ ID NO: 8656 - DNA, 21 bp, Artificial Sequence
  Synthetic
cctccagucgcctcaguaaag

SEQ ID NO: 8657 - DNA, 20 bp, Artificial Sequence
  Synthetic
tggctgaaautggtgucggt

SEQ ID NO: 8658 - DNA, 21 bp, Artificial Sequence
  Synthetic
ttcggctguctaccattugca

SEQ ID NO: 8659 - DNA, 21 bp, Artificial Sequence
  Synthetic
acactctgggutgaccccuat

SEQ ID NO: 8660 - DNA, 19 bp, Artificial Sequence
  Synthetic
aggctcuggctgaagguct

SEQ ID NO: 8661 - DNA, 20 bp, Artificial Sequence
  Synthetic
ccccatgcaucccttcuaca

SEQ ID NO: 8662 - DNA, 18 bp, Artificial Sequence
  Synthetic
tgtgcgcgagugagugag

SEQ ID NO: 8663 - DNA, 18 bp, Artificial Sequence
  Synthetic
tcctcguctcggcucgaa

SEQ ID NO: 8664 - DNA, 20 bp, Artificial Sequence
  Synthetic
cagatgccucccccaucaaa

SEQ ID NO: 8665 - DNA, 20 bp, Artificial Sequence
  Synthetic
caccuccagaggccacauac

SEQ ID NO: 8666 - DNA, 27 bp, Artificial Sequence
  Synthetic
ctctcaacaaaacuccgaagagatgua

SEQ ID NO: 8667 - DNA, 27 bp, Artificial Sequence
  Synthetic
tcttcttggauttgcacttgguaaact

SEQ ID NO: 8668 - DNA, 20 bp, Artificial Sequence
  Synthetic
ttctcagaggaccuggcuga

SEQ ID NO: 8669 - DNA, 24 bp, Artificial Sequence
  Synthetic
gtgcttttcuccacctttccatut

SEQ ID NO: 8670 - DNA, 17 bp, Artificial Sequence
  Synthetic
cggctuccgcauccact

SEQ ID NO: 8671 - DNA, 17 bp, Artificial Sequence
  Synthetic
gccttccugcgcttcug

SEQ ID NO: 8672 - DNA, 18 bp, Artificial Sequence
  Synthetic
acgtgguaaccgccguag

SEQ ID NO: 8673 - DNA, 19 bp, Artificial Sequence
  Synthetic
tcgccaccaugtacgugag

SEQ ID NO: 8674 - DNA, 27 bp, Artificial Sequence
  Synthetic
caaatttgtcugtcactggtuaaaact

SEQ ID NO: 8675 - DNA, 28 bp, Artificial Sequence
  Synthetic
tttatgttcagatucttctgcaggtuca

SEQ ID NO: 8676 - DNA, 27 bp, Artificial Sequence
  Synthetic
caggaaggaaugttcccaataguagac

SEQ ID NO: 8677 - DNA, 32 bp, Artificial Sequence
  Synthetic
ataatagcttcaucatacctttcacuaagaca

SEQ ID NO: 8678 - DNA, 32 bp, Artificial Sequence
  Synthetic
gctatttttccaaucatgatgaaagtcugaag

SEQ ID NO: 8679 - DNA, 29 bp, Artificial Sequence
  Synthetic
acctgtagttcaacuaaacagaggactua

SEQ ID NO: 8680 - DNA, 32 bp, Artificial Sequence
  Synthetic
caaaaagtaagaacuagcaagacuaggaaaaa

SEQ ID NO: 8681 - DNA, 25 bp, Artificial Sequence
  Synthetic
agggcttcugatttgctacattuga

SEQ ID NO: 8682 - DNA, 28 bp, Artificial Sequence
  Synthetic
tcagagaagccautaaaugaggaaacag

SEQ ID NO: 8683 - DNA, 24 bp, Artificial Sequence
  Synthetic
ctgaaaugaagaagccacuggaga

SEQ ID NO: 8684 - DNA, 25 bp, Artificial Sequence
  Synthetic
ttctgtagcuttgaagaaugcaggt

SEQ ID NO: 8685 - DNA, 26 bp, Artificial Sequence
  Synthetic
cttcaaaagcauttgcttcaaacugg

SEQ ID NO: 8686 - DNA, 32 bp, Artificial Sequence
  Synthetic
aatctctcaggaucttgattauaaagaagcaa

SEQ ID NO: 8687 - DNA, 30 bp, Artificial Sequence
  Synthetic
agccaagaccucttcttttatatcugaaac

SEQ ID NO: 8688 - DNA, 31 bp, Artificial Sequence
  Synthetic
catggaaaagaaucaagatgtatgtgcttua

SEQ ID NO: 8689 - DNA, 30 bp, Artificial Sequence
  Synthetic
ttttggattactcutagatttgtgtttugg

SEQ ID NO: 8690 - DNA, 27 bp, Artificial Sequence
  Synthetic
tctugcagaggagaauaaaaatagugt

SEQ ID NO: 8691 - DNA, 29 bp, Artificial Sequence
  Synthetic
cctgcccatttgutcatgtaatcattaut

SEQ ID NO: 8692 - DNA, 32 bp, Artificial Sequence
  Synthetic
cagagtagtgtagutgtttctgattguaaaaa

SEQ ID NO: 8693 - DNA, 32 bp, Artificial Sequence
  Synthetic
tcaaactgacttccugattcttctaatauagt

SEQ ID NO: 8694 - DNA, 23 bp, Artificial Sequence
  Synthetic
gcttttatuctgctcauggcaca

SEQ ID NO: 8695 - DNA, 30 bp, Artificial Sequence
  Synthetic
acaacagaatcaugacatttactugaagat

SEQ ID NO: 8696 - DNA, 30 bp, Artificial Sequence
  Synthetic
tgaagataacaaatauactgctgccaguag

SEQ ID NO: 8697 - DNA, 23 bp, Artificial Sequence
  Synthetic
cctccutcataaacuggccagat

SEQ ID NO: 8698 - DNA, 30 bp, Artificial Sequence
  Synthetic
ccagaagaatugcataacttttcctuaaat

SEQ ID NO: 8699 - DNA, 23 bp, Artificial Sequence
  Synthetic
cagtaccaacugggacacttuct

SEQ ID NO: 8700 - DNA, 28 bp, Artificial Sequence
  Synthetic
gaattagcatgugagaccattgagauca

SEQ ID NO: 8701 - DNA, 30 bp, Artificial Sequence
  Synthetic
gatgttttgagautttcagtttgtcuacat

SEQ ID NO: 8702 - DNA, 29 bp, Artificial Sequence
  Synthetic
ggcttagagaaggaauatttgatggucaa

SEQ ID NO: 8703 - DNA, 32 bp, Artificial Sequence
  Synthetic
gctgttagacaugctactgttacttaaauaag

SEQ ID NO: 8704 - DNA, 29 bp, Artificial Sequence
  Synthetic
aaatgaagatattugcgttgaggaactug

SEQ ID NO: 8705 - DNA, 26 bp, Artificial Sequence
  Synthetic
acacaaacgattutaccactggcuat

SEQ ID NO: 8706 - DNA, 32 bp, Artificial Sequence
  Synthetic
ctgacattcagagugaagaaatttuacaacat

SEQ ID NO: 8707 - DNA, 25 bp, Artificial Sequence
  Synthetic
cccacaaguatttgcagaugagact

SEQ ID NO: 8708 - DNA, 32 bp, Artificial Sequence
  Synthetic
gcttttcatataaugtggtaaattcatcugct

SEQ ID NO: 8709 - DNA, 28 bp, Artificial Sequence
  Synthetic
ttgtctagacguaggtgaatagugaaga

SEQ ID NO: 8710 - DNA, 28 bp, Artificial Sequence
  Synthetic
caaagtgtcacutgttgagaacatucat

SEQ ID NO: 8711 - DNA, 32 bp, Artificial Sequence
  Synthetic
aagtagttttctgaauctttggagtaaguaga

SEQ ID NO: 8712 - DNA, 28 bp, Artificial Sequence
  Synthetic
tttccuaggcacaataaaagaucgaaga

SEQ ID NO: 8713 - DNA, 33 bp, Artificial Sequence
  Synthetic
cgagacttttctcauactgtattagaattuaga

SEQ ID NO: 8714 - DNA, 26 bp, Artificial Sequence
  Synthetic
acagagtugaacagtgtgtuaggaat

SEQ ID NO: 8715 - DNA, 32 bp, Artificial Sequence
  Synthetic
cttgattggagtugtttttgttaaactgauga

SEQ ID NO: 8716 - DNA, 29 bp, Artificial Sequence
  Synthetic
ttttgtgtgtgtutattttgtgtagcugt

SEQ ID NO: 8717 - DNA, 21 bp, Artificial Sequence
  Synthetic
catccaccaucagccaacugt

SEQ ID NO: 8718 - DNA, 30 bp, Artificial Sequence
  Synthetic
tgcctttccuaaggaatttgctaatagaug

SEQ ID NO: 8719 - DNA, 22 bp, Artificial Sequence
  Synthetic
caactggctugtgcaacattut

SEQ ID NO: 8720 - DNA, 26 bp, Artificial Sequence
  Synthetic
cccctcttagcugtcttaaagaaugg

SEQ ID NO: 8721 - DNA, 28 bp, Artificial Sequence
  Synthetic
caatgactgatutttaccaagagugcaa

SEQ ID NO: 8722 - DNA, 24 bp, Artificial Sequence
  Synthetic
tgcctggccugatacaattaacut

SEQ ID NO: 8723 - DNA, 21 bp, Artificial Sequence
  Synthetic
agtctctttugttgggccucc

SEQ ID NO: 8724 - DNA, 30 bp, Artificial Sequence
  Synthetic
atttgtcctgttuaaagccatctagtuaca

SEQ ID NO: 8725 - DNA, 29 bp, Artificial Sequence
  Synthetic
actggatctgagcutgtttcttatcatuc

SEQ ID NO: 8726 - DNA, 32 bp, Artificial Sequence
  Synthetic
gagatacagaattuatcatcttgcaactucaa

SEQ ID NO: 8727 - DNA, 32 bp, Artificial Sequence
  Synthetic
ccataaacuaacaaguacttatcaaaacugaa

SEQ ID NO: 8728 - DNA, 19 bp, Artificial Sequence
  Synthetic
gcugcaagcaaccuccagt

SEQ ID NO: 8729 - DNA, 24 bp, Artificial Sequence
  Synthetic
gtgtggtgaugctgaaaaguaacc

SEQ ID NO: 8730 - DNA, 28 bp, Artificial Sequence
  Synthetic
cccagatgacutcaaagtcttguaaagg

SEQ ID NO: 8731 - DNA, 21 bp, Artificial Sequence
  Synthetic
gugcagucggagaaacaaaug

SEQ ID NO: 8732 - DNA, 23 bp, Artificial Sequence
  Synthetic
gctcccaccagutcagaagatua

SEQ ID NO: 8733 - DNA, 30 bp, Artificial Sequence
  Synthetic
tcgcctttgcaaaugcttagatatatttut

SEQ ID NO: 8734 - DNA, 29 bp, Artificial Sequence
  Synthetic
ggaaattgaagutgtgaggaugaagagaa

SEQ ID NO: 8735 - DNA, 24 bp, Artificial Sequence
  Synthetic
agagccgaugaaacaaagugagaa

SEQ ID NO: 8736 - DNA, 22 bp, Artificial Sequence
  Synthetic
cctgagcaggguctgcataauc

SEQ ID NO: 8737 - DNA, 29 bp, Artificial Sequence
  Synthetic
acatttacctgtguttttcttcctctugt

SEQ ID NO: 8738 - DNA, 26 bp, Artificial Sequence
  Synthetic
agatattgaguctgaggactucagca

SEQ ID NO: 8739 - DNA, 26 bp, Artificial Sequence
  Synthetic
tgtactgttgcauatttcacctcugg

SEQ ID NO: 8740 - DNA, 24 bp, Artificial Sequence
  Synthetic
gctttcugaaggaggtagagucaa

SEQ ID NO: 8741 - DNA, 27 bp, Artificial Sequence
  Synthetic
gggtgctagttuatagaattcagaguc

SEQ ID NO: 8742 - DNA, 24 bp, Artificial Sequence
  Synthetic
gccatuaagagagctctugacgat

SEQ ID NO: 8743 - DNA, 26 bp, Artificial Sequence
  Synthetic
agtgttgcaguaaacggtattcctut

SEQ ID NO: 8744 - DNA, 27 bp, Artificial Sequence
  Synthetic
tcaaagaatgaaacacaugctgaagug

SEQ ID NO: 8745 - DNA, 26 bp, Artificial Sequence
  Synthetic
ctacttgttucttgcaaacugacagg

SEQ ID NO: 8746 - DNA, 25 bp, Artificial Sequence
  Synthetic
agaattcccugaaactuccaaacct

SEQ ID NO: 8747 - DNA, 23 bp, Artificial Sequence
  Synthetic
tcttccgcauctttctcagctuc

SEQ ID NO: 8748 - DNA, 19 bp, Artificial Sequence
  Synthetic
cctgggcgucactgtguac

SEQ ID NO: 8749 - DNA, 23 bp, Artificial Sequence
  Synthetic
gcuccaaacagccagataucact

SEQ ID NO: 8750 - DNA, 24 bp, Artificial Sequence
  Synthetic
attctcaaugaattcccugggcat

SEQ ID NO: 8751 - DNA, 23 bp, Artificial Sequence
  Synthetic
tcacatgtuacagcatgacagut

SEQ ID NO: 8752 - DNA, 24 bp, Artificial Sequence
  Synthetic
cuggaacagaaugaagacagauga

SEQ ID NO: 8753 - DNA, 24 bp, Artificial Sequence
  Synthetic
tctgctctaugccccaaaauaaga

SEQ ID NO: 8754 - DNA, 28 bp, Artificial Sequence
  Synthetic
ccagaagagaggcauaacaaatacctua

SEQ ID NO: 8755 - DNA, 28 bp, Artificial Sequence
  Synthetic
agatgaacttucagcatcttcactugaa

SEQ ID NO: 8756 - DNA, 24 bp, Artificial Sequence
  Synthetic
aaagaaggaaacuaagacgugcga

SEQ ID NO: 8757 - DNA, 20 bp, Artificial Sequence
  Synthetic
aaagaccgugccaccagtua

SEQ ID NO: 8758 - DNA, 23 bp, Artificial Sequence
  Synthetic
agaacaccagacugtgcaaucat

SEQ ID NO: 8759 - DNA, 29 bp, Artificial Sequence
  Synthetic
aagaaaaagtucagtgacatctcugagaa

SEQ ID NO: 8760 - DNA, 25 bp, Artificial Sequence
  Synthetic
gcactaaccugatatguccagaagg

SEQ ID NO: 8761 - DNA, 25 bp, Artificial Sequence
  Synthetic
caacagtacccuttctggaaagcua

SEQ ID NO: 8762 - DNA, 31 bp, Artificial Sequence
  Synthetic
actaacaactttaagucttcctttccgatut

SEQ ID NO: 8763 - DNA, 23 bp, Artificial Sequence
  Synthetic
ctccgaagccucaaagctaauca

SEQ ID NO: 8764 - DNA, 33 bp, Artificial Sequence
  Synthetic
aatatctctgaagutgtttttaattttgugggt

SEQ ID NO: 8765 - DNA, 21 bp, Artificial Sequence
  Synthetic
gcttgcuggtgccattuacat

SEQ ID NO: 8766 - DNA, 23 bp, Artificial Sequence
  Synthetic
gggtcttcauaaaggtgctuggt

SEQ ID NO: 8767 - DNA, 23 bp, Artificial Sequence
  Synthetic
gggatagtguaaatgcttcugca

SEQ ID NO: 8768 - DNA, 25 bp, Artificial Sequence
  Synthetic
cagctcacugaaaggttcttttgut

SEQ ID NO: 8769 - DNA, 22 bp, Artificial Sequence
  Synthetic
gggctgcuatttaaccagcugt

SEQ ID NO: 8770 - DNA, 27 bp, Artificial Sequence
  Synthetic
cagaaucagtggtugaaaaaggagaaa

SEQ ID NO: 8771 - DNA, 20 bp, Artificial Sequence
  Synthetic
ggaggagagccugatgugga

SEQ ID NO: 8772 - DNA, 27 bp, Artificial Sequence
  Synthetic
ggcacactgaauaattaactgcucaaa

SEQ ID NO: 8773 - DNA, 21 bp, Artificial Sequence
  Synthetic
tttaaccuggagcggctugaa

SEQ ID NO: 8774 - DNA, 23 bp, Artificial Sequence
  Synthetic
gcacgggtauttcctgcttguag

SEQ ID NO: 8775 - DNA, 27 bp, Artificial Sequence
  Synthetic
tcagcagatcutacagcaattaauggt

SEQ ID NO: 8776 - DNA, 27 bp, Artificial Sequence
  Synthetic
tctgttctttugcaaacaggatcucat

SEQ ID NO: 8777 - DNA, 24 bp, Artificial Sequence
  Synthetic
cagcatactttaucgccttcacug

SEQ ID NO: 8778 - DNA, 26 bp, Artificial Sequence
  Synthetic
agtgatgtcuggtaagaatcccucaa

SEQ ID NO: 8779 - DNA, 29 bp, Artificial Sequence
  Synthetic
cccctgagtaugaaacttttgcagaauat

SEQ ID NO: 8780 - DNA, 28 bp, Artificial Sequence
  Synthetic
gcttcagacttcucaatatcttccauga

SEQ ID NO: 8781 - DNA, 31 bp, Artificial Sequence
  Synthetic
catatacaaacauacagctttggtaugaaac

SEQ ID NO: 8782 - DNA, 27 bp, Artificial Sequence
  Synthetic
ttccttttccuaagcaagacgttttug

SEQ ID NO: 8783 - DNA, 31 bp, Artificial Sequence
  Synthetic
aatggttttaacuacacctttacctgaugaa

SEQ ID NO: 8784 - DNA, 30 bp, Artificial Sequence
  Synthetic
ggttgcaatttautttcattcgtataugct

SEQ ID NO: 8785 - DNA, 28 bp, Artificial Sequence
  Synthetic
agcgatgtgcauatataatggaaaggut

SEQ ID NO: 8786 - DNA, 25 bp, Artificial Sequence
  Synthetic
acatatggugggaaaacgtcaucat

SEQ ID NO: 8787 - DNA, 23 bp, Artificial Sequence
  Synthetic
tuctgtagguacagaggcagaca

SEQ ID NO: 8788 - DNA, 25 bp, Artificial Sequence
  Synthetic
gcactttguctgtatatgucccgaa

SEQ ID NO: 8789 - DNA, 26 bp, Artificial Sequence
  Synthetic
cagagcuggcttatatcaguagcaat

SEQ ID NO: 8790 - DNA, 22 bp, Artificial Sequence
  Synthetic
aactgctgucgctcatatggut

SEQ ID NO: 8791 - DNA, 29 bp, Artificial Sequence
  Synthetic
agctgcacaggaaauttttattgttuaca

SEQ ID NO: 8792 - DNA, 26 bp, Artificial Sequence
  Synthetic
tgcttcttctaautccatcagcaguc

SEQ ID NO: 8793 - DNA, 27 bp, Artificial Sequence
  Synthetic
actgcagtatugataccttttgttuct

SEQ ID NO: 8794 - DNA, 26 bp, Artificial Sequence
  Synthetic
aaacctaaaucagacaaccaaggcua

SEQ ID NO: 8795 - DNA, 31 bp, Artificial Sequence
  Synthetic
gggaatactcaaaccuagaagtaaatgcauc

SEQ ID NO: 8796 - DNA, 26 bp, Artificial Sequence
  Synthetic
tgctccagtatuagtgttcgcatuag

SEQ ID NO: 8797 - DNA, 20 bp, Artificial Sequence
  Synthetic
ctttgcaaccccucagcaug

SEQ ID NO: 8798 - DNA, 20 bp, Artificial Sequence
  Synthetic
gaagggcauctggcagaugt

SEQ ID NO: 8799 - DNA, 19 bp, Artificial Sequence
  Synthetic
acugcagcaactugacggt

SEQ ID NO: 8800 - DNA, 17 bp, Artificial Sequence
  Synthetic
agtgcucggacgacgug

SEQ ID NO: 8801 - DNA, 22 bp, Artificial Sequence
  Synthetic
catcaagguggagaaggaccug

SEQ ID NO: 8802 - DNA, 17 bp, Artificial Sequence
  Synthetic
gggtcgcuctcgtggug

SEQ ID NO: 8803 - DNA, 19 bp, Artificial Sequence
  Synthetic
agcucaagcgccacaugaa

SEQ ID NO: 8804 - DNA, 18 bp, Artificial Sequence
  Synthetic
gtucaggagccggugcat

SEQ ID NO: 8805 - DNA, 19 bp, Artificial Sequence
  Synthetic
gtgcctucgaccgagucat

SEQ ID NO: 8806 - DNA, 22 bp, Artificial Sequence
  Synthetic
tgtcgcccaggaaautcaugag

SEQ ID NO: 8807 - DNA, 18 bp, Artificial Sequence
  Synthetic
cttcaacagcgcguggut

SEQ ID NO: 8808 - DNA, 20 bp, Artificial Sequence
  Synthetic
gcacgcagaggugaagugat

SEQ ID NO: 8809 - DNA, 17 bp, Artificial Sequence
  Synthetic
ccgugccccucacacag

SEQ ID NO: 8810 - DNA, 20 bp, Artificial Sequence
  Synthetic
auttgacacuggccacaggt

SEQ ID NO: 8811 - DNA, 25 bp, Artificial Sequence
  Synthetic
ccttcccttucttctttctgtcucc

SEQ ID NO: 8812 - DNA, 24 bp, Artificial Sequence
  Synthetic
gccgtgaacucctcatcaaaauac

SEQ ID NO: 8813 - DNA, 23 bp, Artificial Sequence
  Synthetic
cttggagauccaggtgcttugaa

SEQ ID NO: 8814 - DNA, 18 bp, Artificial Sequence
  Synthetic
cacagcautgcgtgugct

SEQ ID NO: 8815 - DNA, 25 bp, Artificial Sequence
  Synthetic
cgggcacatuaagatcacagactuc

SEQ ID NO: 8816 - DNA, 19 bp, Artificial Sequence
  Synthetic
ccauggagaguagccgagg

SEQ ID NO: 8817 - DNA, 18 bp, Artificial Sequence
  Synthetic
cctugcaggcccugaagt

SEQ ID NO: 8818 - DNA, 18 bp, Artificial Sequence
  Synthetic
cagcccuccacaguccaa

SEQ ID NO: 8819 - DNA, 22 bp, Artificial Sequence
  Synthetic
ggaggaggaggagauggactuc

SEQ ID NO: 8820 - DNA, 18 bp, Artificial Sequence
  Synthetic
ccuggcagcgggtacuaa

SEQ ID NO: 8821 - DNA, 23 bp, Artificial Sequence
  Synthetic
cattcagctucctttgcttcucc

SEQ ID NO: 8822 - DNA, 24 bp, Artificial Sequence
  Synthetic
ccggataugagcatgaaaccuagt

SEQ ID NO: 8823 - DNA, 22 bp, Artificial Sequence
  Synthetic
cagagagcaucagagggttguc

SEQ ID NO: 8824 - DNA, 21 bp, Artificial Sequence
  Synthetic
gctcaactgguccccattgug

SEQ ID NO: 8825 - DNA, 24 bp, Artificial Sequence
  Synthetic
cactgacggaagutctcauaaacg

SEQ ID NO: 8826 - DNA, 21 bp, Artificial Sequence
  Synthetic
gcttggctgucgtctggatut

SEQ ID NO: 8827 - DNA, 22 bp, Artificial Sequence
  Synthetic
gagacccatucatcagctgugt

SEQ ID NO: 8828 - DNA, 27 bp, Artificial Sequence
  Synthetic
agucagauggaaaauaagaggaagaag

SEQ ID NO: 8829 - DNA, 21 bp, Artificial Sequence
  Synthetic
ccaccccaaggauctgcuaga

SEQ ID NO: 8830 - DNA, 20 bp, Artificial Sequence
  Synthetic
gcgcucagttggacucaagt

SEQ ID NO: 8831 - DNA, 21 bp, Artificial Sequence
  Synthetic
gcacttctcutgcccgtttuc

SEQ ID NO: 8832 - DNA, 22 bp, Artificial Sequence
  Synthetic
ggcugataggactucagaggct

SEQ ID NO: 8833 - DNA, 20 bp, Artificial Sequence
  Synthetic
acgacccccugtttgttguc

SEQ ID NO: 8834 - DNA, 28 bp, Artificial Sequence
  Synthetic
tgagaagtgugtaactgagtaucaggaa

SEQ ID NO: 8835 - DNA, 27 bp, Artificial Sequence
  Synthetic
agctgcaataguttctcttttcuaggg

SEQ ID NO: 8836 - DNA, 23 bp, Artificial Sequence
  Synthetic
ggagcagaggcaautcctttuct

SEQ ID NO: 8837 - DNA, 26 bp, Artificial Sequence
  Synthetic
gggtcataagaaugaacattcagugg

SEQ ID NO: 8838 - DNA, 24 bp, Artificial Sequence
  Synthetic
atgaggaactcuccaactttgcut

SEQ ID NO: 8839 - DNA, 24 bp, Artificial Sequence
  Synthetic
gcaacaggatauggaagtttgcug

SEQ ID NO: 8840 - DNA, 19 bp, Artificial Sequence
  Synthetic
ggccgguttgtuagggagt

SEQ ID NO: 8841 - DNA, 19 bp, Artificial Sequence
  Synthetic
gcacccccutccttctuca

SEQ ID NO: 8842 - DNA, 24 bp, Artificial Sequence
  Synthetic
gctgttgucactattgcataugct

SEQ ID NO: 8843 - DNA, 30 bp, Artificial Sequence
  Synthetic
tggccataaggacutatctgttaatgttuc

SEQ ID NO: 8844 - DNA, 22 bp, Artificial Sequence
  Synthetic
ggcgtttaugcaatgagcctut

SEQ ID NO: 8845 - DNA, 29 bp, Artificial Sequence
  Synthetic
tgaaatatcgcatcugctttcctaaagut

SEQ ID NO: 8846 - DNA, 29 bp, Artificial Sequence
  Synthetic
aggttttaatatttutgctcctagcucca

SEQ ID NO: 8847 - DNA, 23 bp, Artificial Sequence
  Synthetic
gctggacugtaggctuagacaac

SEQ ID NO: 8848 - DNA, 29 bp, Artificial Sequence
  Synthetic
agtaattttgcttcuttaggacaccaugt

SEQ ID NO: 8849 - DNA, 20 bp, Artificial Sequence
  Synthetic
ctccucagacgcttgcugat

SEQ ID NO: 8850 - DNA, 27 bp, Artificial Sequence
  Synthetic
tttactgtttcuagccgagctatugac

SEQ ID NO: 8851 - DNA, 27 bp, Artificial Sequence
  Synthetic
agaaaaattaccugatcacctgttcut

SEQ ID NO: 8852 - DNA, 28 bp, Artificial Sequence
  Synthetic
attgctaagugaggtatgtcttttucca

SEQ ID NO: 8853 - DNA, 27 bp, Artificial Sequence
  Synthetic
acatctggagacacaucttcattugag

SEQ ID NO: 8854 - DNA, 27 bp, Artificial Sequence
  Synthetic
agagactgtuaccggaagaagatcuag

SEQ ID NO: 8855 - DNA, 25 bp, Artificial Sequence
  Synthetic
tgacaagcacaugcagaauaagaga

SEQ ID NO: 8856 - DNA, 25 bp, Artificial Sequence
  Synthetic
tctgcagagutgtgtauagaagaca

SEQ ID NO: 8857 - DNA, 30 bp, Artificial Sequence
  Synthetic
tcaagcatcaagcutaagtacaaataauca

SEQ ID NO: 8858 - DNA, 28 bp, Artificial Sequence
  Synthetic
ccatgggacutttatatcaaccucaagt

SEQ ID NO: 8859 - DNA, 29 bp, Artificial Sequence
  Synthetic
ctgaagggugaagcagtttatatatuggt

SEQ ID NO: 8860 - DNA, 22 bp, Artificial Sequence
  Synthetic
accagctaugcagcttcttuca

SEQ ID NO: 8861 - DNA, 21 bp, Artificial Sequence
  Synthetic
aacatccagcugcacccuaag

SEQ ID NO: 8862 - DNA, 23 bp, Artificial Sequence
  Synthetic
cggattctgaaugccaatgauga

SEQ ID NO: 8863 - DNA, 23 bp, Artificial Sequence
  Synthetic
cuagctcacugaaagagcaaagc

SEQ ID NO: 8864 - DNA, 28 bp, Artificial Sequence
  Synthetic
acugatgaagaaccuaagaaaaggaaaa

SEQ ID NO: 8865 - DNA, 25 bp, Artificial Sequence
  Synthetic
cttctgttgcauctgggtatgaaug

SEQ ID NO: 8866 - DNA, 28 bp, Artificial Sequence
  Synthetic
ccaccaagatagauaccacatcattuct

SEQ ID NO: 8867 - DNA, 31 bp, Artificial Sequence
  Synthetic
aagcactacatttucctgttttcaatcttut

SEQ ID NO: 8868 - DNA, 28 bp, Artificial Sequence
  Synthetic
caactcacgggaauctaaaggtaaugat

SEQ ID NO: 8869 - DNA, 31 bp, Artificial Sequence
  Synthetic
ccatggcattcugagtttgattttctattuc

SEQ ID NO: 8870 - DNA, 31 bp, Artificial Sequence
  Synthetic
ccatctattcaaggutgtaagactgtttuct

SEQ ID NO: 8871 - DNA, 28 bp, Artificial Sequence
  Synthetic
agaagacatagcauctggattgcaauac

SEQ ID NO: 8872 - DNA, 28 bp, Artificial Sequence
  Synthetic
ccgaaaaagaaaugatgctccaaaauct

SEQ ID NO: 8873 - DNA, 27 bp, Artificial Sequence
  Synthetic
tgaaauagacaaaggattugacaggct

SEQ ID NO: 8874 - DNA, 28 bp, Artificial Sequence
  Synthetic
tgataaagattcucctcagtcagcugat

SEQ ID NO: 8875 - DNA, 29 bp, Artificial Sequence
  Synthetic
agaactgtcctgaugaaaataatggctut

SEQ ID NO: 8876 - DNA, 28 bp, Artificial Sequence
  Synthetic
gtccttctgaacuacaagaacttgguaa

SEQ ID NO: 8877 - DNA, 28 bp, Artificial Sequence
  Synthetic
cgtcctctaacacauccataatacagut

SEQ ID NO: 8878 - DNA, 22 bp, Artificial Sequence
  Synthetic
cgtgattgucatttggugccat

SEQ ID NO: 8879 - DNA, 29 bp, Artificial Sequence
  Synthetic
gcctagtagtuatttcatctggugagaca

SEQ ID NO: 8880 - DNA, 21 bp, Artificial Sequence
  Synthetic
gcaaaugacagccagcuaacc

SEQ ID NO: 8881 - DNA, 29 bp, Artificial Sequence
  Synthetic
tcattcagaaauccaggactttgtacauc

SEQ ID NO: 8882 - DNA, 27 bp, Artificial Sequence
  Synthetic
agtcacacaacugccttagaatguaaa

SEQ ID NO: 8883 - DNA, 24 bp, Artificial Sequence
  Synthetic
tttctctguggcttgacagucaat

SEQ ID NO: 8884 - DNA, 22 bp, Artificial Sequence
  Synthetic
gtagaccaggccugtacatugg

SEQ ID NO: 8885 - DNA, 30 bp, Artificial Sequence
  Synthetic
ccctccaaattaucagtacaggaaauaaca

SEQ ID NO: 8886 - DNA, 29 bp, Artificial Sequence
  Synthetic
ccacgaaatctatuggctaatcaaactut

SEQ ID NO: 8887 - DNA, 22 bp, Artificial Sequence
  Synthetic
ggaggtuggtcggtugagaaat

SEQ ID NO: 8888 - DNA, 27 bp, Artificial Sequence
  Synthetic
gtaactcagacguaactaagcaaguca

SEQ ID NO: 8889 - DNA, 28 bp, Artificial Sequence
  Synthetic
agtttgaaaggcuaaaaactctccagut

SEQ ID NO: 8890 - DNA, 26 bp, Artificial Sequence
  Synthetic
agatgttcttugggaatcttttugcc

SEQ ID NO: 8891 - DNA, 23 bp, Artificial Sequence
  Synthetic
agagaccggcugagtttcuaagt

SEQ ID NO: 8892 - DNA, 26 bp, Artificial Sequence
  Synthetic
tgggaaaaacutgcaauagccaaaaa

SEQ ID NO: 8893 - DNA, 28 bp, Artificial Sequence
  Synthetic
tcaagaacautctttggtucaagacaga

SEQ ID NO: 8894 - DNA, 28 bp, Artificial Sequence
  Synthetic
gtcaatatgttuaccgacccaagauaca

SEQ ID NO: 8895 - DNA, 27 bp, Artificial Sequence
  Synthetic
tcuaatcaaaacctuaccacacaaact

SEQ ID NO: 8896 - DNA, 30 bp, Artificial Sequence
  Synthetic
cgattatgtgagcaguttgaaccatttaua

SEQ ID NO: 8897 - DNA, 23 bp, Artificial Sequence
  Synthetic
gtttccatcucagtgaggcagut

SEQ ID NO: 8898 - DNA, 22 bp, Artificial Sequence
  Synthetic
ggatgtcgutgagtggagugat

SEQ ID NO: 8899 - DNA, 26 bp, Artificial Sequence
  Synthetic
gaatctttagugagtgtagccatuca

SEQ ID NO: 8900 - DNA, 26 bp, Artificial Sequence
  Synthetic
tgattaaccuttgttcttuccagcca

SEQ ID NO: 8901 - DNA, 21 bp, Artificial Sequence
  Synthetic
tgttccaauggtgguccaagg

SEQ ID NO: 8902 - DNA, 23 bp, Artificial Sequence
  Synthetic
agcaaagggucaaggacttctut

SEQ ID NO: 8903 - DNA, 23 bp, Artificial Sequence
  Synthetic
tggtgtgtttugggtagtgcaua

SEQ ID NO: 8904 - DNA, 25 bp, Artificial Sequence
  Synthetic
acagtaaagacugatttgccuccac

SEQ ID NO: 8905 - DNA, 23 bp, Artificial Sequence
  Synthetic
tcagagagucactttccugagca

SEQ ID NO: 8906 - DNA, 33 bp, Artificial Sequence
  Synthetic
ggtttcaaaattauacatttattgagtcuagcc

SEQ ID NO: 8907 - DNA, 28 bp, Artificial Sequence
  Synthetic
gcatactcatuttctcaggtttugacaa

SEQ ID NO: 8908 - DNA, 25 bp, Artificial Sequence
  Synthetic
actacagatttgcutttgtggccua

SEQ ID NO: 8909 - DNA, 24 bp, Artificial Sequence
  Synthetic
gaatcaggccugtatcuccacaat

SEQ ID NO: 8910 - DNA, 23 bp, Artificial Sequence
  Synthetic
cccaggaaaugttcucacaagca

SEQ ID NO: 8911 - DNA, 30 bp, Artificial Sequence
  Synthetic
gctaaattatgcatuatgtcttcccaguca

SEQ ID NO: 8912 - DNA, 26 bp, Artificial Sequence
  Synthetic
gtcagcacaaaauttagcauccagaa

SEQ ID NO: 8913 - DNA, 20 bp, Artificial Sequence
  Synthetic
agtctucaccaagcagugca

SEQ ID NO: 8914 - DNA, 25 bp, Artificial Sequence
  Synthetic
tcatgaggtgaugtgtttcagtgut

SEQ ID NO: 8915 - DNA, 24 bp, Artificial Sequence
  Synthetic
tcaauaacaaaacgugccaagagc

SEQ ID NO: 8916 - DNA, 28 bp, Artificial Sequence
  Synthetic
ttaggttuagcatgagcttuaacagaca

SEQ ID NO: 8917 - DNA, 24 bp, Artificial Sequence
  Synthetic
agctaatcacauggctgtacucac

SEQ ID NO: 8918 - DNA, 23 bp, Artificial Sequence
  Synthetic
tctccctaaauctgtggagggut

SEQ ID NO: 8919 - DNA, 24 bp, Artificial Sequence
  Synthetic
gaggctgaagaugacagaatguct

SEQ ID NO: 8920 - DNA, 31 bp, Artificial Sequence
  Synthetic
ctgacgatgugaaaagtattgtaagattugt

SEQ ID NO: 8921 - DNA, 28 bp, Artificial Sequence
  Synthetic
acattcaaaacagaugactuacccaaga

SEQ ID NO: 8922 - DNA, 27 bp, Artificial Sequence
  Synthetic
acccactcctaugatttgtttctcuct

SEQ ID NO: 8923 - DNA, 30 bp, Artificial Sequence
  Synthetic
agacttctgtaagutctccaagacatttut

SEQ ID NO: 8924 - DNA, 27 bp, Artificial Sequence
  Synthetic
cagcgtgtcucttcatatacacuaaaa

SEQ ID NO: 8925 - DNA, 22 bp, Artificial Sequence
  Synthetic
gtatttcctcgucgagctccuc

SEQ ID NO: 8926 - DNA, 25 bp, Artificial Sequence
  Synthetic
aaaacgaaatccuccagcatcatug

SEQ ID NO: 8927 - DNA, 27 bp, Artificial Sequence
  Synthetic
cggttgttaugagaatgcataugaagg

SEQ ID NO: 8928 - DNA, 25 bp, Artificial Sequence
  Synthetic
gcctcuaccacttctaugaccagat

SEQ ID NO: 8929 - DNA, 20 bp, Artificial Sequence
  Synthetic
tcccctgatugccgtctcua

SEQ ID NO: 8930 - DNA, 23 bp, Artificial Sequence
  Synthetic
ggcagctgaucacatgttttcuc

SEQ ID NO: 8931 - DNA, 24 bp, Artificial Sequence
  Synthetic
gccaggagtucaatctcttccauc

SEQ ID NO: 8932 - DNA, 21 bp, Artificial Sequence
  Synthetic
ccagtttguccccaccatcuc

SEQ ID NO: 8933 - DNA, 20 bp, Artificial Sequence
  Synthetic
ggtcagggagcagucaggua

SEQ ID NO: 8934 - DNA, 19 bp, Artificial Sequence
  Synthetic
acauacccccacccugaca

SEQ ID NO: 8935 - DNA, 21 bp, Artificial Sequence
  Synthetic
gcaccagauccacctccacua

SEQ ID NO: 8936 - DNA, 19 bp, Artificial Sequence
  Synthetic
ctgccautgctugaaccgt

SEQ ID NO: 8937 - DNA, 19 bp, Artificial Sequence
  Synthetic
agctccucgaagccgtcua

SEQ ID NO: 8938 - DNA, 21 bp, Artificial Sequence
  Synthetic
ggccactucttctcagucaca

SEQ ID NO: 8939 - DNA, 17 bp, Artificial Sequence
  Synthetic
gctgucgagggcugcac

SEQ ID NO: 8940 - DNA, 23 bp, Artificial Sequence
  Synthetic
cuagcatugaccccaaggaagaa

SEQ ID NO: 8941 - DNA, 19 bp, Artificial Sequence
  Synthetic
accucgcaagcaccttcug

SEQ ID NO: 8942 - DNA, 21 bp, Artificial Sequence
  Synthetic
catggagcugcccttccatua

SEQ ID NO: 8943 - DNA, 23 bp, Artificial Sequence
  Synthetic
ctcgatggugaacttctcctcug

SEQ ID NO: 8944 - DNA, 20 bp, Artificial Sequence
  Synthetic
gggaugggaagggtcagaug

SEQ ID NO: 8945 - DNA, 23 bp, Artificial Sequence
  Synthetic
ttgagggttuccaaggactucag

SEQ ID NO: 8946 - DNA, 21 bp, Artificial Sequence
  Synthetic
gccccaaggugagtttctcut

SEQ ID NO: 8947 - DNA, 21 bp, Artificial Sequence
  Synthetic
gagtgagutgttcuccaccca

SEQ ID NO: 8948 - DNA, 18 bp, Artificial Sequence
  Synthetic
cugctggaguacgagcga

SEQ ID NO: 8949 - DNA, 17 bp, Artificial Sequence
  Synthetic
cugcgtgtugagcacca

SEQ ID NO: 8950 - DNA, 27 bp, Artificial Sequence
  Synthetic
gtaggatacttguggttgacttctuga

SEQ ID NO: 8951 - DNA, 29 bp, Artificial Sequence
  Synthetic
ctgaagacagacuattctcuggagaaaaa

SEQ ID NO: 8952 - DNA, 25 bp, Artificial Sequence
  Synthetic
gggtgtuaaaccaagaccagaaaua

SEQ ID NO: 8953 - DNA, 27 bp, Artificial Sequence
  Synthetic
gatttctacaactucaggtttgtgcug

SEQ ID NO: 8954 - DNA, 29 bp, Artificial Sequence
  Synthetic
gcagtatctctcucagtatgattgtguca

SEQ ID NO: 8955 - DNA, 24 bp, Artificial Sequence
  Synthetic
ttcacaccugattcccccuaaaac

SEQ ID NO: 8956 - DNA, 26 bp, Artificial Sequence
  Synthetic
aaaaaggaacuggtccuagaaagcaa

SEQ ID NO: 8957 - DNA, 28 bp, Artificial Sequence
  Synthetic
aggactcauttgatagatttuggaagca

SEQ ID NO: 8958 - DNA, 29 bp, Artificial Sequence
  Synthetic
gaagttgaccutaactcaaatgguaggaa

SEQ ID NO: 8959 - DNA, 26 bp, Artificial Sequence
  Synthetic
gcagcatccgaugacaaatttacauc

SEQ ID NO: 8960 - DNA, 24 bp, Artificial Sequence
  Synthetic
caacugaggaacaacgctatcuca

SEQ ID NO: 8961 - DNA, 22 bp, Artificial Sequence
  Synthetic
ccuatccttccugagcaggact

SEQ ID NO: 8962 - DNA, 23 bp, Artificial Sequence
  Synthetic
ggagcgcaagaguatcagtgaut

SEQ ID NO: 8963 - DNA, 22 bp, Artificial Sequence
  Synthetic
atctccugaaacaaggcaccuc

SEQ ID NO: 8964 - DNA, 23 bp, Artificial Sequence
  Synthetic
caagacgagcucacgagtatuct

SEQ ID NO: 8965 - DNA, 25 bp, Artificial Sequence
  Synthetic
agaaaacagccaucactgttcacut

SEQ ID NO: 8966 - DNA, 24 bp, Artificial Sequence
  Synthetic
cgaggtccccagutctgtagauaa

SEQ ID NO: 8967 - DNA, 20 bp, Artificial Sequence
  Synthetic
cccacggcucctccttauga

SEQ ID NO: 8968 - DNA, 28 bp, Artificial Sequence
  Synthetic
tgtattugagaagcatgtgttucaagga

SEQ ID NO: 8969 - DNA, 22 bp, Artificial Sequence
  Synthetic
cgcagaggccuacattcugaac

SEQ ID NO: 8970 - DNA, 25 bp, Artificial Sequence
  Synthetic
gggtaggcugaagataaatctuggt

SEQ ID NO: 8971 - DNA, 27 bp, Artificial Sequence
  Synthetic
tttgaataaatgaugtgccaatgucag

SEQ ID NO: 8972 - DNA, 30 bp, Artificial Sequence
  Synthetic
tcctctctaucuagaggttttgtagtttua

SEQ ID NO: 8973 - DNA, 26 bp, Artificial Sequence
  Synthetic
tgaatgtcttgguctaattgccucat

SEQ ID NO: 8974 - DNA, 22 bp, Artificial Sequence
  Synthetic
ctgtttctugcagtgttgccut

SEQ ID NO: 8975 - DNA, 24 bp, Artificial Sequence
  Synthetic
ggaaucgtttgaaaucacaacgga

SEQ ID NO: 8976 - DNA, 22 bp, Artificial Sequence
  Synthetic
cactttggutgtcccugagagt

SEQ ID NO: 8977 - DNA, 24 bp, Artificial Sequence
  Synthetic
cgaatatctgugatgttgccugct

SEQ ID NO: 8978 - DNA, 23 bp, Artificial Sequence
  Synthetic
ccutgacaatgaatuccgacggt

SEQ ID NO: 8979 - DNA, 23 bp, Artificial Sequence
  Synthetic
gaaggagcuggaaccattttugt

SEQ ID NO: 8980 - DNA, 26 bp, Artificial Sequence
  Synthetic
ggcttgtaaacaguagttctcctuca

SEQ ID NO: 8981 - DNA, 20 bp, Artificial Sequence
  Synthetic
cgugatgagcucaaccagca

SEQ ID NO: 8982 - DNA, 26 bp, Artificial Sequence
  Synthetic
ggaaccaatctguctctccagtttut

SEQ ID NO: 8983 - DNA, 29 bp, Artificial Sequence
  Synthetic
agauaatctcuaacaaaacaauccacagt

SEQ ID NO: 8984 - DNA, 28 bp, Artificial Sequence
  Synthetic
accccaaattaugattttgtcatugcag

SEQ ID NO: 8985 - DNA, 22 bp, Artificial Sequence
  Synthetic
tguaaagaugggcagcacacat

SEQ ID NO: 8986 - DNA, 20 bp, Artificial Sequence
  Synthetic
cttugacgccgagagcuaca

SEQ ID NO: 8987 - DNA, 19 bp, Artificial Sequence
  Synthetic
ttcucggccccttuccaac

SEQ ID NO: 8988 - DNA, 24 bp, Artificial Sequence
  Synthetic
ttagacctgaaguatccgtctuga

SEQ ID NO: 8989 - DNA, 22 bp, Artificial Sequence
  Synthetic
ggcagctgaugggaggaauaac

SEQ ID NO: 8990 - DNA, 23 bp, Artificial Sequence
  Synthetic
ccccttcucccatgttttctucc

SEQ ID NO: 8991 - DNA, 21 bp, Artificial Sequence
  Synthetic
ggtgaatucgggcttgttguc

SEQ ID NO: 8992 - DNA, 21 bp, Artificial Sequence
  Synthetic
gctaggccaaagguggcuagt

SEQ ID NO: 8993 - DNA, 22 bp, Artificial Sequence
  Synthetic
ctgttgcugttgtgctuaaccc

SEQ ID NO: 8994 - DNA, 31 bp, Artificial Sequence
  Synthetic
cgttttgtttttaacutcattgtttctgcuc

SEQ ID NO: 8995 - DNA, 23 bp, Artificial Sequence
  Synthetic
ttcattcacauccagcacaucca

SEQ ID NO: 8996 - DNA, 21 bp, Artificial Sequence
  Synthetic
gcuggacagggaggatttuga

SEQ ID NO: 8997 - DNA, 23 bp, Artificial Sequence
  Synthetic
gcaaggaacugaactagcuagga

SEQ ID NO: 8998 - DNA, 21 bp, Artificial Sequence
  Synthetic
tttcctccccuggtctcauca

SEQ ID NO: 8999 - DNA, 20 bp, Artificial Sequence
  Synthetic
gtcacacacgcugacctcua

SEQ ID NO: 9000 - DNA, 29 bp, Artificial Sequence
  Synthetic
cctgtgtgtaugactatttctttccuact

SEQ ID NO: 9001 - DNA, 21 bp, Artificial Sequence
  Synthetic
ggacactcaugagggttggug

SEQ ID NO: 9002 - DNA, 19 bp, Artificial Sequence
  Synthetic
gctggcugacatguacgga

SEQ ID NO: 9003 - DNA, 26 bp, Artificial Sequence
  Synthetic
actgcatcacuaaccagtctctttut

SEQ ID NO: 9004 - DNA, 19 bp, Artificial Sequence
  Synthetic
gatgagcucgtgcgcttug

SEQ ID NO: 9005 - DNA, 19 bp, Artificial Sequence
  Synthetic
ccacgcguaggaaguccag

SEQ ID NO: 9006 - DNA, 20 bp, Artificial Sequence
  Synthetic
tgtgtguggacactcacgut

SEQ ID NO: 9007 - DNA, 21 bp, Artificial Sequence
  Synthetic
agaauagggcagagacuggct

SEQ ID NO: 9008 - DNA, 17 bp, Artificial Sequence
  Synthetic
ggcgucctcctctugcc

SEQ ID NO: 9009 - DNA, 17 bp, Artificial Sequence
  Synthetic
gggagcucctgcacugt

SEQ ID NO: 9010 - DNA, 20 bp, Artificial Sequence
  Synthetic
ccgtggcugcaacctcatua

SEQ ID NO: 9011 - DNA, 19 bp, Artificial Sequence
  Synthetic
agcucaagcgcttccucac

SEQ ID NO: 9012 - DNA, 20 bp, Artificial Sequence
  Synthetic
gggctactuacgtgtgtgug

SEQ ID NO: 9013 - DNA, 17 bp, Artificial Sequence
  Synthetic
cucagcgaugccggact

SEQ ID NO: 9014 - DNA, 20 bp, Artificial Sequence
  Synthetic
ccctguccctcagtctugaa

SEQ ID NO: 9015 - DNA, 18 bp, Artificial Sequence
  Synthetic
ccagccccucctcttucc

SEQ ID NO: 9016 - DNA, 20 bp, Artificial Sequence
  Synthetic
ccaggaaguaccgctgcauc

SEQ ID NO: 9017 - DNA, 20 bp, Artificial Sequence
  Synthetic
gggtcacugaagtgctucca

SEQ ID NO: 9018 - DNA, 22 bp, Artificial Sequence
  Synthetic
gccccacgggaautttcaguaa

SEQ ID NO: 9019 - DNA, 23 bp, Artificial Sequence
  Synthetic
cattctcttgcutgggctttgug

SEQ ID NO: 9020 - DNA, 26 bp, Artificial Sequence
  Synthetic
gcuttccgatcuagaggaagaaaacc

SEQ ID NO: 9021 - DNA, 22 bp, Artificial Sequence
  Synthetic
gcttccgaagcutgactctuga

SEQ ID NO: 9022 - DNA, 29 bp, Artificial Sequence
  Synthetic
agaagaacuacaggctactcuacaagaat

SEQ ID NO: 9023 - DNA, 27 bp, Artificial Sequence
  Synthetic
tctcattttctugacttagctgctcug

SEQ ID NO: 9024 - DNA, 29 bp, Artificial Sequence
  Synthetic
ccaaaacttuggaagagtgtagagtuacc

SEQ ID NO: 9025 - DNA, 21 bp, Artificial Sequence
  Synthetic
tgcucgggctacttucaacat

SEQ ID NO: 9026 - DNA, 23 bp, Artificial Sequence
  Synthetic
ctcacagctuttctaagcccugt

SEQ ID NO: 9027 - DNA, 25 bp, Artificial Sequence
  Synthetic
ggagcggguaattcataggaagaug

SEQ ID NO: 9028 - DNA, 19 bp, Artificial Sequence
  Synthetic
ccctgggcuctgtcagcua

SEQ ID NO: 9029 - DNA, 26 bp, Artificial Sequence
  Synthetic
tcugagaaacagagaatgucacaagg

SEQ ID NO: 9030 - DNA, 21 bp, Artificial Sequence
  Synthetic
ctggtguccccctggttttua

SEQ ID NO: 9031 - DNA, 27 bp, Artificial Sequence
  Synthetic
gcacggaaagauaagtcaaaagttcut

SEQ ID NO: 9032 - DNA, 24 bp, Artificial Sequence
  Synthetic
cctcatctgugatactgcacagut

SEQ ID NO: 9033 - DNA, 20 bp, Artificial Sequence
  Synthetic
guaggtguggagcagagcac

SEQ ID NO: 9034 - DNA, 20 bp, Artificial Sequence
  Synthetic
cctugtgatctgucccccat

SEQ ID NO: 9035 - DNA, 20 bp, Artificial Sequence
  Synthetic
aagcugcagtagguggcaat

SEQ ID NO: 9036 - DNA, 22 bp, Artificial Sequence
  Synthetic
gggtggcagugttcctattuca

SEQ ID NO: 9037 - DNA, 21 bp, Artificial Sequence
  Synthetic
gttgtccucaaagagcugggt

SEQ ID NO: 9038 - DNA, 22 bp, Artificial Sequence
  Synthetic
accaggacacgautttguggaa

SEQ ID NO: 9039 - DNA, 21 bp, Artificial Sequence
  Synthetic
caggcacugggttgtaagtug

SEQ ID NO: 9040 - DNA, 20 bp, Artificial Sequence
  Synthetic
gcctgguactgccctatugc

SEQ ID NO: 9041 - DNA, 21 bp, Artificial Sequence
  Synthetic
ggattgggcauggacucaaac

SEQ ID NO: 9042 - DNA, 21 bp, Artificial Sequence
  Synthetic
ttgacctgucccggtaugaag

SEQ ID NO: 9043 - DNA, 22 bp, Artificial Sequence
  Synthetic
cccaaagaucttctugcagcca

SEQ ID NO: 9044 - DNA, 20 bp, Artificial Sequence
  Synthetic
gtggtaaggugcccacctut

SEQ ID NO: 9045 - DNA, 21 bp, Artificial Sequence
  Synthetic
cgaagcagaggugggtgtuat

SEQ ID NO: 9046 - DNA, 20 bp, Artificial Sequence
  Synthetic
cccaacuaagggcctgaucc

SEQ ID NO: 9047 - DNA, 23 bp, Artificial Sequence
  Synthetic
tgtaggagaggucaggttucaca

SEQ ID NO: 9048 - DNA, 19 bp, Artificial Sequence
  Synthetic
ttggcatuctgctggucgt

SEQ ID NO: 9049 - DNA, 18 bp, Artificial Sequence
  Synthetic
ggcugggaggactucacc

SEQ ID NO: 9050 - DNA, 20 bp, Artificial Sequence
  Synthetic
ccatacccuctcagcguacc

SEQ ID NO: 9051 - DNA, 23 bp, Artificial Sequence
  Synthetic
gttttcccggacauggtcuaaga

SEQ ID NO: 9052 - DNA, 23 bp, Artificial Sequence
  Synthetic
acaacacacagutggaggactuc

SEQ ID NO: 9053 - DNA, 17 bp, Artificial Sequence
  Synthetic
ccauggctccucaccca

SEQ ID NO: 9054 - DNA, 20 bp, Artificial Sequence
  Synthetic
gaatgucggccaagatuccg

SEQ ID NO: 9055 - DNA, 21 bp, Artificial Sequence
  Synthetic
cctggcauactggactcauct

SEQ ID NO: 9056 - DNA, 18 bp, Artificial Sequence
  Synthetic
gggctggcuccgatguat

SEQ ID NO: 9057 - DNA, 21 bp, Artificial Sequence
  Synthetic
cgtagccaucagtcucagagg

SEQ ID NO: 9058 - DNA, 18 bp, Artificial Sequence
  Synthetic
gcctucagcccagcctuc

SEQ ID NO: 9059 - DNA, 18 bp, Artificial Sequence
  Synthetic
ctgcggacutggcctuct

SEQ ID NO: 9060 - DNA, 23 bp, Artificial Sequence
  Synthetic
ggtagagugctacactguccaac

SEQ ID NO: 9061 - DNA, 25 bp, Artificial Sequence
  Synthetic
tccuaagaactcauacaaccaggac

SEQ ID NO: 9062 - DNA, 22 bp, Artificial Sequence
  Synthetic
gagtggaauacagagtgguggg

SEQ ID NO: 9063 - DNA, 24 bp, Artificial Sequence
  Synthetic
ctgatgggtugtgtttggtttcut

SEQ ID NO: 9064 - DNA, 31 bp, Artificial Sequence
  Synthetic
actctttccagaaugttgttaagtcttaguc

SEQ ID NO: 9065 - DNA, 23 bp, Artificial Sequence
  Synthetic
tgcaauggaagaaagtgugagca

SEQ ID NO: 9066 - DNA, 21 bp, Artificial Sequence
  Synthetic
tgctccuccacaucaacaacc

SEQ ID NO: 9067 - DNA, 21 bp, Artificial Sequence
  Synthetic
cacaattgguggcgatggtut

SEQ ID NO: 9068 - DNA, 30 bp, Artificial Sequence
  Synthetic
gggaaggaaagaautttgcttaagatauca

SEQ ID NO: 9069 - DNA, 22 bp, Artificial Sequence
  Synthetic
cagccttcuaacagctacccut

SEQ ID NO: 9070 - DNA, 26 bp, Artificial Sequence
  Synthetic
gcaaacacaaaaaccuggttccaaua

SEQ ID NO: 9071 - DNA, 27 bp, Artificial Sequence
  Synthetic
caaacaaaugaggcatcagtcugaaag

SEQ ID NO: 9072 - DNA, 27 bp, Artificial Sequence
  Synthetic
ggaagctcttcaucctcactagauaag

SEQ ID NO: 9073 - DNA, 32 bp, Artificial Sequence
  Synthetic
aatgacattaaggaaagutctgctgttttuag

SEQ ID NO: 9074 - DNA, 24 bp, Artificial Sequence
  Synthetic
caattttggcccuctgtttcuacc

SEQ ID NO: 9075 - DNA, 31 bp, Artificial Sequence
  Synthetic
gcacaatuagccgtaataacatuagagaaaa

SEQ ID NO: 9076 - DNA, 28 bp, Artificial Sequence
  Synthetic
cctagagcctccuttgatactacattug

SEQ ID NO: 9077 - DNA, 29 bp, Artificial Sequence
  Synthetic
aaagtccaaaagucacttttgaatgugaa

SEQ ID NO: 9078 - DNA, 28 bp, Artificial Sequence
  Synthetic
acactgacucacacatttatttggtuct

SEQ ID NO: 9079 - DNA, 27 bp, Artificial Sequence
  Synthetic
ctcatgttaaguggagaaagggtttug

SEQ ID NO: 9080 - DNA, 26 bp, Artificial Sequence
  Synthetic
ctgactggcauttggttgtactttut

SEQ ID NO: 9081 - DNA, 26 bp, Artificial Sequence
  Synthetic
ggaggaagtctuctaccaggcataut

SEQ ID NO: 9082 - DNA, 28 bp, Artificial Sequence
  Synthetic
gccaaatctgcuttcttgataaaaucct

SEQ ID NO: 9083 - DNA, 32 bp, Artificial Sequence
  Synthetic
ccaacttaagccaugtaactgaaaatctaaut

SEQ ID NO: 9084 - DNA, 26 bp, Artificial Sequence
  Synthetic
tcatcacttcuggaaaaccactcaut

SEQ ID NO: 9085 - DNA, 21 bp, Artificial Sequence
  Synthetic
aatgctgaucccctgtgugag

SEQ ID NO: 9086 - DNA, 25 bp, Artificial Sequence
  Synthetic
ctgatacttttcuggatgcctcuca

SEQ ID NO: 9087 - DNA, 30 bp, Artificial Sequence
  Synthetic
taatgacaattcaguttttgagtacctugt

SEQ ID NO: 9088 - DNA, 23 bp, Artificial Sequence
  Synthetic
ccaaggaaggautttcgggtuca

SEQ ID NO: 9089 - DNA, 32 bp, Artificial Sequence
  Synthetic
ccttgtattttacagaugcaaacagctauaat

SEQ ID NO: 9090 - DNA, 30 bp, Artificial Sequence
  Synthetic
aaacaaaagctaauaatggagccacauaac

SEQ ID NO: 9091 - DNA, 29 bp, Artificial Sequence
  Synthetic
attgagcctcauttattttctttttcucc

SEQ ID NO: 9092 - DNA, 27 bp, Artificial Sequence
  Synthetic
autcatttatatguacacagggcagca

SEQ ID NO: 9093 - DNA, 23 bp, Artificial Sequence
  Synthetic
cctttgucccacttggaugagag

SEQ ID NO: 9094 - DNA, 24 bp, Artificial Sequence
  Synthetic
cctccaggcugtaaacttuggaaa

SEQ ID NO: 9095 - DNA, 21 bp, Artificial Sequence
  Synthetic
cagctguggcaatttctggug

SEQ ID NO: 9096 - DNA, 19 bp, Artificial Sequence
  Synthetic
gccccaccccaguctctua

SEQ ID NO: 9097 - DNA, 27 bp, Artificial Sequence
  Synthetic
agctttaagcaagaauaccatgauccc

SEQ ID NO: 9098 - DNA, 24 bp, Artificial Sequence
  Synthetic
gatctcaggaaautccgttgcuct

SEQ ID NO: 9099 - DNA, 25 bp, Artificial Sequence
  Synthetic
gttcaaagatgcuttccagcttcuc

SEQ ID NO: 9100 - DNA, 21 bp, Artificial Sequence
  Synthetic
gggctuagggtggaauaccag

SEQ ID NO: 9101 - DNA, 26 bp, Artificial Sequence
  Synthetic
ctccaattccacuatttaccccucag

SEQ ID NO: 9102 - DNA, 25 bp, Artificial Sequence
  Synthetic
ccaaagtccaugtgaaattgtcucc

SEQ ID NO: 9103 - DNA, 20 bp, Artificial Sequence
  Synthetic
aggaattcggcutcgacgut

SEQ ID NO: 9104 - DNA, 18 bp, Artificial Sequence
  Synthetic
cgcggauctcgatcucgt

SEQ ID NO: 9105 - DNA, 19 bp, Artificial Sequence
  Synthetic
ccttccugcgcctgatguc

SEQ ID NO: 9106 - DNA, 22 bp, Artificial Sequence
  Synthetic
accagtcuccatgtugcagaag

SEQ ID NO: 9107 - DNA, 22 bp, Artificial Sequence
  Synthetic
gcccatatgugcccctaccaua

SEQ ID NO: 9108 - DNA, 21 bp, Artificial Sequence
  Synthetic
gggatuaccggcatccaagug

SEQ ID NO: 9109 - DNA, 22 bp, Artificial Sequence
  Synthetic
gcaaagauggactcaacgguct

SEQ ID NO: 9110 - DNA, 20 bp, Artificial Sequence
  Synthetic
cacggugaccctttaugcct

SEQ ID NO: 9111 - DNA, 23 bp, Artificial Sequence
  Synthetic
agaacuctacagaugcagacagt

SEQ ID NO: 9112 - DNA, 19 bp, Artificial Sequence
  Synthetic
gctgaggguactggcaugg

SEQ ID NO: 9113 - DNA, 24 bp, Artificial Sequence
  Synthetic
gcctgactcuttcttctccctuag

SEQ ID NO: 9114 - DNA, 20 bp, Artificial Sequence
  Synthetic
ggaucctttcucgccagcag

SEQ ID NO: 9115 - DNA, 20 bp, Artificial Sequence
  Synthetic
gacagccccucctatccuca

SEQ ID NO: 9116 - DNA, 19 bp, Artificial Sequence
  Synthetic
ccagcaucgccttuagcac

SEQ ID NO: 9117 - DNA, 20 bp, Artificial Sequence
  Synthetic
tgcctccautactgctccuc

SEQ ID NO: 9118 - DNA, 20 bp, Artificial Sequence
  Synthetic
ccaccucaccttgucaccag

SEQ ID NO: 9119 - DNA, 21 bp, Artificial Sequence
  Synthetic
gccccacacuggaaatcucaa

SEQ ID NO: 9120 - DNA, 20 bp, Artificial Sequence
  Synthetic
caaguacgacgcacctugac

SEQ ID NO: 9121 - DNA, 22 bp, Artificial Sequence
  Synthetic
gggttttgcucactgtctgtuc

SEQ ID NO: 9122 - DNA, 21 bp, Artificial Sequence
  Synthetic
gcagcaaugggaaggagguag

SEQ ID NO: 9123 - DNA, 19 bp, Artificial Sequence
  Synthetic
tcagcccccucaacccuaa

SEQ ID NO: 9124 - DNA, 22 bp, Artificial Sequence
  Synthetic
cagctucaccaggagatcctut

SEQ ID NO: 9125 - DNA, 22 bp, Artificial Sequence
  Synthetic
ggcatctucttcctctttuggc

SEQ ID NO: 9126 - DNA, 24 bp, Artificial Sequence
  Synthetic
ctcttcctttcuggatttcccuca

SEQ ID NO: 9127 - DNA, 23 bp, Artificial Sequence
  Synthetic
gactctcagcucatcctcttcuc

SEQ ID NO: 9128 - DNA, 22 bp, Artificial Sequence
  Synthetic
ccatgagggucatgctuagagg

SEQ ID NO: 9129 - DNA, 23 bp, Artificial Sequence
  Synthetic
catctctuccttctcgcugacat

SEQ ID NO: 9130 - DNA, 26 bp, Artificial Sequence
  Synthetic
gagtgagaaautcattcatgguggga

SEQ ID NO: 9131 - DNA, 28 bp, Artificial Sequence
  Synthetic
cttaccttctaccuctttcctgcttuag

SEQ ID NO: 9132 - DNA, 22 bp, Artificial Sequence
  Synthetic
caggccugggagttcttctaua

SEQ ID NO: 9133 - DNA, 29 bp, Artificial Sequence
  Synthetic
tctaacccatcuttttccttcttcucaag

SEQ ID NO: 9134 - DNA, 17 bp, Artificial Sequence
  Synthetic
agagccaugcccaccug

SEQ ID NO: 9135 - DNA, 21 bp, Artificial Sequence
  Synthetic
cccttctcuaacctggccuct

SEQ ID NO: 9136 - DNA, 24 bp, Artificial Sequence
  Synthetic
gagtauccttgcacucccaaaagt

SEQ ID NO: 9137 - DNA, 28 bp, Artificial Sequence
  Synthetic
cacaaagagtcuacatgtctagggtcua

SEQ ID NO: 9138 - DNA, 23 bp, Artificial Sequence
  Synthetic
ccagcaaacautggcttcaguac

SEQ ID NO: 9139 - DNA, 27 bp, Artificial Sequence
  Synthetic
gtcttcgaatuggattacttgggucat

SEQ ID NO: 9140 - DNA, 24 bp, Artificial Sequence
  Synthetic
ggagagtcucagccagtgaaaaug

SEQ ID NO: 9141 - DNA, 25 bp, Artificial Sequence
  Synthetic
acaaccgtgtuctaaacctcttcut

SEQ ID NO: 9142 - DNA, 28 bp, Artificial Sequence
  Synthetic
ttctgtagatcagugaaaagcatgaugt

SEQ ID NO: 9143 - DNA, 28 bp, Artificial Sequence
  Synthetic
gcttcatgaggugcagtaacaaaaatug

SEQ ID NO: 9144 - DNA, 28 bp, Artificial Sequence
  Synthetic
tgagaatggcugtacgtaataactuagc

SEQ ID NO: 9145 - DNA, 25 bp, Artificial Sequence
  Synthetic
actctttaccuttggtgcatuagca

SEQ ID NO: 9146 - DNA, 27 bp, Artificial Sequence
  Synthetic
ctacattggcacutagtgtgtaccuaa

SEQ ID NO: 9147 - DNA, 26 bp, Artificial Sequence
  Synthetic
aggctaatttcuctgtcaatgctuca

SEQ ID NO: 9148 - DNA, 28 bp, Artificial Sequence
  Synthetic
gaattactcaugtaagtggaguggacaa

SEQ ID NO: 9149 - DNA, 24 bp, Artificial Sequence
  Synthetic
cagtgaaaugttctaaugcacgct

SEQ ID NO: 9150 - DNA, 28 bp, Artificial Sequence
  Synthetic
ttgtgttcagguggcttctaaataucat

SEQ ID NO: 9151 - DNA, 23 bp, Artificial Sequence
  Synthetic
tttccaacagccugatcauaagc

SEQ ID NO: 9152 - DNA, 29 bp, Artificial Sequence
  Synthetic
tctacttcttttuaaccacaggtgaaucc

SEQ ID NO: 9153 - DNA, 28 bp, Artificial Sequence
  Synthetic
gctcatcaguagagaattgacctctuac

SEQ ID NO: 9154 - DNA, 28 bp, Artificial Sequence
  Synthetic
cttctttaggtutgcaatgagaatuccc

SEQ ID NO: 9155 - DNA, 25 bp, Artificial Sequence
  Synthetic
gacagccauaaacacattugccaat

SEQ ID NO: 9156 - DNA, 25 bp, Artificial Sequence
  Synthetic
atctgcaaaaccuccttatccucac

SEQ ID NO: 9157 - DNA, 21 bp, Artificial Sequence
  Synthetic
ttccggaaaauggcaaaugct

SEQ ID NO: 9158 - DNA, 22 bp, Artificial Sequence
  Synthetic
gtcaactugcaaaagcccagut

SEQ ID NO: 9159 - DNA, 28 bp, Artificial Sequence
  Synthetic
gtaagaagtcauaccactagtatuggca

SEQ ID NO: 9160 - DNA, 30 bp, Artificial Sequence
  Synthetic
gatgctgctaagutgttgtacaataatgut

SEQ ID NO: 9161 - DNA, 28 bp, Artificial Sequence
  Synthetic
tgggtttagatuacctctttccatgtuc

SEQ ID NO: 9162 - DNA, 28 bp, Artificial Sequence
  Synthetic
gctgttagcuagactcatatcuaaagca

SEQ ID NO: 9163 - DNA, 28 bp, Artificial Sequence
  Synthetic
tggatgattcaucatggtaattauggca

SEQ ID NO: 9164 - DNA, 24 bp, Artificial Sequence
  Synthetic
cgataacttttguccctgggacut

SEQ ID NO: 9165 - DNA, 29 bp, Artificial Sequence
  Synthetic
acagatttgttgtuatggttctgaacuga

SEQ ID NO: 9166 - DNA, 27 bp, Artificial Sequence
  Synthetic
ctttgaataggaugcaatgcagtaugc

SEQ ID NO: 9167 - DNA, 23 bp, Artificial Sequence
  Synthetic
ttctaggacgacauctggcctua

SEQ ID NO: 9168 - DNA, 26 bp, Artificial Sequence
  Synthetic
ttggagtgttcuaaatgctaacagut

SEQ ID NO: 9169 - DNA, 25 bp, Artificial Sequence
  Synthetic
gcggtataaccauaaccaaaaggug

SEQ ID NO: 9170 - DNA, 27 bp, Artificial Sequence
  Synthetic
gcctttattttuggaaggagatggtut

SEQ ID NO: 9171 - DNA, 29 bp, Artificial Sequence
  Synthetic
aggattgcatagauacaaagttgaaugga

SEQ ID NO: 9172 - DNA, 28 bp, Artificial Sequence
  Synthetic
cctctatcagttucagctaggtcattut

SEQ ID NO: 9173 - DNA, 27 bp, Artificial Sequence
  Synthetic
ggatccagacautgaattgtctcuagt

SEQ ID NO: 9174 - DNA, 26 bp, Artificial Sequence
  Synthetic
tgttgccttcgguattttaccaguaa

SEQ ID NO: 9175 - DNA, 24 bp, Artificial Sequence
  Synthetic
guattccuggaagaagcagggaaa

SEQ ID NO: 9176 - DNA, 25 bp, Artificial Sequence
  Synthetic
agaggtcactucaagtgtagacuca

SEQ ID NO: 9177 - DNA, 21 bp, Artificial Sequence
  Synthetic
tcuaaatggguacggcagcag

SEQ ID NO: 9178 - DNA, 21 bp, Artificial Sequence
  Synthetic
gttaugacagcacgggcatug

SEQ ID NO: 9179 - DNA, 29 bp, Artificial Sequence
  Synthetic
agcaatttctgagaautttggatatgcut

SEQ ID NO: 9180 - DNA, 27 bp, Artificial Sequence
  Synthetic
ccutaccttgtaagauggcaagaaaca

SEQ ID NO: 9181 - DNA, 26 bp, Artificial Sequence
  Synthetic
gaatctctgtgcuaccttccagaaua

SEQ ID NO: 9182 - DNA, 25 bp, Artificial Sequence
  Synthetic
aaaaugctggtacugagcaagaaga

SEQ ID NO: 9183 - DNA, 28 bp, Artificial Sequence
  Synthetic
aaaaatgggutgttggttcuaccaaaaa

SEQ ID NO: 9184 - DNA, 31 bp, Artificial Sequence
  Synthetic
acttctaatucactaaatacgttucacaggt

SEQ ID NO: 9185 - DNA, 28 bp, Artificial Sequence
  Synthetic
gcaaacgcugaatatcttguagaaagag

SEQ ID NO: 9186 - DNA, 26 bp, Artificial Sequence
  Synthetic
acatctccatgaguaggaagaaggut

SEQ ID NO: 9187 - DNA, 28 bp, Artificial Sequence
  Synthetic
ccatatuacacaguccgagaactaauac

SEQ ID NO: 9188 - DNA, 23 bp, Artificial Sequence
  Synthetic
tcattggaaccccugaataugcc

SEQ ID NO: 9189 - DNA, 29 bp, Artificial Sequence
  Synthetic
actaaacaaggaaacagucaagagtcauc

SEQ ID NO: 9190 - DNA, 26 bp, Artificial Sequence
  Synthetic
cttgactaccaugttcagctguaact

SEQ ID NO: 9191 - DNA, 31 bp, Artificial Sequence
  Synthetic
ggcatccatauacagagatgaaaatgaugat

SEQ ID NO: 9192 - DNA, 29 bp, Artificial Sequence
  Synthetic
ctgaaccagtcuggataaagaatactgua

SEQ ID NO: 9193 - DNA, 24 bp, Artificial Sequence
  Synthetic
aacattgttugttggagaguccca

SEQ ID NO: 9194 - DNA, 17 bp, Artificial Sequence
  Synthetic
gcgaccuggctcucact

SEQ ID NO: 9195 - DNA, 17 bp, Artificial Sequence
  Synthetic
ggtcccggccugagtuc

SEQ ID NO: 9196 - DNA, 21 bp, Artificial Sequence
  Synthetic
gtagaccuccgaggtgttgut

SEQ ID NO: 9197 - DNA, 21 bp, Artificial Sequence
  Synthetic
caggagauggacgagaauccc

SEQ ID NO: 9198 - DNA, 21 bp, Artificial Sequence
  Synthetic
cccagacagcuggagaugaga

SEQ ID NO: 9199 - DNA, 19 bp, Artificial Sequence
  Synthetic
ggacgttgucacgggttug

SEQ ID NO: 9200 - DNA, 23 bp, Artificial Sequence
  Synthetic
gggaatatccugttggcatugga

SEQ ID NO: 9201 - DNA, 23 bp, Artificial Sequence
  Synthetic
ccaacagggacutaccagaaugg

SEQ ID NO: 9202 - DNA, 26 bp, Artificial Sequence
  Synthetic
gtgactcguaactaccaacattucct

SEQ ID NO: 9203 - DNA, 25 bp, Artificial Sequence
  Synthetic
caggcacagcauacactttcttuac

SEQ ID NO: 9204 - DNA, 24 bp, Artificial Sequence
  Synthetic
ttgactcttgucaccatggauacc

SEQ ID NO: 9205 - DNA, 26 bp, Artificial Sequence
  Synthetic
tttctggcgaaautaaagagatcugt

SEQ ID NO: 9206 - DNA, 23 bp, Artificial Sequence
  Synthetic
acgtcaugacacacauccacaat

SEQ ID NO: 9207 - DNA, 22 bp, Artificial Sequence
  Synthetic
tctaatgtggagugcgactugg

SEQ ID NO: 9208 - DNA, 29 bp, Artificial Sequence
  Synthetic
acactctaaaaagucaatcagtctuccag

SEQ ID NO: 9209 - DNA, 27 bp, Artificial Sequence
  Synthetic
cgtgattuggagagaggtatgtaauga

SEQ ID NO: 9210 - DNA, 25 bp, Artificial Sequence
  Synthetic
tcagatcaacucaagagttcuccca

SEQ ID NO: 9211 - DNA, 28 bp, Artificial Sequence
  Synthetic
ggatgttatugcaagacagaattucact

SEQ ID NO: 9212 - DNA, 29 bp, Artificial Sequence
  Synthetic
cagctcatcaagautccacttcttttuaa

SEQ ID NO: 9213 - DNA, 25 bp, Artificial Sequence
  Synthetic
acagaaaccugggtatagccattug

SEQ ID NO: 9214 - DNA, 21 bp, Artificial Sequence
  Synthetic
cuccaacagtucaccaaagcc

SEQ ID NO: 9215 - DNA, 20 bp, Artificial Sequence
  Synthetic
gcgatgaguttgcctgugga

SEQ ID NO: 9216 - DNA, 29 bp, Artificial Sequence
  Synthetic
aaaatgaaacuccagatagcgaatatuct

SEQ ID NO: 9217 - DNA, 22 bp, Artificial Sequence
  Synthetic
aggaatcatucggccactgtuc

SEQ ID NO: 9218 - DNA, 18 bp, Artificial Sequence
  Synthetic
gctcgutcgccuggagac

SEQ ID NO: 9219 - DNA, 29 bp, Artificial Sequence
  Synthetic
gtttctattgaagucacattttccagtuc

SEQ ID NO: 9220 - DNA, 17 bp, Artificial Sequence
  Synthetic
catggaccuggcuggga

SEQ ID NO: 9221 - DNA, 17 bp, Artificial Sequence
  Synthetic
cgggugcactgcttcug

SEQ ID NO: 9222 - DNA, 20 bp, Artificial Sequence
  Synthetic
ggagtgguactgcgaauggt

SEQ ID NO: 9223 - DNA, 21 bp, Artificial Sequence
  Synthetic
gcagacgauactggacgauca

SEQ ID NO: 9224 - DNA, 22 bp, Artificial Sequence
  Synthetic
gcagaaaacagcugtctccuca

SEQ ID NO: 9225 - DNA, 27 bp, Artificial Sequence
  Synthetic
tggattctgtcutttcctttccctuag

SEQ ID NO: 9226 - DNA, 20 bp, Artificial Sequence
  Synthetic
tgcacutgaagucggcacaa

SEQ ID NO: 9227 - DNA, 28 bp, Artificial Sequence
  Synthetic
gcctaccagatguttttgacttctgaua

SEQ ID NO: 9228 - DNA, 24 bp, Artificial Sequence
  Synthetic
catttctcccuctccaggaaagut

SEQ ID NO: 9229 - DNA, 21 bp, Artificial Sequence
  Synthetic
gccugtctctuccaacaccag

SEQ ID NO: 9230 - DNA, 17 bp, Artificial Sequence
  Synthetic
gactgggcuccctgucc

SEQ ID NO: 9231 - DNA, 23 bp, Artificial Sequence
  Synthetic
gaagcgtgaaauacgaaggcauc

SEQ ID NO: 9232 - DNA, 19 bp, Artificial Sequence
  Synthetic
cgtcgtccutctcgctgua

SEQ ID NO: 9233 - DNA, 17 bp, Artificial Sequence
  Synthetic
cgcaugcgtgtcugacc

SEQ ID NO: 9234 - DNA, 21 bp, Artificial Sequence
  Synthetic
tccacggaguagagttuccca

SEQ ID NO: 9235 - DNA, 22 bp, Artificial Sequence
  Synthetic
cctgaaaaagggcuaccugacc

SEQ ID NO: 9236 - DNA, 21 bp, Artificial Sequence
  Synthetic
gaacgucaggatcacctucca

SEQ ID NO: 9237 - DNA, 19 bp, Artificial Sequence
  Synthetic
gcctgtcugtcacgcugat

SEQ ID NO: 9238 - DNA, 22 bp, Artificial Sequence
  Synthetic
ggagugaacgctttguccagag

SEQ ID NO: 9239 - DNA, 22 bp, Artificial Sequence
  Synthetic
tgcacttggugatgtgagtcug

SEQ ID NO: 9240 - DNA, 17 bp, Artificial Sequence
  Synthetic
cuccaccaccguggcaa

SEQ ID NO: 9241 - DNA, 17 bp, Artificial Sequence
  Synthetic
cggtgccaccugtgguc

SEQ ID NO: 9242 - DNA, 23 bp, Artificial Sequence
  Synthetic
ggttatcguaccctgttcuccca

SEQ ID NO: 9243 - DNA, 23 bp, Artificial Sequence
  Synthetic
gtccaagaaugcaaagcacaucc

SEQ ID NO: 9244 - DNA, 18 bp, Artificial Sequence
  Synthetic
ccaacuccctctgcuggt

SEQ ID NO: 9245 - DNA, 18 bp, Artificial Sequence
  Synthetic
cccaugaggaggcacguc

SEQ ID NO: 9246 - DNA, 19 bp, Artificial Sequence
  Synthetic
cccauggacctccauccca

SEQ ID NO: 9247 - DNA, 22 bp, Artificial Sequence
  Synthetic
ggaaatgaagccugtggatguc

SEQ ID NO: 9248 - DNA, 19 bp, Artificial Sequence
  Synthetic
gcccuagcccacaggacua

SEQ ID NO: 9249 - DNA, 23 bp, Artificial Sequence
  Synthetic
ctccccgcutatgatacatuccc

SEQ ID NO: 9250 - DNA, 21 bp, Artificial Sequence
  Synthetic
ctggatgacutgctgaggcut

SEQ ID NO: 9251 - DNA, 17 bp, Artificial Sequence
  Synthetic
gugcactugcagcccat

SEQ ID NO: 9252 - DNA, 20 bp, Artificial Sequence
  Synthetic
ctcggacaccacauggguaa

SEQ ID NO: 9253 - DNA, 17 bp, Artificial Sequence
  Synthetic
ctgagcugcccccucac

SEQ ID NO: 9254 - DNA, 26 bp, Artificial Sequence
  Synthetic
gagtttgguaagacacguagaacaca

SEQ ID NO: 9255 - DNA, 20 bp, Artificial Sequence
  Synthetic
gctcccautgcttggatugc

SEQ ID NO: 9256 - DNA, 23 bp, Artificial Sequence
  Synthetic
gggautaagaauggagccaccaa

SEQ ID NO: 9257 - DNA, 19 bp, Artificial Sequence
  Synthetic
cccucccaccaaggttgug

SEQ ID NO: 9258 - DNA, 19 bp, Artificial Sequence
  Synthetic
ctcaggcacaucccgcuaa

SEQ ID NO: 9259 - DNA, 24 bp, Artificial Sequence
  Synthetic
ctcaaggagaugttugccaagaag

SEQ ID NO: 9260 - DNA, 21 bp, Artificial Sequence
  Synthetic
agtccaggagacucacctuca

SEQ ID NO: 9261 - DNA, 19 bp, Artificial Sequence
  Synthetic
tcguccagacccctgucat

SEQ ID NO: 9262 - DNA, 24 bp, Artificial Sequence
  Synthetic
gggagaaagccaauttacttgcua

SEQ ID NO: 9263 - DNA, 26 bp, Artificial Sequence
  Synthetic
ctctggaaaagcucttctugcaaaaa

SEQ ID NO: 9264 - DNA, 17 bp, Artificial Sequence
  Synthetic
gcccugcccacacuact

SEQ ID NO: 9265 - DNA, 20 bp, Artificial Sequence
  Synthetic
accuccaacccuaacaagcc

SEQ ID NO: 9266 - DNA, 17 bp, Artificial Sequence
  Synthetic
cccagauccccgccauc

SEQ ID NO: 9267 - DNA, 20 bp, Artificial Sequence
  Synthetic
tgagcatgacugtgctgucc

SEQ ID NO: 9268 - DNA, 21 bp, Artificial Sequence
  Synthetic
gcagtggcutctacctcugat

SEQ ID NO: 9269 - DNA, 20 bp, Artificial Sequence
  Synthetic
gtttccagugttcccacguc

SEQ ID NO: 9270 - DNA, 20 bp, Artificial Sequence
  Synthetic
ctctccgugctcacagtcuc

SEQ ID NO: 9271 - DNA, 17 bp, Artificial Sequence
  Synthetic
aatggccgugaggccut

SEQ ID NO: 9272 - DNA, 18 bp, Artificial Sequence
  Synthetic
ggaugggaggcggcatua

SEQ ID NO: 9273 - DNA, 20 bp, Artificial Sequence
  Synthetic
tgatggcuggctctgtctug

SEQ ID NO: 9274 - DNA, 19 bp, Artificial Sequence
  Synthetic
cccuacagcccugccaaac

SEQ ID NO: 9275 - DNA, 23 bp, Artificial Sequence
  Synthetic
ggcagcauacaggacaagaucac

SEQ ID NO: 9276 - DNA, 25 bp, Artificial Sequence
  Synthetic
agactataccagucccaagatucca

SEQ ID NO: 9277 - DNA, 28 bp, Artificial Sequence
  Synthetic
ggtttcccaaugtctttattgatgtucc

SEQ ID NO: 9278 - DNA, 18 bp, Artificial Sequence
  Synthetic
tcctagucctggcucgca

SEQ ID NO: 9279 - DNA, 19 bp, Artificial Sequence
  Synthetic
gccagagagcuccttgguc

SEQ ID NO: 9280 - DNA, 17 bp, Artificial Sequence
  Synthetic
ggcugcaggtgcauggt

SEQ ID NO: 9281 - DNA, 19 bp, Artificial Sequence
  Synthetic
cggccucttccctuaccag

SEQ ID NO: 9282 - DNA, 21 bp, Artificial Sequence
  Synthetic
gagutagagttcucccggcat

SEQ ID NO: 9283 - DNA, 20 bp, Artificial Sequence
  Synthetic
cctgccggguataaaagcug

SEQ ID NO: 9284 - DNA, 19 bp, Artificial Sequence
  Synthetic
gtgatggacugggcgguaa

SEQ ID NO: 9285 - DNA, 19 bp, Artificial Sequence
  Synthetic
accttggutgaggccucct

SEQ ID NO: 9286 - DNA, 20 bp, Artificial Sequence
  Synthetic
ttggccucacacgttccuac

SEQ ID NO: 9287 - DNA, 24 bp, Artificial Sequence
  Synthetic
ggccacaucaagatcactgactut

SEQ ID NO: 9288 - DNA, 18 bp, Artificial Sequence
  Synthetic
acccacagcucctcucca

SEQ ID NO: 9289 - DNA, 18 bp, Artificial Sequence
  Synthetic
accctgcugccttcaucc

SEQ ID NO: 9290 - DNA, 18 bp, Artificial Sequence
  Synthetic
ccctgcucccagcactua

SEQ ID NO: 9291 - DNA, 18 bp, Artificial Sequence
  Synthetic
gucgccaacagccucaag

SEQ ID NO: 9292 - DNA, 20 bp, Artificial Sequence
  Synthetic
ccaucctgugagcaccagaa

SEQ ID NO: 9293 - DNA, 22 bp, Artificial Sequence
  Synthetic
cacggtacutcctgcugaagag

SEQ ID NO: 9294 - DNA, 17 bp, Artificial Sequence
  Synthetic
ggccacuggagcccauc

SEQ ID NO: 9295 - DNA, 19 bp, Artificial Sequence
  Synthetic
gctuggaggactccuggac

SEQ ID NO: 9296 - DNA, 21 bp, Artificial Sequence
  Synthetic
cgtcctccauggcaacuacac

SEQ ID NO: 9297 - DNA, 21 bp, Artificial Sequence
  Synthetic
ggtatgacucgttgcccucct

SEQ ID NO: 9298 - DNA, 22 bp, Artificial Sequence
  Synthetic
cauccaggagggtcugaaagat

SEQ ID NO: 9299 - DNA, 20 bp, Artificial Sequence
  Synthetic
catccccacccutcacucac

SEQ ID NO: 9300 - DNA, 19 bp, Artificial Sequence
  Synthetic
caccuggctccttuccaca

SEQ ID NO: 9301 - DNA, 18 bp, Artificial Sequence
  Synthetic
cuctggtuggaggccact

SEQ ID NO: 9302 - DNA, 21 bp, Artificial Sequence
  Synthetic
gtgguggaatctgguaagggt

SEQ ID NO: 9303 - DNA, 20 bp, Artificial Sequence
  Synthetic
gacagugagggccatgtcuc

SEQ ID NO: 9304 - DNA, 19 bp, Artificial Sequence
  Synthetic
ggaccgucagcaagaucct

SEQ ID NO: 9305 - DNA, 19 bp, Artificial Sequence
  Synthetic
gcagggcaacccutcacuc

SEQ ID NO: 9306 - DNA, 22 bp, Artificial Sequence
  Synthetic
gcgccacuctctacttuacagt

SEQ ID NO: 9307 - DNA, 19 bp, Artificial Sequence
  Synthetic
ccgctgugggagaaagcuc

SEQ ID NO: 9308 - DNA, 20 bp, Artificial Sequence
  Synthetic
gagctuctcgttcucagcgt

SEQ ID NO: 9309 - DNA, 19 bp, Artificial Sequence
  Synthetic
ctgggtccugggcaagaut

SEQ ID NO: 9310 - DNA, 21 bp, Artificial Sequence
  Synthetic
cttctcacugggcucaggaac

SEQ ID NO: 9311 - DNA, 17 bp, Artificial Sequence
  Synthetic
gguctctugcgccggaa

SEQ ID NO: 9312 - DNA, 19 bp, Artificial Sequence
  Synthetic
ccatcgccuctaagcccut

SEQ ID NO: 9313 - DNA, 19 bp, Artificial Sequence
  Synthetic
ctgccgacutcttguccga

SEQ ID NO: 9314 - DNA, 17 bp, Artificial Sequence
  Synthetic
cugggaguggccccaat

SEQ ID NO: 9315 - DNA, 18 bp, Artificial Sequence
  Synthetic
ggcaggugccaccugaag

SEQ ID NO: 9316 - DNA, 20 bp, Artificial Sequence
  Synthetic
gaaggtccuagtgcctcugg

SEQ ID NO: 9317 - DNA, 23 bp, Artificial Sequence
  Synthetic
caacauccagcagguagagagaa

SEQ ID NO: 9318 - DNA, 21 bp, Artificial Sequence
  Synthetic
cccacgagcuctgtagctcua

SEQ ID NO: 9319 - DNA, 19 bp, Artificial Sequence
  Synthetic
caagtuagggcccggacug

SEQ ID NO: 9320 - DNA, 17 bp, Artificial Sequence
  Synthetic
cagtcaggccuggcuca

SEQ ID NO: 9321 - DNA, 17 bp, Artificial Sequence
  Synthetic
gggaatgcuggcgaugg

SEQ ID NO: 9322 - DNA, 18 bp, Artificial Sequence
  Synthetic
ccatctcccugcccauct

SEQ ID NO: 9323 - DNA, 17 bp, Artificial Sequence
  Synthetic
cgcccacugctgctcuc

SEQ ID NO: 9324 - DNA, 23 bp, Artificial Sequence
  Synthetic
ctgtcagaaguggactucgaaga

SEQ ID NO: 9325 - DNA, 18 bp, Artificial Sequence
  Synthetic
tgcccaaugctcgccuac

SEQ ID NO: 9326 - DNA, 20 bp, Artificial Sequence
  Synthetic
ccugcacagguacagaagcc

SEQ ID NO: 9327 - DNA, 19 bp, Artificial Sequence
  Synthetic
gacuccgagacaggcucac

SEQ ID NO: 9328 - DNA, 18 bp, Artificial Sequence
  Synthetic
ccttgtcgucccccugga

SEQ ID NO: 9329 - DNA, 22 bp, Artificial Sequence
  Synthetic
tgaccctaugctctgtguggat

SEQ ID NO: 9330 - DNA, 17 bp, Artificial Sequence
  Synthetic
tctgtgguccggcucct

SEQ ID NO: 9331 - DNA, 18 bp, Artificial Sequence
  Synthetic
gcctccagguccaacgug

SEQ ID NO: 9332 - DNA, 20 bp, Artificial Sequence
  Synthetic
caaatgtacuccggcagcuc

SEQ ID NO: 9333 - DNA, 17 bp, Artificial Sequence
  Synthetic
accaugagcggcgtguc

SEQ ID NO: 9334 - DNA, 18 bp, Artificial Sequence
  Synthetic
gccttccugcccttugct

SEQ ID NO: 9335 - DNA, 25 bp, Artificial Sequence
  Synthetic
cagagtgagaucttcacagttucca

SEQ ID NO: 9336 - DNA, 18 bp, Artificial Sequence
  Synthetic
tgtccgugagtcccccut

SEQ ID NO: 9337 - DNA, 26 bp, Artificial Sequence
  Synthetic
ggtagaugagtagaaaguccccagag

SEQ ID NO: 9338 - DNA, 22 bp, Artificial Sequence
  Synthetic
catcatctucagccacaugcac

SEQ ID NO: 9339 - DNA, 21 bp, Artificial Sequence
  Synthetic
gagcugaggacaagggctuac

SEQ ID NO: 9340 - DNA, 22 bp, Artificial Sequence
  Synthetic
caacactccucaagaacuggca

SEQ ID NO: 9341 - DNA, 20 bp, Artificial Sequence
  Synthetic
ctgagcccuggacccttuac

SEQ ID NO: 9342 - DNA, 20 bp, Artificial Sequence
  Synthetic
gcccctcgcugtcttctcua

SEQ ID NO: 9343 - DNA, 20 bp, Artificial Sequence
  Synthetic
cgcacggcucaatctucaca

SEQ ID NO: 9344 - DNA, 24 bp, Artificial Sequence
  Synthetic
gaacauggaggcgagaagaaaaug

SEQ ID NO: 9345 - DNA, 17 bp, Artificial Sequence
  Synthetic
cucagaccagcgccuga

SEQ ID NO: 9346 - DNA, 23 bp, Artificial Sequence
  Synthetic
ggagucaccaggaaccgtttaug

SEQ ID NO: 9347 - DNA, 22 bp, Artificial Sequence
  Synthetic
ccctctcccuttcctctgtuct

SEQ ID NO: 9348 - DNA, 23 bp, Artificial Sequence
  Synthetic
gcatggcaucgaagguaagaaag

SEQ ID NO: 9349 - DNA, 21 bp, Artificial Sequence
  Synthetic
ccagggagucccacagtgtua

SEQ ID NO: 9350 - DNA, 24 bp, Artificial Sequence
  Synthetic
catccugggtctcaauaaagagca

SEQ ID NO: 9351 - DNA, 21 bp, Artificial Sequence
  Synthetic
gtgggaguccccagaagagut

SEQ ID NO: 9352 - DNA, 17 bp, Artificial Sequence
  Synthetic
agcccuagcctcuccca

SEQ ID NO: 9353 - DNA, 18 bp, Artificial Sequence
  Synthetic
gcccagucctgcugagat

SEQ ID NO: 9354 - DNA, 19 bp, Artificial Sequence
  Synthetic
cuctgcauaaccgggacct

SEQ ID NO: 9355 - DNA, 20 bp, Artificial Sequence
  Synthetic
tgctggaguacgtgaagugg

SEQ ID NO: 9356 - DNA, 17 bp, Artificial Sequence
  Synthetic
gggcuggcatcccttug

SEQ ID NO: 9357 - DNA, 24 bp, Artificial Sequence
  Synthetic
gcatgccaaugtggtggtttauag

SEQ ID NO: 9358 - DNA, 21 bp, Artificial Sequence
  Synthetic
gctggtgtcaugctggtacug

SEQ ID NO: 9359 - DNA, 20 bp, Artificial Sequence
  Synthetic
gtguggagaccagggttuga

SEQ ID NO: 9360 - DNA, 22 bp, Artificial Sequence
  Synthetic
ccccttcctutgtctgccttua

SEQ ID NO: 9361 - DNA, 22 bp, Artificial Sequence
  Synthetic
ggttctgagacccugtgtgtug

SEQ ID NO: 9362 - DNA, 18 bp, Artificial Sequence
  Synthetic
cccaccgaugaccccauc

SEQ ID NO: 9363 - DNA, 18 bp, Artificial Sequence
  Synthetic
gcccucgaggatguccac

SEQ ID NO: 9364 - DNA, 21 bp, Artificial Sequence
  Synthetic
acagcaggcacuagggacuaa

SEQ ID NO: 9365 - DNA, 24 bp, Artificial Sequence
  Synthetic
ggctaggctcuacctcttcctuac

SEQ ID NO: 9366 - DNA, 23 bp, Artificial Sequence
  Synthetic
tcaccaaagtuttcccatcagut

SEQ ID NO: 9367 - DNA, 28 bp, Artificial Sequence
  Synthetic
cccaggtgtcucaaaatctatttctucc

SEQ ID NO: 9368 - DNA, 23 bp, Artificial Sequence
  Synthetic
gcagcagugcactaaauaacgag

SEQ ID NO: 9369 - DNA, 27 bp, Artificial Sequence
  Synthetic
gggttttaaauaccaggagacaugcaa

SEQ ID NO: 9370 - DNA, 23 bp, Artificial Sequence
  Synthetic
gggcatttuaagaaacgctcucg

SEQ ID NO: 9371 - DNA, 23 bp, Artificial Sequence
  Synthetic
tcttagccuccccatccttguag

SEQ ID NO: 9372 - DNA, 25 bp, Artificial Sequence
  Synthetic
tcgtcagtccuttcgtaacacaaut

SEQ ID NO: 9373 - DNA, 26 bp, Artificial Sequence
  Synthetic
ccagagtuaagggctctataatcuca

SEQ ID NO: 9374 - DNA, 19 bp, Artificial Sequence
  Synthetic
cgaugagggagguggcaga

SEQ ID NO: 9375 - DNA, 20 bp, Artificial Sequence
  Synthetic
cctgggtaugctccccatut

SEQ ID NO: 9376 - DNA, 24 bp, Artificial Sequence
  Synthetic
aaagugatgaugaggagcaaggac

SEQ ID NO: 9377 - DNA, 22 bp, Artificial Sequence
  Synthetic
gtgaggautcaggtguggaact

SEQ ID NO: 9378 - DNA, 23 bp, Artificial Sequence
  Synthetic
gaggaggguctagatcctctuga

SEQ ID NO: 9379 - DNA, 21 bp, Artificial Sequence
  Synthetic
gtgcttcagaguctccgtuga

SEQ ID NO: 9380 - DNA, 22 bp, Artificial Sequence
  Synthetic
tccgccaaaagaucccagatuc

SEQ ID NO: 9381 - DNA, 22 bp, Artificial Sequence
  Synthetic
gctgguggaagaaccttctcua

SEQ ID NO: 9382 - DNA, 26 bp, Artificial Sequence
  Synthetic
ccatccagugacaaatcccatuacat

SEQ ID NO: 9383 - DNA, 25 bp, Artificial Sequence
  Synthetic
gtagtaagatcucctgggctcttuc

SEQ ID NO: 9384 - DNA, 22 bp, Artificial Sequence
  Synthetic
ccaaagccacaugcctttgtug

SEQ ID NO: 9385 - DNA, 24 bp, Artificial Sequence
  Synthetic
taattuccagaagggcaaguccat

SEQ ID NO: 9386 - DNA, 20 bp, Artificial Sequence
  Synthetic
aaagcatcucgctccagugt

SEQ ID NO: 9387 - DNA, 31 bp, Artificial Sequence
  Synthetic
actaaatatacaatguttcccatggccauaa

SEQ ID NO: 9388 - DNA, 21 bp, Artificial Sequence
  Synthetic
gtgauaggagcccatguacgg

SEQ ID NO: 9389 - DNA, 23 bp, Artificial Sequence
  Synthetic
cgcccuccgttactactaugaca

SEQ ID NO: 9390 - DNA, 23 bp, Artificial Sequence
  Synthetic
gtttcucacctggattugcaagg

SEQ ID NO: 9391 - DNA, 26 bp, Artificial Sequence
  Synthetic
caggcattatguctgaagtcacauca

SEQ ID NO: 9392 - DNA, 17 bp, Artificial Sequence
  Synthetic
gcucttgcugggaggca

SEQ ID NO: 9393 - DNA, 27 bp, Artificial Sequence
  Synthetic
cgctttttgttutgttttgtagcucct

SEQ ID NO: 9394 - DNA, 22 bp, Artificial Sequence
  Synthetic
gtgcttctccuccatgtagcug

SEQ ID NO: 9395 - DNA, 21 bp, Artificial Sequence
  Synthetic
agtcgauggagacatgctcut

SEQ ID NO: 9396 - DNA, 27 bp, Artificial Sequence
  Synthetic
aaccctttcctuaccttaatagtgcug

SEQ ID NO: 9397 - DNA, 25 bp, Artificial Sequence
  Synthetic
acttcattucccagactuagcacaa

SEQ ID NO: 9398 - DNA, 19 bp, Artificial Sequence
  Synthetic
gccaaguccacgaggtugt

SEQ ID NO: 9399 - DNA, 21 bp, Artificial Sequence
  Synthetic
cagaagttgcugcagtggtuc

SEQ ID NO: 9400 - DNA, 23 bp, Artificial Sequence
  Synthetic
agcctgcttugagaacagaaugg

SEQ ID NO: 9401 - DNA, 23 bp, Artificial Sequence
  Synthetic
caagagtgugaatgaggcacuca

SEQ ID NO: 9402 - DNA, 21 bp, Artificial Sequence
  Synthetic
agcgctctguatcccctctua

SEQ ID NO: 9403 - DNA, 24 bp, Artificial Sequence
  Synthetic
gagctggugttcctctaugacaag

SEQ ID NO: 9404 - DNA, 22 bp, Artificial Sequence
  Synthetic
gtgcctctcugtggagtgttua

SEQ ID NO: 9405 - DNA, 21 bp, Artificial Sequence
  Synthetic
gctgtguggtcttcacaucgt

SEQ ID NO: 9406 - DNA, 21 bp, Artificial Sequence
  Synthetic
actgctgcuctgaggaacauc

SEQ ID NO: 9407 - DNA, 30 bp, Artificial Sequence
  Synthetic
gccgtgtttcugagctagaagattttatua

SEQ ID NO: 9408 - DNA, 27 bp, Artificial Sequence
  Synthetic
tctgatataggagutgatggcttccut

SEQ ID NO: 9409 - DNA, 25 bp, Artificial Sequence
  Synthetic
gagaatggaagucctctcauaaccc

SEQ ID NO: 9410 - DNA, 21 bp, Artificial Sequence
  Synthetic
ggtcggcugtcataaaggcut

SEQ ID NO: 9411 - DNA, 23 bp, Artificial Sequence
  Synthetic
gtccttcccutctgtttagctuc

SEQ ID NO: 9412 - DNA, 21 bp, Artificial Sequence
  Synthetic
caccacgcugctgtcatagua

SEQ ID NO: 9413 - DNA, 21 bp, Artificial Sequence
  Synthetic
ggagucccagatucaggaagg

SEQ ID NO: 9414 - DNA, 20 bp, Artificial Sequence
  Synthetic
gggaagacugccactgacug

SEQ ID NO: 9415 - DNA, 22 bp, Artificial Sequence
  Synthetic
cgtgtgtgaucgttttggctut

SEQ ID NO: 9416 - DNA, 25 bp, Artificial Sequence
  Synthetic
cctgagaaaggaggugtagucacat

SEQ ID NO: 9417 - DNA, 22 bp, Artificial Sequence
  Synthetic
gacagaaccutcagctgtgugt

SEQ ID NO: 9418 - DNA, 22 bp, Artificial Sequence
  Synthetic
cucaagtcugcaaacccagaga

SEQ ID NO: 9419 - DNA, 27 bp, Artificial Sequence
  Synthetic
tgtacttccttcutattggatgcctug

SEQ ID NO: 9420 - DNA, 25 bp, Artificial Sequence
  Synthetic
tggcauagagcacaattttcuggaa

SEQ ID NO: 9421 - DNA, 21 bp, Artificial Sequence
  Synthetic
cttgtcccutggcauaccaca

SEQ ID NO: 9422 - DNA, 19 bp, Artificial Sequence
  Synthetic
cgctcagguccaactucga

SEQ ID NO: 9423 - DNA, 23 bp, Artificial Sequence
  Synthetic
acctctttgucgttgacctucac

SEQ ID NO: 9424 - DNA, 21 bp, Artificial Sequence
  Synthetic
ggaguaccagcccuaccagag

SEQ ID NO: 9425 - DNA, 20 bp, Artificial Sequence
  Synthetic
cgccuccgcaatccucaaaa

SEQ ID NO: 9426 - DNA, 17 bp, Artificial Sequence
  Synthetic
gccgcagugccauaagc

SEQ ID NO: 9427 - DNA, 18 bp, Artificial Sequence
  Synthetic
acgtggcgugaggaacuc

SEQ ID NO: 9428 - DNA, 21 bp, Artificial Sequence
  Synthetic
cctctcaccugtgctaccuca

SEQ ID NO: 9429 - DNA, 21 bp, Artificial Sequence
  Synthetic
ctcgtagagcucaggcactut

SEQ ID NO: 9430 - DNA, 25 bp, Artificial Sequence
  Synthetic
gctcctctgugtctaactcaaguct

SEQ ID NO: 9431 - DNA, 23 bp, Artificial Sequence
  Synthetic
tcattgatgcuggacaggaagut

SEQ ID NO: 9432 - DNA, 21 bp, Artificial Sequence
  Synthetic
gtacattccgcucacggauct

SEQ ID NO: 9433 - DNA, 18 bp, Artificial Sequence
  Synthetic
ccttgcucccctggtgug

SEQ ID NO: 9434 - DNA, 22 bp, Artificial Sequence
  Synthetic
caattggugcacctctttucca

SEQ ID NO: 9435 - DNA, 18 bp, Artificial Sequence
  Synthetic
ggugccctguacacggaa

SEQ ID NO: 9436 - DNA, 23 bp, Artificial Sequence
  Synthetic
cagacccugaggatactgtgcua

SEQ ID NO: 9437 - DNA, 22 bp, Artificial Sequence
  Synthetic
atgaaaaaggacgccaugcauc

SEQ ID NO: 9438 - DNA, 21 bp, Artificial Sequence
  Synthetic
tcacucgggatccucaaggag

SEQ ID NO: 9439 - DNA, 21 bp, Artificial Sequence
  Synthetic
cagctcacggaaguacagcut

SEQ ID NO: 9440 - DNA, 18 bp, Artificial Sequence
  Synthetic
accucgccacggtcttug

SEQ ID NO: 9441 - DNA, 19 bp, Artificial Sequence
  Synthetic
acctcugtcaggucagggt

SEQ ID NO: 9442 - DNA, 26 bp, Artificial Sequence
  Synthetic
ggtacattuctttcgtgtucaaacca

SEQ ID NO: 9443 - DNA, 29 bp, Artificial Sequence
  Synthetic
agccagtgatttucttttgaacatttcuc

SEQ ID NO: 9444 - DNA, 21 bp, Artificial Sequence
  Synthetic
cctaccaguctgugcagcaat

SEQ ID NO: 9445 - DNA, 25 bp, Artificial Sequence
  Synthetic
ctcaugagaaccttatguggaaccc

SEQ ID NO: 9446 - DNA, 25 bp, Artificial Sequence
  Synthetic
ggaugagaaagguaagcctacatua

SEQ ID NO: 9447 - DNA, 22 bp, Artificial Sequence
  Synthetic
tctcccccucttcttagcctug

SEQ ID NO: 9448 - DNA, 31 bp, Artificial Sequence
  Synthetic
tccaagagttttugacatgatgtattcauct

SEQ ID NO: 9449 - DNA, 25 bp, Artificial Sequence
  Synthetic
tcagtgatcgccucttgtgaauaaa

SEQ ID NO: 9450 - DNA, 30 bp, Artificial Sequence
  Synthetic
agtgtttcttgcugtatgttcggtattuat

SEQ ID NO: 9451 - DNA, 27 bp, Artificial Sequence
  Synthetic
ttgatacatgaaautcaacagcccuct

SEQ ID NO: 9452 - DNA, 22 bp, Artificial Sequence
  Synthetic
agaattcttccugccacgugaa

SEQ ID NO: 9453 - DNA, 31 bp, Artificial Sequence
  Synthetic
acacacaaaauacggttataaaagacugact

SEQ ID NO: 9454 - DNA, 29 bp, Artificial Sequence
  Synthetic
gagtcttcttaaautgagctgctuaaaaa

SEQ ID NO: 9455 - DNA, 25 bp, Artificial Sequence
  Synthetic
gcaagaaugagcaggatagucaaac

SEQ ID NO: 9456 - DNA, 22 bp, Artificial Sequence
  Synthetic
caagcccacugagactagucaa

SEQ ID NO: 9457 - DNA, 26 bp, Artificial Sequence
  Synthetic
acaaaaagtagacugacctgguagga

SEQ ID NO: 9458 - DNA, 21 bp, Artificial Sequence
  Synthetic
ggucaacaaagcagctauggg

SEQ ID NO: 9459 - DNA, 28 bp, Artificial Sequence
  Synthetic
atttggttttcuctcttagcaacucact

SEQ ID NO: 9460 - DNA, 21 bp, Artificial Sequence
  Synthetic
gtacucagccggcagcauaat

SEQ ID NO: 9461 - DNA, 31 bp, Artificial Sequence
  Synthetic
agttaccaaagtuacagaaggattccattua

SEQ ID NO: 9462 - DNA, 31 bp, Artificial Sequence
  Synthetic
ttagatttatgatgaauatccttgggcagua

SEQ ID NO: 9463 - DNA, 28 bp, Artificial Sequence
  Synthetic
tgtacataaatugcactgttgucagagt

SEQ ID NO: 9464 - DNA, 22 bp, Artificial Sequence
  Synthetic
ggcagaccuaatgcatcuggga

SEQ ID NO: 9465 - DNA, 23 bp, Artificial Sequence
  Synthetic
cgcatactgtucattggaggcut

SEQ ID NO: 9466 - DNA, 27 bp, Artificial Sequence
  Synthetic
tccttagttcaautggtgatttcugct

SEQ ID NO: 9467 - DNA, 23 bp, Artificial Sequence
  Synthetic
gacactcaugaaacctgcaccua

SEQ ID NO: 9468 - DNA, 20 bp, Artificial Sequence
  Synthetic
cgcagagaucggccctacua

SEQ ID NO: 9469 - DNA, 28 bp, Artificial Sequence
  Synthetic
caaggaataaucataatgttguggccaa

SEQ ID NO: 9470 - DNA, 22 bp, Artificial Sequence
  Synthetic
gggacuaaccaatggtggugat

SEQ ID NO: 9471 - DNA, 24 bp, Artificial Sequence
  Synthetic
ccaactcccauattgaggtuaggg

SEQ ID NO: 9472 - DNA, 22 bp, Artificial Sequence
  Synthetic
gagggcgacagaauatgcagua

SEQ ID NO: 9473 - DNA, 21 bp, Artificial Sequence
  Synthetic
caugccgattgugcacacaaa

SEQ ID NO: 9474 - DNA, 20 bp, Artificial Sequence
  Synthetic
tcuctcagggucaacagcca

SEQ ID NO: 9475 - DNA, 24 bp, Artificial Sequence
  Synthetic
gugagcaugcaaaaggagaacaag

SEQ ID NO: 9476 - DNA, 27 bp, Artificial Sequence
  Synthetic
ccctcaaaaaugctggtgauaagagaa

SEQ ID NO: 9477 - DNA, 21 bp, Artificial Sequence
  Synthetic
acaccacagguccctcacaua

SEQ ID NO: 9478 - DNA, 28 bp, Artificial Sequence
  Synthetic
tggctgttgtatutatttctgtctccug

SEQ ID NO: 9479 - DNA, 27 bp, Artificial Sequence
  Synthetic
cccagggtataaaucacgttaagacut

SEQ ID NO: 9480 - DNA, 25 bp, Artificial Sequence
  Synthetic
cctagttgcataugctcggaaagut

SEQ ID NO: 9481 - DNA, 24 bp, Artificial Sequence
  Synthetic
cccgtcugaagcatatgtacuact

SEQ ID NO: 9482 - DNA, 22 bp, Artificial Sequence
  Synthetic
caagtatgauccgtggcagugt

SEQ ID NO: 9483 - DNA, 22 bp, Artificial Sequence
  Synthetic
gcataaagcgggugttcaggua

SEQ ID NO: 9484 - DNA, 24 bp, Artificial Sequence
  Synthetic
cagttcccaucacagggaaugaat

SEQ ID NO: 9485 - DNA, 22 bp, Artificial Sequence
  Synthetic
cccactattugctgccactcuc

SEQ ID NO: 9486 - DNA, 20 bp, Artificial Sequence
  Synthetic
cccuccaaggcagacaccua

SEQ ID NO: 9487 - DNA, 18 bp, Artificial Sequence
  Synthetic
gaagcagcggugctgtug

SEQ ID NO: 9488 - DNA, 26 bp, Artificial Sequence
  Synthetic
gcatgagaaagggugttcagatuact

SEQ ID NO: 9489 - DNA, 26 bp, Artificial Sequence
  Synthetic
gctggtcttccucctcttttattuca

SEQ ID NO: 9490 - DNA, 29 bp, Artificial Sequence
  Synthetic
tgagacttgagtaaugtttgatgtcacut

SEQ ID NO: 9491 - DNA, 27 bp, Artificial Sequence
  Synthetic
ccaggcautattgaacauaagccaaat

SEQ ID NO: 9492 - DNA, 20 bp, Artificial Sequence
  Synthetic
cggaacagtucaccccagua

SEQ ID NO: 9493 - DNA, 31 bp, Artificial Sequence
  Synthetic
tggacaacaaacuaattagcactttucaaaa

SEQ ID NO: 9494 - DNA, 28 bp, Artificial Sequence
  Synthetic
caacagtaaattugcacctcagtaacut

SEQ ID NO: 9495 - DNA, 23 bp, Artificial Sequence
  Synthetic
cggttttgucagaagcaugaact

SEQ ID NO: 9496 - DNA, 22 bp, Artificial Sequence
  Synthetic
ctgggagagugagagggtgtua

SEQ ID NO: 9497 - DNA, 22 bp, Artificial Sequence
  Synthetic
actgcagucctcaagcattuag

SEQ ID NO: 9498 - DNA, 28 bp, Artificial Sequence
  Synthetic
tgtttcttgucagccatgattattcugt

SEQ ID NO: 9499 - DNA, 25 bp, Artificial Sequence
  Synthetic
gccagaaaucaccctcgaaauaagg

SEQ ID NO: 9500 - DNA, 25 bp, Artificial Sequence
  Synthetic
aaaaauaagagcagcctgaguaggg

SEQ ID NO: 9501 - DNA, 20 bp, Artificial Sequence
  Synthetic
tggccagaaaucttgccgut

SEQ ID NO: 9502 - DNA, 22 bp, Artificial Sequence
  Synthetic
cttggagaguttacgugcacct

SEQ ID NO: 9503 - DNA, 22 bp, Artificial Sequence
  Synthetic
gctggttgtugctctcatcauc

SEQ ID NO: 9504 - DNA, 18 bp, Artificial Sequence
  Synthetic
gcugcagcaccgacuaca

SEQ ID NO: 9505 - DNA, 18 bp, Artificial Sequence
  Synthetic
gttggctgutggccagut

SEQ ID NO: 9506 - DNA, 19 bp, Artificial Sequence
  Synthetic
cagaugcccccgatgacuc

SEQ ID NO: 9507 - DNA, 21 bp, Artificial Sequence
  Synthetic
gcatcccagacugtagtugct

SEQ ID NO: 9508 - DNA, 23 bp, Artificial Sequence
  Synthetic
actctaauccacaacccauccct

SEQ ID NO: 9509 - DNA, 23 bp, Artificial Sequence
  Synthetic
gcctgcatuggattcatgttcug

SEQ ID NO: 9510 - DNA, 20 bp, Artificial Sequence
  Synthetic
ggatgcagcaucacaugcaa

SEQ ID NO: 9511 - DNA, 22 bp, Artificial Sequence
  Synthetic
cccatctgtugctgaaggaguc

SEQ ID NO: 9512 - DNA, 25 bp, Artificial Sequence
  Synthetic
ccagaattcaaugctttctcagcut

SEQ ID NO: 9513 - DNA, 25 bp, Artificial Sequence
  Synthetic
tgctcccaaaauactacaaggtguc

SEQ ID NO: 9514 - DNA, 18 bp, Artificial Sequence
  Synthetic
ggctuggcctgtgguaga

SEQ ID NO: 9515 - DNA, 20 bp, Artificial Sequence
  Synthetic
gtcccucacacctacaccug

SEQ ID NO: 9516 - DNA, 24 bp, Artificial Sequence
  Synthetic
cctcttcgucctcctcatcugaat

SEQ ID NO: 9517 - DNA, 22 bp, Artificial Sequence
  Synthetic
cuatggcccucaacaggagaag

SEQ ID NO: 9518 - DNA, 26 bp, Artificial Sequence
  Synthetic
gagtgaaagaugagtcagagucagag

SEQ ID NO: 9519 - DNA, 25 bp, Artificial Sequence
  Synthetic
ctaccctactuattcacccccugaa

SEQ ID NO: 9520 - DNA, 22 bp, Artificial Sequence
  Synthetic
ggtctcucggacttgagtcuct

SEQ ID NO: 9521 - DNA, 23 bp, Artificial Sequence
  Synthetic
gcctatacucgagaggcttaugg

SEQ ID NO: 9522 - DNA, 21 bp, Artificial Sequence
  Synthetic
gtagacaaucccugcggacaa

SEQ ID NO: 9523 - DNA, 24 bp, Artificial Sequence
  Synthetic
ccagttaggtcutatcctggccua

SEQ ID NO: 9524 - DNA, 19 bp, Artificial Sequence
  Synthetic
cctccccaccuccttggua

SEQ ID NO: 9525 - DNA, 26 bp, Artificial Sequence
  Synthetic
tgacatcccugaaaagctttgatuca

SEQ ID NO: 9526 - DNA, 22 bp, Artificial Sequence
  Synthetic
ttggaagguctccucaaagcag

SEQ ID NO: 9527 - DNA, 22 bp, Artificial Sequence
  Synthetic
tttttagcaguatccgccguca

SEQ ID NO: 9528 - DNA, 21 bp, Artificial Sequence
  Synthetic
ccatcgtgggucttgctctug

SEQ ID NO: 9529 - DNA, 23 bp, Artificial Sequence
  Synthetic
aggcugaagaaaactgccaugaa

SEQ ID NO: 9530 - DNA, 25 bp, Artificial Sequence
  Synthetic
ggtcaagtgtautgacatcccacug

SEQ ID NO: 9531 - DNA, 27 bp, Artificial Sequence
  Synthetic
ccattcaacccuacttccctcatuaag

SEQ ID NO: 9532 - DNA, 21 bp, Artificial Sequence
  Synthetic
tcaggguctctucaggaacca

SEQ ID NO: 9533 - DNA, 22 bp, Artificial Sequence
  Synthetic
tcattgcugccttcaucaggac

SEQ ID NO: 9534 - DNA, 22 bp, Artificial Sequence
  Synthetic
tgagtgggagcaguagtacugg

SEQ ID NO: 9535 - DNA, 24 bp, Artificial Sequence
  Synthetic
tgccttaaccaacuctgttctcug

SEQ ID NO: 9536 - DNA, 22 bp, Artificial Sequence
  Synthetic
cttcaaugaccaccaggtccut

SEQ ID NO: 9537 - DNA, 22 bp, Artificial Sequence
  Synthetic
gatggagguagaaggtcuccca

SEQ ID NO: 9538 - DNA, 21 bp, Artificial Sequence
  Synthetic
cctgagucccagctgtccaua

SEQ ID NO: 9539 - DNA, 24 bp, Artificial Sequence
  Synthetic
tcatcctacucacctttcccucat

SEQ ID NO: 9540 - DNA, 22 bp, Artificial Sequence
  Synthetic
gctgcugttcccuaaagacaca

SEQ ID NO: 9541 - DNA, 21 bp, Artificial Sequence
  Synthetic
gttggacgacgutcacaaugg

SEQ ID NO: 9542 - DNA, 26 bp, Artificial Sequence
  Synthetic
caaactttcucaccatggtttcagut

SEQ ID NO: 9543 - DNA, 26 bp, Artificial Sequence
  Synthetic
tccttttctttcugccttcttaggug

SEQ ID NO: 9544 - DNA, 20 bp, Artificial Sequence
  Synthetic
gctagtcacuggtgcggtuc

SEQ ID NO: 9545 - DNA, 30 bp, Artificial Sequence
  Synthetic
ggctttttggtguttgaattttctgtuaat

SEQ ID NO: 9546 - DNA, 20 bp, Artificial Sequence
  Synthetic
cagctcgutcccgataucca

SEQ ID NO: 9547 - DNA, 30 bp, Artificial Sequence
  Synthetic
ggctccagguaaagaaaataaacattgaut

SEQ ID NO: 9548 - DNA, 23 bp, Artificial Sequence
  Synthetic
cccagcugtattatugacggcat

SEQ ID NO: 9549 - DNA, 22 bp, Artificial Sequence
  Synthetic
cctggacccaaacuacatguct

SEQ ID NO: 9550 - DNA, 19 bp, Artificial Sequence
  Synthetic
gctgcaucacacgctcauc

SEQ ID NO: 9551 - DNA, 21 bp, Artificial Sequence
  Synthetic
gctgaagagcugaggaccuct

SEQ ID NO: 9552 - DNA, 22 bp, Artificial Sequence
  Synthetic
ttgggtgagguccttgacatuc

SEQ ID NO: 9553 - DNA, 21 bp, Artificial Sequence
  Synthetic
ctcctgggutggttgagacut

SEQ ID NO: 9554 - DNA, 24 bp, Artificial Sequence
  Synthetic
cttcagaatctugttggctgcaut

SEQ ID NO: 9555 - DNA, 22 bp, Artificial Sequence
  Synthetic
gctctuccccaacccacattuc

SEQ ID NO: 9556 - DNA, 21 bp, Artificial Sequence
  Synthetic
catggccuaccagagtugcat

SEQ ID NO: 9557 - DNA, 23 bp, Artificial Sequence
  Synthetic
ctaacacgugtgtgtuccaacag

SEQ ID NO: 9558 - DNA, 18 bp, Artificial Sequence
  Synthetic
tcacagguggcctgctuc

SEQ ID NO: 9559 - DNA, 21 bp, Artificial Sequence
  Synthetic
gggcttguttctctgctucca

SEQ ID NO: 9560 - DNA, 19 bp, Artificial Sequence
  Synthetic
gggtggguggttgtcacuc

SEQ ID NO: 9561 - DNA, 26 bp, Artificial Sequence
  Synthetic
gtagaggacuggcagaaaatcctuat

SEQ ID NO: 9562 - DNA, 30 bp, Artificial Sequence
  Synthetic
aaaagtatggaaauaagcctcaaaaaugac

SEQ ID NO: 9563 - DNA, 24 bp, Artificial Sequence
  Synthetic
gtcccaagggutgtttctcttcua

SEQ ID NO: 9564 - DNA, 24 bp, Artificial Sequence
  Synthetic
ccaaagaucaaagagacgaaguct

SEQ ID NO: 9565 - DNA, 20 bp, Artificial Sequence
  Synthetic
gatgccctugtggcctauga

SEQ ID NO: 9566 - DNA, 26 bp, Artificial Sequence
  Synthetic
ggaactccagutctttgtagtguagt

SEQ ID NO: 9567 - DNA, 22 bp, Artificial Sequence
  Synthetic
ttctcttgttugtgccccauct

SEQ ID NO: 9568 - DNA, 22 bp, Artificial Sequence
  Synthetic
atgatgagtccutcagcagcuc

SEQ ID NO: 9569 - DNA, 24 bp, Artificial Sequence
  Synthetic
caattggcccutgaaactgatugt

SEQ ID NO: 9570 - DNA, 23 bp, Artificial Sequence
  Synthetic
tgtctgtccagacucccatctua

SEQ ID NO: 9571 - DNA, 21 bp, Artificial Sequence
  Synthetic
cggagtcccuggatttcacug

SEQ ID NO: 9572 - DNA, 23 bp, Artificial Sequence
  Synthetic
gggcagguagagcttaaatucac

SEQ ID NO: 9573 - DNA, 29 bp, Artificial Sequence
  Synthetic
ttcatatatcaucagaaagggaccugact

SEQ ID NO: 9574 - DNA, 22 bp, Artificial Sequence
  Synthetic
acagctggguagaactcaucca

SEQ ID NO: 9575 - DNA, 21 bp, Artificial Sequence
  Synthetic
ctctgccugaagtcacgucat

SEQ ID NO: 9576 - DNA, 26 bp, Artificial Sequence
  Synthetic
agaaaattcaguagcaccucaagcaa

SEQ ID NO: 9577 - DNA, 27 bp, Artificial Sequence
  Synthetic
caactatgcttucttttctctcguact

SEQ ID NO: 9578 - DNA, 24 bp, Artificial Sequence
  Synthetic
cttcagaauaggctccatguaggg

SEQ ID NO: 9579 - DNA, 26 bp, Artificial Sequence
  Synthetic
ctgccatagagaacauatgagcctut

SEQ ID NO: 9580 - DNA, 22 bp, Artificial Sequence
  Synthetic
agtttgcuaagcacatcugcca

SEQ ID NO: 9581 - DNA, 20 bp, Artificial Sequence
  Synthetic
ccactgugcggatcattucc

SEQ ID NO: 9582 - DNA, 21 bp, Artificial Sequence
  Synthetic
ggguttgtgcauaaggaccag

SEQ ID NO: 9583 - DNA, 23 bp, Artificial Sequence
  Synthetic
cccagcccutatgtgacttgtut

SEQ ID NO: 9584 - DNA, 24 bp, Artificial Sequence
  Synthetic
cgcgaggcaaauagacctuaaact

SEQ ID NO: 9585 - DNA, 28 bp, Artificial Sequence
  Synthetic
gagctatctacuttgtcttttctgugct

SEQ ID NO: 9586 - DNA, 22 bp, Artificial Sequence
  Synthetic
tttgtuccgaagcccaugagat

SEQ ID NO: 9587 - DNA, 23 bp, Artificial Sequence
  Synthetic
gcccagttugaatgccagtcaua

SEQ ID NO: 9588 - DNA, 20 bp, Artificial Sequence
  Synthetic
gctacagcucccucacggat

SEQ ID NO: 9589 - DNA, 24 bp, Artificial Sequence
  Synthetic
ggtaccaaugagagttctcggtut

SEQ ID NO: 9590 - DNA, 25 bp, Artificial Sequence
  Synthetic
catctgagcuggaaaccaatucaaa

SEQ ID NO: 9591 - DNA, 21 bp, Artificial Sequence
  Synthetic
acucccaccaccacagtuaga

SEQ ID NO: 9592 - DNA, 25 bp, Artificial Sequence
  Synthetic
ggaagatgacuggatggaaaacauc

SEQ ID NO: 9593 - DNA, 22 bp, Artificial Sequence
  Synthetic
gcctgtagugctggtcattuct

SEQ ID NO: 9594 - DNA, 17 bp, Artificial Sequence
  Synthetic
tggcggugaaggctuga

SEQ ID NO: 9595 - DNA, 17 bp, Artificial Sequence
  Synthetic
cgctcucccggaugagg

SEQ ID NO: 9596 - DNA, 20 bp, Artificial Sequence
  Synthetic
tcaatacgaggccugcccua

SEQ ID NO: 9597 - DNA, 18 bp, Artificial Sequence
  Synthetic
cuccaccagctucagcgt

SEQ ID NO: 9598 - DNA, 22 bp, Artificial Sequence
  Synthetic
cccaggagcccauctacaucat

SEQ ID NO: 9599 - DNA, 25 bp, Artificial Sequence
  Synthetic
tgggucagaagaaaaggugtattuc

SEQ ID NO: 9600 - DNA, 21 bp, Artificial Sequence
  Synthetic
agggaggguacgtgtgagaut

SEQ ID NO: 9601 - DNA, 25 bp, Artificial Sequence
  Synthetic
acatctgactugatggtgaatgucc

SEQ ID NO: 9602 - DNA, 20 bp, Artificial Sequence
  Synthetic
cagtaccagccucagcctug

SEQ ID NO: 9603 - DNA, 21 bp, Artificial Sequence
  Synthetic
gtgtcacatgugggtgggaut

SEQ ID NO: 9604 - DNA, 23 bp, Artificial Sequence
  Synthetic
ggccttgctuaggatcactacut

SEQ ID NO: 9605 - DNA, 25 bp, Artificial Sequence
  Synthetic
cctgtcagttcugatactgaggaug

SEQ ID NO: 9606 - DNA, 19 bp, Artificial Sequence
  Synthetic
ctcuaagcgccaacccuca

SEQ ID NO: 9607 - DNA, 18 bp, Artificial Sequence
  Synthetic
ctccgccuctcttuggct

SEQ ID NO: 9608 - DNA, 17 bp, Artificial Sequence
  Synthetic
ggcctgggucttgggut

SEQ ID NO: 9609 - DNA, 18 bp, Artificial Sequence
  Synthetic
cggcuggagagagctgug

SEQ ID NO: 9610 - DNA, 25 bp, Artificial Sequence
  Synthetic
cgtagaaatagugctggtacgaguc

SEQ ID NO: 9611 - DNA, 17 bp, Artificial Sequence
  Synthetic
gcaggcugcaagcuggt

SEQ ID NO: 9612 - DNA, 22 bp, Artificial Sequence
  Synthetic
tcccctuccacataaacaugcc

SEQ ID NO: 9613 - DNA, 23 bp, Artificial Sequence
  Synthetic
cagaagcaagugaggtccucaaa

SEQ ID NO: 9614 - DNA, 22 bp, Artificial Sequence
  Synthetic
ccagaggcugagccatagacug

SEQ ID NO: 9615 - DNA, 22 bp, Artificial Sequence
  Synthetic
tcctcccagcugatctgaagut

SEQ ID NO: 9616 - DNA, 21 bp, Artificial Sequence
  Synthetic
agcugacaggcagaccuagat

SEQ ID NO: 9617 - DNA, 21 bp, Artificial Sequence
  Synthetic
cgagggagaucccatcaggut

SEQ ID NO: 9618 - DNA, 22 bp, Artificial Sequence
  Synthetic
gcaggccugattcaatgacuct

SEQ ID NO: 9619 - DNA, 22 bp, Artificial Sequence
  Synthetic
gtcaccuccacaaggatgugaa

SEQ ID NO: 9620 - DNA, 19 bp, Artificial Sequence
  Synthetic
agacgcugggctaucgaag

SEQ ID NO: 9621 - DNA, 20 bp, Artificial Sequence
  Synthetic
tccagggaccutggtaggug

SEQ ID NO: 9622 - DNA, 22 bp, Artificial Sequence
  Synthetic
gctcagtcugcttctcttccut

SEQ ID NO: 9623 - DNA, 19 bp, Artificial Sequence
  Synthetic
ccaguaccaggcagggtug

SEQ ID NO: 9624 - DNA, 19 bp, Artificial Sequence
  Synthetic
gctatuggcagcagcctug

SEQ ID NO: 9625 - DNA, 22 bp, Artificial Sequence
  Synthetic
ccuaattgugagggcagacaga

SEQ ID NO: 9626 - DNA, 29 bp, Artificial Sequence
  Synthetic
gaaguacaacaaagauaacaaaggtagug

SEQ ID NO: 9627 - DNA, 25 bp, Artificial Sequence
  Synthetic
atatcaagtataugggctggcctug

SEQ ID NO: 9628 - DNA, 20 bp, Artificial Sequence
  Synthetic
ccacgcccaguatccaggua

SEQ ID NO: 9629 - DNA, 20 bp, Artificial Sequence
  Synthetic
ccctgggaguggtcaactuc

SEQ ID NO: 9630 - DNA, 18 bp, Artificial Sequence
  Synthetic
ctcuccacagggcacugg

SEQ ID NO: 9631 - DNA, 20 bp, Artificial Sequence
  Synthetic
tgcaaaggagcuctgctuca

SEQ ID NO: 9632 - DNA, 22 bp, Artificial Sequence
  Synthetic
gtcaaagagaucacccgucagt

SEQ ID NO: 9633 - DNA, 22 bp, Artificial Sequence
  Synthetic
agaaggcttccuctaccaccut

SEQ ID NO: 9634 - DNA, 26 bp, Artificial Sequence
  Synthetic
tgtgacttcagcuacgtctctgaaua

SEQ ID NO: 9635 - DNA, 21 bp, Artificial Sequence
  Synthetic
ctgtgucccaagaccctgaug

SEQ ID NO: 9636 - DNA, 29 bp, Artificial Sequence
  Synthetic
gttctcaagtctguctctctgtgttatut

SEQ ID NO: 9637 - DNA, 27 bp, Artificial Sequence
  Synthetic
acagctuaaacagaaagtcaugaacca

SEQ ID NO: 9638 - DNA, 17 bp, Artificial Sequence
  Synthetic
gcugggcagcgtgtuct

SEQ ID NO: 9639 - DNA, 21 bp, Artificial Sequence
  Synthetic
ggagcgccugataatccaguc

SEQ ID NO: 9640 - DNA, 21 bp, Artificial Sequence
  Synthetic
ccgtcactucacgtgaggtua

SEQ ID NO: 9641 - DNA, 18 bp, Artificial Sequence
  Synthetic
ggtgcgugcgctctuaga

SEQ ID NO: 9642 - DNA, 20 bp, Artificial Sequence
  Synthetic
gcgcacguccttcttctcut

SEQ ID NO: 9643 - DNA, 22 bp, Artificial Sequence
  Synthetic
gcugcagcaguaaagaacttuc

SEQ ID NO: 9644 - DNA, 21 bp, Artificial Sequence
  Synthetic
tgtctgtcugtctgccugact

SEQ ID NO: 9645 - DNA, 19 bp, Artificial Sequence
  Synthetic
agccaaugggaaggcctug

SEQ ID NO: 9646 - DNA, 28 bp, Artificial Sequence
  Synthetic
ctcaagcugcgaaaacataatagaaaug

SEQ ID NO: 9647 - DNA, 23 bp, Artificial Sequence
  Synthetic
gccagatgacagucacaagacut

SEQ ID NO: 9648 - DNA, 25 bp, Artificial Sequence
  Synthetic
agccagaaagggccuatuaaaacag

SEQ ID NO: 9649 - DNA, 25 bp, Artificial Sequence
  Synthetic
ccaagtgaaaautggagactucggt

SEQ ID NO: 9650 - DNA, 22 bp, Artificial Sequence
  Synthetic
cactggccuttatgacccuaga

SEQ ID NO: 9651 - DNA, 24 bp, Artificial Sequence
  Synthetic
agtggagguaaccacatagcugat

SEQ ID NO: 9652 - DNA, 21 bp, Artificial Sequence
  Synthetic
atagttcaugcagcgggucat

SEQ ID NO: 9653 - DNA, 22 bp, Artificial Sequence
  Synthetic
ggctgagaaguttgtagguggt

SEQ ID NO: 9654 - DNA, 21 bp, Artificial Sequence
  Synthetic
ccuagacagcaccgtaauggg

SEQ ID NO: 9655 - DNA, 25 bp, Artificial Sequence
  Synthetic
cagcttggcuaaacttgacctttut

SEQ ID NO: 9656 - DNA, 21 bp, Artificial Sequence
  Synthetic
tgttccacuggcuccagaaac

SEQ ID NO: 9657 - DNA, 26 bp, Artificial Sequence
  Synthetic
tctattctgggacccugatggatuac

SEQ ID NO: 9658 - DNA, 26 bp, Artificial Sequence
  Synthetic
tttagcaugaagctgatgttauccgt

SEQ ID NO: 9659 - DNA, 23 bp, Artificial Sequence
  Synthetic
actttcagaucgaggugcagaag

SEQ ID NO: 9660 - DNA, 22 bp, Artificial Sequence
  Synthetic
gtaatgatgggcauctgctgug

SEQ ID NO: 9661 - DNA, 25 bp, Artificial Sequence
  Synthetic
cagccacutaagctgauagagacat

SEQ ID NO: 9662 - DNA, 24 bp, Artificial Sequence
  Synthetic
aagattcccagucaccatcactuc

SEQ ID NO: 9663 - DNA, 25 bp, Artificial Sequence
  Synthetic
cctgaaggugaaatacttggcuacc

SEQ ID NO: 9664 - DNA, 20 bp, Artificial Sequence
  Synthetic
agccatcccuagacacucgt

SEQ ID NO: 9665 - DNA, 21 bp, Artificial Sequence
  Synthetic
cctccctgugtagtagcctuc

SEQ ID NO: 9666 - DNA, 22 bp, Artificial Sequence
  Synthetic
gatggtgcgauttggagcauac

SEQ ID NO: 9667 - DNA, 21 bp, Artificial Sequence
  Synthetic
ggccaaatguatccgcctuga

SEQ ID NO: 9668 - DNA, 24 bp, Artificial Sequence
  Synthetic
cctcaagaacacgguttcaucaat

SEQ ID NO: 9669 - DNA, 27 bp, Artificial Sequence
  Synthetic
ttttgtctttagcgcutctctgaagua

SEQ ID NO: 9670 - DNA, 24 bp, Artificial Sequence
  Synthetic
ttgccctgugcttacttacatuca

SEQ ID NO: 9671 - DNA, 22 bp, Artificial Sequence
  Synthetic
gaagggucaggcatcttcucac

SEQ ID NO: 9672 - DNA, 21 bp, Artificial Sequence
  Synthetic
gcatcuacccctggtcugaag

SEQ ID NO: 9673 - DNA, 23 bp, Artificial Sequence
  Synthetic
cucttaagtaggugccacaagca

SEQ ID NO: 9674 - DNA, 23 bp, Artificial Sequence
  Synthetic
gctactgguggttgtcactgaug

SEQ ID NO: 9675 - DNA, 22 bp, Artificial Sequence
  Synthetic
actcttccagauccagggugaa

SEQ ID NO: 9676 - DNA, 26 bp, Artificial Sequence
  Synthetic
tctttattccccacugtcttcucagt

SEQ ID NO: 9677 - DNA, 20 bp, Artificial Sequence
  Synthetic
gtcttccagugccattcgug

SEQ ID NO: 9678 - DNA, 22 bp, Artificial Sequence
  Synthetic
ggtcatcaucacccaccatucc

SEQ ID NO: 9679 - DNA, 23 bp, Artificial Sequence
  Synthetic
aacacgtccugtttccttgtuct

SEQ ID NO: 9680 - DNA, 21 bp, Artificial Sequence
  Synthetic
aggaggccugagaaacuaggt

SEQ ID NO: 9681 - DNA, 22 bp, Artificial Sequence
  Synthetic
catccagatcuagccgaccauc

SEQ ID NO: 9682 - DNA, 28 bp, Artificial Sequence
  Synthetic
tctgtgagugactaaaatgcatuacagg

SEQ ID NO: 9683 - DNA, 20 bp, Artificial Sequence
  Synthetic
ctggccagagccaucaaaug

SEQ ID NO: 9684 - DNA, 22 bp, Artificial Sequence
  Synthetic
ctccttcaacucctggtctcuc

SEQ ID NO: 9685 - DNA, 25 bp, Artificial Sequence
  Synthetic
actcaggctcguattgtaagcatut

SEQ ID NO: 9686 - DNA, 20 bp, Artificial Sequence
  Synthetic
cctctccccuctgacccuac

SEQ ID NO: 9687 - DNA, 24 bp, Artificial Sequence
  Synthetic
gggtatgaguctgaggucagaact

SEQ ID NO: 9688 - DNA, 26 bp, Artificial Sequence
  Synthetic
gatctgtctcuctctgtctcttcugt

SEQ ID NO: 9689 - DNA, 26 bp, Artificial Sequence
  Synthetic
gggagtacuagaaaaggaaaggctua

SEQ ID NO: 9690 - DNA, 26 bp, Artificial Sequence
  Synthetic
cccauaagaaaatcccugaggaagaa

SEQ ID NO: 9691 - DNA, 20 bp, Artificial Sequence
  Synthetic
catcugagcccccaaaccuc

SEQ ID NO: 9692 - DNA, 22 bp, Artificial Sequence
  Synthetic
aacttcuggagagctcccatug

SEQ ID NO: 9693 - DNA, 27 bp, Artificial Sequence
  Synthetic
caacacaguagggagagaacaagatua

SEQ ID NO: 9694 - DNA, 27 bp, Artificial Sequence
  Synthetic
cttaaaccttccuaatttcctgcucca

SEQ ID NO: 9695 - DNA, 28 bp, Artificial Sequence
  Synthetic
agcaagagacttaucactttagccttut

SEQ ID NO: 9696 - DNA, 28 bp, Artificial Sequence
  Synthetic
ctgtgggtugaaaactctagcuaaagaa

SEQ ID NO: 9697 - DNA, 27 bp, Artificial Sequence
  Synthetic
cagtattacguattgcaaaugcaggag

SEQ ID NO: 9698 - DNA, 23 bp, Artificial Sequence
  Synthetic
gaagaaccugagtggaguggaat

SEQ ID NO: 9699 - DNA, 22 bp, Artificial Sequence
  Synthetic
cctcacccuggatctctttucc

SEQ ID NO: 9700 - DNA, 22 bp, Artificial Sequence
  Synthetic
gcugccagcacuaaggaaagag

SEQ ID NO: 9701 - DNA, 28 bp, Artificial Sequence
  Synthetic
cagutcaatcagtauaaaacggaagcag

SEQ ID NO: 9702 - DNA, 20 bp, Artificial Sequence
  Synthetic
agtagtcggugctgggauct

SEQ ID NO: 9703 - DNA, 22 bp, Artificial Sequence
  Synthetic
caagacugatgccaguagcact

SEQ ID NO: 9704 - DNA, 21 bp, Artificial Sequence
  Synthetic
ctguaagcactgugaggagca

SEQ ID NO: 9705 - DNA, 21 bp, Artificial Sequence
  Synthetic
gggaccgguataaagcgguag

SEQ ID NO: 9706 - DNA, 30 bp, Artificial Sequence
  Synthetic
gaaugaatgaatatagttugcagccagaat

SEQ ID NO: 9707 - DNA, 25 bp, Artificial Sequence
  Synthetic
caggaacagccutgaaaatgtctut

SEQ ID NO: 9708 - DNA, 21 bp, Artificial Sequence
  Synthetic
cacaaaccugacttccuccga

SEQ ID NO: 9709 - DNA, 24 bp, Artificial Sequence
  Synthetic
tgaacctcuccactgagatucaca

SEQ ID NO: 9710 - DNA, 27 bp, Artificial Sequence
  Synthetic
tcaggatgauaaaacccatctctgcua

SEQ ID NO: 9711 - DNA, 21 bp, Artificial Sequence
  Synthetic
gtgtggugctgaaacagugag

SEQ ID NO: 9712 - DNA, 25 bp, Artificial Sequence
  Synthetic
cgtctccatauccaatgcatcgaua

SEQ ID NO: 9713 - DNA, 23 bp, Artificial Sequence
  Synthetic
tgacacatuggttctgagaugcc

SEQ ID NO: 9714 - DNA, 27 bp, Artificial Sequence
  Synthetic
accatgttgttutctctgttgcauaga

SEQ ID NO: 9715 - DNA, 21 bp, Artificial Sequence
  Synthetic
gcacctccaccucagaccuat

SEQ ID NO: 9716 - DNA, 22 bp, Artificial Sequence
  Synthetic
tcctgggcutcctcttctucat

SEQ ID NO: 9717 - DNA, 21 bp, Artificial Sequence
  Synthetic
cactgaauggagtcgctcuca

SEQ ID NO: 9718 - DNA, 23 bp, Artificial Sequence
  Synthetic
tccaagaaautttcccgtucgga

SEQ ID NO: 9719 - DNA, 21 bp, Artificial Sequence
  Synthetic
atcttggcagacuccgcauac

SEQ ID NO: 9720 - DNA, 24 bp, Artificial Sequence
  Synthetic
gcctgaugaccagaaccgtattua

SEQ ID NO: 9721 - DNA, 23 bp, Artificial Sequence
  Synthetic
ggactcagguagatgactcugga

SEQ ID NO: 9722 - DNA, 26 bp, Artificial Sequence
  Synthetic
ggtcaguacataatggugaagcaact

SEQ ID NO: 9723 - DNA, 22 bp, Artificial Sequence
  Synthetic
guggctaggtauaagcacccaa

SEQ ID NO: 9724 - DNA, 24 bp, Artificial Sequence
  Synthetic
tcuttcagcaaagugcagaggaaa

SEQ ID NO: 9725 - DNA, 26 bp, Artificial Sequence
  Synthetic
gtuggaagaggaagagaauaaaaguc

SEQ ID NO: 9726 - DNA, 29 bp, Artificial Sequence
  Synthetic
ctacagatgacutgtggtttttgaaugag

SEQ ID NO: 9727 - DNA, 27 bp, Artificial Sequence
  Synthetic
actaugagcacacaaacagaaucaaca

SEQ ID NO: 9728 - DNA, 22 bp, Artificial Sequence
  Synthetic
tggcagugtactgaaugcaaga

SEQ ID NO: 9729 - DNA, 29 bp, Artificial Sequence
  Synthetic
ggacatcatttccutcattttcctttuca

SEQ ID NO: 9730 - DNA, 21 bp, Artificial Sequence
  Synthetic
cgggccaucttgtcacttgut

SEQ ID NO: 9731 - DNA, 26 bp, Artificial Sequence
  Synthetic
tgtggtaagugaacggaataaaugca

SEQ ID NO: 9732 - DNA, 24 bp, Artificial Sequence
  Synthetic
tcaaactgctcugctgtgagauag

SEQ ID NO: 9733 - DNA, 29 bp, Artificial Sequence
  Synthetic
tgctttaggaaaccaaauatcactgcuaa

SEQ ID NO: 9734 - DNA, 23 bp, Artificial Sequence
  Synthetic
caactacccaaugtggaaucact

SEQ ID NO: 9735 - DNA, 24 bp, Artificial Sequence
  Synthetic
gcagcaauggacattttgagtuga

SEQ ID NO: 9736 - DNA, 27 bp, Artificial Sequence
  Synthetic
aagaatucaagacaggaacacucagaa

SEQ ID NO: 9737 - DNA, 31 bp, Artificial Sequence
  Synthetic
ggtacaggtttaaauactagaattggcttug

SEQ ID NO: 9738 - DNA, 27 bp, Artificial Sequence
  Synthetic
agtcctgguaacagtacttcaugaact

SEQ ID NO: 9739 - DNA, 26 bp, Artificial Sequence
  Synthetic
tcagaagtttgtutttgttgcctcug

SEQ ID NO: 9740 - DNA, 23 bp, Artificial Sequence
  Synthetic
agtatggcaugggtctgaggtua

SEQ ID NO: 9741 - DNA, 29 bp, Artificial Sequence
  Synthetic
ccagttattaaagcutttggcatctugaa

SEQ ID NO: 9742 - DNA, 19 bp, Artificial Sequence
  Synthetic
caggagggcugaaggucac

SEQ ID NO: 9743 - DNA, 18 bp, Artificial Sequence
  Synthetic
agccgcagccutagctuc

SEQ ID NO: 9744 - DNA, 18 bp, Artificial Sequence
  Synthetic
accctcuccggtgtguct

SEQ ID NO: 9745 - DNA, 17 bp, Artificial Sequence
  Synthetic
guggagcagcucggcat

SEQ ID NO: 9746 - DNA, 24 bp, Artificial Sequence
  Synthetic
gggaggacauctggaagaagttug

SEQ ID NO: 9747 - DNA, 20 bp, Artificial Sequence
  Synthetic
ccccacagcucgttcucaag

SEQ ID NO: 9748 - DNA, 20 bp, Artificial Sequence
  Synthetic
cacaaggcccucagtaccuc

SEQ ID NO: 9749 - DNA, 25 bp, Artificial Sequence
  Synthetic
gccaagacauacgagcacuaacaaa

SEQ ID NO: 9750 - DNA, 20 bp, Artificial Sequence
  Synthetic
cgtccgcucaagagtgucat

SEQ ID NO: 9751 - DNA, 21 bp, Artificial Sequence
  Synthetic
cgugagaaagcuggaccgaag

SEQ ID NO: 9752 - DNA, 19 bp, Artificial Sequence
  Synthetic
gggucgcgcattttctuca

SEQ ID NO: 9753 - DNA, 18 bp, Artificial Sequence
  Synthetic
gtggtggucggcttcucc

SEQ ID NO: 9754 - DNA, 23 bp, Artificial Sequence
  Synthetic
cttaggcttcucctggcaatcuc

SEQ ID NO: 9755 - DNA, 21 bp, Artificial Sequence
  Synthetic
acccaacuccaacctgtcuct

SEQ ID NO: 9756 - DNA, 29 bp, Artificial Sequence
  Synthetic
gaggaggaautctgaucacagaaagaaaa

SEQ ID NO: 9757 - DNA, 26 bp, Artificial Sequence
  Synthetic
gtacctgatuctccatttcuggcaat

SEQ ID NO: 9758 - DNA, 26 bp, Artificial Sequence
  Synthetic
ctgccttgcugaataagtguaaaacc

SEQ ID NO: 9759 - DNA, 25 bp, Artificial Sequence
  Synthetic
taatcatgtggguaactgcaggtua

SEQ ID NO: 9760 - DNA, 30 bp, Artificial Sequence
  Synthetic
tuactactttctttuaggaaaacaccagaa

SEQ ID NO: 9761 - DNA, 32 bp, Artificial Sequence
  Synthetic
atattgcatacctgauccatatctaaagtugt

SEQ ID NO: 9762 - DNA, 30 bp, Artificial Sequence
  Synthetic
ggaagaaaaaguccttcgtaacaauaaaaa

SEQ ID NO: 9763 - DNA, 32 bp, Artificial Sequence
  Synthetic
tcatgttagagcauttagggaattaauaaagg

SEQ ID NO: 9764 - DNA, 22 bp, Artificial Sequence
  Synthetic
gtgtcaaauggagcacctgtuc

SEQ ID NO: 9765 - DNA, 29 bp, Artificial Sequence
  Synthetic
acgtcattaggaauaaatgcaatttcauc

SEQ ID NO: 9766 - DNA, 24 bp, Artificial Sequence
  Synthetic
gggaagaggaacutctaccuacga

SEQ ID NO: 9767 - DNA, 23 bp, Artificial Sequence
  Synthetic
ggtgagtgcugtgacatguagat

SEQ ID NO: 9768 - DNA, 27 bp, Artificial Sequence
  Synthetic
actaatgggacautcacatgtgttuca

SEQ ID NO: 9769 - DNA, 30 bp, Artificial Sequence
  Synthetic
agctattattcttugctattacttcagcut

SEQ ID NO: 9770 - DNA, 30 bp, Artificial Sequence
  Synthetic
aactaagttaugtatttcctttuggcaaca

SEQ ID NO: 9771 - DNA, 23 bp, Artificial Sequence
  Synthetic
acatgaacacggacugattuccc

SEQ ID NO: 9772 - DNA, 18 bp, Artificial Sequence
  Synthetic
ttuccttgccuggcaggt

SEQ ID NO: 9773 - DNA, 27 bp, Artificial Sequence
  Synthetic
tctcagaatctgauatgacccttcgut

SEQ ID NO: 9774 - DNA, 22 bp, Artificial Sequence
  Synthetic
cgttaguggaggtggtgaugac

SEQ ID NO: 9775 - DNA, 24 bp, Artificial Sequence
  Synthetic
tgaggaaatccucaggcacauaga

SEQ ID NO: 9776 - DNA, 32 bp, Artificial Sequence
  Synthetic
agaaagatggcacauatatccaagtatgauag

SEQ ID NO: 9777 - DNA, 27 bp, Artificial Sequence
  Synthetic
gtatggccagaagaaucttcctcttut

SEQ ID NO: 9778 - DNA, 32 bp, Artificial Sequence
  Synthetic
ccttgaggaagaauattttagggaaaagcuaa

SEQ ID NO: 9779 - DNA, 25 bp, Artificial Sequence
  Synthetic
agguagaagacacaaccaccuagag

SEQ ID NO: 9780 - DNA, 21 bp, Artificial Sequence
  Synthetic
gtgccccacuctgtaaccaut

SEQ ID NO: 9781 - DNA, 27 bp, Artificial Sequence
  Synthetic
gggagacccaacautatgaatttuact

SEQ ID NO: 9782 - DNA, 24 bp, Artificial Sequence
  Synthetic
ctttgaccaugaaaaggcucgaaa

SEQ ID NO: 9783 - DNA, 22 bp, Artificial Sequence
  Synthetic
ccaattctgutgcgctgttuct

SEQ ID NO: 9784 - DNA, 22 bp, Artificial Sequence
  Synthetic
ccaaacgaugaagcctcactut

SEQ ID NO: 9785 - DNA, 26 bp, Artificial Sequence
  Synthetic
cgtgatccuttaagctcuaagaaggg

SEQ ID NO: 9786 - DNA, 21 bp, Artificial Sequence
  Synthetic
gttacgtcccugctgaagugt

SEQ ID NO: 9787 - DNA, 29 bp, Artificial Sequence
  Synthetic
atcacatctaaaugactgaatgagaacut

SEQ ID NO: 9788 - DNA, 23 bp, Artificial Sequence
  Synthetic
ccagccaggagacuattacgtuc

SEQ ID NO: 9789 - DNA, 31 bp, Artificial Sequence
  Synthetic
ctgattcatcttcucaaattctcttgcttut

SEQ ID NO: 9790 - DNA, 18 bp, Artificial Sequence
  Synthetic
guaccccgggacctcuga

SEQ ID NO: 9791 - DNA, 19 bp, Artificial Sequence
  Synthetic
cgaagtgguagccguagcc

SEQ ID NO: 9792 - DNA, 22 bp, Artificial Sequence
  Synthetic
ctauacgagccctuaccagcac

SEQ ID NO: 9793 - DNA, 20 bp, Artificial Sequence
  Synthetic
gtcctuggtgcaguacacct

SEQ ID NO: 9794 - DNA, 20 bp, Artificial Sequence
  Synthetic
cgtatcucggctgcuacgaa

SEQ ID NO: 9795 - DNA, 22 bp, Artificial Sequence
  Synthetic
cttctaagcugtctguggccaa

SEQ ID NO: 9796 - DNA, 20 bp, Artificial Sequence
  Synthetic
ccgtcugacttcgcuagcaa

SEQ ID NO: 9797 - DNA, 17 bp, Artificial Sequence
  Synthetic
cgcuccaggccgtaguc

SEQ ID NO: 9798 - DNA, 31 bp, Artificial Sequence
  Synthetic
cgtgtacauaaacaaagagaaaagactucaa

SEQ ID NO: 9799 - DNA, 18 bp, Artificial Sequence
  Synthetic
cgcttccuggagctcuca

SEQ ID NO: 9800 - DNA, 21 bp, Artificial Sequence
  Synthetic
cagaaagcaccgaugctcuga

SEQ ID NO: 9801 - DNA, 26 bp, Artificial Sequence
  Synthetic
ctttgcaaatgcuttggaagaaguct

SEQ ID NO: 9802 - DNA, 26 bp, Artificial Sequence
  Synthetic
ccaaattagagaacuaccctggaaug

SEQ ID NO: 9803 - DNA, 20 bp, Artificial Sequence
  Synthetic
ggctcaucgacgacatggug

SEQ ID NO: 9804 - DNA, 30 bp, Artificial Sequence
  Synthetic
aaaaagaagcttaugctacagtcatacaua

SEQ ID NO: 9805 - DNA, 27 bp, Artificial Sequence
  Synthetic
cagtacagagcaacugattttgttgut

SEQ ID NO: 9806 - DNA, 23 bp, Artificial Sequence
  Synthetic
aaccctcttcucatcaggaguga

SEQ ID NO: 9807 - DNA, 30 bp, Artificial Sequence
  Synthetic
ccatttgtcugaaaaactttgcttctaaut

SEQ ID NO: 9808 - DNA, 18 bp, Artificial Sequence
  Synthetic
gctgcaagcugggacugg

SEQ ID NO: 9809 - DNA, 17 bp, Artificial Sequence
  Synthetic
tccccggccucuccaaa

SEQ ID NO: 9810 - DNA, 18 bp, Artificial Sequence
  Synthetic
gcttgaacucgccgugac

SEQ ID NO: 9811 - DNA, 19 bp, Artificial Sequence
  Synthetic
gcactctuccccagtuccc

SEQ ID NO: 9812 - DNA, 23 bp, Artificial Sequence
  Synthetic
gaggguaacttctgttucccgat

SEQ ID NO: 9813 - DNA, 28 bp, Artificial Sequence
  Synthetic
tgctacaggaaauaaagcaacaaaugac

SEQ ID NO: 9814 - DNA, 27 bp, Artificial Sequence
  Synthetic
agtgggcuagaatgattttuaacagca

SEQ ID NO: 9815 - DNA, 24 bp, Artificial Sequence
  Synthetic
acaaaaggcagutcctgaaacugt

SEQ ID NO: 9816 - DNA, 28 bp, Artificial Sequence
  Synthetic
atattttgtgcaguattaatgcttgcug

SEQ ID NO: 9817 - DNA, 26 bp, Artificial Sequence
  Synthetic
cacaactctgucaagccattttagut

SEQ ID NO: 9818 - DNA, 21 bp, Artificial Sequence
  Synthetic
gcccagcuctgtucaaaccat

SEQ ID NO: 9819 - DNA, 28 bp, Artificial Sequence
  Synthetic
tgtttctggaaagcugagtcttttcuac

SEQ ID NO: 9820 - DNA, 21 bp, Artificial Sequence
  Synthetic
gtacauggcaggaacuccgat

SEQ ID NO: 9821 - DNA, 28 bp, Artificial Sequence
  Synthetic
caaagaggagaauaatacagctcugacc

SEQ ID NO: 9822 - DNA, 27 bp, Artificial Sequence
  Synthetic
gtgtactaactguttcctacagctuct

SEQ ID NO: 9823 - DNA, 29 bp, Artificial Sequence
  Synthetic
aatgcatatttguataggagacugccaaa

SEQ ID NO: 9824 - DNA, 26 bp, Artificial Sequence
  Synthetic
ggaaaaatgtuagctgctagccucat

SEQ ID NO: 9825 - DNA, 22 bp, Artificial Sequence
  Synthetic
gtttgctaaaugccagtgugct

SEQ ID NO: 9826 - DNA, 28 bp, Artificial Sequence
  Synthetic
gcctctgcacuttactatgatgaattug

SEQ ID NO: 9827 - DNA, 26 bp, Artificial Sequence
  Synthetic
tcacaggatgauctattttcacacug

SEQ ID NO: 9828 - DNA, 26 bp, Artificial Sequence
  Synthetic
atgtacgtggaguaatacacctauga

SEQ ID NO: 9829 - DNA, 27 bp, Artificial Sequence
  Synthetic
catcaatctccuccaagtttccgtuat

SEQ ID NO: 9830 - DNA, 28 bp, Artificial Sequence
  Synthetic
ttgtactttgcagautgtaaatgcctuc

SEQ ID NO: 9831 - DNA, 28 bp, Artificial Sequence
  Synthetic
tagtactaccaguataggacacttcuct

SEQ ID NO: 9832 - DNA, 23 bp, Artificial Sequence
  Synthetic
agacatcctccuctgacacacut

SEQ ID NO: 9833 - DNA, 25 bp, Artificial Sequence
  Synthetic
agctgggtttcugttaatctcacug

SEQ ID NO: 9834 - DNA, 21 bp, Artificial Sequence
  Synthetic
gactugactccatugcgaacc

SEQ ID NO: 9835 - DNA, 24 bp, Artificial Sequence
  Synthetic
gggucagcagtugaaaaacacaat

SEQ ID NO: 9836 - DNA, 23 bp, Artificial Sequence
  Synthetic
agctaaccccucttacctugact

SEQ ID NO: 9837 - DNA, 29 bp, Artificial Sequence
  Synthetic
acaatcttggcuatgtagttatgacucac

SEQ ID NO: 9838 - DNA, 31 bp, Artificial Sequence
  Synthetic
gatcatagaggaatuagaggaatctgtagut

SEQ ID NO: 9839 - DNA, 22 bp, Artificial Sequence
  Synthetic
gaucagttcugggacaccaaca

SEQ ID NO: 9840 - DNA, 22 bp, Artificial Sequence
  Synthetic
agtgcucaaaggagcagatcuc

SEQ ID NO: 9841 - DNA, 24 bp, Artificial Sequence
  Synthetic
tgaggtccuctctagagtgaucca

SEQ ID NO: 9842 - DNA, 29 bp, Artificial Sequence
  Synthetic
tgaaggcaugatgataaacucacaaaaga

SEQ ID NO: 9843 - DNA, 25 bp, Artificial Sequence
  Synthetic
ccagaaagccuctctacaattgtug

SEQ ID NO: 9844 - DNA, 22 bp, Artificial Sequence
  Synthetic
gcccatttccautccctccaua

SEQ ID NO: 9845 - DNA, 29 bp, Artificial Sequence
  Synthetic
tgaattcatggaaaaugagaggctauaat

SEQ ID NO: 9846 - DNA, 19 bp, Artificial Sequence
  Synthetic
gcgccaaaaugtcgtucgt

SEQ ID NO: 9847 - DNA, 18 bp, Artificial Sequence
  Synthetic
ggctcgacuccctccgua

SEQ ID NO: 9848 - DNA, 22 bp, Artificial Sequence
  Synthetic
ggtgacccagcagugagtttut

SEQ ID NO: 9849 - DNA, 27 bp, Artificial Sequence
  Synthetic
ctatacctgtaugcacactttccauca

SEQ ID NO: 9850 - DNA, 25 bp, Artificial Sequence
  Synthetic
auagccaugaggagaaaagcttuaa

SEQ ID NO: 9851 - DNA, 31 bp, Artificial Sequence
  Synthetic
ctagaacacattacuttgatgacaaatcuca

SEQ ID NO: 9852 - DNA, 29 bp, Artificial Sequence
  Synthetic
ggataaaacccuagccttcaaaatgaaug

SEQ ID NO: 9853 - DNA, 21 bp, Artificial Sequence
  Synthetic
gggtgttucctgtgaguggat

SEQ ID NO: 9854 - DNA, 30 bp, Artificial Sequence
  Synthetic
tttttaatacagactutgctaccaggacut

SEQ ID NO: 9855 - DNA, 24 bp, Artificial Sequence
  Synthetic
gaaatgcaucaagcttctgtuccc

SEQ ID NO: 9856 - DNA, 30 bp, Artificial Sequence
  Synthetic
taataatgatcugcacttccttttctucat

SEQ ID NO: 9857 - DNA, 30 bp, Artificial Sequence
  Synthetic
attaatttctucctggagacucaaaacact

SEQ ID NO: 9858 - DNA, 30 bp, Artificial Sequence
  Synthetic
ttcagcttttcctuaaagtcacttcattut

SEQ ID NO: 9859 - DNA, 29 bp, Artificial Sequence
  Synthetic
agctactatttucagaaacgatcagtuga

SEQ ID NO: 9860 - DNA, 33 bp, Artificial Sequence
  Synthetic
tgagaatgtttaaautcgtacctatttugaggt

SEQ ID NO: 9861 - DNA, 24 bp, Artificial Sequence
  Synthetic
agatatgtacugcttccggaugga

SEQ ID NO: 9862 - DNA, 28 bp, Artificial Sequence
  Synthetic
ctgcctgatcuatacaaagtcttugaga

SEQ ID NO: 9863 - DNA, 28 bp, Artificial Sequence
  Synthetic
aaggcaagtauaagtcttaagtgcuacc

SEQ ID NO: 9864 - DNA, 22 bp, Artificial Sequence
  Synthetic
gccaacttucctgctcucaact

SEQ ID NO: 9865 - DNA, 23 bp, Artificial Sequence
  Synthetic
ctcaccttcauagcaagggauca

SEQ ID NO: 9866 - DNA, 23 bp, Artificial Sequence
  Synthetic
ggaaccaucaaagtgcugaacct

SEQ ID NO: 9867 - DNA, 30 bp, Artificial Sequence
  Synthetic
aacaatgaagcaauaatttgtgaatcuggt

SEQ ID NO: 9868 - DNA, 21 bp, Artificial Sequence
  Synthetic
gagggcauccttgtgugagag

SEQ ID NO: 9869 - DNA, 25 bp, Artificial Sequence
  Synthetic
cctcauccctgatcucagaaaacat

SEQ ID NO: 9870 - DNA, 23 bp, Artificial Sequence
  Synthetic
gtgactgtggucttttcctguga

SEQ ID NO: 9871 - DNA, 29 bp, Artificial Sequence
  Synthetic
ctcatgtgccttuaaagaaaaacagctua

SEQ ID NO: 9872 - DNA, 22 bp, Artificial Sequence
  Synthetic
catcacagtgugtcggtcctut

SEQ ID NO: 9873 - DNA, 21 bp, Artificial Sequence
  Synthetic
gcagcttcuctgtgaccugac

SEQ ID NO: 9874 - DNA, 21 bp, Artificial Sequence
  Synthetic
actgtguactcgttugccact

SEQ ID NO: 9875 - DNA, 24 bp, Artificial Sequence
  Synthetic
gctcugaaggaaacaccgacauac

SEQ ID NO: 9876 - DNA, 21 bp, Artificial Sequence
  Synthetic
gcctgcugatgccaaauacca

SEQ ID NO: 9877 - DNA, 28 bp, Artificial Sequence
  Synthetic
ctggtcccauaaatctctcatcttugaa

SEQ ID NO: 9878 - DNA, 23 bp, Artificial Sequence
  Synthetic
gggtcatctgucagcatctctut

SEQ ID NO: 9879 - DNA, 22 bp, Artificial Sequence
  Synthetic
ctcaaggtggaugtcaggguag

SEQ ID NO: 9880 - DNA, 23 bp, Artificial Sequence
  Synthetic
ttgccuaacagcacactguaact

SEQ ID NO: 9881 - DNA, 28 bp, Artificial Sequence
  Synthetic
cagatgtcaacaautcaaatgcttcuaa

SEQ ID NO: 9882 - DNA, 25 bp, Artificial Sequence
  Synthetic
ttcagcacttcuaactcagcttcuc

SEQ ID NO: 9883 - DNA, 22 bp, Artificial Sequence
  Synthetic
gatcaggtcaugtgactggugt

SEQ ID NO: 9884 - DNA, 24 bp, Artificial Sequence
  Synthetic
cttctgtagcutgtttggtcaguc

SEQ ID NO: 9885 - DNA, 26 bp, Artificial Sequence
  Synthetic
accactgaaguattttcaaggtgucc

SEQ ID NO: 9886 - DNA, 21 bp, Artificial Sequence
  Synthetic
ctccaagccuccgataagcuc

SEQ ID NO: 9887 - DNA, 23 bp, Artificial Sequence
  Synthetic
tttatggcuggtgtctgacucac

SEQ ID NO: 9888 - DNA, 27 bp, Artificial Sequence
  Synthetic
cttacgctuaactccaactgugaaaaa

SEQ ID NO: 9889 - DNA, 23 bp, Artificial Sequence
  Synthetic
cacaaggacaaacuagaguccac

SEQ ID NO: 9890 - DNA, 27 bp, Artificial Sequence
  Synthetic
gttactgtttguctctctctagtugcc

SEQ ID NO: 9891 - DNA, 27 bp, Artificial Sequence
  Synthetic
gcacatttacuaggtgtttacctguga

SEQ ID NO: 9892 - DNA, 24 bp, Artificial Sequence
  Synthetic
gatgtgcuaaatgcatacauggca

SEQ ID NO: 9893 - DNA, 23 bp, Artificial Sequence
  Synthetic
gatgcagatuaacacgcgatugt

SEQ ID NO: 9894 - DNA, 23 bp, Artificial Sequence
  Synthetic
tgctctccagauttggtgaaucg

SEQ ID NO: 9895 - DNA, 23 bp, Artificial Sequence
  Synthetic
aggttgttgutgaaggtgauggt

SEQ ID NO: 9896 - DNA, 27 bp, Artificial Sequence
  Synthetic
cacatttcagagutgtcaaaacguagt

SEQ ID NO: 9897 - DNA, 23 bp, Artificial Sequence
  Synthetic
cagtaaacgaggacauggaguga

SEQ ID NO: 9898 - DNA, 22 bp, Artificial Sequence
  Synthetic
ctaagtugcccagagtgggaut

SEQ ID NO: 9899 - DNA, 29 bp, Artificial Sequence
  Synthetic
tcgagtacacccauaattagtagttucct

SEQ ID NO: 9900 - DNA, 26 bp, Artificial Sequence
  Synthetic
gtagcttccutatagcacaacugcat

SEQ ID NO: 9901 - DNA, 29 bp, Artificial Sequence
  Synthetic
agatctataactggutcacacgaatgtut

SEQ ID NO: 9902 - DNA, 24 bp, Artificial Sequence
  Synthetic
gtgaggcaaaagguggagtatcua

SEQ ID NO: 9903 - DNA, 22 bp, Artificial Sequence
  Synthetic
cucatacuccaacgaccccaac

SEQ ID NO: 9904 - DNA, 27 bp, Artificial Sequence
  Synthetic
ccautcaataatgaguacacaggaact

SEQ ID NO: 9905 - DNA, 21 bp, Artificial Sequence
  Synthetic
gcgcuggacgatagaaguaca

SEQ ID NO: 9906 - DNA, 22 bp, Artificial Sequence
  Synthetic
gcagtttuggacccatcucagt

SEQ ID NO: 9907 - DNA, 22 bp, Artificial Sequence
  Synthetic
aggcaacaaucacagcagttug

SEQ ID NO: 9908 - DNA, 25 bp, Artificial Sequence
  Synthetic
ctagatagtccuctgggatctgugg

SEQ ID NO: 9909 - DNA, 26 bp, Artificial Sequence
  Synthetic
cttaccgtccuctctttcctttguag

SEQ ID NO: 9910 - DNA, 24 bp, Artificial Sequence
  Synthetic
ttacctgaagagcuggttgttugt

SEQ ID NO: 9911 - DNA, 26 bp, Artificial Sequence
  Synthetic
tttttatgaagagucccctgaaccug

SEQ ID NO: 9912 - DNA, 20 bp, Artificial Sequence
  Synthetic
ccgccgcacuctagtaagug

SEQ ID NO: 9913 - DNA, 22 bp, Artificial Sequence
  Synthetic
cccccatcutggaaatcctugt

SEQ ID NO: 9914 - DNA, 21 bp, Artificial Sequence
  Synthetic
gcacttugacagctccucgaa

SEQ ID NO: 9915 - DNA, 21 bp, Artificial Sequence
  Synthetic
ggaacuggccctcugaaaact

SEQ ID NO: 9916 - DNA, 22 bp, Artificial Sequence
  Synthetic
caucttgtgguagaggccacag

SEQ ID NO: 9917 - DNA, 20 bp, Artificial Sequence
  Synthetic
cccgagaacutgccggtuaa

SEQ ID NO: 9918 - DNA, 24 bp, Artificial Sequence
  Synthetic
gctagggucaggagacacttctut

SEQ ID NO: 9919 - DNA, 20 bp, Artificial Sequence
  Synthetic
gcccacuctctgtguaccca

SEQ ID NO: 9920 - DNA, 20 bp, Artificial Sequence
  Synthetic
gcctgggutctcaucaccac

SEQ ID NO: 9921 - DNA, 17 bp, Artificial Sequence
  Synthetic
agctgcugccuccagac

SEQ ID NO: 9922 - DNA, 17 bp, Artificial Sequence
  Synthetic
ctcgcauccgtcugcac

SEQ ID NO: 9923 - DNA, 17 bp, Artificial Sequence
  Synthetic
gggccugcagttcgcut

SEQ ID NO: 9924 - DNA, 17 bp, Artificial Sequence
  Synthetic
ctugccgggcuggaagt

SEQ ID NO: 9925 - DNA, 22 bp, Artificial Sequence
  Synthetic
caacgagtgcutcatcaaggug

SEQ ID NO: 9926 - DNA, 18 bp, Artificial Sequence
  Synthetic
gagcgccacguacgagua

SEQ ID NO: 9927 - DNA, 17 bp, Artificial Sequence
  Synthetic
gaccggucgcacaguca

SEQ ID NO: 9928 - DNA, 17 bp, Artificial Sequence
  Synthetic
gcucagcctcuggccat

SEQ ID NO: 9929 - DNA, 18 bp, Artificial Sequence
  Synthetic
gucgtgctucgggaaacc

SEQ ID NO: 9930 - DNA, 24 bp, Artificial Sequence
  Synthetic
ctatgtgtutttggagcugacagt

SEQ ID NO: 9931 - DNA, 21 bp, Artificial Sequence
  Synthetic
ggccatccutaaggtctccuc

SEQ ID NO: 9932 - DNA, 29 bp, Artificial Sequence
  Synthetic
tgctattatcatcuctggaggacctaaut

SEQ ID NO: 9933 - DNA, 27 bp, Artificial Sequence
  Synthetic
aacaaatttgcugacatacctgcauac

SEQ ID NO: 9934 - DNA, 19 bp, Artificial Sequence
  Synthetic
gagcacagutccacccuga

SEQ ID NO: 9935 - DNA, 28 bp, Artificial Sequence
  Synthetic
cctactctctcuttgatctctcgaauac

SEQ ID NO: 9936 - DNA, 24 bp, Artificial Sequence
  Synthetic
cgagaaagccaguctgtugaagag

SEQ ID NO: 9937 - DNA, 28 bp, Artificial Sequence
  Synthetic
catactgagaaaacugtaattgtgcuca

SEQ ID NO: 9938 - DNA, 25 bp, Artificial Sequence
  Synthetic
cttgaaaucagaggaggutttccut

SEQ ID NO: 9939 - DNA, 24 bp, Artificial Sequence
  Synthetic
tctgatgagcuctgtgtcattgug

SEQ ID NO: 9940 - DNA, 18 bp, Artificial Sequence
  Synthetic
cctggccuggcaaucaga

SEQ ID NO: 9941 - DNA, 29 bp, Artificial Sequence
  Synthetic
ccgttcaatttcutgtaatgattagcugt

SEQ ID NO: 9942 - DNA, 24 bp, Artificial Sequence
  Synthetic
gatgaacctgacugggaatcacut

SEQ ID NO: 9943 - DNA, 26 bp, Artificial Sequence
  Synthetic
tctacatttgagccutttggtctucc

SEQ ID NO: 9944 - DNA, 23 bp, Artificial Sequence
  Synthetic
attttgaucgggacccactucaa

SEQ ID NO: 9945 - DNA, 25 bp, Artificial Sequence
  Synthetic
agaggtacugagaacgtgcatuaga

SEQ ID NO: 9946 - DNA, 23 bp, Artificial Sequence
  Synthetic
gaacccttuggaagagactugct

SEQ ID NO: 9947 - DNA, 26 bp, Artificial Sequence
  Synthetic
ttttcttcaaatucctacagggccut

SEQ ID NO: 9948 - DNA, 25 bp, Artificial Sequence
  Synthetic
gtaggtaagcuggccctgagataua

SEQ ID NO: 9949 - DNA, 26 bp, Artificial Sequence
  Synthetic
gtcatggataugatgaccaauagcca

SEQ ID NO: 9950 - DNA, 24 bp, Artificial Sequence
  Synthetic
cucagggagaaaccucaacaaagt

SEQ ID NO: 9951 - DNA, 31 bp, Artificial Sequence
  Synthetic
cagcaccattacuaactgttaaaacaaucaa

SEQ ID NO: 9952 - DNA, 22 bp, Artificial Sequence
  Synthetic
gggactccutgtcagacaguga

SEQ ID NO: 9953 - DNA, 30 bp, Artificial Sequence
  Synthetic
ccatccctttccauttaccaacaatatuct

SEQ ID NO: 9954 - DNA, 25 bp, Artificial Sequence
  Synthetic
gtttcttcauagtcatccucagggt

SEQ ID NO: 9955 - DNA, 21 bp, Artificial Sequence
  Synthetic
aaggcttuggtgaccagucaa

SEQ ID NO: 9956 - DNA, 30 bp, Artificial Sequence
  Synthetic
cgtcaaaatggaauaaaagaagaaagauca

SEQ ID NO: 9957 - DNA, 28 bp, Artificial Sequence
  Synthetic
acagacaccuaaagaaacatgagaaugg

SEQ ID NO: 9958 - DNA, 24 bp, Artificial Sequence
  Synthetic
ggagattuctggaaagucagccat

SEQ ID NO: 9959 - DNA, 23 bp, Artificial Sequence
  Synthetic
ccagtgagcucttacagtcagug

SEQ ID NO: 9960 - DNA, 25 bp, Artificial Sequence
  Synthetic
ataaagaaaggagugggtctugcat

SEQ ID NO: 9961 - DNA, 22 bp, Artificial Sequence
  Synthetic
agccccuggatctaagtauggg

SEQ ID NO: 9962 - DNA, 26 bp, Artificial Sequence
  Synthetic
agggtaagguaaagctccaactttut

SEQ ID NO: 9963 - DNA, 25 bp, Artificial Sequence
  Synthetic
cagcaatcautccattttcucacca

SEQ ID NO: 9964 - DNA, 23 bp, Artificial Sequence
  Synthetic
tgtccccuacagatgggtgttua

SEQ ID NO: 9965 - DNA, 27 bp, Artificial Sequence
  Synthetic
ctttgatacctgcuagttctcctgtua

SEQ ID NO: 9966 - DNA, 23 bp, Artificial Sequence
  Synthetic
acgtagtgcugaacatttgucca

SEQ ID NO: 9967 - DNA, 26 bp, Artificial Sequence
  Synthetic
agaagcaatugacataaagccugaga

SEQ ID NO: 9968 - DNA, 20 bp, Artificial Sequence
  Synthetic
atgtgacauctgguggcgaa

SEQ ID NO: 9969 - DNA, 26 bp, Artificial Sequence
  Synthetic
atgttgttccguttatgaatgcaucc

SEQ ID NO: 9970 - DNA, 20 bp, Artificial Sequence
  Synthetic
ggtggcgugagtggtacuaa

SEQ ID NO: 9971 - DNA, 31 bp, Artificial Sequence
  Synthetic
ctgattccatccaccuttattttgtcttuaa

SEQ ID NO: 9972 - DNA, 26 bp, Artificial Sequence
  Synthetic
acaatctcttcuttacacagcugcaa

SEQ ID NO: 9973 - DNA, 28 bp, Artificial Sequence
  Synthetic
ccaaaaggaagaucgaagtaggugaaaa

SEQ ID NO: 9974 - DNA, 22 bp, Artificial Sequence
  Synthetic
ccggagcgcuagagacagauat

SEQ ID NO: 9975 - DNA, 17 bp, Artificial Sequence
  Synthetic
cugcaggacugggcaca

SEQ ID NO: 9976 - DNA, 24 bp, Artificial Sequence
  Synthetic
ctctagatgatuccagtgccctuc

SEQ ID NO: 9977 - DNA, 25 bp, Artificial Sequence
  Synthetic
gagctcccuaggatggcttauaaac

SEQ ID NO: 9978 - DNA, 20 bp, Artificial Sequence
  Synthetic
cagttucgaccccagucaca

SEQ ID NO: 9979 - DNA, 20 bp, Artificial Sequence
  Synthetic
tgutccgatuggagccacag

SEQ ID NO: 9980 - DNA, 23 bp, Artificial Sequence
  Synthetic
ccaaccagggacgcuattaugaa

SEQ ID NO: 9981 - DNA, 22 bp, Artificial Sequence
  Synthetic
ggatacaucccaggagggtuct

SEQ ID NO: 9982 - DNA, 23 bp, Artificial Sequence
  Synthetic
actttggctutagcaggacugaa

SEQ ID NO: 9983 - DNA, 25 bp, Artificial Sequence
  Synthetic
cagatgaugcaggtaaaacaaucca

SEQ ID NO: 9984 - DNA, 18 bp, Artificial Sequence
  Synthetic
cagtgucgacgcgcagua

SEQ ID NO: 9985 - DNA, 23 bp, Artificial Sequence
  Synthetic
atggaaauctcgauccaaagcca

SEQ ID NO: 9986 - DNA, 21 bp, Artificial Sequence
  Synthetic
caaggcgagcacugaccttua

SEQ ID NO: 9987 - DNA, 27 bp, Artificial Sequence
  Synthetic
tgtgtttcuaaggcaaggttaauagca

SEQ ID NO: 9988 - DNA, 19 bp, Artificial Sequence
  Synthetic
gcctcauggttgcccauct

SEQ ID NO: 9989 - DNA, 17 bp, Artificial Sequence
  Synthetic
accagcccugtgccauc

SEQ ID NO: 9990 - DNA, 18 bp, Artificial Sequence
  Synthetic
cactcgggucatggccut

SEQ ID NO: 9991 - DNA, 21 bp, Artificial Sequence
  Synthetic
ccgttctucagccaggagaug

SEQ ID NO: 9992 - DNA, 19 bp, Artificial Sequence
  Synthetic
gcgacguggagttccacug

SEQ ID NO: 9993 - DNA, 19 bp, Artificial Sequence
  Synthetic
cccacctugagcacgguaa

SEQ ID NO: 9994 - DNA, 22 bp, Artificial Sequence
  Synthetic
gcctatcgcuctgctctctcut

SEQ ID NO: 9995 - DNA, 27 bp, Artificial Sequence
  Synthetic
gtgaugagaaaacccaatagaatugcc

SEQ ID NO: 9996 - DNA, 18 bp, Artificial Sequence
  Synthetic
tgtaccuccacgcccugt

SEQ ID NO: 9997 - DNA, 20 bp, Artificial Sequence
  Synthetic
gctcgagcucggagacatug

SEQ ID NO: 9998 - DNA, 23 bp, Artificial Sequence
  Synthetic
tgaagatgcugaaaggugaggag

SEQ ID NO: 9999 - DNA, 26 bp, Artificial Sequence
  Synthetic
ttgtgtttcccgaucatcttcaucat

SEQ ID NO: 10000 - DNA, 20 bp, Artificial Sequence
  Synthetic
ggagagguggagaggctuca

SEQ ID NO: 10001 - DNA, 25 bp, Artificial Sequence
  Synthetic
gtcttcttgtaguagtcgaggtugt

SEQ ID NO: 10002 - DNA, 20 bp, Artificial Sequence
  Synthetic
ctcugggagatctucacgct

SEQ ID NO: 10003 - DNA, 17 bp, Artificial Sequence
  Synthetic
gccagggaugccacuca

SEQ ID NO: 10004 - DNA, 20 bp, Artificial Sequence
  Synthetic
cgccttucgagcagtacucc

SEQ ID NO: 10005 - DNA, 21 bp, Artificial Sequence
  Synthetic
ctagggaccccucacattgut

SEQ ID NO: 10006 - DNA, 26 bp, Artificial Sequence
  Synthetic
ttccgaaaagtaaugcctgacatgua

SEQ ID NO: 10007 - DNA, 29 bp, Artificial Sequence
  Synthetic
tcagtaactggatutcaaagccttatgut

SEQ ID NO: 10008 - DNA, 21 bp, Artificial Sequence
  Synthetic
tgtctatgguatcgccuggct

SEQ ID NO: 10009 - DNA, 28 bp, Artificial Sequence
  Synthetic
aatctacctcuaagagtggaactccaut

SEQ ID NO: 10010 - DNA, 24 bp, Artificial Sequence
  Synthetic
caaatcacagacuagccacagcua

SEQ ID NO: 10011 - DNA, 22 bp, Artificial Sequence
  Synthetic
ccatcttggauctctgcaccug

SEQ ID NO: 10012 - DNA, 27 bp, Artificial Sequence
  Synthetic
gggucagagacaacaatatguaagaaa

SEQ ID NO: 10013 - DNA, 22 bp, Artificial Sequence
  Synthetic
catatcgaucctgccactuccc

SEQ ID NO: 10014 - DNA, 28 bp, Artificial Sequence
  Synthetic
ctgtgctctaatuttaggtcctttcuga

SEQ ID NO: 10015 - DNA, 19 bp, Artificial Sequence
  Synthetic
agtgcugacagucggagga

SEQ ID NO: 10016 - DNA, 30 bp, Artificial Sequence
  Synthetic
gttgtaattttgccutgtttttcctttugt

SEQ ID NO: 10017 - DNA, 19 bp, Artificial Sequence
  Synthetic
gcacgugcagaacgacuat

SEQ ID NO: 10018 - DNA, 28 bp, Artificial Sequence
  Synthetic
gggacuattaugucagaagagagaaaga

SEQ ID NO: 10019 - DNA, 25 bp, Artificial Sequence
  Synthetic
ccaacaaaccugttgaaaacactug

SEQ ID NO: 10020 - DNA, 28 bp, Artificial Sequence
  Synthetic
gtgattggatttutgtcactgattgugt

SEQ ID NO: 10021 - DNA, 29 bp, Artificial Sequence
  Synthetic
gcttcttttccutctttgcttctttuaga

SEQ ID NO: 10022 - DNA, 28 bp, Artificial Sequence
  Synthetic
gaagatggaacucagtatuggaagaagt

SEQ ID NO: 10023 - DNA, 21 bp, Artificial Sequence
  Synthetic
cccacgcggacuattaaguct

SEQ ID NO: 10024 - DNA, 25 bp, Artificial Sequence
  Synthetic
ccutgtaugggaaagaagauaacga

SEQ ID NO: 10025 - DNA, 26 bp, Artificial Sequence
  Synthetic
cgtttcacacutttgatcatgaugcc

SEQ ID NO: 10026 - DNA, 25 bp, Artificial Sequence
  Synthetic
tutctccttttcugaaaccagcaga

SEQ ID NO: 10027 - DNA, 28 bp, Artificial Sequence
  Synthetic
acacatgaacacuccagaatcatuaact

SEQ ID NO: 10028 - DNA, 27 bp, Artificial Sequence
  Synthetic
acagaacctucactgataaaugggaag

SEQ ID NO: 10029 - DNA, 27 bp, Artificial Sequence
  Synthetic
gaaataagatcugataagcccacugga

SEQ ID NO: 10030 - DNA, 23 bp, Artificial Sequence
  Synthetic
gaaaucctgactuacgacaggct

SEQ ID NO: 10031 - DNA, 23 bp, Artificial Sequence
  Synthetic
tcaagtgaatugcagtcctuccc

SEQ ID NO: 10032 - DNA, 25 bp, Artificial Sequence
  Synthetic
ttgttctctcuccagagtgctcuaa

SEQ ID NO: 10033 - DNA, 28 bp, Artificial Sequence
  Synthetic
cataaggaagttgugttgggtctatgua

SEQ ID NO: 10034 - DNA, 32 bp, Artificial Sequence
  Synthetic
tatctcaccttctutctaaccttttcttaugt

SEQ ID NO: 10035 - DNA, 26 bp, Artificial Sequence
  Synthetic
tcttataaagugcagcttctgcauga

SEQ ID NO: 10036 - DNA, 23 bp, Artificial Sequence
  Synthetic
ggccctagacutagaagactugc

SEQ ID NO: 10037 - DNA, 27 bp, Artificial Sequence
  Synthetic
ggctctaaaaugctctgttcucaaaaa

SEQ ID NO: 10038 - DNA, 28 bp, Artificial Sequence
  Synthetic
cacctgaaagcautttcaactgtgtaua

SEQ ID NO: 10039 - DNA, 24 bp, Artificial Sequence
  Synthetic
agcaggacaccaaugaaactucaa

SEQ ID NO: 10040 - DNA, 24 bp, Artificial Sequence
  Synthetic
ggatgcagauccccuaaaaagacc

SEQ ID NO: 10041 - DNA, 22 bp, Artificial Sequence
  Synthetic
ggttagucctcacccugaaagc

SEQ ID NO: 10042 - DNA, 17 bp, Artificial Sequence
  Synthetic
tcccugcaguccgaggt

SEQ ID NO: 10043 - DNA, 24 bp, Artificial Sequence
  Synthetic
acactgagcuctcctcctgttuaa

SEQ ID NO: 10044 - DNA, 30 bp, Artificial Sequence
  Synthetic
tgaaatttgtctttutaatatggctgaguc

SEQ ID NO: 10045 - DNA, 25 bp, Artificial Sequence
  Synthetic
tgctcaattaacugtgccatcucat

SEQ ID NO: 10046 - DNA, 23 bp, Artificial Sequence
  Synthetic
gggtcacatacutcctcctccuc

SEQ ID NO: 10047 - DNA, 26 bp, Artificial Sequence
  Synthetic
cacttgaagaacugaagccauaacaa

SEQ ID NO: 10048 - DNA, 25 bp, Artificial Sequence
  Synthetic
aaaacttccuctgttccugaacaca

SEQ ID NO: 10049 - DNA, 26 bp, Artificial Sequence
  Synthetic
gtggttaaaatcugtgactttggcut

SEQ ID NO: 10050 - DNA, 21 bp, Artificial Sequence
  Synthetic
gagctctggcuactggtgaug

SEQ ID NO: 10051 - DNA, 30 bp, Artificial Sequence
  Synthetic
aagactcattttguattcaaggagtttgut

SEQ ID NO: 10052 - DNA, 31 bp, Artificial Sequence
  Synthetic
acagaaagatagaucaccacataatttugct

SEQ ID NO: 10053 - DNA, 24 bp, Artificial Sequence
  Synthetic
cttgttgctgutgttgttgacuct

SEQ ID NO: 10054 - DNA, 32 bp, Artificial Sequence
  Synthetic
tttatcccactgaccutctattatgaaaaaug

SEQ ID NO: 10055 - DNA, 27 bp, Artificial Sequence
  Synthetic
cctctgtuaggcattgtatugaaggat

SEQ ID NO: 10056 - DNA, 27 bp, Artificial Sequence
  Synthetic
ttacaacauaatctccuagaggacagt

SEQ ID NO: 10057 - DNA, 24 bp, Artificial Sequence
  Synthetic
caagaaaagacautgcgtggucag

SEQ ID NO: 10058 - DNA, 30 bp, Artificial Sequence
  Synthetic
aaacaacagggaautacatagcttaguacc

SEQ ID NO: 10059 - DNA, 23 bp, Artificial Sequence
  Synthetic
gttauccaagcgguaaatgtguc

SEQ ID NO: 10060 - DNA, 22 bp, Artificial Sequence
  Synthetic
ccgtacaugtcagcgttugagt

SEQ ID NO: 10061 - DNA, 29 bp, Artificial Sequence
  Synthetic
gaaagtcagcttuagttgctaaaatccuc

SEQ ID NO: 10062 - DNA, 22 bp, Artificial Sequence
  Synthetic
gtactucgcagggattcugaca

SEQ ID NO: 10063 - DNA, 30 bp, Artificial Sequence
  Synthetic
atcaaatgaccauttacagtaagtugacct

SEQ ID NO: 10064 - DNA, 27 bp, Artificial Sequence
  Synthetic
aagtcaatccccacauttagttcagut

SEQ ID NO: 10065 - DNA, 30 bp, Artificial Sequence
  Synthetic
agttataggcttatutgctctctcatgtuc

SEQ ID NO: 10066 - DNA, 30 bp, Artificial Sequence
  Synthetic
caccacagtttugtttttgttctcaguaat

SEQ ID NO: 10067 - DNA, 27 bp, Artificial Sequence
  Synthetic
gtctggttagaguttaggaaccugaaa

SEQ ID NO: 10068 - DNA, 32 bp, Artificial Sequence
  Synthetic
agagttgtattagccutaattgtaagtatguc

SEQ ID NO: 10069 - DNA, 28 bp, Artificial Sequence
  Synthetic
cctattaggtcuaactcagtggcaacua

SEQ ID NO: 10070 - DNA, 28 bp, Artificial Sequence
  Synthetic
gtgggaagcacutaattatcaagucagt

SEQ ID NO: 10071 - DNA, 26 bp, Artificial Sequence
  Synthetic
agggatcugaaacaacattcatgugt

SEQ ID NO: 10072 - DNA, 30 bp, Artificial Sequence
  Synthetic
gtcccatctgugcaaattttcatattacut

SEQ ID NO: 10073 - DNA, 24 bp, Artificial Sequence
  Synthetic
caagaaucccaaacucaccaggat

SEQ ID NO: 10074 - DNA, 30 bp, Artificial Sequence
  Synthetic
cgtctacacaatuggacaaattcatcttut

SEQ ID NO: 10075 - DNA, 20 bp, Artificial Sequence
  Synthetic
gagttgtguggcggaucaga

SEQ ID NO: 10076 - DNA, 26 bp, Artificial Sequence
  Synthetic
guagaatctgcatucccagagacaag

SEQ ID NO: 10077 - DNA, 27 bp, Artificial Sequence
  Synthetic
tctcttgatacaucaatccgtgttugg

SEQ ID NO: 10078 - DNA, 25 bp, Artificial Sequence
  Synthetic
caaaacatguaaacactggcctguc

SEQ ID NO: 10079 - DNA, 31 bp, Artificial Sequence
  Synthetic
aaaccttgactaaauctaccatgttttcuca

SEQ ID NO: 10080 - DNA, 29 bp, Artificial Sequence
  Synthetic
agtgttgtcaucagaaccactaactatuc

SEQ ID NO: 10081 - DNA, 28 bp, Artificial Sequence
  Synthetic
gtttatgcctucatttttctctucacca

SEQ ID NO: 10082 - DNA, 26 bp, Artificial Sequence
  Synthetic
ctcttcttugcatttctctcuccaga

SEQ ID NO: 10083 - DNA, 26 bp, Artificial Sequence
  Synthetic
tttcttagttggcacuctatgtgcut

SEQ ID NO: 10084 - DNA, 19 bp, Artificial Sequence
  Synthetic
tcctggaggccugtaggug

SEQ ID NO: 10085 - DNA, 24 bp, Artificial Sequence
  Synthetic
tttttgtaguaccactgggctugt

SEQ ID NO: 10086 - DNA, 23 bp, Artificial Sequence
  Synthetic
agctcagtaucaaaccgcttcuc

SEQ ID NO: 10087 - DNA, 23 bp, Artificial Sequence
  Synthetic
tgtaatctgauccctctgcugct

SEQ ID NO: 10088 - DNA, 30 bp, Artificial Sequence
  Synthetic
caaagactgugaggaaagtttcatuacaat

SEQ ID NO: 10089 - DNA, 25 bp, Artificial Sequence
  Synthetic
acatactaacagugtcacgaacucc

SEQ ID NO: 10090 - DNA, 24 bp, Artificial Sequence
  Synthetic
ctcttgttgtcugagttgctgtug

SEQ ID NO: 10091 - DNA, 23 bp, Artificial Sequence
  Synthetic
gaatcaggaacugctctctgugg

SEQ ID NO: 10092 - DNA, 28 bp, Artificial Sequence
  Synthetic
gaagttcaccucctaacaatactucaca

SEQ ID NO: 10093 - DNA, 22 bp, Artificial Sequence
  Synthetic
ggaggguggtccttuacaaact

SEQ ID NO: 10094 - DNA, 24 bp, Artificial Sequence
  Synthetic
tggttttgcutgaggctgauacat

SEQ ID NO: 10095 - DNA, 21 bp, Artificial Sequence
  Synthetic
gcagagccugaaaaccatgug

SEQ ID NO: 10096 - DNA, 25 bp, Artificial Sequence
  Synthetic
aaaggatactugtcaccacuccaac

SEQ ID NO: 10097 - DNA, 27 bp, Artificial Sequence
  Synthetic
tctgtactucacactaaaaauggcgat

SEQ ID NO: 10098 - DNA, 27 bp, Artificial Sequence
  Synthetic
actcacctgatuctaaaaccctcauct

SEQ ID NO: 10099 - DNA, 25 bp, Artificial Sequence
  Synthetic
gttgaggatacutctgcagatucga

SEQ ID NO: 10100 - DNA, 22 bp, Artificial Sequence
  Synthetic
ctccagtccauaaggcatggut

SEQ ID NO: 10101 - DNA, 27 bp, Artificial Sequence
  Synthetic
caaaatagaacaagutgttgggauggg

SEQ ID NO: 10102 - DNA, 24 bp, Artificial Sequence
  Synthetic
ccaagtaccaugcgtaagtuaagc

SEQ ID NO: 10103 - DNA, 20 bp, Artificial Sequence
  Synthetic
gggccugatactuggagaga

SEQ ID NO: 10104 - DNA, 28 bp, Artificial Sequence
  Synthetic
tccagaaaguttcaguagaacaacgaat

SEQ ID NO: 10105 - DNA, 26 bp, Artificial Sequence
  Synthetic
tttgttttccaauagcggaatgucac

SEQ ID NO: 10106 - DNA, 26 bp, Artificial Sequence
  Synthetic
gatctagtgcagutccctatgtcaut

SEQ ID NO: 10107 - DNA, 22 bp, Artificial Sequence
  Synthetic
gttggaauccaggaagggugac

SEQ ID NO: 10108 - DNA, 24 bp, Artificial Sequence
  Synthetic
gccaatcagugctgataacactut

SEQ ID NO: 10109 - DNA, 28 bp, Artificial Sequence
  Synthetic
tcctctttttcttuctagggataccuga

SEQ ID NO: 10110 - DNA, 30 bp, Artificial Sequence
  Synthetic
aataatccaaaagtucactgataccaccut

SEQ ID NO: 10111 - DNA, 25 bp, Artificial Sequence
  Synthetic
accgcucaaatgttatcugggaaat

SEQ ID NO: 10112 - DNA, 29 bp, Artificial Sequence
  Synthetic
tcgtcatcaaaauggaaataaaacugcaa

SEQ ID NO: 10113 - DNA, 27 bp, Artificial Sequence
  Synthetic
ctggatgguggacaataaaagaaugag

SEQ ID NO: 10114 - DNA, 29 bp, Artificial Sequence
  Synthetic
cgtacagtctguggtaagtaactttuagg

SEQ ID NO: 10115 - DNA, 25 bp, Artificial Sequence
  Synthetic
ctgtggatcugggcaaatgaaaaug

SEQ ID NO: 10116 - DNA, 21 bp, Artificial Sequence
  Synthetic
acttggacugacggaactugg

SEQ ID NO: 10117 - DNA, 22 bp, Artificial Sequence
  Synthetic
aaggacacagcaguggtatugg

SEQ ID NO: 10118 - DNA, 27 bp, Artificial Sequence
  Synthetic
cttacagguctcgcttatuaaagcaga

SEQ ID NO: 10119 - DNA, 26 bp, Artificial Sequence
  Synthetic
tgtcaacautatttcccaucacacct

SEQ ID NO: 10120 - DNA, 27 bp, Artificial Sequence
  Synthetic
ttcaaagaagugagtttggactuacga

SEQ ID NO: 10121 - DNA, 27 bp, Artificial Sequence
  Synthetic
cuttagggaactuagcagagagcaaat

SEQ ID NO: 10122 - DNA, 28 bp, Artificial Sequence
  Synthetic
gctttatctgauaacacacaccacucaa

SEQ ID NO: 10123 - DNA, 28 bp, Artificial Sequence
  Synthetic
tgttttaaagctacucaccctgtaaugg

SEQ ID NO: 10124 - DNA, 25 bp, Artificial Sequence
  Synthetic
agttctguagccttgagtaugggat

SEQ ID NO: 10125 - DNA, 28 bp, Artificial Sequence
  Synthetic
ggagggcaagaguattaagaacaaagua

SEQ ID NO: 10126 - DNA, 31 bp, Artificial Sequence
  Synthetic
gaggcatctttggucctatattgaatgtuat

SEQ ID NO: 10127 - DNA, 21 bp, Artificial Sequence
  Synthetic
agcccaauccgccacataaut

SEQ ID NO: 10128 - DNA, 30 bp, Artificial Sequence
  Synthetic
gattttaaagtgaaguttgtctccaagugt

SEQ ID NO: 10129 - DNA, 28 bp, Artificial Sequence
  Synthetic
attaatcccutttagtgccuccagaaaa

SEQ ID NO: 10130 - DNA, 28 bp, Artificial Sequence
  Synthetic
cactggatgcugttctgtttatgauagt

SEQ ID NO: 10131 - DNA, 29 bp, Artificial Sequence
  Synthetic
gcagtttgtgugctaaaggaaaaatguat

SEQ ID NO: 10132 - DNA, 27 bp, Artificial Sequence
  Synthetic
gaacaacuttatcctccuggaagaaca

SEQ ID NO: 10133 - DNA, 23 bp, Artificial Sequence
  Synthetic
gaaactgcucacataccccauga

SEQ ID NO: 10134 - DNA, 23 bp, Artificial Sequence
  Synthetic
cccttgauagactgaccuggaaa

SEQ ID NO: 10135 - DNA, 22 bp, Artificial Sequence
  Synthetic
atcatatugggcacagcctgut

SEQ ID NO: 10136 - DNA, 21 bp, Artificial Sequence
  Synthetic
aacgaagaguactgcctgcug

SEQ ID NO: 10137 - DNA, 25 bp, Artificial Sequence
  Synthetic
cactgtgggagauaggacaaaucat

SEQ ID NO: 10138 - DNA, 22 bp, Artificial Sequence
  Synthetic
agauggttgcuagagcaaagcc

SEQ ID NO: 10139 - DNA, 27 bp, Artificial Sequence
  Synthetic
gggacatgaguttacattcctgatugt

SEQ ID NO: 10140 - DNA, 23 bp, Artificial Sequence
  Synthetic
cugtcagattatcuacgcaccca

SEQ ID NO: 10141 - DNA, 21 bp, Artificial Sequence
  Synthetic
tgttcacccugcatgctcaua

SEQ ID NO: 10142 - DNA, 24 bp, Artificial Sequence
  Synthetic
ttctagaggcaggutggtttgtut

SEQ ID NO: 10143 - DNA, 23 bp, Artificial Sequence
  Synthetic
ccgaaatccgguactgatgtcut

SEQ ID NO: 10144 - DNA, 19 bp, Artificial Sequence
  Synthetic
gcugaagggcagctctuct

SEQ ID NO: 10145 - DNA, 17 bp, Artificial Sequence
  Synthetic
gccacuggcggagctuc

SEQ ID NO: 10146 - DNA, 21 bp, Artificial Sequence
  Synthetic
gugcgcttugaacaagagcaa

SEQ ID NO: 10147 - DNA, 24 bp, Artificial Sequence
  Synthetic
gcctctgtuaggtgacccaaatuc

SEQ ID NO: 10148 - DNA, 19 bp, Artificial Sequence
  Synthetic
cacccggaaaucccguacc

SEQ ID NO: 10149 - DNA, 24 bp, Artificial Sequence
  Synthetic
atggccacautagcaattagcuct

SEQ ID NO: 10150 - DNA, 22 bp, Artificial Sequence
  Synthetic
tcugcctgtacuaccgggaaat

SEQ ID NO: 10151 - DNA, 25 bp, Artificial Sequence
  Synthetic
gcagcttctcaaugtttttcctcug

SEQ ID NO: 10152 - DNA, 25 bp, Artificial Sequence
  Synthetic
ctgagtgcugtttaatagugagcca

SEQ ID NO: 10153 - DNA, 25 bp, Artificial Sequence
  Synthetic
tgatgtgttcuggtaaatcguagcc

SEQ ID NO: 10154 - DNA, 22 bp, Artificial Sequence
  Synthetic
gtgttgaaggugttccuggaga

SEQ ID NO: 10155 - DNA, 22 bp, Artificial Sequence
  Synthetic
tgactgggcutcaaaaugccat

SEQ ID NO: 10156 - DNA, 22 bp, Artificial Sequence
  Synthetic
ggtggaaacaggugatgacugt

SEQ ID NO: 10157 - DNA, 23 bp, Artificial Sequence
  Synthetic
gggtagtcccauctcaagtcuca

SEQ ID NO: 10158 - DNA, 17 bp, Artificial Sequence
  Synthetic
cugggagccctucgact

SEQ ID NO: 10159 - DNA, 17 bp, Artificial Sequence
  Synthetic
cccgccucccataccug

SEQ ID NO: 10160 - DNA, 22 bp, Artificial Sequence
  Synthetic
cuccagacccugaagaagagga

SEQ ID NO: 10161 - DNA, 24 bp, Artificial Sequence
  Synthetic
cgggtctcuccttctcatgatcut

SEQ ID NO: 10162 - DNA, 21 bp, Artificial Sequence
  Synthetic
ctgccagcccuaacaugagat

SEQ ID NO: 10163 - DNA, 25 bp, Artificial Sequence
  Synthetic
aagggacagagaaugtaaccucaga

SEQ ID NO: 10164 - DNA, 21 bp, Artificial Sequence
  Synthetic
tctcctugacttccucagcct

SEQ ID NO: 10165 - DNA, 21 bp, Artificial Sequence
  Synthetic
agaacacugagggcagagcua

SEQ ID NO: 10166 - DNA, 23 bp, Artificial Sequence
  Synthetic
gtgattacugctccatcucccaa

SEQ ID NO: 10167 - DNA, 23 bp, Artificial Sequence
  Synthetic
ctcacgtuagcctgatactuggt

SEQ ID NO: 10168 - DNA, 27 bp, Artificial Sequence
  Synthetic
tgaactcactguctaaggtccuaacaa

SEQ ID NO: 10169 - DNA, 22 bp, Artificial Sequence
  Synthetic
ttgggcaauttctgccugaaag

SEQ ID NO: 10170 - DNA, 28 bp, Artificial Sequence
  Synthetic
cttgtgattgacuttaaacttgtuggca

SEQ ID NO: 10171 - DNA, 21 bp, Artificial Sequence
  Synthetic
gaaccuccagcagaagacucc

SEQ ID NO: 10172 - DNA, 28 bp, Artificial Sequence
  Synthetic
attgaucaggaagaacuaaacaagacca

SEQ ID NO: 10173 - DNA, 22 bp, Artificial Sequence
  Synthetic
aacaugcaaaggcttcucacac

SEQ ID NO: 10174 - DNA, 23 bp, Artificial Sequence
  Synthetic
ctccagcagagcaaaauctugaa

SEQ ID NO: 10175 - DNA, 28 bp, Artificial Sequence
  Synthetic
gtggtaaagggaauaagcattattugcc

SEQ ID NO: 10176 - DNA, 25 bp, Artificial Sequence
  Synthetic
gcttcgagguggtatataugaccga

SEQ ID NO: 10177 - DNA, 23 bp, Artificial Sequence
  Synthetic
tttgccttgcuctcttccatcut

SEQ ID NO: 10178 - DNA, 19 bp, Artificial Sequence
  Synthetic
gcugaggccgacaagaaug

SEQ ID NO: 10179 - DNA, 23 bp, Artificial Sequence
  Synthetic
ccacaccaaguaccaaagcuact

SEQ ID NO: 10180 - DNA, 19 bp, Artificial Sequence
  Synthetic
gctctcuccgctcgaagug

SEQ ID NO: 10181 - DNA, 21 bp, Artificial Sequence
  Synthetic
cgtcttcaucgtcctccucct

SEQ ID NO: 10182 - DNA, 24 bp, Artificial Sequence
  Synthetic
ctatatcatcugggtgctcggtut

SEQ ID NO: 10183 - DNA, 21 bp, Artificial Sequence
  Synthetic
gccagtuccctcattcuggac

SEQ ID NO: 10184 - DNA, 18 bp, Artificial Sequence
  Synthetic
acagtcccucccagcuct

SEQ ID NO: 10185 - DNA, 22 bp, Artificial Sequence
  Synthetic
atcgtccuggacttcauccaac

SEQ ID NO: 10186 - DNA, 23 bp, Artificial Sequence
  Synthetic
gttcggaccutcatctcugaact

SEQ ID NO: 10187 - DNA, 20 bp, Artificial Sequence
  Synthetic
atcatgacaucgctguggct

SEQ ID NO: 10188 - DNA, 23 bp, Artificial Sequence
  Synthetic
ttggtcaaucagaacttgcucca

SEQ ID NO: 10189 - DNA, 21 bp, Artificial Sequence
  Synthetic
gagggttugcatagacuggct

SEQ ID NO: 10190 - DNA, 30 bp, Artificial Sequence
  Synthetic
aacaatcttgtcuggagatatggtcaatut

SEQ ID NO: 10191 - DNA, 26 bp, Artificial Sequence
  Synthetic
gcagtaacugacacacatgaaaaugg

SEQ ID NO: 10192 - DNA, 28 bp, Artificial Sequence
  Synthetic
ttcaggagccacauaaactactucaaat

SEQ ID NO: 10193 - DNA, 23 bp, Artificial Sequence
  Synthetic
tagatctcuctaccccuaagcct

SEQ ID NO: 10194 - DNA, 31 bp, Artificial Sequence
  Synthetic
gtccaacaaaggagcaugattatactagaua

SEQ ID NO: 10195 - DNA, 26 bp, Artificial Sequence
  Synthetic
aagautcccuaaagaaaagccaaggt

SEQ ID NO: 10196 - DNA, 29 bp, Artificial Sequence
  Synthetic
aaaagaaagaaguaagagtcaacctcaut

SEQ ID NO: 10197 - DNA, 24 bp, Artificial Sequence
  Synthetic
gttctccaggcugaagtatauggg

SEQ ID NO: 10198 - DNA, 25 bp, Artificial Sequence
  Synthetic
ttcaaaattgtccugtacacccugt

SEQ ID NO: 10199 - DNA, 25 bp, Artificial Sequence
  Synthetic
gcttttacagcugcactctatucag

SEQ ID NO: 10200 - DNA, 24 bp, Artificial Sequence
  Synthetic
tggttgattugagacacagacugg

SEQ ID NO: 10201 - DNA, 23 bp, Artificial Sequence
  Synthetic
gcuggagaaggagtucgacaaag

SEQ ID NO: 10202 - DNA, 22 bp, Artificial Sequence
  Synthetic
atgactatgaugggctgctucc

SEQ ID NO: 10203 - DNA, 22 bp, Artificial Sequence
  Synthetic
gctaatgagcutgagcaccugt

SEQ ID NO: 10204 - DNA, 23 bp, Artificial Sequence
  Synthetic
acaatguagggagaggtggcaua

SEQ ID NO: 10205 - DNA, 22 bp, Artificial Sequence
  Synthetic
ctttgcgattuctgcccatcug

SEQ ID NO: 10206 - DNA, 24 bp, Artificial Sequence
  Synthetic
acaagctuccagaagaacagucat

SEQ ID NO: 10207 - DNA, 29 bp, Artificial Sequence
  Synthetic
accgtctctcucattaaactagatucaca

SEQ ID NO: 10208 - DNA, 30 bp, Artificial Sequence
  Synthetic
cctttcttctgucctctctttatttcuaca

SEQ ID NO: 10209 - DNA, 22 bp, Artificial Sequence
  Synthetic
gagatggaguggagtggtgtuc

SEQ ID NO: 10210 - DNA, 27 bp, Artificial Sequence
  Synthetic
agcagutttgaattcttugaagaagca

SEQ ID NO: 10211 - DNA, 21 bp, Artificial Sequence
  Synthetic
gggtgggucaagtgaactcuc

SEQ ID NO: 10212 - DNA, 27 bp, Artificial Sequence
  Synthetic
aacacttccaguaaccatgaaaacuca

SEQ ID NO: 10213 - DNA, 29 bp, Artificial Sequence
  Synthetic
tgaaccaaagacutacacagtatttucct

SEQ ID NO: 10214 - DNA, 30 bp, Artificial Sequence
  Synthetic
cattggtttattagucccattaggagtuct

SEQ ID NO: 10215 - DNA, 26 bp, Artificial Sequence
  Synthetic
gtccattutcttgaaacucagcaaca

SEQ ID NO: 10216 - DNA, 27 bp, Artificial Sequence
  Synthetic
acagtgttagaaaaaugtggctcucat

SEQ ID NO: 10217 - DNA, 27 bp, Artificial Sequence
  Synthetic
gaacattgtctucatcttctgatgcug

SEQ ID NO: 10218 - DNA, 17 bp, Artificial Sequence
  Synthetic
cggacgcuggtcatgug

SEQ ID NO: 10219 - DNA, 22 bp, Artificial Sequence
  Synthetic
actaaatgcacutggtgcugct

SEQ ID NO: 10220 - DNA, 31 bp, Artificial Sequence
  Synthetic
tgtattttaactucttttctagcugcaaggt

SEQ ID NO: 10221 - DNA, 20 bp, Artificial Sequence
  Synthetic
ttctgtugacagcgccugat

SEQ ID NO: 10222 - DNA, 27 bp, Artificial Sequence
  Synthetic
tgctcagauaccaaggtauaaaggaca

SEQ ID NO: 10223 - DNA, 22 bp, Artificial Sequence
  Synthetic
cugagaacccaatcugacagga

SEQ ID NO: 10224 - DNA, 23 bp, Artificial Sequence
  Synthetic
gagcaccgautaactgtcctugt

SEQ ID NO: 10225 - DNA, 22 bp, Artificial Sequence
  Synthetic
aagtccacauctttgggcacut

SEQ ID NO: 10226 - DNA, 26 bp, Artificial Sequence
  Synthetic
gcggattatcuggaagatgttgcaua

SEQ ID NO: 10227 - DNA, 23 bp, Artificial Sequence
  Synthetic
cagugtttttgaaaugcaaggca

SEQ ID NO: 10228 - DNA, 28 bp, Artificial Sequence
  Synthetic
ttgtacaactgaautggaacaaagauga

SEQ ID NO: 10229 - DNA, 25 bp, Artificial Sequence
  Synthetic
agtctccugtttatcagucagacct

SEQ ID NO: 10230 - DNA, 26 bp, Artificial Sequence
  Synthetic
cattttgatttutgtgcggtugcaat

SEQ ID NO: 10231 - DNA, 25 bp, Artificial Sequence
  Synthetic
cacctcaggautagaaatggtucga

SEQ ID NO: 10232 - DNA, 29 bp, Artificial Sequence
  Synthetic
agctttagagaaguatggtcuggaaaaag

SEQ ID NO: 10233 - DNA, 27 bp, Artificial Sequence
  Synthetic
atgatatgguaggctgaaaatcuaggt

SEQ ID NO: 10234 - DNA, 28 bp, Artificial Sequence
  Synthetic
gggattttaguctttcagtugaagagga

SEQ ID NO: 10235 - DNA, 28 bp, Artificial Sequence
  Synthetic
cttaactctacuaaatagggcagctuct

SEQ ID NO: 10236 - DNA, 30 bp, Artificial Sequence
  Synthetic
cattctgtgttuaaatgctgtgaactucat

SEQ ID NO: 10237 - DNA, 21 bp, Artificial Sequence
  Synthetic
ggccttccacguaggtttcug

SEQ ID NO: 10238 - DNA, 21 bp, Artificial Sequence
  Synthetic
cgctgagtgucaagcttggut

SEQ ID NO: 10239 - DNA, 25 bp, Artificial Sequence
  Synthetic
gataatctggcugctgttctacuct

SEQ ID NO: 10240 - DNA, 30 bp, Artificial Sequence
  Synthetic
gctgaagattcatutttgtctgccattaua

SEQ ID NO: 10241 - DNA, 24 bp, Artificial Sequence
  Synthetic
tgactttatgtgugcgctctguag

SEQ ID NO: 10242 - DNA, 24 bp, Artificial Sequence
  Synthetic
agagtccagautgtttcccatgug

SEQ ID NO: 10243 - DNA, 25 bp, Artificial Sequence
  Synthetic
agactgttctcutcagggtcatcua

SEQ ID NO: 10244 - DNA, 22 bp, Artificial Sequence
  Synthetic
cgattatccgucagcagtuggg

SEQ ID NO: 10245 - DNA, 28 bp, Artificial Sequence
  Synthetic
agctcttgctcaucataaagatcagaug

SEQ ID NO: 10246 - DNA, 21 bp, Artificial Sequence
  Synthetic
cgcagtgauggaagggaagug

SEQ ID NO: 10247 - DNA, 24 bp, Artificial Sequence
  Synthetic
ctcuggcacagagggtcuaaaaat

SEQ ID NO: 10248 - DNA, 22 bp, Artificial Sequence
  Synthetic
tcaatgcagugttttcgcctug

SEQ ID NO: 10249 - DNA, 27 bp, Artificial Sequence
  Synthetic
cagaatctcucacatcatttgcugaat

SEQ ID NO: 10250 - DNA, 24 bp, Artificial Sequence
  Synthetic
tcatgacaagaacaagcuctgugg

SEQ ID NO: 10251 - DNA, 23 bp, Artificial Sequence
  Synthetic
actgttgttuccctactggucct

SEQ ID NO: 10252 - DNA, 22 bp, Artificial Sequence
  Synthetic
ggagggaaaagugcataugcct

SEQ ID NO: 10253 - DNA, 28 bp, Artificial Sequence
  Synthetic
actagauaactgagatguccaaagggaa

SEQ ID NO: 10254 - DNA, 22 bp, Artificial Sequence
  Synthetic
cagctauggaccgaaagtcuga

SEQ ID NO: 10255 - DNA, 20 bp, Artificial Sequence
  Synthetic
ctgcuggtgtttuccaacgg

SEQ ID NO: 10256 - DNA, 21 bp, Artificial Sequence
  Synthetic
gttttcucccctgacugcaca

SEQ ID NO: 10257 - DNA, 25 bp, Artificial Sequence
  Synthetic
aaagctcctcuttgctgactguaat

SEQ ID NO: 10258 - DNA, 21 bp, Artificial Sequence
  Synthetic
ggacaccaugctgatcaugca

SEQ ID NO: 10259 - DNA, 25 bp, Artificial Sequence
  Synthetic
gggcccutttaatccttaucacgat

SEQ ID NO: 10260 - DNA, 27 bp, Artificial Sequence
  Synthetic
cgctgaagaaaaggutatggtccttua

SEQ ID NO: 10261 - DNA, 21 bp, Artificial Sequence
  Synthetic
gcaggtccaaucacaaagcug

SEQ ID NO: 10262 - DNA, 29 bp, Artificial Sequence
  Synthetic
taaaggtattuttgtattctcugagcact

SEQ ID NO: 10263 - DNA, 21 bp, Artificial Sequence
  Synthetic
acagctgcuccagtagaucct

SEQ ID NO: 10264 - DNA, 26 bp, Artificial Sequence
  Synthetic
actggagaaugaacugaacacaaagt

SEQ ID NO: 10265 - DNA, 29 bp, Artificial Sequence
  Synthetic
atcacttagaaatauaacccccttccuct

SEQ ID NO: 10266 - DNA, 21 bp, Artificial Sequence
  Synthetic
cctgcagcuatgtcucccaag

SEQ ID NO: 10267 - DNA, 24 bp, Artificial Sequence
  Synthetic
tgttttcucttgctgtuccaacaa

SEQ ID NO: 10268 - DNA, 21 bp, Artificial Sequence
  Synthetic
caggtccuccaccaccatauc

SEQ ID NO: 10269 - DNA, 24 bp, Artificial Sequence
  Synthetic
tttcacauggaaactuggaaagct

SEQ ID NO: 10270 - DNA, 21 bp, Artificial Sequence
  Synthetic
ccaaagccaaagutgccuaca

SEQ ID NO: 10271 - DNA, 27 bp, Artificial Sequence
  Synthetic
ctagacaagaaaugcaggaagtucaga

SEQ ID NO: 10272 - DNA, 29 bp, Artificial Sequence
  Synthetic
caaagtaatctcuaaggtgatgttccuca

SEQ ID NO: 10273 - DNA, 24 bp, Artificial Sequence
  Synthetic
ggttgggtgcuttgaattatgcut

SEQ ID NO: 10274 - DNA, 26 bp, Artificial Sequence
  Synthetic
agttcctcaaacuttcttctgtggut

SEQ ID NO: 10275 - DNA, 20 bp, Artificial Sequence
  Synthetic
gccagcaggucacctcauat

SEQ ID NO: 10276 - DNA, 18 bp, Artificial Sequence
  Synthetic
gggatgguggaggcuagg

SEQ ID NO: 10277 - DNA, 25 bp, Artificial Sequence
  Synthetic
agaaccgcaggaugaaaaugaagaa

SEQ ID NO: 10278 - DNA, 24 bp, Artificial Sequence
  Synthetic
ccttcgctgggutgtttttctcua

SEQ ID NO: 10279 - DNA, 17 bp, Artificial Sequence
  Synthetic
tctcctucgcgggctug

SEQ ID NO: 10280 - DNA, 18 bp, Artificial Sequence
  Synthetic
gccaacgcucagctcauc

SEQ ID NO: 10281 - DNA, 24 bp, Artificial Sequence
  Synthetic
tgcagtttcauaatttccgugggt

SEQ ID NO: 10282 - DNA, 25 bp, Artificial Sequence
  Synthetic
ccttcattcucctgttcugaaacca

SEQ ID NO: 10283 - DNA, 24 bp, Artificial Sequence
  Synthetic
ccctataccaaguaccagauccga

SEQ ID NO: 10284 - DNA, 18 bp, Artificial Sequence
  Synthetic
ctctgugcacgagcucct

SEQ ID NO: 10285 - DNA, 18 bp, Artificial Sequence
  Synthetic
cgtctucgcgcccaauga

SEQ ID NO: 10286 - DNA, 29 bp, Artificial Sequence
  Synthetic
gttgccttctugctctatttttaauccat

SEQ ID NO: 10287 - DNA, 23 bp, Artificial Sequence
  Synthetic
gataucagccacgacgaatcuct

SEQ ID NO: 10288 - DNA, 20 bp, Artificial Sequence
  Synthetic
cagggcuggtagcttuccat

SEQ ID NO: 10289 - DNA, 19 bp, Artificial Sequence
  Synthetic
gcgctaaggagutcgccut

SEQ ID NO: 10290 - DNA, 20 bp, Artificial Sequence
  Synthetic
gctgccgaaguagccauagg

SEQ ID NO: 10291 - DNA, 17 bp, Artificial Sequence
  Synthetic
cgucgtccucgggaggt

SEQ ID NO: 10292 - DNA, 23 bp, Artificial Sequence
  Synthetic
tctttaaagggutgctgaaugct

SEQ ID NO: 10293 - DNA, 21 bp, Artificial Sequence
  Synthetic
cggtgucggctgagattauca

SEQ ID NO: 10294 - DNA, 21 bp, Artificial Sequence
  Synthetic
ctcttccccuccattcaugca

SEQ ID NO: 10295 - DNA, 23 bp, Artificial Sequence
  Synthetic
ctgacagtccutgcacttctcut

SEQ ID NO: 10296 - DNA, 25 bp, Artificial Sequence
  Synthetic
cataggttggcugctgtaattctug

SEQ ID NO: 10297 - DNA, 27 bp, Artificial Sequence
  Synthetic
ttaatctttttctcugcttagcctcug

SEQ ID NO: 10298 - DNA, 21 bp, Artificial Sequence
  Synthetic
cccgagacucacacttctuct

SEQ ID NO: 10299 - DNA, 19 bp, Artificial Sequence
  Synthetic
ccgctggugacccactuac

SEQ ID NO: 10300 - DNA, 21 bp, Artificial Sequence
  Synthetic
catgtccccacgcugagttua

SEQ ID NO: 10301 - DNA, 21 bp, Artificial Sequence
  Synthetic
tggcattugaagggcttcucc

SEQ ID NO: 10302 - DNA, 20 bp, Artificial Sequence
  Synthetic
ggacgcgacugaacccttua

SEQ ID NO: 10303 - DNA, 22 bp, Artificial Sequence
  Synthetic
tttggcgacgutacttgcuagt

SEQ ID NO: 10304 - DNA, 18 bp, Artificial Sequence
  Synthetic
aggtggucccggtcauca

SEQ ID NO: 10305 - DNA, 20 bp, Artificial Sequence
  Synthetic
accaacutggcctuggagag

SEQ ID NO: 10306 - DNA, 24 bp, Artificial Sequence
  Synthetic
ggagcagaugaaggtgtacaagug

SEQ ID NO: 10307 - DNA, 20 bp, Artificial Sequence
  Synthetic
cgagaacucgtaccggucct

SEQ ID NO: 10308 - DNA, 23 bp, Artificial Sequence
  Synthetic
gggtgttgguttggctctatuct

SEQ ID NO: 10309 - DNA, 23 bp, Artificial Sequence
  Synthetic
atgtattttugagcccccauggt

SEQ ID NO: 10310 - DNA, 23 bp, Artificial Sequence
  Synthetic
tttagacacagucctgtgggaut

SEQ ID NO: 10311 - DNA, 21 bp, Artificial Sequence
  Synthetic
cgttgtggccucaaccattuc

SEQ ID NO: 10312 - DNA, 24 bp, Artificial Sequence
  Synthetic
ttggaggcugagataagtcctuct

SEQ ID NO: 10313 - DNA, 30 bp, Artificial Sequence
  Synthetic
gggataatatatguataaaagcaccugcca

SEQ ID NO: 10314 - DNA, 24 bp, Artificial Sequence
  Synthetic
aggaacctccuacctctattcugg

SEQ ID NO: 10315 - DNA, 22 bp, Artificial Sequence
  Synthetic
aaggtcagtucagcctttguga

SEQ ID NO: 10316 - DNA, 21 bp, Artificial Sequence
  Synthetic
tcacuagccgacagagacugt

SEQ ID NO: 10317 - DNA, 25 bp, Artificial Sequence
  Synthetic
gctatgagaacutgctctgacctug

SEQ ID NO: 10318 - DNA, 26 bp, Artificial Sequence
  Synthetic
agataattcctccuccctatgagcug

SEQ ID NO: 10319 - DNA, 23 bp, Artificial Sequence
  Synthetic
cctctgggaaguagggactgtut

SEQ ID NO: 10320 - DNA, 18 bp, Artificial Sequence
  Synthetic
gccugcaggatggugaca

SEQ ID NO: 10321 - DNA, 26 bp, Artificial Sequence
  Synthetic
cctcacctuggtcctttacaauacag

SEQ ID NO: 10322 - DNA, 23 bp, Artificial Sequence
  Synthetic
ggcttaacutagctccugaacca

SEQ ID NO: 10323 - DNA, 23 bp, Artificial Sequence
  Synthetic
cacucctttttggucaaccacag

SEQ ID NO: 10324 - DNA, 21 bp, Artificial Sequence
  Synthetic
acagtgcacutgcatggctua

SEQ ID NO: 10325 - DNA, 27 bp, Artificial Sequence
  Synthetic
tctcacactcuttccaatttctuccag

SEQ ID NO: 10326 - DNA, 20 bp, Artificial Sequence
  Synthetic
gccctccaugacccttauga

SEQ ID NO: 10327 - DNA, 21 bp, Artificial Sequence
  Synthetic
gcaaccugcagatgagugacc

SEQ ID NO: 10328 - DNA, 21 bp, Artificial Sequence
  Synthetic
caggtggcucctgagtacauc

SEQ ID NO: 10329 - DNA, 27 bp, Artificial Sequence
  Synthetic
ctttctttcctuctccattctcucaca

SEQ ID NO: 10330 - DNA, 23 bp, Artificial Sequence
  Synthetic
gcaagacucctactccctucaaa

SEQ ID NO: 10331 - DNA, 17 bp, Artificial Sequence
  Synthetic
acccacugcccaaggug

SEQ ID NO: 10332 - DNA, 22 bp, Artificial Sequence
  Synthetic
ggagtguaaagaggcacuagca

SEQ ID NO: 10333 - DNA, 32 bp, Artificial Sequence
  Synthetic
cttctgaaggtcutcctcatttaaaacauaaa

SEQ ID NO: 10334 - DNA, 23 bp, Artificial Sequence
  Synthetic
gggagccaaagucctttcatcug

SEQ ID NO: 10335 - DNA, 28 bp, Artificial Sequence
  Synthetic
ccgtcaaaaacauaaaaccatcttucgt

SEQ ID NO: 10336 - DNA, 22 bp, Artificial Sequence
  Synthetic
ggcccagcutgctagacaaaua

SEQ ID NO: 10337 - DNA, 29 bp, Artificial Sequence
  Synthetic
tttttgttgacgaucttgttgaagaaguc

SEQ ID NO: 10338 - DNA, 31 bp, Artificial Sequence
  Synthetic
ccctgctaatcugttattaccattatcauct

SEQ ID NO: 10339 - DNA, 21 bp, Artificial Sequence
  Synthetic
tggagacacuggatgggaguc

SEQ ID NO: 10340 - DNA, 30 bp, Artificial Sequence
  Synthetic
ttttaaaagttctaugttgtccttguaggt

SEQ ID NO: 10341 - DNA, 30 bp, Artificial Sequence
  Synthetic
ctcatttucaaggagaacuctagttttcut

SEQ ID NO: 10342 - DNA, 28 bp, Artificial Sequence
  Synthetic
tggtaaggaagautctatcctatcaugt

SEQ ID NO: 10343 - DNA, 27 bp, Artificial Sequence
  Synthetic
cagttaaaguaagtaaagugccaccag

SEQ ID NO: 10344 - DNA, 25 bp, Artificial Sequence
  Synthetic
tgaaaautgactuagccaaccgaga

SEQ ID NO: 10345 - DNA, 27 bp, Artificial Sequence
  Synthetic
acagcaaaatcauccttgtattcatug

SEQ ID NO: 10346 - DNA, 21 bp, Artificial Sequence
  Synthetic
gaatctgcaacucccccugaa

SEQ ID NO: 10347 - DNA, 30 bp, Artificial Sequence
  Synthetic
aagcatttctuaccttaatttccaguacat

SEQ ID NO: 10348 - DNA, 26 bp, Artificial Sequence
  Synthetic
aaagtgcuacaacctgtgtaguacaa

SEQ ID NO: 10349 - DNA, 26 bp, Artificial Sequence
  Synthetic
tgatatugagacaacaccagcaauca

SEQ ID NO: 10350 - DNA, 26 bp, Artificial Sequence
  Synthetic
ctgtttcaguccccattaaaugaggt

SEQ ID NO: 10351 - DNA, 27 bp, Artificial Sequence
  Synthetic
gactggatataucagagtccccacuag

SEQ ID NO: 10352 - DNA, 32 bp, Artificial Sequence
  Synthetic
gacaaaagtattcacugttccataatgaagut

SEQ ID NO: 10353 - DNA, 21 bp, Artificial Sequence
  Synthetic
cttcactucgcaggcagatuc

SEQ ID NO: 10354 - DNA, 32 bp, Artificial Sequence
  Synthetic
cttgccagagacaugtatgataaagaatacua

SEQ ID NO: 10355 - DNA, 32 bp, Artificial Sequence
  Synthetic
atgaaaguaaaagaggagaaautcagagauaa

SEQ ID NO: 10356 - DNA, 23 bp, Artificial Sequence
  Synthetic
gctaaaatgcuggcacccuaaag

SEQ ID NO: 10357 - DNA, 23 bp, Artificial Sequence
  Synthetic
gagcgacacautttacgtucaca

SEQ ID NO: 10358 - DNA, 22 bp, Artificial Sequence
  Synthetic
cggatactuggcaaatcugcga

SEQ ID NO: 10359 - DNA, 18 bp, Artificial Sequence
  Synthetic
gcugggtuaccccaccag

SEQ ID NO: 10360 - DNA, 22 bp, Artificial Sequence
  Synthetic
acacugacactcugagacacct

SEQ ID NO: 10361 - DNA, 22 bp, Artificial Sequence
  Synthetic
atttgcugccagagggatcuac

SEQ ID NO: 10362 - DNA, 18 bp, Artificial Sequence
  Synthetic
cctacaccugcggtgcug

SEQ ID NO: 10363 - DNA, 20 bp, Artificial Sequence
  Synthetic
aggtauccagcccttcccut

SEQ ID NO: 10364 - DNA, 18 bp, Artificial Sequence
  Synthetic
ggctccugtcctgcucct

SEQ ID NO: 10365 - DNA, 23 bp, Artificial Sequence
  Synthetic
cagatgcagaucgacaagaucct

SEQ ID NO: 10366 - DNA, 18 bp, Artificial Sequence
  Synthetic
cggctgcauggcgauaag

SEQ ID NO: 10367 - DNA, 27 bp, Artificial Sequence
  Synthetic
gtgtatgtgtttugcttttccttcugt

SEQ ID NO: 10368 - DNA, 23 bp, Artificial Sequence
  Synthetic
ttggaagggauctttgactuggg

SEQ ID NO: 10369 - DNA, 24 bp, Artificial Sequence
  Synthetic
gtgaagggcutcgattttgcuaag

SEQ ID NO: 10370 - DNA, 21 bp, Artificial Sequence
  Synthetic
cagagcucactgucagaacga

SEQ ID NO: 10371 - DNA, 22 bp, Artificial Sequence
  Synthetic
cagtcaagucttcggaccugat

SEQ ID NO: 10372 - DNA, 26 bp, Artificial Sequence
  Synthetic
gaaacaagaaagguagcaucattcuc

SEQ ID NO: 10373 - DNA, 27 bp, Artificial Sequence
  Synthetic
gtatccacagcucaacttatctcagut

SEQ ID NO: 10374 - DNA, 26 bp, Artificial Sequence
  Synthetic
ccactggagggaauaagagtuaagca

SEQ ID NO: 10375 - DNA, 23 bp, Artificial Sequence
  Synthetic
gaaaggccuaatgacagctcuct

SEQ ID NO: 10376 - DNA, 22 bp, Artificial Sequence
  Synthetic
ccagtcucaccagacaucacac

SEQ ID NO: 10377 - DNA, 24 bp, Artificial Sequence
  Synthetic
ggcatttgguggtttgctttcaut

SEQ ID NO: 10378 - DNA, 20 bp, Artificial Sequence
  Synthetic
ctgtgggugtgagtgauggg

SEQ ID NO: 10379 - DNA, 19 bp, Artificial Sequence
  Synthetic
cggtcacgugtctgtccug

SEQ ID NO: 10380 - DNA, 23 bp, Artificial Sequence
  Synthetic
acgcutcaacaaacucgagagaa

SEQ ID NO: 10381 - DNA, 22 bp, Artificial Sequence
  Synthetic
ctgcagtcauctcagctgtcuc

SEQ ID NO: 10382 - DNA, 21 bp, Artificial Sequence
  Synthetic
aaaacacucgggtctcugacg

SEQ ID NO: 10383 - DNA, 22 bp, Artificial Sequence
  Synthetic
tctgttgcugaaacccaaguga

SEQ ID NO: 10384 - DNA, 20 bp, Artificial Sequence
  Synthetic
cggtcaugcacagagtcucg

SEQ ID NO: 10385 - DNA, 24 bp, Artificial Sequence
  Synthetic
tcctguggacaacactcataucct

SEQ ID NO: 10386 - DNA, 24 bp, Artificial Sequence
  Synthetic
caaggaggguaacgguataguaat

SEQ ID NO: 10387 - DNA, 24 bp, Artificial Sequence
  Synthetic
catttaucaagcaggactcugcca

SEQ ID NO: 10388 - DNA, 22 bp, Artificial Sequence
  Synthetic
cgtggagtgguccagtgaguat

SEQ ID NO: 10389 - DNA, 26 bp, Artificial Sequence
  Synthetic
gccactactttugatacagcctttut

SEQ ID NO: 10390 - DNA, 17 bp, Artificial Sequence
  Synthetic
gtccgcugcccttguct

SEQ ID NO: 10391 - DNA, 25 bp, Artificial Sequence
  Synthetic
ggaugaaauggaaacgcagcaaaaa

SEQ ID NO: 10392 - DNA, 17 bp, Artificial Sequence
  Synthetic
ggtgccgguggaggaug

SEQ ID NO: 10393 - DNA, 17 bp, Artificial Sequence
  Synthetic
cagcuggaccaguggct

SEQ ID NO: 10394 - DNA, 17 bp, Artificial Sequence
  Synthetic
gggcgaugggttgaugg

SEQ ID NO: 10395 - DNA, 19 bp, Artificial Sequence
  Synthetic
tgcagcugcggatggauag

SEQ ID NO: 10396 - DNA, 22 bp, Artificial Sequence
  Synthetic
cctgtctgugtcctctctguct

SEQ ID NO: 10397 - DNA, 20 bp, Artificial Sequence
  Synthetic
ggtgaccucttgccaucacg

SEQ ID NO: 10398 - DNA, 18 bp, Artificial Sequence
  Synthetic
cccaugagcccacacucc

SEQ ID NO: 10399 - DNA, 19 bp, Artificial Sequence
  Synthetic
cacagagcgugtgtuccga

SEQ ID NO: 10400 - DNA, 19 bp, Artificial Sequence
  Synthetic
catccgcugguaccacaac

SEQ ID NO: 10401 - DNA, 20 bp, Artificial Sequence
  Synthetic
ggtgacggguagggtagguc

SEQ ID NO: 10402 - DNA, 20 bp, Artificial Sequence
  Synthetic
gcatcacagccuaccagucc

SEQ ID NO: 10403 - DNA, 19 bp, Artificial Sequence
  Synthetic
gcacccuggtgatgtcgut

SEQ ID NO: 10404 - DNA, 21 bp, Artificial Sequence
  Synthetic
tttgctcaagccuctctcuca

SEQ ID NO: 10405 - DNA, 18 bp, Artificial Sequence
  Synthetic
caggugctcguccaccag

SEQ ID NO: 10406 - DNA, 21 bp, Artificial Sequence
  Synthetic
ggtccuggtgtctcugaggag

SEQ ID NO: 10407 - DNA, 22 bp, Artificial Sequence
  Synthetic
cattucggaagacgagcagtug

SEQ ID NO: 10408 - DNA, 18 bp, Artificial Sequence
  Synthetic
cugagggagccgaaccug

SEQ ID NO: 10409 - DNA, 19 bp, Artificial Sequence
  Synthetic
caugagcacggccacatug

SEQ ID NO: 10410 - DNA, 21 bp, Artificial Sequence
  Synthetic
tgggtuggacggccattaaut

SEQ ID NO: 10411 - DNA, 24 bp, Artificial Sequence
  Synthetic
catctggtagutggtgagtgugat

SEQ ID NO: 10412 - DNA, 20 bp, Artificial Sequence
  Synthetic
ggacccccaauccctcatuc

SEQ ID NO: 10413 - DNA, 24 bp, Artificial Sequence
  Synthetic
atctggtgtuaggtaggtaggcut

SEQ ID NO: 10414 - DNA, 21 bp, Artificial Sequence
  Synthetic
cctctattcuccgggagucca

SEQ ID NO: 10415 - DNA, 19 bp, Artificial Sequence
  Synthetic
ccguacaagcagcugcaca

SEQ ID NO: 10416 - DNA, 20 bp, Artificial Sequence
  Synthetic
gcuggagaaggagagccauc

SEQ ID NO: 10417 - DNA, 23 bp, Artificial Sequence
  Synthetic
ccttagacgguagtttcgctcut

SEQ ID NO: 10418 - DNA, 17 bp, Artificial Sequence
  Synthetic
aagctgggcugggtguc

SEQ ID NO: 10419 - DNA, 19 bp, Artificial Sequence
  Synthetic
cttcctcucgcccaucaca

SEQ ID NO: 10420 - DNA, 24 bp, Artificial Sequence
  Synthetic
agaaagcaggacuctacagtgcua

SEQ ID NO: 10421 - DNA, 18 bp, Artificial Sequence
  Synthetic
ctccaaccucccctgugc

SEQ ID NO: 10422 - DNA, 19 bp, Artificial Sequence
  Synthetic
gctgctccuctgggttgug

SEQ ID NO: 10423 - DNA, 19 bp, Artificial Sequence
  Synthetic
cccatggccucttctccug

SEQ ID NO: 10424 - DNA, 23 bp, Artificial Sequence
  Synthetic
accgcccagaaggugttagtaua

SEQ ID NO: 10425 - DNA, 20 bp, Artificial Sequence
  Synthetic
cagtgggacucccatgcuag

SEQ ID NO: 10426 - DNA, 24 bp, Artificial Sequence
  Synthetic
gcaggacaucgagaggagaagtua

SEQ ID NO: 10427 - DNA, 22 bp, Artificial Sequence
  Synthetic
cgacaaagagauggaggtgcut

SEQ ID NO: 10428 - DNA, 23 bp, Artificial Sequence
  Synthetic
ccctactgagauggagtgtgugt

SEQ ID NO: 10429 - DNA, 24 bp, Artificial Sequence
  Synthetic
cctgccttaugtccagatctugaa

SEQ ID NO: 10430 - DNA, 23 bp, Artificial Sequence
  Synthetic
tgccgtacucattctccacaaug

SEQ ID NO: 10431 - DNA, 22 bp, Artificial Sequence
  Synthetic
gcattttccuctggacccucaa

SEQ ID NO: 10432 - DNA, 18 bp, Artificial Sequence
  Synthetic
gcagggcutggcuaccaa

SEQ ID NO: 10433 - DNA, 17 bp, Artificial Sequence
  Synthetic
gugcagcuggcggaaag

SEQ ID NO: 10434 - DNA, 18 bp, Artificial Sequence
  Synthetic
gaggcacutccagcucca

SEQ ID NO: 10435 - DNA, 19 bp, Artificial Sequence
  Synthetic
cctttccccuccccuacct

SEQ ID NO: 10436 - DNA, 27 bp, Artificial Sequence
  Synthetic
gttcatggcatucaaggtgttcataut

SEQ ID NO: 10437 - DNA, 19 bp, Artificial Sequence
  Synthetic
cagcagcugtatggccgua

SEQ ID NO: 10438 - DNA, 23 bp, Artificial Sequence
  Synthetic
aatggctauaaggcatggcauga

SEQ ID NO: 10439 - DNA, 30 bp, Artificial Sequence
  Synthetic
gggaacataagtauctatgagaggatucca

SEQ ID NO: 10440 - DNA, 21 bp, Artificial Sequence
  Synthetic
catcgtggagucgtaacugct

SEQ ID NO: 10441 - DNA, 23 bp, Artificial Sequence
  Synthetic
accctctaugcagaacauggaga

SEQ ID NO: 10442 - DNA, 24 bp, Artificial Sequence
  Synthetic
atgctcacugctttcttctugagt

SEQ ID NO: 10443 - DNA, 20 bp, Artificial Sequence
  Synthetic
ccgtggtgucagagcagaug

SEQ ID NO: 10444 - DNA, 21 bp, Artificial Sequence
  Synthetic
cgtcattcugggcagtctcug

SEQ ID NO: 10445 - DNA, 24 bp, Artificial Sequence
  Synthetic
caauagtccugagaccgaaaccaa

SEQ ID NO: 10446 - DNA, 23 bp, Artificial Sequence
  Synthetic
cccgacucaacttaaatccuggt

SEQ ID NO: 10447 - DNA, 25 bp, Artificial Sequence
  Synthetic
ctctttugcgaaaacgtgatgugaa

SEQ ID NO: 10448 - DNA, 23 bp, Artificial Sequence
  Synthetic
gcctctcggagucagaatctuca

SEQ ID NO: 10449 - DNA, 23 bp, Artificial Sequence
  Synthetic
aacagaaaccauttcuccaccga

SEQ ID NO: 10450 - DNA, 24 bp, Artificial Sequence
  Synthetic
cttctctugggaaggtcaggttuc

SEQ ID NO: 10451 - DNA, 22 bp, Artificial Sequence
  Synthetic
gctctuggaagagacgtctuca

SEQ ID NO: 10452 - DNA, 26 bp, Artificial Sequence
  Synthetic
agagactattcaugcccttacacuga

SEQ ID NO: 10453 - DNA, 20 bp, Artificial Sequence
  Synthetic
ccagaatguttgcgcuggac

SEQ ID NO: 10454 - DNA, 23 bp, Artificial Sequence
  Synthetic
agtgtggaagugatgtctugagg

SEQ ID NO: 10455 - DNA, 26 bp, Artificial Sequence
  Synthetic
ctccagagaaaccgutatctgatcug

SEQ ID NO: 10456 - DNA, 28 bp, Artificial Sequence
  Synthetic
cccttgacaucattctgtgttaguacat

SEQ ID NO: 10457 - DNA, 31 bp, Artificial Sequence
  Synthetic
cctctactgactgutttgttctgtttattuc

SEQ ID NO: 10458 - DNA, 25 bp, Artificial Sequence
  Synthetic
tggatcucaaaacagaaggucaagg

SEQ ID NO: 10459 - DNA, 20 bp, Artificial Sequence
  Synthetic
ctgatccacaaguccgcugt

SEQ ID NO: 10460 - DNA, 23 bp, Artificial Sequence
  Synthetic
ctaaacucttacctgugggccaa

SEQ ID NO: 10461 - DNA, 23 bp, Artificial Sequence
  Synthetic
gctcatugatggcctuaccaaat

SEQ ID NO: 10462 - DNA, 25 bp, Artificial Sequence
  Synthetic
cctattggattaguatagcgccgut

SEQ ID NO: 10463 - DNA, 28 bp, Artificial Sequence
  Synthetic
tgtctgtcacacutctatgtggaattut

SEQ ID NO: 10464 - DNA, 23 bp, Artificial Sequence
  Synthetic
tttttgccutgatcucgacagga

SEQ ID NO: 10465 - DNA, 23 bp, Artificial Sequence
  Synthetic
tgttcuccctcgtatuaggccat

SEQ ID NO: 10466 - DNA, 22 bp, Artificial Sequence
  Synthetic
catccacgutggttgcttuagt

SEQ ID NO: 10467 - DNA, 27 bp, Artificial Sequence
  Synthetic
tttttgaaaggucagaaggatgtguct

SEQ ID NO: 10468 - DNA, 22 bp, Artificial Sequence
  Synthetic
ggaugaagacacagcatugcat

SEQ ID NO: 10469 - DNA, 31 bp, Artificial Sequence
  Synthetic
caggataagggauaacgactctatggataua

SEQ ID NO: 10470 - DNA, 29 bp, Artificial Sequence
  Synthetic
gcctaagaaatuttctacagagguaacca

SEQ ID NO: 10471 - DNA, 21 bp, Artificial Sequence
  Synthetic
gaagaaccugggccaucacaa

SEQ ID NO: 10472 - DNA, 25 bp, Artificial Sequence
  Synthetic
tttgatctgucttgcctttuaccca

SEQ ID NO: 10473 - DNA, 28 bp, Artificial Sequence
  Synthetic
ccgatagtaacacutctaagcagaauga

SEQ ID NO: 10474 - DNA, 24 bp, Artificial Sequence
  Synthetic
gccttgattcccutgaccatctut

SEQ ID NO: 10475 - DNA, 30 bp, Artificial Sequence
  Synthetic
tcataaactauaagcatgaagcuccaacat

SEQ ID NO: 10476 - DNA, 22 bp, Artificial Sequence
  Synthetic
tgccgucgtcctatatuccaac

SEQ ID NO: 10477 - DNA, 26 bp, Artificial Sequence
  Synthetic
ttctaattgaguctggagcugcaaat

SEQ ID NO: 10478 - DNA, 30 bp, Artificial Sequence
  Synthetic
ctttacaagtgtggaugtgtttctgattut

SEQ ID NO: 10479 - DNA, 24 bp, Artificial Sequence
  Synthetic
ctaagagtttaaccugccgcctua

SEQ ID NO: 10480 - DNA, 29 bp, Artificial Sequence
  Synthetic
acagautatccgaagaaucaaagaaagca

SEQ ID NO: 10481 - DNA, 24 bp, Artificial Sequence
  Synthetic
cgccttaattutagcagtgcucaa

SEQ ID NO: 10482 - DNA, 25 bp, Artificial Sequence
  Synthetic
accaagaaggutcggacaaugaaaa

SEQ ID NO: 10483 - DNA, 26 bp, Artificial Sequence
  Synthetic
tgtttaagggautcagaaucaaggca

SEQ ID NO: 10484 - DNA, 27 bp, Artificial Sequence
  Synthetic
gaaaacaaagagucagagagagaugga

SEQ ID NO: 10485 - DNA, 27 bp, Artificial Sequence
  Synthetic
tggtagagugacttctacaguaaaggg

SEQ ID NO: 10486 - DNA, 19 bp, Artificial Sequence
  Synthetic
gggaggcuattcugcccat

SEQ ID NO: 10487 - DNA, 21 bp, Artificial Sequence
  Synthetic
caagtggacutcggtgctuac

SEQ ID NO: 10488 - DNA, 19 bp, Artificial Sequence
  Synthetic
ctcctacgutgcggucaca

SEQ ID NO: 10489 - DNA, 24 bp, Artificial Sequence
  Synthetic
gtttttgatgaagguctcgtcguc

SEQ ID NO: 10490 - DNA, 21 bp, Artificial Sequence
  Synthetic
ggattctcugctctccucgac

SEQ ID NO: 10491 - DNA, 26 bp, Artificial Sequence
  Synthetic
gccaatgaaaaugggaaaggtaucca

SEQ ID NO: 10492 - DNA, 23 bp, Artificial Sequence
  Synthetic
gaucagcaacaaccgaaaaugca

SEQ ID NO: 10493 - DNA, 25 bp, Artificial Sequence
  Synthetic
gggccttttcautgttttccaacuc

SEQ ID NO: 10494 - DNA, 20 bp, Artificial Sequence
  Synthetic
gcccagcccauttgtaacut

SEQ ID NO: 10495 - DNA, 28 bp, Artificial Sequence
  Synthetic
ggcatttccagaaauatcaccattcuga

SEQ ID NO: 10496 - DNA, 21 bp, Artificial Sequence
  Synthetic
ctggtauccacccaaccaugt

SEQ ID NO: 10497 - DNA, 27 bp, Artificial Sequence
  Synthetic
tcaggtatctgguattaagtacctugc

SEQ ID NO: 10498 - DNA, 25 bp, Artificial Sequence
  Synthetic
tgugactcaugaaacacaggaagaa

SEQ ID NO: 10499 - DNA, 29 bp, Artificial Sequence
  Synthetic
aaaatctctacucacacttatgtguaagg

SEQ ID NO: 10500 - DNA, 25 bp, Artificial Sequence
  Synthetic
cttcaggugaggagattttugcaac

SEQ ID NO: 10501 - DNA, 32 bp, Artificial Sequence
  Synthetic
caaagaacaagaacauatcattaaggatuacc

SEQ ID NO: 10502 - DNA, 32 bp, Artificial Sequence
  Synthetic
atggatattatagautaactgcagaugcacat

SEQ ID NO: 10503 - DNA, 32 bp, Artificial Sequence
  Synthetic
tacttttaagtctguattactcacgaaatugg

SEQ ID NO: 10504 - DNA, 32 bp, Artificial Sequence
  Synthetic
gcgagaaaatgtcautgaatataaacactgut

SEQ ID NO: 10505 - DNA, 29 bp, Artificial Sequence
  Synthetic
cagtttccauctggtaacaatucaaaaga

SEQ ID NO: 10506 - DNA, 22 bp, Artificial Sequence
  Synthetic
aggcguacgaagagaaguagga

SEQ ID NO: 10507 - DNA, 26 bp, Artificial Sequence
  Synthetic
tgagtacgutgtatgcataugagagc

SEQ ID NO: 10508 - DNA, 22 bp, Artificial Sequence
  Synthetic
gctccaguacttgtggacugat

SEQ ID NO: 10509 - DNA, 25 bp, Artificial Sequence
  Synthetic
gaggatttccugtcttcctgtctuc

SEQ ID NO: 10510 - DNA, 24 bp, Artificial Sequence
  Synthetic
aaaagaaggtuggtgtggcatuac

SEQ ID NO: 10511 - DNA, 28 bp, Artificial Sequence
  Synthetic
gcctgaaatcuggttcataatccauaca

SEQ ID NO: 10512 - DNA, 26 bp, Artificial Sequence
  Synthetic
tttgtaattugccttgaaaactuggt

SEQ ID NO: 10513 - DNA, 26 bp, Artificial Sequence
  Synthetic
tcttaggtgcucttcagtactaugct

SEQ ID NO: 10514 - DNA, 31 bp, Artificial Sequence
  Synthetic
ccatatggaagtutacgagactatctucaaa

SEQ ID NO: 10515 - DNA, 23 bp, Artificial Sequence
  Synthetic
atgtctactucaacacggtugct

SEQ ID NO: 10516 - DNA, 31 bp, Artificial Sequence
  Synthetic
gtaaaatcaagaguccacatatcaaguaact

SEQ ID NO: 10517 - DNA, 22 bp, Artificial Sequence
  Synthetic
accacuccaaagcuccaaacat

SEQ ID NO: 10518 - DNA, 31 bp, Artificial Sequence
  Synthetic
gacagaatgcuggaacaataatgtaaaucaa

SEQ ID NO: 10519 - DNA, 30 bp, Artificial Sequence
  Synthetic
gtaaatctacttuggtctcagaaugaaggt

SEQ ID NO: 10520 - DNA, 25 bp, Artificial Sequence
  Synthetic
aagtcutgaagtttcuggaaagggt

SEQ ID NO: 10521 - DNA, 26 bp, Artificial Sequence
  Synthetic
ctacttaaagugcttgtcctttucgg

SEQ ID NO: 10522 - DNA, 21 bp, Artificial Sequence
  Synthetic
gtgattaucccagcagggcut

SEQ ID NO: 10523 - DNA, 26 bp, Artificial Sequence
  Synthetic
gatgacaaugaggaggaatcagauga

SEQ ID NO: 10524 - DNA, 23 bp, Artificial Sequence
  Synthetic
tggcgguaacgttgatttctuct

SEQ ID NO: 10525 - DNA, 28 bp, Artificial Sequence
  Synthetic
ggaaaaagagtagcucagaggctttaut

SEQ ID NO: 10526 - DNA, 28 bp, Artificial Sequence
  Synthetic
agaggattcttuggaagatttgttguga

SEQ ID NO: 10527 - DNA, 25 bp, Artificial Sequence
  Synthetic
gcagtaguaccagttttucaaagcc

SEQ ID NO: 10528 - DNA, 21 bp, Artificial Sequence
  Synthetic
ggaggtgautcactgguggat

SEQ ID NO: 10529 - DNA, 30 bp, Artificial Sequence
  Synthetic
gcttttaaaatttcacutatgcctcacuct

SEQ ID NO: 10530 - DNA, 25 bp, Artificial Sequence
  Synthetic
caaagtgctguatgttactgtgcuc

SEQ ID NO: 10531 - DNA, 22 bp, Artificial Sequence
  Synthetic
gttattcacggcugtctcucct

SEQ ID NO: 10532 - DNA, 23 bp, Artificial Sequence
  Synthetic
cagctcaagcucttcaaaacgug

SEQ ID NO: 10533 - DNA, 23 bp, Artificial Sequence
  Synthetic
tcaccctuaggcatcatcctuct

SEQ ID NO: 10534 - DNA, 24 bp, Artificial Sequence
  Synthetic
gtcctgtaaggcuttggtatccug

SEQ ID NO: 10535 - DNA, 21 bp, Artificial Sequence
  Synthetic
aggcugggaagacacttctug

SEQ ID NO: 10536 - DNA, 22 bp, Artificial Sequence
  Synthetic
cttttcuggcatctucccacag

SEQ ID NO: 10537 - DNA, 23 bp, Artificial Sequence
  Synthetic
tgtatgccugaggtgttttugga

SEQ ID NO: 10538 - DNA, 21 bp, Artificial Sequence
  Synthetic
ggtcaggtgguggcagtagua

SEQ ID NO: 10539 - DNA, 29 bp, Artificial Sequence
  Synthetic
gactagtcaagauccaagtauaaggaagt

SEQ ID NO: 10540 - DNA, 21 bp, Artificial Sequence
  Synthetic
tguacaccuggaccaacacag

SEQ ID NO: 10541 - DNA, 22 bp, Artificial Sequence
  Synthetic
cccatcaugacccctgctcuat

SEQ ID NO: 10542 - DNA, 20 bp, Artificial Sequence
  Synthetic
ggucagcacucaaccagagg

SEQ ID NO: 10543 - DNA, 22 bp, Artificial Sequence
  Synthetic
cuctacagtgcuggagacacag

SEQ ID NO: 10544 - DNA, 21 bp, Artificial Sequence
  Synthetic
gagcggatguttctctggcua

SEQ ID NO: 10545 - DNA, 21 bp, Artificial Sequence
  Synthetic
agaactccgguctgactcuga

SEQ ID NO: 10546 - DNA, 20 bp, Artificial Sequence
  Synthetic
aaactctguggacacgcuca

SEQ ID NO: 10547 - DNA, 26 bp, Artificial Sequence
  Synthetic
acctgaaggaguacaatctggtcuaa

SEQ ID NO: 10548 - DNA, 26 bp, Artificial Sequence
  Synthetic
accatcatattcugggaagtagucga

SEQ ID NO: 10549 - DNA, 28 bp, Artificial Sequence
  Synthetic
gcaaggctcuctttagaacaattaucac

SEQ ID NO: 10550 - DNA, 27 bp, Artificial Sequence
  Synthetic
ggactcagtuactacctgaaaaugaca

SEQ ID NO: 10551 - DNA, 23 bp, Artificial Sequence
  Synthetic
tctcattgtgucttccctccuct

SEQ ID NO: 10552 - DNA, 22 bp, Artificial Sequence
  Synthetic
ctccaatgaagagucgcaccua

SEQ ID NO: 10553 - DNA, 23 bp, Artificial Sequence
  Synthetic
tgagaatcauccatgggucagga

SEQ ID NO: 10554 - DNA, 20 bp, Artificial Sequence
  Synthetic
ggtcatcaccugtcctgugg

SEQ ID NO: 10555 - DNA, 25 bp, Artificial Sequence
  Synthetic
agaccttguacagatggaatcguct

SEQ ID NO: 10556 - DNA, 19 bp, Artificial Sequence
  Synthetic
ccccaaacacaugcagugg

SEQ ID NO: 10557 - DNA, 19 bp, Artificial Sequence
  Synthetic
cttcggaggaugggcugag

SEQ ID NO: 10558 - DNA, 27 bp, Artificial Sequence
  Synthetic
aagtgctcttguccaaaatactcucaa

SEQ ID NO: 10559 - DNA, 27 bp, Artificial Sequence
  Synthetic
ggaaatcatagccacuattcaggtgut

SEQ ID NO: 10560 - DNA, 27 bp, Artificial Sequence
  Synthetic
gatccttcucagacaatttctcucact

SEQ ID NO: 10561 - DNA, 26 bp, Artificial Sequence
  Synthetic
gaaaggaagaagauttctcuccccat

SEQ ID NO: 10562 - DNA, 29 bp, Artificial Sequence
  Synthetic
accaaactgauacattttgaaaccugaga

SEQ ID NO: 10563 - DNA, 22 bp, Artificial Sequence
  Synthetic
tcctgttugcagcgtgagtuaa

SEQ ID NO: 10564 - DNA, 25 bp, Artificial Sequence
  Synthetic
aaatctggtagaguccctgaaguca

SEQ ID NO: 10565 - DNA, 23 bp, Artificial Sequence
  Synthetic
gatcaggcutccacttuggaaac

SEQ ID NO: 10566 - DNA, 22 bp, Artificial Sequence
  Synthetic
ctcttgaggaacugcctguaac

SEQ ID NO: 10567 - DNA, 24 bp, Artificial Sequence
  Synthetic
gtccccactucatatgtcgaaguc

SEQ ID NO: 10568 - DNA, 23 bp, Artificial Sequence
  Synthetic
tcaaactcgucgtcaaaauccgt

SEQ ID NO: 10569 - DNA, 20 bp, Artificial Sequence
  Synthetic
ccagucgcagggactcaauc

SEQ ID NO: 10570 - DNA, 24 bp, Artificial Sequence
  Synthetic
cgcctggccutgaatttcttaaua

SEQ ID NO: 10571 - DNA, 21 bp, Artificial Sequence
  Synthetic
gaggattucagcaaccuccca

SEQ ID NO: 10572 - DNA, 20 bp, Artificial Sequence
  Synthetic
cctuttgctgctugggagac

SEQ ID NO: 10573 - DNA, 23 bp, Artificial Sequence
  Synthetic
atttttactcugtcacggcucca

SEQ ID NO: 10574 - DNA, 20 bp, Artificial Sequence
  Synthetic
gattgggaucaccugccgat

SEQ ID NO: 10575 - DNA, 23 bp, Artificial Sequence
  Synthetic
gagguaacaatgcugccgaaaaa

SEQ ID NO: 10576 - DNA, 25 bp, Artificial Sequence
  Synthetic
cgtccattttcucaaagtactgcug

SEQ ID NO: 10577 - DNA, 23 bp, Artificial Sequence
  Synthetic
agaacaatgcuctttgggagcut

SEQ ID NO: 10578 - DNA, 26 bp, Artificial Sequence
  Synthetic
agacatgtatttcucctttccgtgug

SEQ ID NO: 10579 - DNA, 28 bp, Artificial Sequence
  Synthetic
agctgacatguctgcatttttattucag

SEQ ID NO: 10580 - DNA, 22 bp, Artificial Sequence
  Synthetic
cccucaaaagacctuccaagga

SEQ ID NO: 10581 - DNA, 21 bp, Artificial Sequence
  Synthetic
cacaugaagaggcacctcuga

SEQ ID NO: 10582 - DNA, 18 bp, Artificial Sequence
  Synthetic
gtgggcacugacctgugt

SEQ ID NO: 10583 - DNA, 19 bp, Artificial Sequence
  Synthetic
aagggaaauggcgaugcct

SEQ ID NO: 10584 - DNA, 27 bp, Artificial Sequence
  Synthetic
agatatcttcagtucggattcctccut

SEQ ID NO: 10585 - DNA, 23 bp, Artificial Sequence
  Synthetic
gccttctcuggttcatttugcac

SEQ ID NO: 10586 - DNA, 21 bp, Artificial Sequence
  Synthetic
cctcagccacucctacaugga

SEQ ID NO: 10587 - DNA, 18 bp, Artificial Sequence
  Synthetic
aggguacctcugcaccgt

SEQ ID NO: 10588 - DNA, 19 bp, Artificial Sequence
  Synthetic
ccgcaccucttcacctucc

SEQ ID NO: 10589 - DNA, 20 bp, Artificial Sequence
  Synthetic
gacgacuccagcttcaugct

SEQ ID NO: 10590 - DNA, 26 bp, Artificial Sequence
  Synthetic
cuatcacaaaaugaacggacagaacc

SEQ ID NO: 10591 - DNA, 24 bp, Artificial Sequence
  Synthetic
gctatccugtcaatttccugcaga

SEQ ID NO: 10592 - DNA, 18 bp, Artificial Sequence
  Synthetic
catcucgccctucagcca

SEQ ID NO: 10593 - DNA, 18 bp, Artificial Sequence
  Synthetic
ggcccugtgagcaucgag

SEQ ID NO: 10594 - DNA, 26 bp, Artificial Sequence
  Synthetic
acaggtggautaatagggcttugaaa

SEQ ID NO: 10595 - DNA, 25 bp, Artificial Sequence
  Synthetic
gagatucacatttccugcaaaacca

SEQ ID NO: 10596 - DNA, 28 bp, Artificial Sequence
  Synthetic
tttccacaauggaaccaattgtttuaca

SEQ ID NO: 10597 - DNA, 28 bp, Artificial Sequence
  Synthetic
ctggatttgauggagacctgtgatttua

SEQ ID NO: 10598 - DNA, 27 bp, Artificial Sequence
  Synthetic
tcttcttattaatguggcacccatugt

SEQ ID NO: 10599 - DNA, 26 bp, Artificial Sequence
  Synthetic
cagtagtatctuccaagcgctucaat

SEQ ID NO: 10600 - DNA, 22 bp, Artificial Sequence
  Synthetic
caggaacuccaggcagtguaaa

SEQ ID NO: 10601 - DNA, 24 bp, Artificial Sequence
  Synthetic
ctggcttccagacuctcctttaug

SEQ ID NO: 10602 - DNA, 28 bp, Artificial Sequence
  Synthetic
gtttctcatctcucagtttcttctgcut

SEQ ID NO: 10603 - DNA, 25 bp, Artificial Sequence
  Synthetic
cactgaggcuctgtaaacttccaut

SEQ ID NO: 10604 - DNA, 27 bp, Artificial Sequence
  Synthetic
cagtttttcaactugtctgtcatggug

SEQ ID NO: 10605 - DNA, 23 bp, Artificial Sequence
  Synthetic
aaccatgcuggagtttgguacat

SEQ ID NO: 10606 - DNA, 26 bp, Artificial Sequence
  Synthetic
gtgagagtcacuttatcagctcugaa

SEQ ID NO: 10607 - DNA, 29 bp, Artificial Sequence
  Synthetic
ctatactttgcagugtaaatagcgctuac

SEQ ID NO: 10608 - DNA, 27 bp, Artificial Sequence
  Synthetic
gtggtagtttuaggaatgctgaaguca

SEQ ID NO: 10609 - DNA, 26 bp, Artificial Sequence
  Synthetic
gcactgaaagcugtgcattcaauaac

SEQ ID NO: 10610 - DNA, 21 bp, Artificial Sequence
  Synthetic
gctcaacaaggcucaggagug

SEQ ID NO: 10611 - DNA, 26 bp, Artificial Sequence
  Synthetic
cctacaatgccautaattgccagtug

SEQ ID NO: 10612 - DNA, 24 bp, Artificial Sequence
  Synthetic
cagutaatgcaacaucaccaccag

SEQ ID NO: 10613 - DNA, 27 bp, Artificial Sequence
  Synthetic
attatctccauggatggtgagaaaugg

SEQ ID NO: 10614 - DNA, 23 bp, Artificial Sequence
  Synthetic
cctcugaagagagaatcugccat

SEQ ID NO: 10615 - DNA, 24 bp, Artificial Sequence
  Synthetic
cttauaggagguaaggcctttgut

SEQ ID NO: 10616 - DNA, 28 bp, Artificial Sequence
  Synthetic
tgtgaataaugggaggttacugaaagac

SEQ ID NO: 10617 - DNA, 22 bp, Artificial Sequence
  Synthetic
gcacgaacautactcctucgct

SEQ ID NO: 10618 - DNA, 22 bp, Artificial Sequence
  Synthetic
catcgaaugcaagacaugcagt

SEQ ID NO: 10619 - DNA, 28 bp, Artificial Sequence
  Synthetic
aagctttagaaagaaaguagccatacuc

SEQ ID NO: 10620 - DNA, 22 bp, Artificial Sequence
  Synthetic
tcagggaugtggattugccaag

SEQ ID NO: 10621 - DNA, 25 bp, Artificial Sequence
  Synthetic
ctcaaccuacaacaatcgttgctut

SEQ ID NO: 10622 - DNA, 22 bp, Artificial Sequence
  Synthetic
ttcatctggucatgctgcauct

SEQ ID NO: 10623 - DNA, 25 bp, Artificial Sequence
  Synthetic
atcaatgagcccuttggttttctug

SEQ ID NO: 10624 - DNA, 22 bp, Artificial Sequence
  Synthetic
cccagtucacaaaaguccagca

SEQ ID NO: 10625 - DNA, 23 bp, Artificial Sequence
  Synthetic
cgagactguccctgagtggtaua

SEQ ID NO: 10626 - DNA, 26 bp, Artificial Sequence
  Synthetic
gtatgctaattuggtgccatttuggt

SEQ ID NO: 10627 - DNA, 26 bp, Artificial Sequence
  Synthetic
tcttcaguaacgacatccttgttucc

SEQ ID NO: 10628 - DNA, 26 bp, Artificial Sequence
  Synthetic
acagattaccaaagcuttacctgugt

SEQ ID NO: 10629 - DNA, 26 bp, Artificial Sequence
  Synthetic
cgcttaccucaaatactgaaagguct

SEQ ID NO: 10630 - DNA, 28 bp, Artificial Sequence
  Synthetic
ctctgacatactugatctgtttctccut

SEQ ID NO: 10631 - DNA, 30 bp, Artificial Sequence
  Synthetic
agcttcctggaucatgaaagtaaauaaagt

SEQ ID NO: 10632 - DNA, 31 bp, Artificial Sequence
  Synthetic
attacatcttgttcugccttatcacatuaca

SEQ ID NO: 10633 - DNA, 28 bp, Artificial Sequence
  Synthetic
tcttcagacacugcagcattagaaatua

SEQ ID NO: 10634 - DNA, 17 bp, Artificial Sequence
  Synthetic
gcagcugctggagcugt

SEQ ID NO: 10635 - DNA, 28 bp, Artificial Sequence
  Synthetic
gggagagcttugaatattttcttctuct

SEQ ID NO: 10636 - DNA, 23 bp, Artificial Sequence
  Synthetic
tccugagaaaagcatuccagcat

SEQ ID NO: 10637 - DNA, 22 bp, Artificial Sequence
  Synthetic
ctcttuggcacccagtcagaua

SEQ ID NO: 10638 - DNA, 23 bp, Artificial Sequence
  Synthetic
gatugaggaggaggucaaggaaa

SEQ ID NO: 10639 - DNA, 26 bp, Artificial Sequence
  Synthetic
caggtttgaugagatcatcttcuggt

SEQ ID NO: 10640 - DNA, 20 bp, Artificial Sequence
  Synthetic
accatgaugccgaugacgag

SEQ ID NO: 10641 - DNA, 25 bp, Artificial Sequence
  Synthetic
caggctgcacautaaggtcuaaaaa

SEQ ID NO: 10642 - DNA, 21 bp, Artificial Sequence
  Synthetic
ccgagacucaagaggcctgua

SEQ ID NO: 10643 - DNA, 21 bp, Artificial Sequence
  Synthetic
ttgacagaacguacggacugg

SEQ ID NO: 10644 - DNA, 21 bp, Artificial Sequence
  Synthetic
cagcugctcctauagcaacct

SEQ ID NO: 10645 - DNA, 22 bp, Artificial Sequence
  Synthetic
cacagcctugaggagactugac

SEQ ID NO: 10646 - DNA, 25 bp, Artificial Sequence
  Synthetic
ccattaaguaacacagggcttgtuc

SEQ ID NO: 10647 - DNA, 23 bp, Artificial Sequence
  Synthetic
gatgccaauatttgaugcagcca

SEQ ID NO: 10648 - DNA, 21 bp, Artificial Sequence
  Synthetic
acagtggcuaccacagcaauc

SEQ ID NO: 10649 - DNA, 22 bp, Artificial Sequence
  Synthetic
tgttcatguagccgtgatgucc

SEQ ID NO: 10650 - DNA, 24 bp, Artificial Sequence
  Synthetic
gaagctcttucacttcggaggaut

SEQ ID NO: 10651 - DNA, 19 bp, Artificial Sequence
  Synthetic
ccgccccacuttgcctauc

SEQ ID NO: 10652 - DNA, 26 bp, Artificial Sequence
  Synthetic
gaguacacagauaaagcccattttuc

SEQ ID NO: 10653 - DNA, 21 bp, Artificial Sequence
  Synthetic
accacaguaggccccaattuc

SEQ ID NO: 10654 - DNA, 26 bp, Artificial Sequence
  Synthetic
tgtgaagaaaaaccaaucactctuga

SEQ ID NO: 10655 - DNA, 27 bp, Artificial Sequence
  Synthetic
guggaatugguaaaagaagaagacaaa

SEQ ID NO: 10656 - DNA, 27 bp, Artificial Sequence
  Synthetic
agatcaagaaugacaatguccaagaca

SEQ ID NO: 10657 - DNA, 26 bp, Artificial Sequence
  Synthetic
ctgcaagaguacaaagattggcttut

SEQ ID NO: 10658 - DNA, 27 bp, Artificial Sequence
  Synthetic
catacauccagcacctatatacugcat

SEQ ID NO: 10659 - DNA, 21 bp, Artificial Sequence
  Synthetic
ccaccatguaacccctcucac

SEQ ID NO: 10660 - DNA, 28 bp, Artificial Sequence
  Synthetic
cagacacagucattcatgtttuaacact

SEQ ID NO: 10661 - DNA, 25 bp, Artificial Sequence
  Synthetic
tcaccuagttacccugacacaagaa

SEQ ID NO: 10662 - DNA, 24 bp, Artificial Sequence
  Synthetic
agaggtatuactggtguggcaagt

SEQ ID NO: 10663 - DNA, 25 bp, Artificial Sequence
  Synthetic
ggattcccguggaggaacttttuaa

SEQ ID NO: 10664 - DNA, 23 bp, Artificial Sequence
  Synthetic
ctcaacatugacggcctttctuc

SEQ ID NO: 10665 - DNA, 31 bp, Artificial Sequence
  Synthetic
ggtaacagaaaacaaugtgatgaaaauagca

SEQ ID NO: 10666 - DNA, 23 bp, Artificial Sequence
  Synthetic
ggcgaatgcaguttttcctccua

SEQ ID NO: 10667 - DNA, 29 bp, Artificial Sequence
  Synthetic
actgatttgtgaauatgcctactgtucat

SEQ ID NO: 10668 - DNA, 21 bp, Artificial Sequence
  Synthetic
ggtguctgccgtugaagagag

SEQ ID NO: 10669 - DNA, 24 bp, Artificial Sequence
  Synthetic
ccttctcagauggagccaggatua

SEQ ID NO: 10670 - DNA, 27 bp, Artificial Sequence
  Synthetic
tgcagagugaaaggatatcccaauaga

SEQ ID NO: 10671 - DNA, 23 bp, Artificial Sequence
  Synthetic
cctgtgtcguctagccttttcut

SEQ ID NO: 10672 - DNA, 22 bp, Artificial Sequence
  Synthetic
gctgggcaucactgtaaaccut

SEQ ID NO: 10673 - DNA, 28 bp, Artificial Sequence
  Synthetic
gcttatttattgguctctcattcuccca

SEQ ID NO: 10674 - DNA, 20 bp, Artificial Sequence
  Synthetic
gcatggtuggcattgggtuc

SEQ ID NO: 10675 - DNA, 23 bp, Artificial Sequence
  Synthetic
gggaagctguccatcagtauaca

SEQ ID NO: 10676 - DNA, 21 bp, Artificial Sequence
  Synthetic
gcaccccauccttaguccaac

SEQ ID NO: 10677 - DNA, 23 bp, Artificial Sequence
  Synthetic
ccatctgtcuccgtcttctcuct

SEQ ID NO: 10678 - DNA, 17 bp, Artificial Sequence
  Synthetic
cctgcauccggcaccuc

SEQ ID NO: 10679 - DNA, 19 bp, Artificial Sequence
  Synthetic
gctgcaagugtgtgctcuc

SEQ ID NO: 10680 - DNA, 19 bp, Artificial Sequence
  Synthetic
ggccgagguctcgatguag

SEQ ID NO: 10681 - DNA, 20 bp, Artificial Sequence
  Synthetic
ctctcgctutccacctcuca

SEQ ID NO: 10682 - DNA, 21 bp, Artificial Sequence
  Synthetic
gccaggcucacctctatagug

SEQ ID NO: 10683 - DNA, 17 bp, Artificial Sequence
  Synthetic
ccccugaggagcgauga

SEQ ID NO: 10684 - DNA, 17 bp, Artificial Sequence
  Synthetic
ggccaguccagcacuga

SEQ ID NO: 10685 - DNA, 17 bp, Artificial Sequence
  Synthetic
gtcctcugcgccctucc

SEQ ID NO: 10686 - DNA, 20 bp, Artificial Sequence
  Synthetic
ctccttguccagcaccauca

SEQ ID NO: 10687 - DNA, 20 bp, Artificial Sequence
  Synthetic
cgggtaatuagagcccgcua

SEQ ID NO: 10688 - DNA, 22 bp, Artificial Sequence
  Synthetic
gactcagtuccaacccaaaugc

SEQ ID NO: 10689 - DNA, 23 bp, Artificial Sequence
  Synthetic
ggaagtcttugctgccttttguc

SEQ ID NO: 10690 - DNA, 23 bp, Artificial Sequence
  Synthetic
catcagagagucctccuggagat

SEQ ID NO: 10691 - DNA, 20 bp, Artificial Sequence
  Synthetic
ctggugcagcaactcttucc

SEQ ID NO: 10692 - DNA, 22 bp, Artificial Sequence
  Synthetic
gacgtagguagtgctugagacc

SEQ ID NO: 10693 - DNA, 21 bp, Artificial Sequence
  Synthetic
agcatugcagagaggcgtauc

SEQ ID NO: 10694 - DNA, 22 bp, Artificial Sequence
  Synthetic
acacuttgtcttucacccgcat

SEQ ID NO: 10695 - DNA, 21 bp, Artificial Sequence
  Synthetic
gagccctgucttccaggatug

SEQ ID NO: 10696 - DNA, 21 bp, Artificial Sequence
  Synthetic
gtccgaaguccccagtagtuc

SEQ ID NO: 10697 - DNA, 20 bp, Artificial Sequence
  Synthetic
gtggccaccaagaucaacuc

SEQ ID NO: 10698 - DNA, 19 bp, Artificial Sequence
  Synthetic
gctcctcuggcttggacuc

SEQ ID NO: 10699 - DNA, 20 bp, Artificial Sequence
  Synthetic
ggcaacctugctctcaccut

SEQ ID NO: 10700 - DNA, 19 bp, Artificial Sequence
  Synthetic
cctcctucagcaggtuggg

SEQ ID NO: 10701 - DNA, 21 bp, Artificial Sequence
  Synthetic
cgatggugagacccctucaga

SEQ ID NO: 10702 - DNA, 18 bp, Artificial Sequence
  Synthetic
cagcugcagaagcuccag

SEQ ID NO: 10703 - DNA, 23 bp, Artificial Sequence
  Synthetic
ggtgggccaucatgagacauaat

SEQ ID NO: 10704 - DNA, 24 bp, Artificial Sequence
  Synthetic
gctgaggctgutccatatgacauc

SEQ ID NO: 10705 - DNA, 21 bp, Artificial Sequence
  Synthetic
gtggccgaccugtctatcauc

SEQ ID NO: 10706 - DNA, 32 bp, Artificial Sequence
  Synthetic
cttatttaccucacttgattcaaaaucaaccc

SEQ ID NO: 10707 - DNA, 26 bp, Artificial Sequence
  Synthetic
aggcacactugatgaattatgtagut

SEQ ID NO: 10708 - DNA, 21 bp, Artificial Sequence
  Synthetic
tgtgaatgugcacaggacuga

SEQ ID NO: 10709 - DNA, 25 bp, Artificial Sequence
  Synthetic
cagaacagauggctaatgactcuga

SEQ ID NO: 10710 - DNA, 24 bp, Artificial Sequence
  Synthetic
ctcaatggcauctttctcctccut

SEQ ID NO: 10711 - DNA, 30 bp, Artificial Sequence
  Synthetic
aggaataaaaactauttctgcatccaguga

SEQ ID NO: 10712 - DNA, 29 bp, Artificial Sequence
  Synthetic
gataatgtctuttggattagcuacccgat

SEQ ID NO: 10713 - DNA, 27 bp, Artificial Sequence
  Synthetic
gcaaattgttgttucctagcgttcaua

SEQ ID NO: 10714 - DNA, 32 bp, Artificial Sequence
  Synthetic
gttaaaaatgtcuggatgattagcuagaacaa

SEQ ID NO: 10715 - DNA, 23 bp, Artificial Sequence
  Synthetic
cactgtgacucggtgttcattuc

SEQ ID NO: 10716 - DNA, 26 bp, Artificial Sequence
  Synthetic
ccttgaaagautaagggcattucact

SEQ ID NO: 10717 - DNA, 28 bp, Artificial Sequence
  Synthetic
aaguaacaatgtugagaccaaaggaaga

SEQ ID NO: 10718 - DNA, 27 bp, Artificial Sequence
  Synthetic
acagacaaacuaaactgatcattucca

SEQ ID NO: 10719 - DNA, 27 bp, Artificial Sequence
  Synthetic
caagatggcaaccucaacatttcaaut

SEQ ID NO: 10720 - DNA, 30 bp, Artificial Sequence
  Synthetic
aaaataacttgtuaaccaagggaatauggt

SEQ ID NO: 10721 - DNA, 28 bp, Artificial Sequence
  Synthetic
gagaaagatgcagucagaggaaatgaua

SEQ ID NO: 10722 - DNA, 30 bp, Artificial Sequence
  Synthetic
ttgtcttcccttucttctttaggaattgut

SEQ ID NO: 10723 - DNA, 21 bp, Artificial Sequence
  Synthetic
gccctgcccuaaacagtgaug

SEQ ID NO: 10724 - DNA, 23 bp, Artificial Sequence
  Synthetic
gcccatttagugtttggctcaut

SEQ ID NO: 10725 - DNA, 22 bp, Artificial Sequence
  Synthetic
acaggtacaccugcagcctaua

SEQ ID NO: 10726 - DNA, 27 bp, Artificial Sequence
  Synthetic
attgattcattccugaagtgacacugt

SEQ ID NO: 10727 - DNA, 27 bp, Artificial Sequence
  Synthetic
ccagttucaacacacaccatttuaact

SEQ ID NO: 10728 - DNA, 26 bp, Artificial Sequence
  Synthetic
ctttcccaucaattgctgatucaaca

SEQ ID NO: 10729 - DNA, 23 bp, Artificial Sequence
  Synthetic
agtagcttttccutcccccttuc

SEQ ID NO: 10730 - DNA, 28 bp, Artificial Sequence
  Synthetic
ggttcgcttgauctgagttaaaaugaaa

SEQ ID NO: 10731 - DNA, 24 bp, Artificial Sequence
  Synthetic
ctagaugtcctcaugcagcaaaag

SEQ ID NO: 10732 - DNA, 20 bp, Artificial Sequence
  Synthetic
gggcatgcugctgacgatua

SEQ ID NO: 10733 - DNA, 22 bp, Artificial Sequence
  Synthetic
ctctccactucgtctccaaucc

SEQ ID NO: 10734 - DNA, 23 bp, Artificial Sequence
  Synthetic
gctcaggauccatcagttgtuct

SEQ ID NO: 10735 - DNA, 25 bp, Artificial Sequence
  Synthetic
gcctgttuaacatgggctuaaagga

SEQ ID NO: 10736 - DNA, 22 bp, Artificial Sequence
  Synthetic
ccaugagaaagucaggtgctua

SEQ ID NO: 10737 - DNA, 21 bp, Artificial Sequence
  Synthetic
gcagcaccugctgaacaguag

SEQ ID NO: 10738 - DNA, 18 bp, Artificial Sequence
  Synthetic
gacugagcccccuccaag

SEQ ID NO: 10739 - DNA, 25 bp, Artificial Sequence
  Synthetic
tcaaaaacagacutgcctgcaauag

SEQ ID NO: 10740 - DNA, 22 bp, Artificial Sequence
  Synthetic
tcagtacaaaauggccagugct

SEQ ID NO: 10741 - DNA, 22 bp, Artificial Sequence
  Synthetic
tcagagccacutctaggtcucc

SEQ ID NO: 10742 - DNA, 28 bp, Artificial Sequence
  Synthetic
cgttucagcaagucacaaagatuaaaaa

SEQ ID NO: 10743 - DNA, 27 bp, Artificial Sequence
  Synthetic
gggtctttaucctttctgttgauggag

SEQ ID NO: 10744 - DNA, 28 bp, Artificial Sequence
  Synthetic
gacacaggtcaaaaauattcgacagtuc

SEQ ID NO: 10745 - DNA, 25 bp, Artificial Sequence
  Synthetic
ggcactgaatcuactattcggtgua

SEQ ID NO: 10746 - DNA, 28 bp, Artificial Sequence
  Synthetic
agaagutttggatcuagaacgacgaaaa

SEQ ID NO: 10747 - DNA, 22 bp, Artificial Sequence
  Synthetic
ggattgtuggaggcauaagcca

SEQ ID NO: 10748 - DNA, 28 bp, Artificial Sequence
  Synthetic
actccattcuggaacaaggtttgataug

SEQ ID NO: 10749 - DNA, 23 bp, Artificial Sequence
  Synthetic
tccugaagaagatgtuccagcag

SEQ ID NO: 10750 - DNA, 19 bp, Artificial Sequence
  Synthetic
agacuagtgcuccggcaga

SEQ ID NO: 10751 - DNA, 20 bp, Artificial Sequence
  Synthetic
ctccacgcucttgucagcat

SEQ ID NO: 10752 - DNA, 31 bp, Artificial Sequence
  Synthetic
gatacaacagctgucaaaaccaaaatactua

SEQ ID NO: 10753 - DNA, 23 bp, Artificial Sequence
  Synthetic
gagcctauggaggaagtggaaug

SEQ ID NO: 10754 - DNA, 26 bp, Artificial Sequence
  Synthetic
gautaaacatgtcugcagaagagcag

SEQ ID NO: 10755 - DNA, 23 bp, Artificial Sequence
  Synthetic
ccgactccaagautgaccttcut

SEQ ID NO: 10756 - DNA, 27 bp, Artificial Sequence
  Synthetic
gaatacagatucactgattgtugcaga

SEQ ID NO: 10757 - DNA, 28 bp, Artificial Sequence
  Synthetic
aggcatccattguagattctgacattut

SEQ ID NO: 10758 - DNA, 26 bp, Artificial Sequence
  Synthetic
gaggaaaagagugaagaagggaaugt

SEQ ID NO: 10759 - DNA, 27 bp, Artificial Sequence
  Synthetic
gagtggtttugggaacttcttttctug

SEQ ID NO: 10760 - DNA, 26 bp, Artificial Sequence
  Synthetic
ctctccaauggcaatagttcuaagca

SEQ ID NO: 10761 - DNA, 24 bp, Artificial Sequence
  Synthetic
tggtgctgauttcctcttucaaca

SEQ ID NO: 10762 - DNA, 28 bp, Artificial Sequence
  Synthetic
gggtactaagtaauaggtgttgggugaa

SEQ ID NO: 10763 - DNA, 21 bp, Artificial Sequence
  Synthetic
gtagtttggucccaggcacuc

SEQ ID NO: 10764 - DNA, 25 bp, Artificial Sequence
  Synthetic
gatgatgcaaugtggaaagtgugat

SEQ ID NO: 10765 - DNA, 31 bp, Artificial Sequence
  Synthetic
aagtgctctagaggcuaataaatgtaguagt

SEQ ID NO: 10766 - DNA, 24 bp, Artificial Sequence
  Synthetic
ggacctgauccaccagttctuact

SEQ ID NO: 10767 - DNA, 24 bp, Artificial Sequence
  Synthetic
agguccaaagaagctttatuggca

SEQ ID NO: 10768 - DNA, 28 bp, Artificial Sequence
  Synthetic
tgttttcttttagcaaauggaacgtgut

SEQ ID NO: 10769 - DNA, 26 bp, Artificial Sequence
  Synthetic
tgagaactcucagatttcuagccgat

SEQ ID NO: 10770 - DNA, 25 bp, Artificial Sequence
  Synthetic
ggatctcaagguattgatgggaguc

SEQ ID NO: 10771 - DNA, 23 bp, Artificial Sequence
  Synthetic
ggccctgtgutgcaaagtactua

SEQ ID NO: 10772 - DNA, 20 bp, Artificial Sequence
  Synthetic
tgtcucacatccugcaccag

SEQ ID NO: 10773 - DNA, 23 bp, Artificial Sequence
  Synthetic
ctaaagctctcucacttcgccut

SEQ ID NO: 10774 - DNA, 23 bp, Artificial Sequence
  Synthetic
ggccagggaaccuaggauaaaga

SEQ ID NO: 10775 - DNA, 22 bp, Artificial Sequence
  Synthetic
ggcactccacuatcttgcaugt

SEQ ID NO: 10776 - DNA, 21 bp, Artificial Sequence
  Synthetic
ctcaaagguccccaggatucg

SEQ ID NO: 10777 - DNA, 26 bp, Artificial Sequence
  Synthetic
aagtcaccaagauaaagttgccugaa

SEQ ID NO: 10778 - DNA, 26 bp, Artificial Sequence
  Synthetic
tcaagtgccaaaguagttgatcaugt

SEQ ID NO: 10779 - DNA, 24 bp, Artificial Sequence
  Synthetic
gcactggacugcttcatttcugaa

SEQ ID NO: 10780 - DNA, 25 bp, Artificial Sequence
  Synthetic
atcgagaucaacacacagautcuac

SEQ ID NO: 10781 - DNA, 26 bp, Artificial Sequence
  Synthetic
tctcctatcuctggaactagauccca

SEQ ID NO: 10782 - DNA, 29 bp, Artificial Sequence
  Synthetic
tgacacctcuaaaaatggaaaaugagagt

SEQ ID NO: 10783 - DNA, 21 bp, Artificial Sequence
  Synthetic
cactggaccauctcctggaut

SEQ ID NO: 10784 - DNA, 22 bp, Artificial Sequence
  Synthetic
agagaucagcugaaggacaggt

SEQ ID NO: 10785 - DNA, 27 bp, Artificial Sequence
  Synthetic
gaaataaattatgggaugccagtcgut

SEQ ID NO: 10786 - DNA, 25 bp, Artificial Sequence
  Synthetic
atggataacugccattctguaagca

SEQ ID NO: 10787 - DNA, 28 bp, Artificial Sequence
  Synthetic
ctgaatctgattucaggagctcagtaut

SEQ ID NO: 10788 - DNA, 25 bp, Artificial Sequence
  Synthetic
cagtttgagtugcctctagagcuac

SEQ ID NO: 10789 - DNA, 23 bp, Artificial Sequence
  Synthetic
tcacttucagaggaggcuacaga

SEQ ID NO: 10790 - DNA, 24 bp, Artificial Sequence
  Synthetic
ccagccacugagaaactcatagut

SEQ ID NO: 10791 - DNA, 28 bp, Artificial Sequence
  Synthetic
cccaatactgaaguatttgtctccauca

SEQ ID NO: 10792 - DNA, 22 bp, Artificial Sequence
  Synthetic
ctcagtaccacaguagccacuc

SEQ ID NO: 10793 - DNA, 25 bp, Artificial Sequence
  Synthetic
gggagggtgugaagttaatcaaugt

SEQ ID NO: 10794 - DNA, 19 bp, Artificial Sequence
  Synthetic
gtuccaggacacgucacct

SEQ ID NO: 10795 - DNA, 22 bp, Artificial Sequence
  Synthetic
gtgatguccccagttguggaaa

SEQ ID NO: 10796 - DNA, 23 bp, Artificial Sequence
  Synthetic
ccatcctcuccatcttcuggaca

SEQ ID NO: 10797 - DNA, 24 bp, Artificial Sequence
  Synthetic
tctggaaugtgtgctucagaagaa

SEQ ID NO: 10798 - DNA, 23 bp, Artificial Sequence
  Synthetic
gagcauttgttacugcaaccact

SEQ ID NO: 10799 - DNA, 24 bp, Artificial Sequence
  Synthetic
agtaatgcttuccttccgctttug

SEQ ID NO: 10800 - DNA, 20 bp, Artificial Sequence
  Synthetic
gugccaagcactgucgaaat

SEQ ID NO: 10801 - DNA, 27 bp, Artificial Sequence
  Synthetic
gtcaugagataagaaaaucgagaccca

SEQ ID NO: 10802 - DNA, 23 bp, Artificial Sequence
  Synthetic
caactagcauggatctgccaaug

SEQ ID NO: 10803 - DNA, 21 bp, Artificial Sequence
  Synthetic
aaggtcacuccagcattuggt

SEQ ID NO: 10804 - DNA, 21 bp, Artificial Sequence
  Synthetic
cacgctucatcaatcacucgt

SEQ ID NO: 10805 - DNA, 28 bp, Artificial Sequence
  Synthetic
cttatagtcguaagtgagttcctcucct

SEQ ID NO: 10806 - DNA, 21 bp, Artificial Sequence
  Synthetic
ctctttgacucagcguacgga

SEQ ID NO: 10807 - DNA, 20 bp, Artificial Sequence
  Synthetic
gtggtcauactcccgctuga

SEQ ID NO: 10808 - DNA, 21 bp, Artificial Sequence
  Synthetic
ccttccugcagtccttgcuaa

SEQ ID NO: 10809 - DNA, 23 bp, Artificial Sequence
  Synthetic
gccauccatgttcuggaaaaagg

SEQ ID NO: 10810 - DNA, 21 bp, Artificial Sequence
  Synthetic
ctgggtccuactcactgcaut

SEQ ID NO: 10811 - DNA, 28 bp, Artificial Sequence
  Synthetic
ggaagcaaaggagagautacatatccug

SEQ ID NO: 10812 - DNA, 28 bp, Artificial Sequence
  Synthetic
gggccctccgutattactatgauaaaaa

SEQ ID NO: 10813 - DNA, 26 bp, Artificial Sequence
  Synthetic
atgtaggagatgucagaagggtacut

SEQ ID NO: 10814 - DNA, 21 bp, Artificial Sequence
  Synthetic
gggacuttctcugaaggccat

SEQ ID NO: 10815 - DNA, 28 bp, Artificial Sequence
  Synthetic
caatggaggatcutaaagagaccagtua

SEQ ID NO: 10816 - DNA, 29 bp, Artificial Sequence
  Synthetic
cagtcacauaggccacttttaaaacuaat

SEQ ID NO: 10817 - DNA, 24 bp, Artificial Sequence
  Synthetic
ccagagtgauctattgacctgugt

SEQ ID NO: 10818 - DNA, 28 bp, Artificial Sequence
  Synthetic
ctttaactcctuggacttctgtttucct

SEQ ID NO: 10819 - DNA, 25 bp, Artificial Sequence
  Synthetic
ttttgaaggaugacagcauggaaga

SEQ ID NO: 10820 - DNA, 24 bp, Artificial Sequence
  Synthetic
cactcgaaauggagtcacagtcut

SEQ ID NO: 10821 - DNA, 23 bp, Artificial Sequence
  Synthetic
gtggacagcaccutcattttgug

SEQ ID NO: 10822 - DNA, 28 bp, Artificial Sequence
  Synthetic
catatgtctcucgaatgtcttcaucaga

SEQ ID NO: 10823 - DNA, 23 bp, Artificial Sequence
  Synthetic
gcatgtctugctgttcatctugg

SEQ ID NO: 10824 - DNA, 21 bp, Artificial Sequence
  Synthetic
gcttgccagcuggatccttut

SEQ ID NO: 10825 - DNA, 22 bp, Artificial Sequence
  Synthetic
gatgacaatgguggaccgcaua

SEQ ID NO: 10826 - DNA, 29 bp, Artificial Sequence
  Synthetic
aaattatcagctgcutatgagagtgtuga

SEQ ID NO: 10827 - DNA, 22 bp, Artificial Sequence
  Synthetic
ccctattccugtgcgtctugaa

SEQ ID NO: 10828 - DNA, 27 bp, Artificial Sequence
  Synthetic
gcttttaagttccutcttcccactcua

SEQ ID NO: 10829 - DNA, 23 bp, Artificial Sequence
  Synthetic
ccttacaguctctgaacgauggg

SEQ ID NO: 10830 - DNA, 24 bp, Artificial Sequence
  Synthetic
cacgttcaugaaactctuccacat

SEQ ID NO: 10831 - DNA, 27 bp, Artificial Sequence
  Synthetic
agagtctagaatugatagtttgcctug

SEQ ID NO: 10832 - DNA, 26 bp, Artificial Sequence
  Synthetic
tgggtatttccuatcctcagcatcut

SEQ ID NO: 10833 - DNA, 21 bp, Artificial Sequence
  Synthetic
gggactcacutgagtgaggut

SEQ ID NO: 10834 - DNA, 23 bp, Artificial Sequence
  Synthetic
catacaagccgcucaggatuaca

SEQ ID NO: 10835 - DNA, 21 bp, Artificial Sequence
  Synthetic
tcagggtgucctgatgucaga

SEQ ID NO: 10836 - DNA, 22 bp, Artificial Sequence
  Synthetic
agaacagacccagucagcagua

SEQ ID NO: 10837 - DNA, 23 bp, Artificial Sequence
  Synthetic
tgtatcccugttcccaattugca

SEQ ID NO: 10838 - DNA, 24 bp, Artificial Sequence
  Synthetic
cucaatgugccagcaaaaagaaga

SEQ ID NO: 10839 - DNA, 26 bp, Artificial Sequence
  Synthetic
aggaatatgcacuttctggtuggaat

SEQ ID NO: 10840 - DNA, 23 bp, Artificial Sequence
  Synthetic
gccgccaaaautccttttcuact

SEQ ID NO: 10841 - DNA, 26 bp, Artificial Sequence
  Synthetic
atctcatcatggguttgtgtttacut

SEQ ID NO: 10842 - DNA, 22 bp, Artificial Sequence
  Synthetic
cctttgggcacaucaggtagug

SEQ ID NO: 10843 - DNA, 31 bp, Artificial Sequence
  Synthetic
caggttgatctcuatgtttgtatgttttgug

SEQ ID NO: 10844 - DNA, 24 bp, Artificial Sequence
  Synthetic
cagccccaaaaauctgaagttuct

SEQ ID NO: 10845 - DNA, 28 bp, Artificial Sequence
  Synthetic
gttgaagaggatuctgaaactttcctug

SEQ ID NO: 10846 - DNA, 24 bp, Artificial Sequence
  Synthetic
gactucaaaagagacccagtucct

SEQ ID NO: 10847 - DNA, 27 bp, Artificial Sequence
  Synthetic
agtcaagatgcutgaatttgcctttut

SEQ ID NO: 10848 - DNA, 19 bp, Artificial Sequence
  Synthetic
agtguacggacucccccat

SEQ ID NO: 10849 - DNA, 20 bp, Artificial Sequence
  Synthetic
gtcttugagccgagtuggga

SEQ ID NO: 10850 - DNA, 32 bp, Artificial Sequence
  Synthetic
attaccacttguactagtatgcctuaagaaaa

SEQ ID NO: 10851 - DNA, 32 bp, Artificial Sequence
  Synthetic
tgatgccttctauacattagttcgagaaatuc

SEQ ID NO: 10852 - DNA, 33 bp, Artificial Sequence
  Synthetic
tgacauaacagttatgatttugcagaaaacaga

SEQ ID NO: 10853 - DNA, 28 bp, Artificial Sequence
  Synthetic
caaaacaggcucaggactuagcaagaag

SEQ ID NO: 10854 - DNA, 32 bp, Artificial Sequence
  Synthetic
aaacccacctauaatggtgaatatctucaaat

SEQ ID NO: 10855 - DNA, 27 bp, Artificial Sequence
  Synthetic
tggagaaaccugtctcttggatatuct

SEQ ID NO: 10856 - DNA, 19 bp, Artificial Sequence
  Synthetic
gcgaggugtctcccuagct

SEQ ID NO: 10857 - DNA, 20 bp, Artificial Sequence
  Synthetic
gcgctgtccucatagacgua

SEQ ID NO: 10858 - DNA, 17 bp, Artificial Sequence
  Synthetic
ggctacggcuaccccut

SEQ ID NO: 10859 - DNA, 21 bp, Artificial Sequence
  Synthetic
ggguagaaggcgaactcctug

SEQ ID NO: 10860 - DNA, 22 bp, Artificial Sequence
  Synthetic
ctagagaaggaauacgcggcua

SEQ ID NO: 10861 - DNA, 24 bp, Artificial Sequence
  Synthetic
ctgaccaccutcttctcttugacc

SEQ ID NO: 10862 - DNA, 26 bp, Artificial Sequence
  Synthetic
caggagaggagaaugaugtttaacuc

SEQ ID NO: 10863 - DNA, 23 bp, Artificial Sequence
  Synthetic
gagaacucgggcatgtaguaagt

SEQ ID NO: 10864 - DNA, 24 bp, Artificial Sequence
  Synthetic
ctcaugaaaaacgaaggctccuac

SEQ ID NO: 10865 - DNA, 21 bp, Artificial Sequence
  Synthetic
gttgucgaagaaacggucgaa

SEQ ID NO: 10866 - DNA, 27 bp, Artificial Sequence
  Synthetic
agcgagagttttucttcaacgtgtaua

SEQ ID NO: 10867 - DNA, 24 bp, Artificial Sequence
  Synthetic
agcagaggatutcccgagaaauac

SEQ ID NO: 10868 - DNA, 27 bp, Artificial Sequence
  Synthetic
atttcttucagacattctugccacaac

SEQ ID NO: 10869 - DNA, 27 bp, Artificial Sequence
  Synthetic
gttaggagagcutgacttgagaaauct

SEQ ID NO: 10870 - DNA, 24 bp, Artificial Sequence
  Synthetic
tgtuccaggaggaaacugaagaga

SEQ ID NO: 10871 - DNA, 23 bp, Artificial Sequence
  Synthetic
accccagaugaaaguggaaagac

SEQ ID NO: 10872 - DNA, 28 bp, Artificial Sequence
  Synthetic
caataccaacaugtctgtacctacugat

SEQ ID NO: 10873 - DNA, 23 bp, Artificial Sequence
  Synthetic
acagagccaugctacaatugagg

SEQ ID NO: 10874 - DNA, 31 bp, Artificial Sequence
  Synthetic
tctggttagauccagcttaatacaaatttut

SEQ ID NO: 10875 - DNA, 28 bp, Artificial Sequence
  Synthetic
tccatgatgcucaaaattaactuaccct

SEQ ID NO: 10876 - DNA, 24 bp, Artificial Sequence
  Synthetic
ttguacaagagctucaggaagaga

SEQ ID NO: 10877 - DNA, 26 bp, Artificial Sequence
  Synthetic
aatatcaaaaagcugtgtgaaugcgt

SEQ ID NO: 10878 - DNA, 25 bp, Artificial Sequence
  Synthetic
gtgattggtuggatcaggatucagt

SEQ ID NO: 10879 - DNA, 29 bp, Artificial Sequence
  Synthetic
actacctcatcaucttcatctgagagtuc

SEQ ID NO: 10880 - DNA, 25 bp, Artificial Sequence
  Synthetic
tctcugagaaagccaaacuggaaaa

SEQ ID NO: 10881 - DNA, 29 bp, Artificial Sequence
  Synthetic
ctttcttgtgatugtgaagcttgtguaat

SEQ ID NO: 10882 - DNA, 21 bp, Artificial Sequence
  Synthetic
ggaataagcccugcccaguat

SEQ ID NO: 10883 - DNA, 31 bp, Artificial Sequence
  Synthetic
tgaggcattttcucactttgatatatgugaa

SEQ ID NO: 10884 - DNA, 20 bp, Artificial Sequence
  Synthetic
cctaccucctggcuggagaa

SEQ ID NO: 10885 - DNA, 21 bp, Artificial Sequence
  Synthetic
gaagtctuccccatcgtcguc

SEQ ID NO: 10886 - DNA, 19 bp, Artificial Sequence
  Synthetic
ctcaaccagucccaccugt

SEQ ID NO: 10887 - DNA, 18 bp, Artificial Sequence
  Synthetic
gcccucccagggaagaug

SEQ ID NO: 10888 - DNA, 21 bp, Artificial Sequence
  Synthetic
gctcagctuctcagaacccuc

SEQ ID NO: 10889 - DNA, 18 bp, Artificial Sequence
  Synthetic
guagacacgcaccuccgt

SEQ ID NO: 10890 - DNA, 23 bp, Artificial Sequence
  Synthetic
cccttagugacagtgtcuacacc

SEQ ID NO: 10891 - DNA, 21 bp, Artificial Sequence
  Synthetic
cagaauctcccugccaaggaa

SEQ ID NO: 10892 - DNA, 18 bp, Artificial Sequence
  Synthetic
cuaccagcagccgcucat

SEQ ID NO: 10893 - DNA, 18 bp, Artificial Sequence
  Synthetic
accccttucccctgcauc

SEQ ID NO: 10894 - DNA, 20 bp, Artificial Sequence
  Synthetic
gtggcuagcagccttgttug

SEQ ID NO: 10895 - DNA, 23 bp, Artificial Sequence
  Synthetic
ggtggagaugaaggtctcgauga

SEQ ID NO: 10896 - DNA, 25 bp, Artificial Sequence
  Synthetic
cgcagacagcutctagagaaaaguc

SEQ ID NO: 10897 - DNA, 22 bp, Artificial Sequence
  Synthetic
aggctcaggucgaagattcgua

SEQ ID NO: 10898 - DNA, 24 bp, Artificial Sequence
  Synthetic
catctgccagcugacatccuaaaa

SEQ ID NO: 10899 - DNA, 25 bp, Artificial Sequence
  Synthetic
tgatccatuttgcttcatucagact

SEQ ID NO: 10900 - DNA, 25 bp, Artificial Sequence
  Synthetic
gatatctcgagccaauccaaaguca

SEQ ID NO: 10901 - DNA, 29 bp, Artificial Sequence
  Synthetic
gaagttgagtcuagaagaaagatugcact

SEQ ID NO: 10902 - DNA, 26 bp, Artificial Sequence
  Synthetic
ggtgtatcugaacttctctugaacca

SEQ ID NO: 10903 - DNA, 26 bp, Artificial Sequence
  Synthetic
ggacaaatggauggtgtgctttuaat

SEQ ID NO: 10904 - DNA, 22 bp, Artificial Sequence
  Synthetic
tggaagugggttaccugacagt

SEQ ID NO: 10905 - DNA, 30 bp, Artificial Sequence
  Synthetic
tacatttttaaugctcctttcttugacaga

SEQ ID NO: 10906 - DNA, 27 bp, Artificial Sequence
  Synthetic
tgcttcagagaugaaatgatgagucag

SEQ ID NO: 10907 - DNA, 28 bp, Artificial Sequence
  Synthetic
catctcattctaugcaacaattggtgut

SEQ ID NO: 10908 - DNA, 28 bp, Artificial Sequence
  Synthetic
gagttatggtugattgagaaggtuagca

SEQ ID NO: 10909 - DNA, 23 bp, Artificial Sequence
  Synthetic
cttggaccuggaagaagtgtuca

SEQ ID NO: 10910 - DNA, 25 bp, Artificial Sequence
  Synthetic
gcgacaaguaaggagaautatgcua

SEQ ID NO: 10911 - DNA, 25 bp, Artificial Sequence
  Synthetic
cctacccacaaaucagatgtacgug

SEQ ID NO: 10912 - DNA, 30 bp, Artificial Sequence
  Synthetic
gttaattgttccugcattttcagaauacaa

SEQ ID NO: 10913 - DNA, 25 bp, Artificial Sequence
  Synthetic
cctcagaccacautgccacaatuat

SEQ ID NO: 10914 - DNA, 30 bp, Artificial Sequence
  Synthetic
acatuagaaaaaggucaaaaggaaattaug

SEQ ID NO: 10915 - DNA, 22 bp, Artificial Sequence
  Synthetic
ccctgguctgcatatcugagag

SEQ ID NO: 10916 - DNA, 32 bp, Artificial Sequence
  Synthetic
cattttatgtcaagaagguattcctccactua

SEQ ID NO: 10917 - DNA, 23 bp, Artificial Sequence
  Synthetic
cgctgtggaaguggatgtatcug

SEQ ID NO: 10918 - DNA, 22 bp, Artificial Sequence
  Synthetic
aatcacaaaaagcagcuggcuc

SEQ ID NO: 10919 - DNA, 21 bp, Artificial Sequence
  Synthetic
acaactcgguggtcctguact

SEQ ID NO: 10920 - DNA, 21 bp, Artificial Sequence
  Synthetic
ctcgtaccccuccatcaacug

SEQ ID NO: 10921 - DNA, 26 bp, Artificial Sequence
  Synthetic
gtataacctttcuccttctcccccua

SEQ ID NO: 10922 - DNA, 24 bp, Artificial Sequence
  Synthetic
ccctgacguacattcaaaggcaut

SEQ ID NO: 10923 - DNA, 23 bp, Artificial Sequence
  Synthetic
ctatcagatcaugctggacugct

SEQ ID NO: 10924 - DNA, 24 bp, Artificial Sequence
  Synthetic
ggactacagcugaggaagtguaaa

SEQ ID NO: 10925 - DNA, 27 bp, Artificial Sequence
  Synthetic
acaacgtggugaagatttgtgatttug

SEQ ID NO: 10926 - DNA, 25 bp, Artificial Sequence
  Synthetic
gacutttatcttccugaaagccgga

SEQ ID NO: 10927 - DNA, 22 bp, Artificial Sequence
  Synthetic
ctccttttcaccugggtcctut

SEQ ID NO: 10928 - DNA, 30 bp, Artificial Sequence
  Synthetic
tatgaatctgtugaacaaatatctuaccca

SEQ ID NO: 10929 - DNA, 32 bp, Artificial Sequence
  Synthetic
actacctatcaattauaatggacccagaugaa

SEQ ID NO: 10930 - DNA, 26 bp, Artificial Sequence
  Synthetic
acaaacagggaaauagatgtcugacc

SEQ ID NO: 10931 - DNA, 24 bp, Artificial Sequence
  Synthetic
cagcacgcugtttatugaaagagt

SEQ ID NO: 10932 - DNA, 30 bp, Artificial Sequence
  Synthetic
tctcattattacugctatcatcuccgaact

SEQ ID NO: 10933 - DNA, 25 bp, Artificial Sequence
  Synthetic
gcacaaggaaugattguaccacaca

SEQ ID NO: 10934 - DNA, 32 bp, Artificial Sequence
  Synthetic
agtaaaatccaaguaacgtctctgtauaagaa

SEQ ID NO: 10935 - DNA, 28 bp, Artificial Sequence
  Synthetic
agacactgatutttctgtgaacugaagt

SEQ ID NO: 10936 - DNA, 24 bp, Artificial Sequence
  Synthetic
caattctgttucccatgttgcugt

SEQ ID NO: 10937 - DNA, 29 bp, Artificial Sequence
  Synthetic
tttgttatctgaggacutacaccaagtut

SEQ ID NO: 10938 - DNA, 27 bp, Artificial Sequence
  Synthetic
gtataattcccugcatcctcttcagut

SEQ ID NO: 10939 - DNA, 27 bp, Artificial Sequence
  Synthetic
cgtgttaucaaagtgatatugagaggc

SEQ ID NO: 10940 - DNA, 27 bp, Artificial Sequence
  Synthetic
tcctttgtcttugttctgcattttguc

SEQ ID NO: 10941 - DNA, 30 bp, Artificial Sequence
  Synthetic
tatataactttaagcaugaacactcacucc

SEQ ID NO: 10942 - DNA, 26 bp, Artificial Sequence
  Synthetic
ggtcagaagcccuatttctttguacg

SEQ ID NO: 10943 - DNA, 23 bp, Artificial Sequence
  Synthetic
tggugaaacagtatugccaacca

SEQ ID NO: 10944 - DNA, 22 bp, Artificial Sequence
  Synthetic
ctgtagaagccagugtggttug

SEQ ID NO: 10945 - DNA, 25 bp, Artificial Sequence
  Synthetic
gtctttgccugaaatggtgaguaag

SEQ ID NO: 10946 - DNA, 30 bp, Artificial Sequence
  Synthetic
cgggtttcattutattagcattgtatugga

SEQ ID NO: 10947 - DNA, 26 bp, Artificial Sequence
  Synthetic
aagaaacagaagcacuacccatacug

SEQ ID NO: 10948 - DNA, 21 bp, Artificial Sequence
  Synthetic
augaggucggaaacacagcaa

SEQ ID NO: 10949 - DNA, 21 bp, Artificial Sequence
  Synthetic
cggcagatgauggtgatggug

SEQ ID NO: 10950 - DNA, 23 bp, Artificial Sequence
  Synthetic
catggcaagtuactgtgttccuc

SEQ ID NO: 10951 - DNA, 27 bp, Artificial Sequence
  Synthetic
ttttaacttugacaatgtgtugcccaa

SEQ ID NO: 10952 - DNA, 19 bp, Artificial Sequence
  Synthetic
catggtgcutaccgtgugg

SEQ ID NO: 10953 - DNA, 20 bp, Artificial Sequence
  Synthetic
ctgggccagaacgucaugat

SEQ ID NO: 10954 - DNA, 20 bp, Artificial Sequence
  Synthetic
aggtgaggacugggucgaaa

SEQ ID NO: 10955 - DNA, 24 bp, Artificial Sequence
  Synthetic
cgcaaagauggcctctacttuacc

SEQ ID NO: 10956 - DNA, 24 bp, Artificial Sequence
  Synthetic
actggagagaugctttcttctugg

SEQ ID NO: 10957 - DNA, 24 bp, Artificial Sequence
  Synthetic
tgtgcagaaugaaggaacuggaaa

SEQ ID NO: 10958 - DNA, 17 bp, Artificial Sequence
  Synthetic
cuggaaguccccgcaca

SEQ ID NO: 10959 - DNA, 22 bp, Artificial Sequence
  Synthetic
ccgacttcaugagcaaccugag

SEQ ID NO: 10960 - DNA, 24 bp, Artificial Sequence
  Synthetic
ggctacttggcugcactaataugt

SEQ ID NO: 10961 - DNA, 23 bp, Artificial Sequence
  Synthetic
ggaaaggaaugaagagggtguga

SEQ ID NO: 10962 - DNA, 29 bp, Artificial Sequence
  Synthetic
ctgtcttcagaaggucatagttaauggaa

SEQ ID NO: 10963 - DNA, 22 bp, Artificial Sequence
  Synthetic
aaaaagccacccacutccttug

SEQ ID NO: 10964 - DNA, 25 bp, Artificial Sequence
  Synthetic
cttcatugagatcttguccaccgat

SEQ ID NO: 10965 - DNA, 29 bp, Artificial Sequence
  Synthetic
tcaagatgaugacgttaaatcgtttucct

SEQ ID NO: 10966 - DNA, 22 bp, Artificial Sequence
  Synthetic
gtgagtgccuttccccatctua

SEQ ID NO: 10967 - DNA, 21 bp, Artificial Sequence
  Synthetic
cagaugttguccgagggaacc

SEQ ID NO: 10968 - DNA, 21 bp, Artificial Sequence
  Synthetic
ttgcccaaautcccctucact

SEQ ID NO: 10969 - DNA, 26 bp, Artificial Sequence
  Synthetic
gatttgatgaaacuctccccugaaga

SEQ ID NO: 10970 - DNA, 24 bp, Artificial Sequence
  Synthetic
tcctgtattauggtaacgguggga

SEQ ID NO: 10971 - DNA, 28 bp, Artificial Sequence
  Synthetic
gctctgttatucagaagactgctttcut

SEQ ID NO: 10972 - DNA, 21 bp, Artificial Sequence
  Synthetic
ccaacgcuagactgctcugaa

SEQ ID NO: 10973 - DNA, 27 bp, Artificial Sequence
  Synthetic
tcctttgtgatuttcttgatcacugct

SEQ ID NO: 10974 - DNA, 22 bp, Artificial Sequence
  Synthetic
ttgtccccaccutcttcccuat

SEQ ID NO: 10975 - DNA, 30 bp, Artificial Sequence
  Synthetic
aaagucagaagaagaggaaaautactguaa

SEQ ID NO: 10976 - DNA, 26 bp, Artificial Sequence
  Synthetic
cagatgcttuggcagtagaagaugat

SEQ ID NO: 10977 - DNA, 23 bp, Artificial Sequence
  Synthetic
tgcgtcacuttctttgaugacct

SEQ ID NO: 10978 - DNA, 22 bp, Artificial Sequence
  Synthetic
cccuccaccaagagacuaaaca

SEQ ID NO: 10979 - DNA, 22 bp, Artificial Sequence
  Synthetic
ggagcuaaagagcgtgugagat

SEQ ID NO: 10980 - DNA, 31 bp, Artificial Sequence
  Synthetic
gcttacctttgcugaagttattatttgtgut

SEQ ID NO: 10981 - DNA, 28 bp, Artificial Sequence
  Synthetic
gcctcatctucagaaaacatcataguct

SEQ ID NO: 10982 - DNA, 27 bp, Artificial Sequence
  Synthetic
catcattguttatcattgtugcaggct

SEQ ID NO: 10983 - DNA, 28 bp, Artificial Sequence
  Synthetic
tgttccaattcgauctttcatccttgut

SEQ ID NO: 10984 - DNA, 25 bp, Artificial Sequence
  Synthetic
gctgacugagaaaacaggaaagcua

SEQ ID NO: 10985 - DNA, 23 bp, Artificial Sequence
  Synthetic
cagtcucgggcagttcttcauac

SEQ ID NO: 10986 - DNA, 25 bp, Artificial Sequence
  Synthetic
tggtaucaaaacaacagtuggagca

SEQ ID NO: 10987 - DNA, 27 bp, Artificial Sequence
  Synthetic
acacacagauctaataagugaccacct

SEQ ID NO: 10988 - DNA, 30 bp, Artificial Sequence
  Synthetic
gcagaaaaggauaagcagauaaaacagact

SEQ ID NO: 10989 - DNA, 28 bp, Artificial Sequence
  Synthetic
acacttactgatuatgtgcatcaaagua

SEQ ID NO: 10990 - DNA, 30 bp, Artificial Sequence
  Synthetic
agttgtgcccauaattcttgtagatttuct

SEQ ID NO: 10991 - DNA, 28 bp, Artificial Sequence
  Synthetic
gaaatttcatgtugtagttgctctucca

SEQ ID NO: 10992 - DNA, 24 bp, Artificial Sequence
  Synthetic
cagagcgaguctctgtcucaaaaa

SEQ ID NO: 10993 - DNA, 24 bp, Artificial Sequence
  Synthetic
tgccacctgaauaagtccagttuc

SEQ ID NO: 10994 - DNA, 27 bp, Artificial Sequence
  Synthetic
tttgtctgtgcautgcattttatguca

SEQ ID NO: 10995 - DNA, 26 bp, Artificial Sequence
  Synthetic
tcatgctatggcuctgggattttuac

SEQ ID NO: 10996 - DNA, 28 bp, Artificial Sequence
  Synthetic
gtgatattggaguctggttttcctttut

SEQ ID NO: 10997 - DNA, 25 bp, Artificial Sequence
  Synthetic
ccatattcaccugtaacagctgugt

SEQ ID NO: 10998 - DNA, 27 bp, Artificial Sequence
  Synthetic
atcttcttttcccccucatgaagaaut

SEQ ID NO: 10999 - DNA, 22 bp, Artificial Sequence
  Synthetic
aggtgccauttgcagtuacact

SEQ ID NO: 11000 - DNA, 28 bp, Artificial Sequence
  Synthetic
gtgatcttgtaaguttgatttggcucat

SEQ ID NO: 11001 - DNA, 26 bp, Artificial Sequence
  Synthetic
caaatuagaagggauagacaccttug

SEQ ID NO: 11002 - DNA, 29 bp, Artificial Sequence
  Synthetic
acagagaagtgtugagcaagaagaaaaua

SEQ ID NO: 11003 - DNA, 22 bp, Artificial Sequence
  Synthetic
cccaagaatgugcatggtgaug

SEQ ID NO: 11004 - DNA, 24 bp, Artificial Sequence
  Synthetic
gcagtcccautcattcttcagucc

SEQ ID NO: 11005 - DNA, 25 bp, Artificial Sequence
  Synthetic
accagctaccutctgtctttcatut

SEQ ID NO: 11006 - DNA, 30 bp, Artificial Sequence
  Synthetic
ggttttacatttcutttccttgtgtaugga

SEQ ID NO: 11007 - DNA, 24 bp, Artificial Sequence
  Synthetic
ctcctttgugagctgttggttuac

SEQ ID NO: 11008 - DNA, 17 bp, Artificial Sequence
  Synthetic
tggccuccccctcctuc

SEQ ID NO: 11009 - DNA, 18 bp, Artificial Sequence
  Synthetic
cattcccucggucgccat

SEQ ID NO: 11010 - DNA, 27 bp, Artificial Sequence
  Synthetic
ctgatggtaauggcagaaatcttucat

SEQ ID NO: 11011 - DNA, 28 bp, Artificial Sequence
  Synthetic
tgtttgtagaggugaaaaatgccauact

SEQ ID NO: 11012 - DNA, 28 bp, Artificial Sequence
  Synthetic
aatgctgatgggaucacttaatgtuaca

SEQ ID NO: 11013 - DNA, 29 bp, Artificial Sequence
  Synthetic
ttcacaacaaugccaaagtgtagatttut

SEQ ID NO: 11014 - DNA, 23 bp, Artificial Sequence
  Synthetic
ctacuaccagcccccauaaacag

SEQ ID NO: 11015 - DNA, 24 bp, Artificial Sequence
  Synthetic
aggcctcugagtaactctcaucag

SEQ ID NO: 11016 - DNA, 22 bp, Artificial Sequence
  Synthetic
ggctacatcucgcctctcuaca

SEQ ID NO: 11017 - DNA, 22 bp, Artificial Sequence
  Synthetic
aauccaacctugacaagcagga

SEQ ID NO: 11018 - DNA, 21 bp, Artificial Sequence
  Synthetic
agctgtgucagacaagcacuc

SEQ ID NO: 11019 - DNA, 26 bp, Artificial Sequence
  Synthetic
tgcatatacatcutgagcaaggacuc

SEQ ID NO: 11020 - DNA, 22 bp, Artificial Sequence
  Synthetic
cggtgcugatgcagtaguacaa

SEQ ID NO: 11021 - DNA, 25 bp, Artificial Sequence
  Synthetic
gggttaatcucacaaacacugcaga

SEQ ID NO: 11022 - DNA, 26 bp, Artificial Sequence
  Synthetic
tttttggctttguagctgctaaaucc

SEQ ID NO: 11023 - DNA, 25 bp, Artificial Sequence
  Synthetic
ctcctacaauacccaagttgaucgt

SEQ ID NO: 11024 - DNA, 33 bp, Artificial Sequence
  Synthetic
gtaaagtgattattttuaatgtttgcaggacua

SEQ ID NO: 11025 - DNA, 28 bp, Artificial Sequence
  Synthetic
ccaaaccaaccccauatatgagauaaca

SEQ ID NO: 11026 - DNA, 25 bp, Artificial Sequence
  Synthetic
ctccatguccactgtattcttugca

SEQ ID NO: 11027 - DNA, 27 bp, Artificial Sequence
  Synthetic
gccaagttagtauacaccgatggtaut

SEQ ID NO: 11028 - DNA, 22 bp, Artificial Sequence
  Synthetic
gtcatggtcautggacggcuat

SEQ ID NO: 11029 - DNA, 28 bp, Artificial Sequence
  Synthetic
acagatcaacutttatccaaaucgggaa

SEQ ID NO: 11030 - DNA, 25 bp, Artificial Sequence
  Synthetic
caccattttctucaatgtcacgugt

SEQ ID NO: 11031 - DNA, 22 bp, Artificial Sequence
  Synthetic
tgctttaugaaactgcgcucct

SEQ ID NO: 11032 - DNA, 28 bp, Artificial Sequence
  Synthetic
tcaatgatcaggaaaugctgtatucaca

SEQ ID NO: 11033 - DNA, 26 bp, Artificial Sequence
  Synthetic
acuttagtgtcagucaccaaagaagg

SEQ ID NO: 11034 - DNA, 22 bp, Artificial Sequence
  Synthetic
cauctcaucaccagaggcagat

SEQ ID NO: 11035 - DNA, 26 bp, Artificial Sequence
  Synthetic
accattagtttuccaattggcctcut

SEQ ID NO: 11036 - DNA, 28 bp, Artificial Sequence
  Synthetic
ctgcgtacauacaatttgatgttgtuct

SEQ ID NO: 11037 - DNA, 30 bp, Artificial Sequence
  Synthetic
tgcattgttcatuggtacttagtgtatcug

SEQ ID NO: 11038 - DNA, 22 bp, Artificial Sequence
  Synthetic
accccaaucaccuacagacaga

SEQ ID NO: 11039 - DNA, 28 bp, Artificial Sequence
  Synthetic
tggaacaaaagutatcctacaccugaaa

SEQ ID NO: 11040 - DNA, 26 bp, Artificial Sequence
  Synthetic
gacttggcgauagtaccaaggttaut

SEQ ID NO: 11041 - DNA, 26 bp, Artificial Sequence
  Synthetic
aaatccgguatgaaagctugacagat

SEQ ID NO: 11042 - DNA, 26 bp, Artificial Sequence
  Synthetic
gttttagctutctgtgacuccaacca

SEQ ID NO: 11043 - DNA, 22 bp, Artificial Sequence
  Synthetic
ggcaacaccuctacaaggauct

SEQ ID NO: 11044 - DNA, 23 bp, Artificial Sequence
  Synthetic
ttgagtcccutggtaccttcuca

SEQ ID NO: 11045 - DNA, 17 bp, Artificial Sequence
  Synthetic
gcccuccctucgggaca

SEQ ID NO: 11046 - DNA, 20 bp, Artificial Sequence
  Synthetic
tgtgcuccccacttuggaac

SEQ ID NO: 11047 - DNA, 22 bp, Artificial Sequence
  Synthetic
cccagcucactgatcttcucaa

SEQ ID NO: 11048 - DNA, 26 bp, Artificial Sequence
  Synthetic
gaacattgtcacuaactggtctggua

SEQ ID NO: 11049 - DNA, 30 bp, Artificial Sequence
  Synthetic
atcaatgaggaacutagaagaaaaactuca

SEQ ID NO: 11050 - DNA, 20 bp, Artificial Sequence
  Synthetic
tcccatcccucctccagaug

SEQ ID NO: 11051 - DNA, 20 bp, Artificial Sequence
  Synthetic
ctccccuccaacaguccaag

SEQ ID NO: 11052 - DNA, 22 bp, Artificial Sequence
  Synthetic
accacgtccuctcgtttcctua

SEQ ID NO: 11053 - DNA, 23 bp, Artificial Sequence
  Synthetic
gcuctttgttgctucccaaacac

SEQ ID NO: 11054 - DNA, 18 bp, Artificial Sequence
  Synthetic
cccaggguctgccuacca

SEQ ID NO: 11055 - DNA, 21 bp, Artificial Sequence
  Synthetic
cattctgccccauccccauag

SEQ ID NO: 11056 - DNA, 24 bp, Artificial Sequence
  Synthetic
acatctccgucatagttctugcag

SEQ ID NO: 11057 - DNA, 23 bp, Artificial Sequence
  Synthetic
ccctctccccauaacagacctut

SEQ ID NO: 11058 - DNA, 24 bp, Artificial Sequence
  Synthetic
aagttgtacacutcccactcctug

SEQ ID NO: 11059 - DNA, 19 bp, Artificial Sequence
  Synthetic
ctcgccuagccatcctcut

SEQ ID NO: 11060 - DNA, 21 bp, Artificial Sequence
  Synthetic
gcagagtcaauggtgaccugg

SEQ ID NO: 11061 - DNA, 24 bp, Artificial Sequence
  Synthetic
acttcttatccugccctttgtugt

SEQ ID NO: 11062 - DNA, 22 bp, Artificial Sequence
  Synthetic
ctgctgggutttgctttgtuct

SEQ ID NO: 11063 - DNA, 23 bp, Artificial Sequence
  Synthetic
gcagauggttcugaggaggaaac

SEQ ID NO: 11064 - DNA, 19 bp, Artificial Sequence
  Synthetic
ccatggccucgttgctcuc

SEQ ID NO: 11065 - DNA, 21 bp, Artificial Sequence
  Synthetic
cctaaccaccccuccaacuct

SEQ ID NO: 11066 - DNA, 25 bp, Artificial Sequence
  Synthetic
ggaggacgaaaugaaatcugggaat

SEQ ID NO: 11067 - DNA, 23 bp, Artificial Sequence
  Synthetic
cttugccacagucaaagagaaug

SEQ ID NO: 11068 - DNA, 18 bp, Artificial Sequence
  Synthetic
cgcaccugtctcugcagt

SEQ ID NO: 11069 - DNA, 21 bp, Artificial Sequence
  Synthetic
gagaugaagacgcagcuggaa

SEQ ID NO: 11070 - DNA, 18 bp, Artificial Sequence
  Synthetic
cccacgcccuctaccuga

SEQ ID NO: 11071 - DNA, 21 bp, Artificial Sequence
  Synthetic
gcggccgcutatgataaacug

SEQ ID NO: 11072 - DNA, 20 bp, Artificial Sequence
  Synthetic
gttctgctuggcctccauct

SEQ ID NO: 11073 - DNA, 22 bp, Artificial Sequence
  Synthetic
ggacctcttugcatccctttug

SEQ ID NO: 11074 - DNA, 22 bp, Artificial Sequence
  Synthetic
cgtgtttcugcctcatctccug

SEQ ID NO: 11075 - DNA, 22 bp, Artificial Sequence
  Synthetic
gcactgagaugaccctctguct

SEQ ID NO: 11076 - DNA, 22 bp, Artificial Sequence
  Synthetic
gcatcttgagcuctgcgatcug

SEQ ID NO: 11077 - DNA, 22 bp, Artificial Sequence
  Synthetic
cttccugaagagcaccttggut

SEQ ID NO: 11078 - DNA, 24 bp, Artificial Sequence
  Synthetic
ccagtttctugatcttggccucag

SEQ ID NO: 11079 - DNA, 28 bp, Artificial Sequence
  Synthetic
caccacgagaguaaatctgttauaacca

SEQ ID NO: 11080 - DNA, 20 bp, Artificial Sequence
  Synthetic
caagucctgtuccccagcaa

SEQ ID NO: 11081 - DNA, 23 bp, Artificial Sequence
  Synthetic
aaggaggaugaacugcagaagac

SEQ ID NO: 11082 - DNA, 22 bp, Artificial Sequence
  Synthetic
agaaaggccccugtttgtgaut

SEQ ID NO: 11083 - DNA, 24 bp, Artificial Sequence
  Synthetic
cuagaggaggagugagattugaag

SEQ ID NO: 11084 - DNA, 18 bp, Artificial Sequence
  Synthetic
ggacagcccuggcttcug

SEQ ID NO: 11085 - DNA, 18 bp, Artificial Sequence
  Synthetic
gcagcugggcaagcugat

SEQ ID NO: 11086 - DNA, 20 bp, Artificial Sequence
  Synthetic
ggtccccugagacagagucc

SEQ ID NO: 11087 - DNA, 22 bp, Artificial Sequence
  Synthetic
cggacaaguctttcguggagaa

SEQ ID NO: 11088 - DNA, 23 bp, Artificial Sequence
  Synthetic
gacaaccaagaccauggctctua

SEQ ID NO: 11089 - DNA, 22 bp, Artificial Sequence
  Synthetic
gcctttuccgctggatacucac

SEQ ID NO: 11090 - DNA, 24 bp, Artificial Sequence
  Synthetic
tcagagagcagaaauctgtccuga

SEQ ID NO: 11091 - DNA, 25 bp, Artificial Sequence
  Synthetic
aggaugatgagatgtuccaggaaac

SEQ ID NO: 11092 - DNA, 24 bp, Artificial Sequence
  Synthetic
cttttcuggaaaatccatguggct

SEQ ID NO: 11093 - DNA, 28 bp, Artificial Sequence
  Synthetic
ggttgctttcuccaataactagatguga

SEQ ID NO: 11094 - DNA, 21 bp, Artificial Sequence
  Synthetic
gcccutgtacatgucgacgat

SEQ ID NO: 11095 - DNA, 22 bp, Artificial Sequence
  Synthetic
gtgcaatcugtctacccuggag

SEQ ID NO: 11096 - DNA, 26 bp, Artificial Sequence
  Synthetic
gctgttgaugaagtttttguccacaa

SEQ ID NO: 11097 - DNA, 20 bp, Artificial Sequence
  Synthetic
tccuagacagggcaagguga

SEQ ID NO: 11098 - DNA, 22 bp, Artificial Sequence
  Synthetic
cctgccacauggatgtatucca

SEQ ID NO: 11099 - DNA, 21 bp, Artificial Sequence
  Synthetic
agattgagugccacccuaagc

SEQ ID NO: 11100 - DNA, 20 bp, Artificial Sequence
  Synthetic
ccuggagtuccgcaaagact

SEQ ID NO: 11101 - DNA, 21 bp, Artificial Sequence
  Synthetic
tccatcccagcutcacaccua

SEQ ID NO: 11102 - DNA, 22 bp, Artificial Sequence
  Synthetic
cctcacctuaccctcatccugt

SEQ ID NO: 11103 - DNA, 19 bp, Artificial Sequence
  Synthetic
ggtggcagcugtacaccuc

SEQ ID NO: 11104 - DNA, 19 bp, Artificial Sequence
  Synthetic
ggccuagaggacccacuct

SEQ ID NO: 11105 - DNA, 19 bp, Artificial Sequence
  Synthetic
gtccuccccatcugcaagg

SEQ ID NO: 11106 - DNA, 19 bp, Artificial Sequence
  Synthetic
ccacttucgagcccuggac

SEQ ID NO: 11107 - DNA, 19 bp, Artificial Sequence
  Synthetic
tcaggcucaaaggcccauc

SEQ ID NO: 11108 - DNA, 21 bp, Artificial Sequence
  Synthetic
gcccuacggacagcagagtua

SEQ ID NO: 11109 - DNA, 28 bp, Artificial Sequence
  Synthetic
gcaatautcagaaagaguaggaagaggt

SEQ ID NO: 11110 - DNA, 21 bp, Artificial Sequence
  Synthetic
gcuatgguggacagcagcaaa

SEQ ID NO: 11111 - DNA, 21 bp, Artificial Sequence
  Synthetic
gcugcagacaaagcugaagac

SEQ ID NO: 11112 - DNA, 18 bp, Artificial Sequence
  Synthetic
cgguggctauggacagca

SEQ ID NO: 11113 - DNA, 17 bp, Artificial Sequence
  Synthetic
ccaugccacctcugcct

SEQ ID NO: 11114 - DNA, 28 bp, Artificial Sequence
  Synthetic
ttcacatttgcautttctctgtucaaca

SEQ ID NO: 11115 - DNA, 21 bp, Artificial Sequence
  Synthetic
tgacagaaagcucccacucct

SEQ ID NO: 11116 - DNA, 23 bp, Artificial Sequence
  Synthetic
ggagcagacccauacttggtcua

SEQ ID NO: 11117 - DNA, 23 bp, Artificial Sequence
  Synthetic
acggatuaggacacttccaguca

SEQ ID NO: 11118 - DNA, 20 bp, Artificial Sequence
  Synthetic
gctatgaucgaggcggcuac

SEQ ID NO: 11119 - DNA, 25 bp, Artificial Sequence
  Synthetic
tgttatcctauggcctctgtucaac

SEQ ID NO: 11120 - DNA, 19 bp, Artificial Sequence
  Synthetic
gcgactuggagctgagugg

SEQ ID NO: 11121 - DNA, 17 bp, Artificial Sequence
  Synthetic
guggcauccccagcaga

SEQ ID NO: 11122 - DNA, 25 bp, Artificial Sequence
  Synthetic
tcctcaagugatggttuaaggcaaa

SEQ ID NO: 11123 - DNA, 30 bp, Artificial Sequence
  Synthetic
ccutattcttaaattgaugcaaacgaggaa

SEQ ID NO: 11124 - DNA, 24 bp, Artificial Sequence
  Synthetic
cacaagagauacctgtggtctcug

SEQ ID NO: 11125 - DNA, 23 bp, Artificial Sequence
  Synthetic
ccttgtgcatucatccgcaaaut

SEQ ID NO: 11126 - DNA, 27 bp, Artificial Sequence
  Synthetic
ttggtgttcatcauagccctaattgut

SEQ ID NO: 11127 - DNA, 22 bp, Artificial Sequence
  Synthetic
gccatgcugtgctcauaaagga

SEQ ID NO: 11128 - DNA, 25 bp, Artificial Sequence
  Synthetic
gtgaacacacuggtaaguacacgat

SEQ ID NO: 11129 - DNA, 30 bp, Artificial Sequence
  Synthetic
ctgcgtttgatcuttgtctaaatagtgtua

SEQ ID NO: 11130 - DNA, 20 bp, Artificial Sequence
  Synthetic
cttgagguggtcgactugct

SEQ ID NO: 11131 - DNA, 20 bp, Artificial Sequence
  Synthetic
gtgauccggcugaagcagaa

SEQ ID NO: 11132 - DNA, 18 bp, Artificial Sequence
  Synthetic
gtcttccaggugcgccut

SEQ ID NO: 11133 - DNA, 19 bp, Artificial Sequence
  Synthetic
accgcatcaucagccagug

SEQ ID NO: 11134 - DNA, 19 bp, Artificial Sequence
  Synthetic
caggcucgggaagatccuc

SEQ ID NO: 11135 - DNA, 18 bp, Artificial Sequence
  Synthetic
gaggcgagcccutcctua

SEQ ID NO: 11136 - DNA, 22 bp, Artificial Sequence
  Synthetic
tctacctcugtgcaaagugcaa

SEQ ID NO: 11137 - DNA, 21 bp, Artificial Sequence
  Synthetic
ttgctctcugcctcgtcttuc

SEQ ID NO: 11138 - DNA, 21 bp, Artificial Sequence
  Synthetic
gtcccgucagaagagaugagg

SEQ ID NO: 11139 - DNA, 20 bp, Artificial Sequence
  Synthetic
ctgtggtcugaggcctagug

SEQ ID NO: 11140 - DNA, 19 bp, Artificial Sequence
  Synthetic
cccagaggugctgagaugg

SEQ ID NO: 11141 - DNA, 21 bp, Artificial Sequence
  Synthetic
ctgagccacutcttggtgtug

SEQ ID NO: 11142 - DNA, 25 bp, Artificial Sequence
  Synthetic
cttcctgatgutttcttcccugact

SEQ ID NO: 11143 - DNA, 21 bp, Artificial Sequence
  Synthetic
tggtttctauggcgtggtugt

SEQ ID NO: 11144 - DNA, 21 bp, Artificial Sequence
  Synthetic
gaagcugacaggaggauccac

SEQ ID NO: 11145 - DNA, 26 bp, Artificial Sequence
  Synthetic
gcttttcttaccugccttgaactcut

SEQ ID NO: 11146 - DNA, 21 bp, Artificial Sequence
  Synthetic
gccgtcugcggaaaatcucaa

SEQ ID NO: 11147 - DNA, 19 bp, Artificial Sequence
  Synthetic
gccttccugtgccagcaua

SEQ ID NO: 11148 - DNA, 21 bp, Artificial Sequence
  Synthetic
ggccaggguagctctttucaa

SEQ ID NO: 11149 - DNA, 28 bp, Artificial Sequence
  Synthetic
ggattgtgtgttcugtcctcattgtaut

SEQ ID NO: 11150 - DNA, 18 bp, Artificial Sequence
  Synthetic
cgguccgaaagctgcgua

SEQ ID NO: 11151 - DNA, 27 bp, Artificial Sequence
  Synthetic
agcaatttcttacuctctctgcaagut

SEQ ID NO: 11152 - DNA, 20 bp, Artificial Sequence
  Synthetic
ccccaugaaggagagccuca

SEQ ID NO: 11153 - DNA, 21 bp, Artificial Sequence
  Synthetic
tgatggttucacggctgtcuc

SEQ ID NO: 11154 - DNA, 23 bp, Artificial Sequence
  Synthetic
cgtgttgaugctgagctgaauct

SEQ ID NO: 11155 - DNA, 21 bp, Artificial Sequence
  Synthetic
gcagctgtauccctccttucg

SEQ ID NO: 11156 - DNA, 24 bp, Artificial Sequence
  Synthetic
tgagagacugacaaggaaagucct

SEQ ID NO: 11157 - DNA, 22 bp, Artificial Sequence
  Synthetic
gatgcactguctgcttctcugt

SEQ ID NO: 11158 - DNA, 18 bp, Artificial Sequence
  Synthetic
gatguggcagccagctuc

SEQ ID NO: 11159 - DNA, 17 bp, Artificial Sequence
  Synthetic
gtccugggctucacgct

SEQ ID NO: 11160 - DNA, 20 bp, Artificial Sequence
  Synthetic
gaaccucctgcgttuccaga

SEQ ID NO: 11161 - DNA, 21 bp, Artificial Sequence
  Synthetic
ggtcatcugtcgcacatuggt

SEQ ID NO: 11162 - DNA, 25 bp, Artificial Sequence
  Synthetic
cttggcuctttaattuggcagacac

SEQ ID NO: 11163 - DNA, 23 bp, Artificial Sequence
  Synthetic
ttttctgttccuggctctgtcut

SEQ ID NO: 11164 - DNA, 21 bp, Artificial Sequence
  Synthetic
ccgtctgautctgggcttuga

SEQ ID NO: 11165 - DNA, 29 bp, Artificial Sequence
  Synthetic
ttgtttttcagagutctttgttgctugaa

SEQ ID NO: 11166 - DNA, 27 bp, Artificial Sequence
  Synthetic
atgtcctatttucccaaccagctuaaa

SEQ ID NO: 11167 - DNA, 21 bp, Artificial Sequence
  Synthetic
ggguattctcucagccgggat

SEQ ID NO: 11168 - DNA, 18 bp, Artificial Sequence
  Synthetic
cgggucacccttcuggaa

SEQ ID NO: 11169 - DNA, 19 bp, Artificial Sequence
  Synthetic
gcccugtggacauggagat

SEQ ID NO: 11170 - DNA, 22 bp, Artificial Sequence
  Synthetic
gctctgtgucagcctctguact

SEQ ID NO: 11171 - DNA, 23 bp, Artificial Sequence
  Synthetic
atggtgacugtggtcttttucca

SEQ ID NO: 11172 - DNA, 21 bp, Artificial Sequence
  Synthetic
ggtggucgcacttcttcaugt

SEQ ID NO: 11173 - DNA, 21 bp, Artificial Sequence
  Synthetic
tgcactggcutacagctgaug

SEQ ID NO: 11174 - DNA, 21 bp, Artificial Sequence
  Synthetic
gcttcaccuttcccggaugaa

SEQ ID NO: 11175 - DNA, 21 bp, Artificial Sequence
  Synthetic
agactcagacgugcccuaaac

SEQ ID NO: 11176 - DNA, 20 bp, Artificial Sequence
  Synthetic
gcagaagcagugaccgcuat

SEQ ID NO: 11177 - DNA, 21 bp, Artificial Sequence
  Synthetic
catctgagccgugtctctguc

SEQ ID NO: 11178 - DNA, 27 bp, Artificial Sequence
  Synthetic
gcaggcaagaaaaaucaattctuacca

SEQ ID NO: 11179 - DNA, 19 bp, Artificial Sequence
  Synthetic
gacttgccucagccccaut

SEQ ID NO: 11180 - DNA, 17 bp, Artificial Sequence
  Synthetic
aacaauggcggcuccga

SEQ ID NO: 11181 - DNA, 19 bp, Artificial Sequence
  Synthetic
cgcgtuccttacccugcat

SEQ ID NO: 11182 - DNA, 22 bp, Artificial Sequence
  Synthetic
gggatttcacugcagaggacut

SEQ ID NO: 11183 - DNA, 28 bp, Artificial Sequence
  Synthetic
agtaccaaaaauaatcatggcaucacct

SEQ ID NO: 11184 - DNA, 29 bp, Artificial Sequence
  Synthetic
gaactcatgtcuacctcgtttgataagut

SEQ ID NO: 11185 - DNA, 23 bp, Artificial Sequence
  Synthetic
gcattcaaaacuccagcagcauc

SEQ ID NO: 11186 - DNA, 24 bp, Artificial Sequence
  Synthetic
gcttccattugcctattcctugag

SEQ ID NO: 11187 - DNA, 25 bp, Artificial Sequence
  Synthetic
ggcaaggtugaatcagcauaaacat

SEQ ID NO: 11188 - DNA, 23 bp, Artificial Sequence
  Synthetic
gttgaggucgcatgctatgttug

SEQ ID NO: 11189 - DNA, 26 bp, Artificial Sequence
  Synthetic
attctttacgtcutgcttcctcucag

SEQ ID NO: 11190 - DNA, 23 bp, Artificial Sequence
  Synthetic
ccagtcauccagaactucagcag

SEQ ID NO: 11191 - DNA, 22 bp, Artificial Sequence
  Synthetic
tgctgtggugtctgagtgttut

SEQ ID NO: 11192 - DNA, 22 bp, Artificial Sequence
  Synthetic
cactggucaccacaaactcgua

SEQ ID NO: 11193 - DNA, 20 bp, Artificial Sequence
  Synthetic
ccacgggccutgtgttgtua

SEQ ID NO: 11194 - DNA, 21 bp, Artificial Sequence
  Synthetic
ctctcctccugagctccugat

SEQ ID NO: 11195 - DNA, 22 bp, Artificial Sequence
  Synthetic
gtugccagagaguacagaaggg

SEQ ID NO: 11196 - DNA, 18 bp, Artificial Sequence
  Synthetic
cctcagcgautccugcca

SEQ ID NO: 11197 - DNA, 18 bp, Artificial Sequence
  Synthetic
cggcugaccgagaagcuc

SEQ ID NO: 11198 - DNA, 22 bp, Artificial Sequence
  Synthetic
atgaggtagauccggtccauca

SEQ ID NO: 11199 - DNA, 23 bp, Artificial Sequence
  Synthetic
ccatcttcutcggagaugagcag

SEQ ID NO: 11200 - DNA, 21 bp, Artificial Sequence
  Synthetic
cacctacugcagggaucacaa

SEQ ID NO: 11201 - DNA, 23 bp, Artificial Sequence
  Synthetic
aagaagaggaagguggcatucag

SEQ ID NO: 11202 - DNA, 26 bp, Artificial Sequence
  Synthetic
ctcatgggagtaugaaggagatggua

SEQ ID NO: 11203 - DNA, 17 bp, Artificial Sequence
  Synthetic
gccacccccguacctug

SEQ ID NO: 11204 - DNA, 20 bp, Artificial Sequence
  Synthetic
tguggaggagggaacaguct

SEQ ID NO: 11205 - DNA, 21 bp, Artificial Sequence
  Synthetic
ggtgagcacgutggcaaatug

SEQ ID NO: 11206 - DNA, 20 bp, Artificial Sequence
  Synthetic
caggctgccutctctggtua

SEQ ID NO: 11207 - DNA, 23 bp, Artificial Sequence
  Synthetic
ccatctuaccacagctgacugac

SEQ ID NO: 11208 - DNA, 22 bp, Artificial Sequence
  Synthetic
cctggtgtugaaccttcctcuc

SEQ ID NO: 11209 - DNA, 26 bp, Artificial Sequence
  Synthetic
gctcagtttctuccctttatgacuca

SEQ ID NO: 11210 - DNA, 21 bp, Artificial Sequence
  Synthetic
ggtggtctuctctggcttugg

SEQ ID NO: 11211 - DNA, 18 bp, Artificial Sequence
  Synthetic
atccgtutgtgggugcct

SEQ ID NO: 11212 - DNA, 20 bp, Artificial Sequence
  Synthetic
ctgtccucccgaaccttugg

SEQ ID NO: 11213 - DNA, 25 bp, Artificial Sequence
  Synthetic
ccatcccatutccttctaagugcat

SEQ ID NO: 11214 - DNA, 22 bp, Artificial Sequence
  Synthetic
cgttaaucccctcctcucccaa

SEQ ID NO: 11215 - DNA, 21 bp, Artificial Sequence
  Synthetic
agccagaaagcuctcccatuc

SEQ ID NO: 11216 - DNA, 20 bp, Artificial Sequence
  Synthetic
cctcaggtucctcgctcuct

SEQ ID NO: 11217 - DNA, 22 bp, Artificial Sequence
  Synthetic
agagctgcacgutgagaatcug

SEQ ID NO: 11218 - DNA, 17 bp, Artificial Sequence
  Synthetic
gggccugcccctcaaug

SEQ ID NO: 11219 - DNA, 20 bp, Artificial Sequence
  Synthetic
agctctcccucacctgtuga

SEQ ID NO: 11220 - DNA, 21 bp, Artificial Sequence
  Synthetic
ctugcaggaacaccagacugt

SEQ ID NO: 11221 - DNA, 17 bp, Artificial Sequence
  Synthetic
ggtggagcutccugcca

SEQ ID NO: 11222 - DNA, 19 bp, Artificial Sequence
  Synthetic
ccagucctcacugcccaga

SEQ ID NO: 11223 - DNA, 24 bp, Artificial Sequence
  Synthetic
cctgctgagguacctgatgauaag

SEQ ID NO: 11224 - DNA, 22 bp, Artificial Sequence
  Synthetic
cttttcucggaaccaugaaccc

SEQ ID NO: 11225 - DNA, 20 bp, Artificial Sequence
  Synthetic
ctctccuccctggatucgga

SEQ ID NO: 11226 - DNA, 21 bp, Artificial Sequence
  Synthetic
ctaccccaagcagucctucac

SEQ ID NO: 11227 - DNA, 22 bp, Artificial Sequence
  Synthetic
gaaggtacucttgccaaaugcc

SEQ ID NO: 11228 - DNA, 21 bp, Artificial Sequence
  Synthetic
gagttugagaagagccgcaug

SEQ ID NO: 11229 - DNA, 21 bp, Artificial Sequence
  Synthetic
tcaggucatcugcaccaacag

SEQ ID NO: 11230 - DNA, 20 bp, Artificial Sequence
  Synthetic
aactacguggaggccatcug

SEQ ID NO: 11231 - DNA, 22 bp, Artificial Sequence
  Synthetic
tcagtuggcaaaagaagcugga

SEQ ID NO: 11232 - DNA, 30 bp, Artificial Sequence
  Synthetic
gaaauagtcttauaacaggucaggaaaagt

SEQ ID NO: 11233 - DNA, 28 bp, Artificial Sequence
  Synthetic
atccagcttctuttccttgtctttauct

SEQ ID NO: 11234 - DNA, 23 bp, Artificial Sequence
  Synthetic
gagctgaagacucttaccacuca

SEQ ID NO: 11235 - DNA, 21 bp, Artificial Sequence
  Synthetic
ggaccuggatggtgucaggat

SEQ ID NO: 11236 - DNA, 26 bp, Artificial Sequence
  Synthetic
ctaatgagcaggaugacaagtacugg

SEQ ID NO: 11237 - DNA, 22 bp, Artificial Sequence
  Synthetic
agutctccttcuccaggaacga

SEQ ID NO: 11238 - DNA, 20 bp, Artificial Sequence
  Synthetic
ccccguggaagtuacacacc

SEQ ID NO: 11239 - DNA, 25 bp, Artificial Sequence
  Synthetic
aaacauaacagaagugagcaccgat

SEQ ID NO: 11240 - DNA, 21 bp, Artificial Sequence
  Synthetic
aguattaggucagccccacca

SEQ ID NO: 11241 - DNA, 24 bp, Artificial Sequence
  Synthetic
gcaaaagaaggcacugtcccttua

SEQ ID NO: 11242 - DNA, 20 bp, Artificial Sequence
  Synthetic
ggccugccagaactgaacuc

SEQ ID NO: 11243 - DNA, 21 bp, Artificial Sequence
  Synthetic
gcgcaaccccuacacactuac

SEQ ID NO: 11244 - DNA, 29 bp, Artificial Sequence
  Synthetic
gccggttucacaagacataatttttauca

SEQ ID NO: 11245 - DNA, 23 bp, Artificial Sequence
  Synthetic
acagtcatucaaacaggcagcua

SEQ ID NO: 11246 - DNA, 28 bp, Artificial Sequence
  Synthetic
tcctttcccagaauatgacaatctgtuc

SEQ ID NO: 11247 - DNA, 23 bp, Artificial Sequence
  Synthetic
acacauggcagagacggtaauac

SEQ ID NO: 11248 - DNA, 19 bp, Artificial Sequence
  Synthetic
cgcgcugccagatttgtuc

SEQ ID NO: 11249 - DNA, 17 bp, Artificial Sequence
  Synthetic
guagcgggucccccaac

SEQ ID NO: 11250 - DNA, 28 bp, Artificial Sequence
  Synthetic
gaaagctgttgacutgaattctttcugt

SEQ ID NO: 11251 - DNA, 23 bp, Artificial Sequence
  Synthetic
catagccugcaggaaatcacuca

SEQ ID NO: 11252 - DNA, 25 bp, Artificial Sequence
  Synthetic
gcaggcttttaugtctgtcgagtua

SEQ ID NO: 11253 - DNA, 22 bp, Artificial Sequence
  Synthetic
gggaatccccaucccaacatuc

SEQ ID NO: 11254 - DNA, 28 bp, Artificial Sequence
  Synthetic
ccaagccautaaaauagaagaggaagca

SEQ ID NO: 11255 - DNA, 29 bp, Artificial Sequence
  Synthetic
cttgctatcttgacugtctcgatcatuat

SEQ ID NO: 11256 - DNA, 28 bp, Artificial Sequence
  Synthetic
tctgtaagtgaugctgctgatgttauat

SEQ ID NO: 11257 - DNA, 21 bp, Artificial Sequence
  Synthetic
tctacucacccaaaggcuggt

SEQ ID NO: 11258 - DNA, 27 bp, Artificial Sequence
  Synthetic
tgcaggacauggttatgaaaatttugg

SEQ ID NO: 11259 - DNA, 30 bp, Artificial Sequence
  Synthetic
tccagtttctttutcttgcatcaattucag

SEQ ID NO: 11260 - DNA, 24 bp, Artificial Sequence
  Synthetic
gtaagugtcacctuaccaaaggca

SEQ ID NO: 11261 - DNA, 23 bp, Artificial Sequence
  Synthetic
ccacugtagatuccgcacaagag

SEQ ID NO: 11262 - DNA, 30 bp, Artificial Sequence
  Synthetic
cacgagaggataguatcagttaagatguct

SEQ ID NO: 11263 - DNA, 24 bp, Artificial Sequence
  Synthetic
tttgataccaaguagctgccagut

SEQ ID NO: 11264 - DNA, 24 bp, Artificial Sequence
  Synthetic
gggaaggaagacutgcttucaaac

SEQ ID NO: 11265 - DNA, 24 bp, Artificial Sequence
  Synthetic
gacagctauctgctggtguaacat

SEQ ID NO: 11266 - DNA, 22 bp, Artificial Sequence
  Synthetic
cacattccugaagagcacuggt

SEQ ID NO: 11267 - DNA, 26 bp, Artificial Sequence
  Synthetic
ctgaaaaugcagacaaaactgccuaa

SEQ ID NO: 11268 - DNA, 27 bp, Artificial Sequence
  Synthetic
tgatgtttugaagtaagtcctuggaca

SEQ ID NO: 11269 - DNA, 26 bp, Artificial Sequence
  Synthetic
gagacucgacttattucagagaccac

SEQ ID NO: 11270 - DNA, 24 bp, Artificial Sequence
  Synthetic
aaccgaataaucccaactgtccug

SEQ ID NO: 11271 - DNA, 23 bp, Artificial Sequence
  Synthetic
ttttgacctcaugtggcctctut

SEQ ID NO: 11272 - DNA, 20 bp, Artificial Sequence
  Synthetic
agaagcugggtgucaggagt

SEQ ID NO: 11273 - DNA, 19 bp, Artificial Sequence
  Synthetic
accaggcggugtcaatgut

SEQ ID NO: 11274 - DNA, 18 bp, Artificial Sequence
  Synthetic
cctgaacutccccuggca

SEQ ID NO: 11275 - DNA, 18 bp, Artificial Sequence
  Synthetic
tgtugccgcaaagcucct

SEQ ID NO: 11276 - DNA, 25 bp, Artificial Sequence
  Synthetic
gtcuguagaagaggaagagaactuc

SEQ ID NO: 11277 - DNA, 20 bp, Artificial Sequence
  Synthetic
aggutctgggauccccaagt

SEQ ID NO: 11278 - DNA, 18 bp, Artificial Sequence
  Synthetic
cctccacuggcugcaact

SEQ ID NO: 11279 - DNA, 19 bp, Artificial Sequence
  Synthetic
cagcagagaccugggtucc

SEQ ID NO: 11280 - DNA, 18 bp, Artificial Sequence
  Synthetic
agagtcgucctcgucgga

SEQ ID NO: 11281 - DNA, 20 bp, Artificial Sequence
  Synthetic
agtgucaagaagctcugcgt

SEQ ID NO: 11282 - DNA, 17 bp, Artificial Sequence
  Synthetic
cacuccgggacccctuc

SEQ ID NO: 11283 - DNA, 21 bp, Artificial Sequence
  Synthetic
gauggcccugaaagagaccaa

SEQ ID NO: 11284 - DNA, 17 bp, Artificial Sequence
  Synthetic
ggcctuccgcctcacua

SEQ ID NO: 11285 - DNA, 21 bp, Artificial Sequence
  Synthetic
tgauggtaaugcccgaaggag

SEQ ID NO: 11286 - DNA, 19 bp, Artificial Sequence
  Synthetic
guccccauagagaggcauc

SEQ ID NO: 11287 - DNA, 26 bp, Artificial Sequence
  Synthetic
tgatgggtgtguttcttccttttcut

SEQ ID NO: 11288 - DNA, 18 bp, Artificial Sequence
  Synthetic
gcacguccactgccctut

SEQ ID NO: 11289 - DNA, 18 bp, Artificial Sequence
  Synthetic
gcccggcccaucaagaug

SEQ ID NO: 11290 - DNA, 17 bp, Artificial Sequence
  Synthetic
gacccuggcccccaauc

SEQ ID NO: 11291 - DNA, 18 bp, Artificial Sequence
  Synthetic
guagccaugcccaccaca

SEQ ID NO: 11292 - DNA, 21 bp, Artificial Sequence
  Synthetic
ccccaaaugcaatgtcauggg

SEQ ID NO: 11293 - DNA, 22 bp, Artificial Sequence
  Synthetic
aaacaccacuccctgtccttut

SEQ ID NO: 11294 - DNA, 18 bp, Artificial Sequence
  Synthetic
gctcugggaagccgacuc

SEQ ID NO: 11295 - DNA, 21 bp, Artificial Sequence
  Synthetic
cctcgcauctcaagacctugt

SEQ ID NO: 11296 - DNA, 24 bp, Artificial Sequence
  Synthetic
agatcugcgaggaauagagaagga

SEQ ID NO: 11297 - DNA, 21 bp, Artificial Sequence
  Synthetic
tgacagaucctgccttcucca

SEQ ID NO: 11298 - DNA, 20 bp, Artificial Sequence
  Synthetic
gtctuggcaggcauagagct

SEQ ID NO: 11299 - DNA, 20 bp, Artificial Sequence
  Synthetic
ggaggtugcacagcaaguca

SEQ ID NO: 11300 - DNA, 22 bp, Artificial Sequence
  Synthetic
tggtgacgccacuaaacactuc

SEQ ID NO: 11301 - DNA, 22 bp, Artificial Sequence
  Synthetic
agtggatcccugatcccactut

SEQ ID NO: 11302 - DNA, 20 bp, Artificial Sequence
  Synthetic
tgtttgaccaccugcagcut

SEQ ID NO: 11303 - DNA, 22 bp, Artificial Sequence
  Synthetic
cctccucaacacaagtgcagut

SEQ ID NO: 11304 - DNA, 21 bp, Artificial Sequence
  Synthetic
ctggaccccagacugagguat

SEQ ID NO: 11305 - DNA, 22 bp, Artificial Sequence
  Synthetic
acccacaucatccttggtucag

SEQ ID NO: 11306 - DNA, 20 bp, Artificial Sequence
  Synthetic
acccacccuagcaguagacc

SEQ ID NO: 11307 - DNA, 20 bp, Artificial Sequence
  Synthetic
tccccatuccctctcaccut

SEQ ID NO: 11308 - DNA, 23 bp, Artificial Sequence
  Synthetic
gttgtctgucctggtaacaguga

SEQ ID NO: 11309 - DNA, 20 bp, Artificial Sequence
  Synthetic
cttcggtacuccccctccut

SEQ ID NO: 11310 - DNA, 19 bp, Artificial Sequence
  Synthetic
cacgtugctcacucccaag

SEQ ID NO: 11311 - DNA, 20 bp, Artificial Sequence
  Synthetic
tcucaaggagcagggugagt

SEQ ID NO: 11312 - DNA, 28 bp, Artificial Sequence
  Synthetic
ctcgaaaugcaaggagatgataaaatug

SEQ ID NO: 11313 - DNA, 20 bp, Artificial Sequence
  Synthetic
ccactcccuctttgctcugg

SEQ ID NO: 11314 - DNA, 21 bp, Artificial Sequence
  Synthetic
tggacaagaggcugcaugaac

SEQ ID NO: 11315 - DNA, 21 bp, Artificial Sequence
  Synthetic
cagaagtccaaucccctcuga

SEQ ID NO: 11316 - DNA, 21 bp, Artificial Sequence
  Synthetic
gugagaagcatucccaaccct

SEQ ID NO: 11317 - DNA, 20 bp, Artificial Sequence
  Synthetic
cctgugggacacagccatuc

SEQ ID NO: 11318 - DNA, 22 bp, Artificial Sequence
  Synthetic
ccacagcccaguttttctcuga

SEQ ID NO: 11319 - DNA, 23 bp, Artificial Sequence
  Synthetic
ccagcacacaacaugaactcugt

SEQ ID NO: 11320 - DNA, 20 bp, Artificial Sequence
  Synthetic
ggaucaaggacaccaucgca

SEQ ID NO: 11321 - DNA, 21 bp, Artificial Sequence
  Synthetic
gucagtaggacucaggaggct

SEQ ID NO: 11322 - DNA, 21 bp, Artificial Sequence
  Synthetic
tcgctcaagucaaacagguca

SEQ ID NO: 11323 - DNA, 17 bp, Artificial Sequence
  Synthetic
cgacagccccucctcuc

SEQ ID NO: 11324 - DNA, 22 bp, Artificial Sequence
  Synthetic
gatcaccucgtccttggugaag

SEQ ID NO: 11325 - DNA, 17 bp, Artificial Sequence
  Synthetic
cagcugcccacuagcca

SEQ ID NO: 11326 - DNA, 17 bp, Artificial Sequence
  Synthetic
gcttugcagcggctgug

SEQ ID NO: 11327 - DNA, 17 bp, Artificial Sequence
  Synthetic
tcgucgcccagctucag

SEQ ID NO: 11328 - DNA, 19 bp, Artificial Sequence
  Synthetic
cucacaaggaggugaggct

SEQ ID NO: 11329 - DNA, 17 bp, Artificial Sequence
  Synthetic
ccgggaccuccgaucca

SEQ ID NO: 11330 - DNA, 20 bp, Artificial Sequence
  Synthetic
ccgaaaucgaguccgagacc

SEQ ID NO: 11331 - DNA, 19 bp, Artificial Sequence
  Synthetic
cutcgcaactugagagcgt

SEQ ID NO: 11332 - DNA, 19 bp, Artificial Sequence
  Synthetic
ggaaagugaggccggugaa

SEQ ID NO: 11333 - DNA, 17 bp, Artificial Sequence
  Synthetic
ccguagaggcagtugcg

SEQ ID NO: 11334 - DNA, 22 bp, Artificial Sequence
  Synthetic
ggtcuccagacccaacttucag

SEQ ID NO: 11335 - DNA, 19 bp, Artificial Sequence
  Synthetic
ccaggcugctccagtguag

SEQ ID NO: 11336 - DNA, 19 bp, Artificial Sequence
  Synthetic
tggcuccagaggaggcuac

SEQ ID NO: 11337 - DNA, 17 bp, Artificial Sequence
  Synthetic
gctgcugccgtcgacut

SEQ ID NO: 11338 - DNA, 19 bp, Artificial Sequence
  Synthetic
gauggaaggagccgcugat

SEQ ID NO: 11339 - DNA, 18 bp, Artificial Sequence
  Synthetic
tcccggagucgggatcut

SEQ ID NO: 11340 - DNA, 20 bp, Artificial Sequence
  Synthetic
gguttcagcaucggcgaaat

SEQ ID NO: 11341 - DNA, 24 bp, Artificial Sequence
  Synthetic
ggtacctucttgacctugagagag

SEQ ID NO: 11342 - DNA, 26 bp, Artificial Sequence
  Synthetic
gaaagcagtacucctaactgacaugg

SEQ ID NO: 11343 - DNA, 18 bp, Artificial Sequence
  Synthetic
cugggagggcgcuacaag

SEQ ID NO: 11344 - DNA, 21 bp, Artificial Sequence
  Synthetic
cactcagcaauagtggcccut

SEQ ID NO: 11345 - DNA, 21 bp, Artificial Sequence
  Synthetic
agattugggacattcguggct

SEQ ID NO: 11346 - DNA, 19 bp, Artificial Sequence
  Synthetic
ccttgucagcgggcatgua

SEQ ID NO: 11347 - DNA, 20 bp, Artificial Sequence
  Synthetic
ggtggcaagaagggugagug

SEQ ID NO: 11348 - DNA, 22 bp, Artificial Sequence
  Synthetic
gggtcgagguagagtuagacat

SEQ ID NO: 11349 - DNA, 20 bp, Artificial Sequence
  Synthetic
tgtcguccagctcugacaac

SEQ ID NO: 11350 - DNA, 18 bp, Artificial Sequence
  Synthetic
cgtgagcgccutttcgug

SEQ ID NO: 11351 - DNA, 19 bp, Artificial Sequence
  Synthetic
agcccuggcaccttcttug

SEQ ID NO: 11352 - DNA, 18 bp, Artificial Sequence
  Synthetic
agcaguccctccugggaa

SEQ ID NO: 11353 - DNA, 20 bp, Artificial Sequence
  Synthetic
accgctugccagaacaugat

SEQ ID NO: 11354 - DNA, 18 bp, Artificial Sequence
  Synthetic
cagacugcccccgaacug

SEQ ID NO: 11355 - DNA, 17 bp, Artificial Sequence
  Synthetic
tctgcccgcugactgug

SEQ ID NO: 11356 - DNA, 18 bp, Artificial Sequence
  Synthetic
gttgcagggacugguggt

SEQ ID NO: 11357 - DNA, 20 bp, Artificial Sequence
  Synthetic
aacggcgcuctggataauca

SEQ ID NO: 11358 - DNA, 19 bp, Artificial Sequence
  Synthetic
ggcgggcacgaautttguc

SEQ ID NO: 11359 - DNA, 19 bp, Artificial Sequence
  Synthetic
gcuccaggcacccgtuaat

SEQ ID NO: 11360 - DNA, 19 bp, Artificial Sequence
  Synthetic
gcgacccgcugcataauga

SEQ ID NO: 11361 - DNA, 20 bp, Artificial Sequence
  Synthetic
ccgatucccacagtcuggag

SEQ ID NO: 11362 - DNA, 19 bp, Artificial Sequence
  Synthetic
cgaagtugcccccaaagug

SEQ ID NO: 11363 - DNA, 18 bp, Artificial Sequence
  Synthetic
catggagcccuacggcut

SEQ ID NO: 11364 - DNA, 20 bp, Artificial Sequence
  Synthetic
gaggcatgutcacagcaguc

SEQ ID NO: 11365 - DNA, 20 bp, Artificial Sequence
  Synthetic
aggccaaaccugccgaauaa

SEQ ID NO: 11366 - DNA, 17 bp, Artificial Sequence
  Synthetic
gcaucggccgtcucagt

SEQ ID NO: 11367 - DNA, 18 bp, Artificial Sequence
  Synthetic
gggccacacguccatcuc

SEQ ID NO: 11368 - DNA, 20 bp, Artificial Sequence
  Synthetic
acttgacagugccctccauc

SEQ ID NO: 11369 - DNA, 20 bp, Artificial Sequence
  Synthetic
aaggtcacuggcccttctuc

SEQ ID NO: 11370 - DNA, 19 bp, Artificial Sequence
  Synthetic
gccctgucctcagcugaaa

SEQ ID NO: 11371 - DNA, 23 bp, Artificial Sequence
  Synthetic
agaagaagcugaagagcauggag

SEQ ID NO: 11372 - DNA, 18 bp, Artificial Sequence
  Synthetic
guagcaggaggccaugca

SEQ ID NO: 11373 - DNA, 17 bp, Artificial Sequence
  Synthetic
gccaagcugcggtugga

SEQ ID NO: 11374 - DNA, 21 bp, Artificial Sequence
  Synthetic
acagagccutggtctcctuct

SEQ ID NO: 11375 - DNA, 21 bp, Artificial Sequence
  Synthetic
gtagctcugagcctcatggug

SEQ ID NO: 11376 - DNA, 17 bp, Artificial Sequence
  Synthetic
cccagccugcagagucc

SEQ ID NO: 11377 - DNA, 19 bp, Artificial Sequence
  Synthetic
agaagcugagccugagcac

SEQ ID NO: 11378 - DNA, 18 bp, Artificial Sequence
  Synthetic
gggccacaacugctgcua

SEQ ID NO: 11379 - DNA, 21 bp, Artificial Sequence
  Synthetic
gagcugcaggtcaagtucaac

SEQ ID NO: 11380 - DNA, 17 bp, Artificial Sequence
  Synthetic
acggccugtgagtgcut

SEQ ID NO: 11381 - DNA, 17 bp, Artificial Sequence
  Synthetic
agcctcgcuccagcauc

SEQ ID NO: 11382 - DNA, 20 bp, Artificial Sequence
  Synthetic
tctttctuggccagcugcat

SEQ ID NO: 11383 - DNA, 17 bp, Artificial Sequence
  Synthetic
gggcuccccctgcatug

SEQ ID NO: 11384 - DNA, 22 bp, Artificial Sequence
  Synthetic
agttctggucctccaggaugat

SEQ ID NO: 11385 - DNA, 21 bp, Artificial Sequence
  Synthetic
ctgctgtccutaccgtgtcuc

SEQ ID NO: 11386 - DNA, 18 bp, Artificial Sequence
  Synthetic
catgccgugccuaccgat

SEQ ID NO: 11387 - DNA, 22 bp, Artificial Sequence
  Synthetic
ggugaaggucagagagaagcag

SEQ ID NO: 11388 - DNA, 20 bp, Artificial Sequence
  Synthetic
aggagtatcucccgggacuc

SEQ ID NO: 11389 - DNA, 22 bp, Artificial Sequence
  Synthetic
attggccagagcaaaguctuct

SEQ ID NO: 11390 - DNA, 20 bp, Artificial Sequence
  Synthetic
ccuggaagaccaccctgtug

SEQ ID NO: 11391 - DNA, 19 bp, Artificial Sequence
  Synthetic
cgacugttcuaggcacgga

SEQ ID NO: 11392 - DNA, 21 bp, Artificial Sequence
  Synthetic
cutccacagcuccgagacaaa

SEQ ID NO: 11393 - DNA, 20 bp, Artificial Sequence
  Synthetic
gcttgtgacucctgcctcuc

SEQ ID NO: 11394 - DNA, 21 bp, Artificial Sequence
  Synthetic
gatgaagtuccactcgaugcc

SEQ ID NO: 11395 - DNA, 22 bp, Artificial Sequence
  Synthetic
gttggcgtcuctctgacatugt

SEQ ID NO: 11396 - DNA, 23 bp, Artificial Sequence
  Synthetic
attcctctggugaaatcggucac

SEQ ID NO: 11397 - DNA, 23 bp, Artificial Sequence
  Synthetic
agucaaguagagggacttatuct

SEQ ID NO: 11398 - DNA, 19 bp, Artificial Sequence
  Synthetic
ggcugcaggccaactacuc

SEQ ID NO: 11399 - DNA, 26 bp, Artificial Sequence
  Synthetic
gcttgtgtugctccttaatattugca

SEQ ID NO: 11400 - DNA, 20 bp, Artificial Sequence
  Synthetic
tccttctugctcttgugcga

SEQ ID NO: 11401 - DNA, 21 bp, Artificial Sequence
  Synthetic
caaggactuggccatgccuaa

SEQ ID NO: 11402 - DNA, 20 bp, Artificial Sequence
  Synthetic
cgugagggtgaugggaagac

SEQ ID NO: 11403 - DNA, 19 bp, Artificial Sequence
  Synthetic
gctcacgugccucaacgaa

SEQ ID NO: 11404 - DNA, 20 bp, Artificial Sequence
  Synthetic
tgutctagccucccagggaa

SEQ ID NO: 11405 - DNA, 22 bp, Artificial Sequence
  Synthetic
gcactgggautcctgcttguag

SEQ ID NO: 11406 - DNA, 18 bp, Artificial Sequence
  Synthetic
gctgcucagcatcuggct

SEQ ID NO: 11407 - DNA, 17 bp, Artificial Sequence
  Synthetic
acccuccctcccuggac

SEQ ID NO: 11408 - DNA, 17 bp, Artificial Sequence
  Synthetic
ttcgccugccccctaut

SEQ ID NO: 11409 - DNA, 21 bp, Artificial Sequence
  Synthetic
tgcugaagaaggaaccaccug

SEQ ID NO: 11410 - DNA, 20 bp, Artificial Sequence
  Synthetic
ggugcaacccccttgaugag

SEQ ID NO: 11411 - DNA, 22 bp, Artificial Sequence
  Synthetic
ccacatagacccutgtgctgug

SEQ ID NO: 11412 - DNA, 22 bp, Artificial Sequence
  Synthetic
gcttgtcuttctccugcagcat

SEQ ID NO: 11413 - DNA, 23 bp, Artificial Sequence
  Synthetic
gagatggugacatcacctcugac

SEQ ID NO: 11414 - DNA, 19 bp, Artificial Sequence
  Synthetic
cugggaaggcuaccaccac

SEQ ID NO: 11415 - DNA, 21 bp, Artificial Sequence
  Synthetic
ggagcugaagttgcgaucact

SEQ ID NO: 11416 - DNA, 18 bp, Artificial Sequence
  Synthetic
caccagaccuggcaccug

SEQ ID NO: 11417 - DNA, 19 bp, Artificial Sequence
  Synthetic
ctcttccuccagcugcaga

SEQ ID NO: 11418 - DNA, 22 bp, Artificial Sequence
  Synthetic
gggatagtggutccattgguga

SEQ ID NO: 11419 - DNA, 22 bp, Artificial Sequence
  Synthetic
gccatgtccucacttcccttut

SEQ ID NO: 11420 - DNA, 23 bp, Artificial Sequence
  Synthetic
ggcctctgugcaatcttctcaut

SEQ ID NO: 11421 - DNA, 23 bp, Artificial Sequence
  Synthetic
gcagaaccacguccactcataua

SEQ ID NO: 11422 - DNA, 20 bp, Artificial Sequence
  Synthetic
aggaggcggcgauaaagtug

SEQ ID NO: 11423 - DNA, 21 bp, Artificial Sequence
  Synthetic
cgacacuccgcaggattucat

SEQ ID NO: 11424 - DNA, 27 bp, Artificial Sequence
  Synthetic
aatggaggcuatatgcattatctuggg

SEQ ID NO: 11425 - DNA, 24 bp, Artificial Sequence
  Synthetic
cagactccacutttccttcagcut

SEQ ID NO: 11426 - DNA, 27 bp, Artificial Sequence
  Synthetic
acagaagtutcaatgtacuaccaagca

SEQ ID NO: 11427 - DNA, 26 bp, Artificial Sequence
  Synthetic
tcgacaaaagcugggatcaacauaaa

SEQ ID NO: 11428 - DNA, 28 bp, Artificial Sequence
  Synthetic
aagaagcttaugaacaactttugcagac

SEQ ID NO: 11429 - DNA, 22 bp, Artificial Sequence
  Synthetic
gagccacatauttgccacacuc

SEQ ID NO: 11430 - DNA, 28 bp, Artificial Sequence
  Synthetic
ccaagcagttctuctgagttgacttaut

SEQ ID NO: 11431 - DNA, 21 bp, Artificial Sequence
  Synthetic
agagtgccuaggtccauccag

SEQ ID NO: 11432 - DNA, 20 bp, Artificial Sequence
  Synthetic
ggcguggagcctaccaatuc

SEQ ID NO: 11433 - DNA, 24 bp, Artificial Sequence
  Synthetic
actaaaagccucctgtgcttagua

SEQ ID NO: 11434 - DNA, 27 bp, Artificial Sequence
  Synthetic
tcutccctatagatuacacaaccagca

SEQ ID NO: 11435 - DNA, 23 bp, Artificial Sequence
  Synthetic
ctggccagagacugagtttguag

SEQ ID NO: 11436 - DNA, 20 bp, Artificial Sequence
  Synthetic
gggctucacaaaggucagag

SEQ ID NO: 11437 - DNA, 24 bp, Artificial Sequence
  Synthetic
cccctgtgutactgaattgcuagg

SEQ ID NO: 11438 - DNA, 24 bp, Artificial Sequence
  Synthetic
ccttgttgaugggaaaagccaaua

SEQ ID NO: 11439 - DNA, 24 bp, Artificial Sequence
  Synthetic
gattttggagaaggugttgctgut

SEQ ID NO: 11440 - DNA, 21 bp, Artificial Sequence
  Synthetic
ccuccctugccaaaggacaag

SEQ ID NO: 11441 - DNA, 25 bp, Artificial Sequence
  Synthetic
tgtaatgtttccuaaagggcaucca

SEQ ID NO: 11442 - DNA, 21 bp, Artificial Sequence
  Synthetic
gtgaggacacagutgtugcag

SEQ ID NO: 11443 - DNA, 26 bp, Artificial Sequence
  Synthetic
actctcaatgautcctggaaugagga

SEQ ID NO: 11444 - DNA, 28 bp, Artificial Sequence
  Synthetic
gtaaactuccacaggtatttguagcaga

SEQ ID NO: 11445 - DNA, 23 bp, Artificial Sequence
  Synthetic
actgtgttcaugcccaatauggt

SEQ ID NO: 11446 - DNA, 29 bp, Artificial Sequence
  Synthetic
cttccagtcttacuaggagcttcttaaug

SEQ ID NO: 11447 - DNA, 22 bp, Artificial Sequence
  Synthetic
ccaaatcuccaggtcgcugaat

SEQ ID NO: 11448 - DNA, 22 bp, Artificial Sequence
  Synthetic
gtggaacgguacgaauggaaca

SEQ ID NO: 11449 - DNA, 23 bp, Artificial Sequence
  Synthetic
acucuccaaaaagagagggacua

SEQ ID NO: 11450 - DNA, 28 bp, Artificial Sequence
  Synthetic
tgatctgctutttgtcactaaugagagt

SEQ ID NO: 11451 - DNA, 25 bp, Artificial Sequence
  Synthetic
caggtcctccautttgtactgtuct

SEQ ID NO: 11452 - DNA, 24 bp, Artificial Sequence
  Synthetic
ggtggaaggauttctgtgtcugag

SEQ ID NO: 11453 - DNA, 21 bp, Artificial Sequence
  Synthetic
ctgautctggtguggaggaca

SEQ ID NO: 11454 - DNA, 17 bp, Artificial Sequence
  Synthetic
cugggccuacggcaaga

SEQ ID NO: 11455 - DNA, 18 bp, Artificial Sequence
  Synthetic
tcaggagguctgggcuca

SEQ ID NO: 11456 - DNA, 21 bp, Artificial Sequence
  Synthetic
acaggccacuacctaugcaac

SEQ ID NO: 11457 - DNA, 27 bp, Artificial Sequence
  Synthetic
tataatgggaagaugtggcttcttgua

SEQ ID NO: 11458 - DNA, 23 bp, Artificial Sequence
  Synthetic
catgcggaaggauggtatucaga

SEQ ID NO: 11459 - DNA, 19 bp, Artificial Sequence
  Synthetic
cccacaautcccgcuaccg

SEQ ID NO: 11460 - DNA, 20 bp, Artificial Sequence
  Synthetic
gaggagagucccccagttug

SEQ ID NO: 11461 - DNA, 19 bp, Artificial Sequence
  Synthetic
cctggagucttcccuccct

SEQ ID NO: 11462 - DNA, 18 bp, Artificial Sequence
  Synthetic
ggcctgaaguggtcccut

SEQ ID NO: 11463 - DNA, 18 bp, Artificial Sequence
  Synthetic
ccagaggcugaggagguc

SEQ ID NO: 11464 - DNA, 22 bp, Artificial Sequence
  Synthetic
tgccatatgcugtggttcucat

SEQ ID NO: 11465 - DNA, 21 bp, Artificial Sequence
  Synthetic
gcttgttccugcaacctccua

SEQ ID NO: 11466 - DNA, 25 bp, Artificial Sequence
  Synthetic
ccaaaagagcagucacatctucaga

SEQ ID NO: 11467 - DNA, 19 bp, Artificial Sequence
  Synthetic
ggagaccaucctggcacug

SEQ ID NO: 11468 - DNA, 25 bp, Artificial Sequence
  Synthetic
agctcagacacuctatcaucaccaa

SEQ ID NO: 11469 - DNA, 20 bp, Artificial Sequence
  Synthetic
ggtggauggagaaggagcug

SEQ ID NO: 11470 - DNA, 24 bp, Artificial Sequence
  Synthetic
cacatcccagugtatatgccauct

SEQ ID NO: 11471 - DNA, 22 bp, Artificial Sequence
  Synthetic
ggaaaacauccctgttcaccug

SEQ ID NO: 11472 - DNA, 20 bp, Artificial Sequence
  Synthetic
gaccaacagucctcgcauga

SEQ ID NO: 11473 - DNA, 21 bp, Artificial Sequence
  Synthetic
ctactgcaguccctgtuggag

SEQ ID NO: 11474 - DNA, 23 bp, Artificial Sequence
  Synthetic
actcaggcagutctttagtugct

SEQ ID NO: 11475 - DNA, 23 bp, Artificial Sequence
  Synthetic
ccccttccuctgcctctatucaa

SEQ ID NO: 11476 - DNA, 23 bp, Artificial Sequence
  Synthetic
gctgauaggaaacacguagtcut

SEQ ID NO: 11477 - DNA, 22 bp, Artificial Sequence
  Synthetic
tggctgagauggaggatttugc

SEQ ID NO: 11478 - DNA, 23 bp, Artificial Sequence
  Synthetic
ccaccaucacaaaggacaucact

SEQ ID NO: 11479 - DNA, 24 bp, Artificial Sequence
  Synthetic
gtgatgaagaagcugacaccugaa

SEQ ID NO: 11480 - DNA, 25 bp, Artificial Sequence
  Synthetic
gacacguaaccatgaatcauccact

SEQ ID NO: 11481 - DNA, 24 bp, Artificial Sequence
  Synthetic
aggagttcuggaggctggtaaaua

SEQ ID NO: 11482 - DNA, 23 bp, Artificial Sequence
  Synthetic
ggtagttgtcaucacagccauca

SEQ ID NO: 11483 - DNA, 26 bp, Artificial Sequence
  Synthetic
actagcctauacagggctgtaaauca

SEQ ID NO: 11484 - DNA, 22 bp, Artificial Sequence
  Synthetic
cctgccccauagatctguagct

SEQ ID NO: 11485 - DNA, 25 bp, Artificial Sequence
  Synthetic
agcatgagaucaggtgatatguagt

SEQ ID NO: 11486 - DNA, 21 bp, Artificial Sequence
  Synthetic
gagcguagcaaggagccaaua

SEQ ID NO: 11487 - DNA, 25 bp, Artificial Sequence
  Synthetic
ccctcacauataaatacacguggca

SEQ ID NO: 11488 - DNA, 22 bp, Artificial Sequence
  Synthetic
gctggctaucctactgctucat

SEQ ID NO: 11489 - DNA, 20 bp, Artificial Sequence
  Synthetic
gagtuccgagaccctctugg

SEQ ID NO: 11490 - DNA, 23 bp, Artificial Sequence
  Synthetic
cccgacagucctagctaaactuc

SEQ ID NO: 11491 - DNA, 20 bp, Artificial Sequence
  Synthetic
agccaucagcaaagggcuat

SEQ ID NO: 11492 - DNA, 25 bp, Artificial Sequence
  Synthetic
acagccacuccattaccctuaaaac

SEQ ID NO: 11493 - DNA, 22 bp, Artificial Sequence
  Synthetic
gcgctgagugatgtcctgaauc

SEQ ID NO: 11494 - DNA, 25 bp, Artificial Sequence
  Synthetic
gtaagcaggcuttctatctcctugg

SEQ ID NO: 11495 - DNA, 23 bp, Artificial Sequence
  Synthetic
agctctgagccuttcttgttcut

SEQ ID NO: 11496 - DNA, 22 bp, Artificial Sequence
  Synthetic
gcggatuaacaagcggatctug

SEQ ID NO: 11497 - DNA, 21 bp, Artificial Sequence
  Synthetic
cacatcagtgugcagcaccua

SEQ ID NO: 11498 - DNA, 21 bp, Artificial Sequence
  Synthetic
gcuctggaactugagcaggaa

SEQ ID NO: 11499 - DNA, 21 bp, Artificial Sequence
  Synthetic
ccataaucccagcccacccua

SEQ ID NO: 11500 - DNA, 24 bp, Artificial Sequence
  Synthetic
gaagagaagggaaguctggucaaa

SEQ ID NO: 11501 - DNA, 24 bp, Artificial Sequence
  Synthetic
atggatcatgucattggcagtcut

SEQ ID NO: 11502 - DNA, 22 bp, Artificial Sequence
  Synthetic
aggtccaacuccacgtauggat

SEQ ID NO: 11503 - DNA, 21 bp, Artificial Sequence
  Synthetic
gctggtuagcgatctctgguc

SEQ ID NO: 11504 - DNA, 24 bp, Artificial Sequence
  Synthetic
gggaaaucagtcataugcagaact

SEQ ID NO: 11505 - DNA, 21 bp, Artificial Sequence
  Synthetic
gctgtcacccutgtcctugaa

SEQ ID NO: 11506 - DNA, 20 bp, Artificial Sequence
  Synthetic
agaaaccauctgtgcugcca

SEQ ID NO: 11507 - DNA, 22 bp, Artificial Sequence
  Synthetic
gacggaagguggtccacatauc

SEQ ID NO: 11508 - DNA, 18 bp, Artificial Sequence
  Synthetic
gtgcttcuccagcuccca

SEQ ID NO: 11509 - DNA, 17 bp, Artificial Sequence
  Synthetic
gcccguggccagctuac

SEQ ID NO: 11510 - DNA, 23 bp, Artificial Sequence
  Synthetic
ttggtgggaauctggatgauaga

SEQ ID NO: 11511 - DNA, 22 bp, Artificial Sequence
  Synthetic
gtagataugaacacgccuggct

SEQ ID NO: 11512 - DNA, 21 bp, Artificial Sequence
  Synthetic
ggaatgaacgutcccgaggut

SEQ ID NO: 11513 - DNA, 27 bp, Artificial Sequence
  Synthetic
agtgttatacugaggctatggguagac

SEQ ID NO: 11514 - DNA, 25 bp, Artificial Sequence
  Synthetic
cccttcatuttcagctcauggagat

SEQ ID NO: 11515 - DNA, 22 bp, Artificial Sequence
  Synthetic
gcttgtggucagtctgactgut

SEQ ID NO: 11516 - DNA, 25 bp, Artificial Sequence
  Synthetic
cttcggcuggataaggtttctucat

SEQ ID NO: 11517 - DNA, 23 bp, Artificial Sequence
  Synthetic
gattggcaagutatgtgcccaut

SEQ ID NO: 11518 - DNA, 22 bp, Artificial Sequence
  Synthetic
catgaccacautgcaguaaccg

SEQ ID NO: 11519 - DNA, 26 bp, Artificial Sequence
  Synthetic
aggctctgaaucttggaattgaagug

SEQ ID NO: 11520 - DNA, 24 bp, Artificial Sequence
  Synthetic
tgaacatggcautggtgtagtuct

SEQ ID NO: 11521 - DNA, 24 bp, Artificial Sequence
  Synthetic
atcaccacagcaauagagaaguct

SEQ ID NO: 11522 - DNA, 18 bp, Artificial Sequence
  Synthetic
gggcugcagtctcuggaa

SEQ ID NO: 11523 - DNA, 18 bp, Artificial Sequence
  Synthetic
tcccugcgaagcaggaug

SEQ ID NO: 11524 - DNA, 22 bp, Artificial Sequence
  Synthetic
gggtagagutgccacaugagag

SEQ ID NO: 11525 - DNA, 28 bp, Artificial Sequence
  Synthetic
ccagtctcaauattctgaagtcttuggt

SEQ ID NO: 11526 - DNA, 25 bp, Artificial Sequence
  Synthetic
aactttctcaccauggtttcagtut

SEQ ID NO: 11527 - DNA, 26 bp, Artificial Sequence
  Synthetic
tccttttctttcugccttcttaggug

SEQ ID NO: 11528 - DNA, 18 bp, Artificial Sequence
  Synthetic
ctcccguggatgcaccua

SEQ ID NO: 11529 - DNA, 30 bp, Artificial Sequence
  Synthetic
gtcaaaatttgaagcaugtttcaatacuct

SEQ ID NO: 11530 - DNA, 22 bp, Artificial Sequence
  Synthetic
aaagtgaucacccgggaagaug

SEQ ID NO: 11531 - DNA, 27 bp, Artificial Sequence
  Synthetic
ccctgatctgucttctgtttcucaaag

SEQ ID NO: 11532 - DNA, 19 bp, Artificial Sequence
  Synthetic
agcgcuacggagatuccct

SEQ ID NO: 11533 - DNA, 18 bp, Artificial Sequence
  Synthetic
cgccctcauccgggacua

SEQ ID NO: 11534 - DNA, 22 bp, Artificial Sequence
  Synthetic
acagaagugcacaatggtccut

SEQ ID NO: 11535 - DNA, 21 bp, Artificial Sequence
  Synthetic
gctgugccaggaacataugac

SEQ ID NO: 11536 - DNA, 30 bp, Artificial Sequence
  Synthetic
gaatatttctacagggutatgtccttucgt

SEQ ID NO: 11537 - DNA, 25 bp, Artificial Sequence
  Synthetic
gaagaggcatcucgtttgtacttug

SEQ ID NO: 11538 - DNA, 23 bp, Artificial Sequence
  Synthetic
ggttagaugagaaacugcccaga

SEQ ID NO: 11539 - DNA, 30 bp, Artificial Sequence
  Synthetic
atgctacatacugtgtctttttgaauacca

SEQ ID NO: 11540 - DNA, 17 bp, Artificial Sequence
  Synthetic
gggctgutctcggugct

SEQ ID NO: 11541 - DNA, 25 bp, Artificial Sequence
  Synthetic
cgatgagaagaagaaacugcgucat

SEQ ID NO: 11542 - DNA, 18 bp, Artificial Sequence
  Synthetic
acttgccccaggucagug

SEQ ID NO: 11543 - DNA, 23 bp, Artificial Sequence
  Synthetic
ctctctgtgccuttgtcctgtua

SEQ ID NO: 11544 - DNA, 23 bp, Artificial Sequence
  Synthetic
gagccaggutctcatgtctucat

SEQ ID NO: 11545 - DNA, 32 bp, Artificial Sequence
  Synthetic
ccacaaaaacaatguatcagaagacatatcua

SEQ ID NO: 11546 - DNA, 24 bp, Artificial Sequence
  Synthetic
agatctgggugcatgtaggtttut

SEQ ID NO: 11547 - DNA, 28 bp, Artificial Sequence
  Synthetic
tgctttctgtcuatgtgtgtgtgtauag

SEQ ID NO: 11548 - DNA, 24 bp, Artificial Sequence
  Synthetic
gtccttgttggugtccattttcut

SEQ ID NO: 11549 - DNA, 26 bp, Artificial Sequence
  Synthetic
taaacaatgtgaucccttcttctgug

SEQ ID NO: 11550 - DNA, 21 bp, Artificial Sequence
  Synthetic
gtcagccuccatcuggacaat

SEQ ID NO: 11551 - DNA, 23 bp, Artificial Sequence
  Synthetic
gctcaucagaagcatcgagtugg

SEQ ID NO: 11552 - DNA, 23 bp, Artificial Sequence
  Synthetic
cctttcccagucaccugaaacaa

SEQ ID NO: 11553 - DNA, 21 bp, Artificial Sequence
  Synthetic
ggatgcutaggaguggccaag

SEQ ID NO: 11554 - DNA, 22 bp, Artificial Sequence
  Synthetic
gtgaatgauccgggaggcauag

SEQ ID NO: 11555 - DNA, 22 bp, Artificial Sequence
  Synthetic
tcacgtctcutccttggagaut

SEQ ID NO: 11556 - DNA, 21 bp, Artificial Sequence
  Synthetic
ctgagccutcctugacccaaa

SEQ ID NO: 11557 - DNA, 24 bp, Artificial Sequence
  Synthetic
tggttgaccucttgtccattucag

SEQ ID NO: 11558 - DNA, 22 bp, Artificial Sequence
  Synthetic
caagggcuctgtgagugagaac

SEQ ID NO: 11559 - DNA, 23 bp, Artificial Sequence
  Synthetic
aagcacaaagugaacatuggcat

SEQ ID NO: 11560 - DNA, 21 bp, Artificial Sequence
  Synthetic
gggtctgucttgctcaaucag

SEQ ID NO: 11561 - DNA, 24 bp, Artificial Sequence
  Synthetic
ctttctgccacccuctttttcaut

SEQ ID NO: 11562 - DNA, 19 bp, Artificial Sequence
  Synthetic
ctggccaucacctcggtua

SEQ ID NO: 11563 - DNA, 21 bp, Artificial Sequence
  Synthetic
aacttgcaggccutgtttgug

SEQ ID NO: 11564 - DNA, 23 bp, Artificial Sequence
  Synthetic
ggatctcctugtgctcactgtuc

SEQ ID NO: 11565 - DNA, 22 bp, Artificial Sequence
  Synthetic
gcagaccuacctgtcuacagca

SEQ ID NO: 11566 - DNA, 21 bp, Artificial Sequence
  Synthetic
ccaagccucacgctgauacag

SEQ ID NO: 11567 - DNA, 23 bp, Artificial Sequence
  Synthetic
acagtctucacttgcaucagcat

SEQ ID NO: 11568 - DNA, 25 bp, Artificial Sequence
  Synthetic
atgggtaatgaugtcttccauggac

SEQ ID NO: 11569 - DNA, 25 bp, Artificial Sequence
  Synthetic
ccaaccctttauccttcctctcuca

SEQ ID NO: 11570 - DNA, 18 bp, Artificial Sequence
  Synthetic
gagccuggactccccuct

SEQ ID NO: 11571 - DNA, 23 bp, Artificial Sequence
  Synthetic
gaugagacctuggccaaagagaa

SEQ ID NO: 11572 - DNA, 21 bp, Artificial Sequence
  Synthetic
gctcctcccugtagacacuca

SEQ ID NO: 11573 - DNA, 23 bp, Artificial Sequence
  Synthetic
agttgtcauggaaatggcaucca

SEQ ID NO: 11574 - DNA, 22 bp, Artificial Sequence
  Synthetic
attuagcccacacaucccacaa

SEQ ID NO: 11575 - DNA, 21 bp, Artificial Sequence
  Synthetic
tctagcaatgugagcgtccug

SEQ ID NO: 11576 - DNA, 23 bp, Artificial Sequence
  Synthetic
ggtctgacccaaucttctgctut

SEQ ID NO: 11577 - DNA, 20 bp, Artificial Sequence
  Synthetic
cttgtcttucaggcccugct

SEQ ID NO: 11578 - DNA, 18 bp, Artificial Sequence
  Synthetic
ggaacacucacggcucct

SEQ ID NO: 11579 - DNA, 17 bp, Artificial Sequence
  Synthetic
cgacucaccccgtguct

SEQ ID NO: 11580 - DNA, 19 bp, Artificial Sequence
  Synthetic
gaggacgagugggaggtuc

SEQ ID NO: 11581 - DNA, 20 bp, Artificial Sequence
  Synthetic
agctgtccugggactcucat

SEQ ID NO: 11582 - DNA, 20 bp, Artificial Sequence
  Synthetic
aactugggccagcaactcut

SEQ ID NO: 11583 - DNA, 20 bp, Artificial Sequence
  Synthetic
tcactgguctgttccctugc

SEQ ID NO: 11584 - DNA, 21 bp, Artificial Sequence
  Synthetic
gcgccagaagccautaacuac

SEQ ID NO: 11585 - DNA, 23 bp, Artificial Sequence
  Synthetic
tgaatgggaagacauggactugc

SEQ ID NO: 11586 - DNA, 18 bp, Artificial Sequence
  Synthetic
accggcugcaatgcatuc

SEQ ID NO: 11587 - DNA, 26 bp, Artificial Sequence
  Synthetic
aaaagaattgcauacctcactggcua

SEQ ID NO: 11588 - DNA, 25 bp, Artificial Sequence
  Synthetic
ggaagttgtgautcttcctctuggt

SEQ ID NO: 11589 - DNA, 22 bp, Artificial Sequence
  Synthetic
gaggttcuggagagagatgcug

SEQ ID NO: 11590 - DNA, 24 bp, Artificial Sequence
  Synthetic
cacgccactuttccaaactgttua

SEQ ID NO: 11591 - DNA, 22 bp, Artificial Sequence
  Synthetic
gtcaggcautggctcttcucaa

SEQ ID NO: 11592 - DNA, 17 bp, Artificial Sequence
  Synthetic
gaggcugggagugcagt

SEQ ID NO: 11593 - DNA, 20 bp, Artificial Sequence
  Synthetic
caggaacuacgcctccauca

SEQ ID NO: 11594 - DNA, 22 bp, Artificial Sequence
  Synthetic
gtacgagtcguagtccatgucc

SEQ ID NO: 11595 - DNA, 17 bp, Artificial Sequence
  Synthetic
gcaggcugcaagcuggt

SEQ ID NO: 11596 - DNA, 22 bp, Artificial Sequence
  Synthetic
ccctgaagugtttcucccgaac

SEQ ID NO: 11597 - DNA, 21 bp, Artificial Sequence
  Synthetic
gctggagugggactcagcuaa

SEQ ID NO: 11598 - DNA, 22 bp, Artificial Sequence
  Synthetic
cagtatcaucaaggccaugggt

SEQ ID NO: 11599 - DNA, 23 bp, Artificial Sequence
  Synthetic
ccagtggagutcttgggatcuct

SEQ ID NO: 11600 - DNA, 20 bp, Artificial Sequence
  Synthetic
cagccuggcaactcctacug

SEQ ID NO: 11601 - DNA, 24 bp, Artificial Sequence
  Synthetic
cttttatctccuccccatcuccct

SEQ ID NO: 11602 - DNA, 25 bp, Artificial Sequence
  Synthetic
cttcaagtcacgaaaugacagcaut

SEQ ID NO: 11603 - DNA, 21 bp, Artificial Sequence
  Synthetic
gcacagggucagattcagugg

SEQ ID NO: 11604 - DNA, 20 bp, Artificial Sequence
  Synthetic
cgcgatcucgctaccgttua

SEQ ID NO: 11605 - DNA, 17 bp, Artificial Sequence
  Synthetic
gctgugcggctttggug

SEQ ID NO: 11606 - DNA, 21 bp, Artificial Sequence
  Synthetic
tgctttaauccagcgcctcuc

SEQ ID NO: 11607 - DNA, 23 bp, Artificial Sequence
  Synthetic
ctgcaatctucggtagtccauct

SEQ ID NO: 11608 - DNA, 30 bp, Artificial Sequence
  Synthetic
caaaaauaagcactttacuaacaacaggat

SEQ ID NO: 11609 - DNA, 20 bp, Artificial Sequence
  Synthetic
ggccagcaagucctggauaa

SEQ ID NO: 11610 - DNA, 19 bp, Artificial Sequence
  Synthetic
gtggtacgguggtcacugg

SEQ ID NO: 11611 - DNA, 24 bp, Artificial Sequence
  Synthetic
ttgaggctatauccacaggccuat

SEQ ID NO: 11612 - DNA, 17 bp, Artificial Sequence
  Synthetic
cttgcggcuggccttuc

SEQ ID NO: 11613 - DNA, 18 bp, Artificial Sequence
  Synthetic
tggccccuaaagcccuct

SEQ ID NO: 11614 - DNA, 21 bp, Artificial Sequence
  Synthetic
ccttugcagacaccccugaag

SEQ ID NO: 11615 - DNA, 22 bp, Artificial Sequence
  Synthetic
ctaactcttuggcccctctgug

SEQ ID NO: 11616 - DNA, 23 bp, Artificial Sequence
  Synthetic
ccccaaaguagaggctctcauct

SEQ ID NO: 11617 - DNA, 19 bp, Artificial Sequence
  Synthetic
cagugtcctcaugccaacc

SEQ ID NO: 11618 - DNA, 22 bp, Artificial Sequence
  Synthetic
tgggccacaaccuagttcctua

SEQ ID NO: 11619 - DNA, 22 bp, Artificial Sequence
  Synthetic
gctttggcugggtctttttgut

SEQ ID NO: 11620 - DNA, 22 bp, Artificial Sequence
  Synthetic
atgagtuggcacccactgtuaa

SEQ ID NO: 11621 - DNA, 23 bp, Artificial Sequence
  Synthetic
ggcuggaggaaaaagugaaaacc

SEQ ID NO: 11622 - DNA, 18 bp, Artificial Sequence
  Synthetic
ggtgatgugcccgtugct

SEQ ID NO: 11623 - DNA, 21 bp, Artificial Sequence
  Synthetic
cagagcaugaccctgaaccug

SEQ ID NO: 11624 - DNA, 17 bp, Artificial Sequence
  Synthetic
ctcaccagcucgcucca

SEQ ID NO: 11625 - DNA, 17 bp, Artificial Sequence
  Synthetic
cugcggacuccgaggaa

SEQ ID NO: 11626 - DNA, 20 bp, Artificial Sequence
  Synthetic
ccagccgggaaagutcttug

SEQ ID NO: 11627 - DNA, 17 bp, Artificial Sequence
  Synthetic
ctcccgggcuggtgtut

SEQ ID NO: 11628 - DNA, 26 bp, Artificial Sequence
  Synthetic
cagugacttttuggacagaacacaaa

SEQ ID NO: 11629 - DNA, 27 bp, Artificial Sequence
  Synthetic
ggacaagcttucagaaccttatugaag

SEQ ID NO: 11630 - DNA, 21 bp, Artificial Sequence
  Synthetic
tgacguggcccatagauacct

SEQ ID NO: 11631 - DNA, 25 bp, Artificial Sequence
  Synthetic
ttgttccugaaaatgauaggcccaa

SEQ ID NO: 11632 - DNA, 27 bp, Artificial Sequence
  Synthetic
ccttatcggttucaattgctttggtua

SEQ ID NO: 11633 - DNA, 28 bp, Artificial Sequence
  Synthetic
gactttagcaaugtgcttgactttuact

SEQ ID NO: 11634 - DNA, 30 bp, Artificial Sequence
  Synthetic
ggttccttaagauctcgatttccttttuca

SEQ ID NO: 11635 - DNA, 21 bp, Artificial Sequence
  Synthetic
acagcacaugcatcttuccct

SEQ ID NO: 11636 - DNA, 20 bp, Artificial Sequence
  Synthetic
caccugaaagccctcactug

SEQ ID NO: 11637 - DNA, 22 bp, Artificial Sequence
  Synthetic
ggactccaagaaccugagtgug

SEQ ID NO: 11638 - DNA, 21 bp, Artificial Sequence
  Synthetic
ctggtttcuggtgggaccaut

SEQ ID NO: 11639 - DNA, 23 bp, Artificial Sequence
  Synthetic
gauctcttcaugcaccggaaaag

SEQ ID NO: 11640 - DNA, 24 bp, Artificial Sequence
  Synthetic
cttcagaagtuccttcgtcaucct

SEQ ID NO: 11641 - DNA, 23 bp, Artificial Sequence
  Synthetic
catgttcccautgaggacccaut

SEQ ID NO: 11642 - DNA, 20 bp, Artificial Sequence
  Synthetic
ccgaaccgugcagactguag

SEQ ID NO: 11643 - DNA, 22 bp, Artificial Sequence
  Synthetic
cccatgccugaccccatttuaa

SEQ ID NO: 11644 - DNA, 23 bp, Artificial Sequence
  Synthetic
gaactcagcaautctccctcuca

SEQ ID NO: 11645 - DNA, 21 bp, Artificial Sequence
  Synthetic
acaagauccgggaagagugga

SEQ ID NO: 11646 - DNA, 27 bp, Artificial Sequence
  Synthetic
caccgtaatgutttgtcaaagttucca

SEQ ID NO: 11647 - DNA, 24 bp, Artificial Sequence
  Synthetic
caucagauagaggaaccttcucac

SEQ ID NO: 11648 - DNA, 22 bp, Artificial Sequence
  Synthetic
catcccacaaacuccagctuct

SEQ ID NO: 11649 - DNA, 22 bp, Artificial Sequence
  Synthetic
ccaacgacaaugagcagucagt

SEQ ID NO: 11650 - DNA, 25 bp, Artificial Sequence
  Synthetic
agatcttcugaactagtgtgtuggt

SEQ ID NO: 11651 - DNA, 24 bp, Artificial Sequence
  Synthetic
gaucttctatctgucggacaggga

SEQ ID NO: 11652 - DNA, 20 bp, Artificial Sequence
  Synthetic
gcaggaugggagggaaagug

SEQ ID NO: 11653 - DNA, 21 bp, Artificial Sequence
  Synthetic
cucacctgucaggaacaccag

SEQ ID NO: 11654 - DNA, 23 bp, Artificial Sequence
  Synthetic
cccatctaugaccccatgatcuc

SEQ ID NO: 11655 - DNA, 20 bp, Artificial Sequence
  Synthetic
caccacccuctccttagcuc

SEQ ID NO: 11656 - DNA, 26 bp, Artificial Sequence
  Synthetic
cccccatcucacatacatacattuca

SEQ ID NO: 11657 - DNA, 22 bp, Artificial Sequence
  Synthetic
tttgctgctcucaccacttcut

SEQ ID NO: 11658 - DNA, 21 bp, Artificial Sequence
  Synthetic
ttggctgugttctguaccaac

SEQ ID NO: 11659 - DNA, 28 bp, Artificial Sequence
  Synthetic
gcctcatctgugacattgaaaaagaauc

SEQ ID NO: 11660 - DNA, 22 bp, Artificial Sequence
  Synthetic
tctgtgcuatggctugaaggag

SEQ ID NO: 11661 - DNA, 25 bp, Artificial Sequence
  Synthetic
atgtatttccucccctaccctguaa

SEQ ID NO: 11662 - DNA, 25 bp, Artificial Sequence
  Synthetic
acaactgatgtcutacttgtggcug

SEQ ID NO: 11663 - DNA, 23 bp, Artificial Sequence
  Synthetic
caaatatgugcaccttcccucct

SEQ ID NO: 11664 - DNA, 20 bp, Artificial Sequence
  Synthetic
agctacttuggccgaagugt

SEQ ID NO: 11665 - DNA, 18 bp, Artificial Sequence
  Synthetic
ctguccaccaccaccuga

SEQ ID NO: 11666 - DNA, 22 bp, Artificial Sequence
  Synthetic
gcatcactggaugaatggacug

SEQ ID NO: 11667 - DNA, 22 bp, Artificial Sequence
  Synthetic
gccctgaugctaagcagtuact

SEQ ID NO: 11668 - DNA, 28 bp, Artificial Sequence
  Synthetic
guatctacaactcuggagaacagaaagg

SEQ ID NO: 11669 - DNA, 21 bp, Artificial Sequence
  Synthetic
ctgaggccaauaccccaauct

SEQ ID NO: 11670 - DNA, 24 bp, Artificial Sequence
  Synthetic
gtgttatggcugtgaccatguact

SEQ ID NO: 11671 - DNA, 23 bp, Artificial Sequence
  Synthetic
ccacautctcctcaugccaagac

SEQ ID NO: 11672 - DNA, 30 bp, Artificial Sequence
  Synthetic
aatggctcatttuaaatgtcttcctaucca

SEQ ID NO: 11673 - DNA, 20 bp, Artificial Sequence
  Synthetic
tcacagcuctcagacucggt

SEQ ID NO: 11674 - DNA, 30 bp, Artificial Sequence
  Synthetic
aattcctttttaccaguatgtggagtauct

SEQ ID NO: 11675 - DNA, 23 bp, Artificial Sequence
  Synthetic
augggcatccuccagaaaagaaa

SEQ ID NO: 11676 - DNA, 24 bp, Artificial Sequence
  Synthetic
cttcctttccacucctttcccaut

SEQ ID NO: 11677 - DNA, 27 bp, Artificial Sequence
  Synthetic
gcttgaaccatutactttgtgactuga

SEQ ID NO: 11678 - DNA, 28 bp, Artificial Sequence
  Synthetic
aatttgaggutatctgcuacgaaacagt

SEQ ID NO: 11679 - DNA, 28 bp, Artificial Sequence
  Synthetic
tcctcctgttutatacctctaacuaccc

SEQ ID NO: 11680 - DNA, 28 bp, Artificial Sequence
  Synthetic
gaacggcataagucctattttagcctua

SEQ ID NO: 11681 - DNA, 25 bp, Artificial Sequence
  Synthetic
gggacaagatgucgagtcagaauat

SEQ ID NO: 11682 - DNA, 23 bp, Artificial Sequence
  Synthetic
cttccaagcuctttgggtttucc

SEQ ID NO: 11683 - DNA, 20 bp, Artificial Sequence
  Synthetic
tgagcgaguaccccaccuac

SEQ ID NO: 11684 - DNA, 27 bp, Artificial Sequence
  Synthetic
tctgagatcgucaggttataucgagag

SEQ ID NO: 11685 - DNA, 21 bp, Artificial Sequence
  Synthetic
ctgaagugcccatttcccugt

SEQ ID NO: 11686 - DNA, 21 bp, Artificial Sequence
  Synthetic
gagagtacgcugctggtcaua

SEQ ID NO: 11687 - DNA, 23 bp, Artificial Sequence
  Synthetic
ccuaaacccguaacagttgtuac

SEQ ID NO: 11688 - DNA, 27 bp, Artificial Sequence
  Synthetic
gcatatgcaugagaagaatuagaaagc

SEQ ID NO: 11689 - DNA, 28 bp, Artificial Sequence
  Synthetic
ggaaagaucagctctaaggaugaagaaa

SEQ ID NO: 11690 - DNA, 24 bp, Artificial Sequence
  Synthetic
ggaacagctucctagaagggaauc

SEQ ID NO: 11691 - DNA, 28 bp, Artificial Sequence
  Synthetic
ttccagggattautatgtgtttctgugt

SEQ ID NO: 11692 - DNA, 23 bp, Artificial Sequence
  Synthetic
ccccacccutaattugaggaagt

SEQ ID NO: 11693 - DNA, 21 bp, Artificial Sequence
  Synthetic
ccaucagacagagccaugcag

SEQ ID NO: 11694 - DNA, 22 bp, Artificial Sequence
  Synthetic
gactgtgcutgtggatgtuacc

SEQ ID NO: 11695 - DNA, 20 bp, Artificial Sequence
  Synthetic
gucagacaccccactucact

SEQ ID NO: 11696 - DNA, 27 bp, Artificial Sequence
  Synthetic
gcagtcaatttcuctttccttcttcug

SEQ ID NO: 11697 - DNA, 25 bp, Artificial Sequence
  Synthetic
aaggagauagcaggaatgcttugaa

SEQ ID NO: 11698 - DNA, 23 bp, Artificial Sequence
  Synthetic
ggaugaaauggacaacagggact

SEQ ID NO: 11699 - DNA, 24 bp, Artificial Sequence
  Synthetic
atggctggcuctttactctcttuc

SEQ ID NO: 11700 - DNA, 19 bp, Artificial Sequence
  Synthetic
gccccaguggatcaacgug

SEQ ID NO: 11701 - DNA, 20 bp, Artificial Sequence
  Synthetic
cccgctgucattgttgtugg

SEQ ID NO: 11702 - DNA, 22 bp, Artificial Sequence
  Synthetic
cccaccgccuaatcctacuaac

SEQ ID NO: 11703 - DNA, 18 bp, Artificial Sequence
  Synthetic
tctcccuggctccagucc

SEQ ID NO: 11704 - DNA, 28 bp, Artificial Sequence
  Synthetic
cctttgtgtgaaugctaaatagggaaut

SEQ ID NO: 11705 - DNA, 21 bp, Artificial Sequence
  Synthetic
ggagagatccugcaagcacug

SEQ ID NO: 11706 - DNA, 24 bp, Artificial Sequence
  Synthetic
acggcaaaccacugatatctucat

SEQ ID NO: 11707 - DNA, 28 bp, Artificial Sequence
  Synthetic
tcaaagctgugatacagacugaagaaat

SEQ ID NO: 11708 - DNA, 24 bp, Artificial Sequence
  Synthetic
gatgaaacatcuaggctggaccut

SEQ ID NO: 11709 - DNA, 28 bp, Artificial Sequence
  Synthetic
gatttgtctgtaaaucagttgagccaut

SEQ ID NO: 11710 - DNA, 27 bp, Artificial Sequence
  Synthetic
tgtgagttttaaautgaagcagttguc

SEQ ID NO: 11711 - DNA, 26 bp, Artificial Sequence
  Synthetic
acttagagtccuccaggtcatcatut

SEQ ID NO: 11712 - DNA, 24 bp, Artificial Sequence
  Synthetic
ccacgtctgauatcactgccauac

SEQ ID NO: 11713 - DNA, 24 bp, Artificial Sequence
  Synthetic
agccaaauccaagaattccacuga

SEQ ID NO: 11714 - DNA, 30 bp, Artificial Sequence
  Synthetic
aagaaagagattcagcuggttattaaggut

SEQ ID NO: 11715 - DNA, 26 bp, Artificial Sequence
  Synthetic
agctaccttggautttgatgccuaag

SEQ ID NO: 11716 - DNA, 23 bp, Artificial Sequence
  Synthetic
gctgttcucaaacactgauccac

SEQ ID NO: 11717 - DNA, 26 bp, Artificial Sequence
  Synthetic
ggatcaacaagcugatgaatgaguct

SEQ ID NO: 11718 - DNA, 25 bp, Artificial Sequence
  Synthetic
gcttaccaucattggctugaaaaca

SEQ ID NO: 11719 - DNA, 27 bp, Artificial Sequence
  Synthetic
tctttactctgucattggtggtttuct

SEQ ID NO: 11720 - DNA, 23 bp, Artificial Sequence
  Synthetic
ccactttugcagcaacctttuct

SEQ ID NO: 11721 - DNA, 30 bp, Artificial Sequence
  Synthetic
tcaggaattuagtggttatgtucaacaagt

SEQ ID NO: 11722 - DNA, 27 bp, Artificial Sequence
  Synthetic
acttcttgucaaaaagtgaatgctugt

SEQ ID NO: 11723 - DNA, 28 bp, Artificial Sequence
  Synthetic
caattgaaatgtuaggaggtgaactugg

SEQ ID NO: 11724 - DNA, 28 bp, Artificial Sequence
  Synthetic
ggatcaagaccauaatcctggtttacut

SEQ ID NO: 11725 - DNA, 28 bp, Artificial Sequence
  Synthetic
gttttatgtauagcttttgcatcugcca

SEQ ID NO: 11726 - DNA, 17 bp, Artificial Sequence
  Synthetic
ccatucgagccgcgtuc

SEQ ID NO: 11727 - DNA, 23 bp, Artificial Sequence
  Synthetic
gaaattcuacccaagctcccuca

SEQ ID NO: 11728 - DNA, 21 bp, Artificial Sequence
  Synthetic
agcacccccgguatuaaaacg

SEQ ID NO: 11729 - DNA, 22 bp, Artificial Sequence
  Synthetic
agtcatctucgtccggguagaa

SEQ ID NO: 11730 - DNA, 19 bp, Artificial Sequence
  Synthetic
gagctgggucacggagaug

SEQ ID NO: 11731 - DNA, 18 bp, Artificial Sequence
  Synthetic
cgctccacaugcagucct

SEQ ID NO: 11732 - DNA, 26 bp, Artificial Sequence
  Synthetic
tggttctcacaugagagtaacuagca

SEQ ID NO: 11733 - DNA, 23 bp, Artificial Sequence
  Synthetic
agtgatggugaatgtggugacag

SEQ ID NO: 11734 - DNA, 21 bp, Artificial Sequence
  Synthetic
gucgcagaaaccacaacaucc

SEQ ID NO: 11735 - DNA, 22 bp, Artificial Sequence
  Synthetic
ggagggaguggacatacucagt

SEQ ID NO: 11736 - DNA, 19 bp, Artificial Sequence
  Synthetic
tgcgcutcttucagggcat

SEQ ID NO: 11737 - DNA, 21 bp, Artificial Sequence
  Synthetic
cggccccaugtacttgaucac

SEQ ID NO: 11738 - DNA, 24 bp, Artificial Sequence
  Synthetic
tgttaaaatguccgcagttgaugg

SEQ ID NO: 11739 - DNA, 26 bp, Artificial Sequence
  Synthetic
ggtaaaacacautcctttgguccaat

SEQ ID NO: 11740 - DNA, 30 bp, Artificial Sequence
  Synthetic
attcttaattttaggutgcagtttcaucac

SEQ ID NO: 11741 - DNA, 30 bp, Artificial Sequence
  Synthetic
tccaatttcatauactggctgaagucaaaa

SEQ ID NO: 11742 - DNA, 29 bp, Artificial Sequence
  Synthetic
ctgatttagtugagacttacgtgctuagt

SEQ ID NO: 11743 - DNA, 27 bp, Artificial Sequence
  Synthetic
atctgggaaucgacgaagtaaatctuc

SEQ ID NO: 11744 - DNA, 30 bp, Artificial Sequence
  Synthetic
ttataggattttgucactttgttctgttug

SEQ ID NO: 11745 - DNA, 26 bp, Artificial Sequence
  Synthetic
tgttgacugcatcttctttuccaagt

SEQ ID NO: 11746 - DNA, 29 bp, Artificial Sequence
  Synthetic
tggatgtttcauaggatactttggataug

SEQ ID NO: 11747 - DNA, 20 bp, Artificial Sequence
  Synthetic
aatggcatccugggcttcut

SEQ ID NO: 11748 - DNA, 30 bp, Artificial Sequence
  Synthetic
tagtagcagaaagaaguttaaaatctugct

SEQ ID NO: 11749 - DNA, 22 bp, Artificial Sequence
  Synthetic
acaatggacacutctgcugact

SEQ ID NO: 11750 - DNA, 27 bp, Artificial Sequence
  Synthetic
ttggccaatcagauaccaactgtuaat

SEQ ID NO: 11751 - DNA, 26 bp, Artificial Sequence
  Synthetic
aggcaatuactgatgattucaagggt

SEQ ID NO: 11752 - DNA, 32 bp, Artificial Sequence
  Synthetic
ctgaaatgucagaagaaaacatcacaauaaag

SEQ ID NO: 11753 - DNA, 32 bp, Artificial Sequence
  Synthetic
agcttatcaatatuaccttcattccattacug

SEQ ID NO: 11754 - DNA, 22 bp, Artificial Sequence
  Synthetic
auggaacattcauccgcgagaa

SEQ ID NO: 11755 - DNA, 22 bp, Artificial Sequence
  Synthetic
cacacacauggcagtagugact

SEQ ID NO: 11756 - DNA, 22 bp, Artificial Sequence
  Synthetic
gcgaaguagccgccaaauaaaa

SEQ ID NO: 11757 - DNA, 22 bp, Artificial Sequence
  Synthetic
caggcctucactctcactaucc

SEQ ID NO: 11758 - DNA, 23 bp, Artificial Sequence
  Synthetic
accccgatuttgatgcatcuaca

SEQ ID NO: 11759 - DNA, 27 bp, Artificial Sequence
  Synthetic
catgtgguacagctcataaaattuccc

SEQ ID NO: 11760 - DNA, 32 bp, Artificial Sequence
  Synthetic
gaactacagtaaguatcttcttagccucaaag

SEQ ID NO: 11761 - DNA, 25 bp, Artificial Sequence
  Synthetic
tgccactagagucctaaatcucgaa

SEQ ID NO: 11762 - DNA, 24 bp, Artificial Sequence
  Synthetic
gagaaaagtgaautggccctcuct

SEQ ID NO: 11763 - DNA, 25 bp, Artificial Sequence
  Synthetic
tgataggctutggtgaagauagcac

SEQ ID NO: 11764 - DNA, 24 bp, Artificial Sequence
  Synthetic
gcttccagaucttgagaggcuact

SEQ ID NO: 11765 - DNA, 27 bp, Artificial Sequence
  Synthetic
tcctuccagagcagaaagaaaaucaat

SEQ ID NO: 11766 - DNA, 23 bp, Artificial Sequence
  Synthetic
aacagagccucctggaataccua

SEQ ID NO: 11767 - DNA, 27 bp, Artificial Sequence
  Synthetic
tttacagcccutcttggtagattucaa

SEQ ID NO: 11768 - DNA, 22 bp, Artificial Sequence
  Synthetic
attctgtugccggaagauaccc

SEQ ID NO: 11769 - DNA, 24 bp, Artificial Sequence
  Synthetic
cacaataggcuttgccatttucct

SEQ ID NO: 11770 - DNA, 30 bp, Artificial Sequence
  Synthetic
aattcctttgagtuacttccttatgcauat

SEQ ID NO: 11771 - DNA, 32 bp, Artificial Sequence
  Synthetic
taatcttctactaaugaatggtagtgagtuga

SEQ ID NO: 11772 - DNA, 28 bp, Artificial Sequence
  Synthetic
ccagaggaagtuattcaaaagggacaua

SEQ ID NO: 11773 - DNA, 28 bp, Artificial Sequence
  Synthetic
tactgtttcttugaaacttaaggucagt

SEQ ID NO: 11774 - DNA, 19 bp, Artificial Sequence
  Synthetic
cucccccagucaaagagug

SEQ ID NO: 11775 - DNA, 18 bp, Artificial Sequence
  Synthetic
cgtgcggcgaugactuga

SEQ ID NO: 11776 - DNA, 19 bp, Artificial Sequence
  Synthetic
ctggcuaacggguggaaca

SEQ ID NO: 11777 - DNA, 21 bp, Artificial Sequence
  Synthetic
gggcgcauactcttagtccut

SEQ ID NO: 11778 - DNA, 25 bp, Artificial Sequence
  Synthetic
ccaagctcaaagauactgtctccug

SEQ ID NO: 11779 - DNA, 28 bp, Artificial Sequence
  Synthetic
aaacaattcacaaaauttgccaccatug

SEQ ID NO: 11780 - DNA, 18 bp, Artificial Sequence
  Synthetic
caugcaacgcgagctuct

SEQ ID NO: 11781 - DNA, 20 bp, Artificial Sequence
  Synthetic
ccctguggcaagatgccaut

SEQ ID NO: 11782 - DNA, 27 bp, Artificial Sequence
  Synthetic
gcagtatttcacuggaaaccccttaut

SEQ ID NO: 11783 - DNA, 21 bp, Artificial Sequence
  Synthetic
agttgaccgugggaaggaauc

SEQ ID NO: 11784 - DNA, 24 bp, Artificial Sequence
  Synthetic
aagccagccucaattgtctcaaua

SEQ ID NO: 11785 - DNA, 30 bp, Artificial Sequence
  Synthetic
tctataactaggaugattggagtgttgugt

SEQ ID NO: 11786 - DNA, 23 bp, Artificial Sequence
  Synthetic
gcctccctcugatttcatagcut

SEQ ID NO: 11787 - DNA, 24 bp, Artificial Sequence
  Synthetic
tttgggacaagcagaugatauccc

SEQ ID NO: 11788 - DNA, 28 bp, Artificial Sequence
  Synthetic
tggtgtgtaggutatctctactttucca

SEQ ID NO: 11789 - DNA, 24 bp, Artificial Sequence
  Synthetic
actgccctatutgtctaggtguct

SEQ ID NO: 11790 - DNA, 23 bp, Artificial Sequence
  Synthetic
cctttcugagtttgcuacacgga

SEQ ID NO: 11791 - DNA, 19 bp, Artificial Sequence
  Synthetic
gtggcggutctgtgguaga

SEQ ID NO: 11792 - DNA, 18 bp, Artificial Sequence
  Synthetic
ggcgggcagcutguagag

SEQ ID NO: 11793 - DNA, 18 bp, Artificial Sequence
  Synthetic
ctacgccuaccgctucga

SEQ ID NO: 11794 - DNA, 17 bp, Artificial Sequence
  Synthetic
cugtgcccugaccccaa

SEQ ID NO: 11795 - DNA, 24 bp, Artificial Sequence
  Synthetic
tcctgattcutttcttctgcugct

SEQ ID NO: 11796 - DNA, 26 bp, Artificial Sequence
  Synthetic
cuatttucagaaaucaggaagcaacc

SEQ ID NO: 11797 - DNA, 29 bp, Artificial Sequence
  Synthetic
tgactctctcccgutttaagaataatucc

SEQ ID NO: 11798 - DNA, 25 bp, Artificial Sequence
  Synthetic
cctggagtcutacattgaggaugaa

SEQ ID NO: 11799 - DNA, 23 bp, Artificial Sequence
  Synthetic
tttgaaacaacugtgctcuccct

SEQ ID NO: 11800 - DNA, 25 bp, Artificial Sequence
  Synthetic
caacataccucgactcattgucagt

SEQ ID NO: 11801 - DNA, 33 bp, Artificial Sequence
  Synthetic
aaaaatacaaccuccaaaagataugagaaacat

SEQ ID NO: 11802 - DNA, 27 bp, Artificial Sequence
  Synthetic
cagttcaguacaaagttgaggtaguga

SEQ ID NO: 11803 - DNA, 30 bp, Artificial Sequence
  Synthetic
gctgttacggaaugaagaatgaactttaut

SEQ ID NO: 11804 - DNA, 27 bp, Artificial Sequence
  Synthetic
gtagttccucaggaaaucaagaaagca

SEQ ID NO: 11805 - DNA, 26 bp, Artificial Sequence
  Synthetic
tgtcactaatugccactcatttccuc

SEQ ID NO: 11806 - DNA, 27 bp, Artificial Sequence
  Synthetic
tttgcttcactcuctagaccagaguat

SEQ ID NO: 11807 - DNA, 22 bp, Artificial Sequence
  Synthetic
ccctttctgugttccctcctug

SEQ ID NO: 11808 - DNA, 31 bp, Artificial Sequence
  Synthetic
cacagggcattutagattatctggauaacat

SEQ ID NO: 11809 - DNA, 26 bp, Artificial Sequence
  Synthetic
tctttcccaacauattgcctctuacc

SEQ ID NO: 11810 - DNA, 21 bp, Artificial Sequence
  Synthetic
ctctgcacugccctttttgut

SEQ ID NO: 11811 - DNA, 27 bp, Artificial Sequence
  Synthetic
tgacagaatugatgtaactucaccagt

SEQ ID NO: 11812 - DNA, 27 bp, Artificial Sequence
  Synthetic
gtatttccggtuactgagactttgugt

SEQ ID NO: 11813 - DNA, 24 bp, Artificial Sequence
  Synthetic
tcctccccacauacaccatgtaut

SEQ ID NO: 11814 - DNA, 27 bp, Artificial Sequence
  Synthetic
tgaatttcaagtcuaatggtggtgugt

SEQ ID NO: 11815 - DNA, 29 bp, Artificial Sequence
  Synthetic
ctgatttttgcugaaatagcaguaacagt

SEQ ID NO: 11816 - DNA, 23 bp, Artificial Sequence
  Synthetic
tctctttgtugctgtgactuccc

SEQ ID NO: 11817 - DNA, 24 bp, Artificial Sequence
  Synthetic
agatgaactucgtcacaaguccac

SEQ ID NO: 11818 - DNA, 25 bp, Artificial Sequence
  Synthetic
acagagatcugcccaagaaattgut

SEQ ID NO: 11819 - DNA, 25 bp, Artificial Sequence
  Synthetic
tcctcattutcctttttcucagcca

SEQ ID NO: 11820 - DNA, 29 bp, Artificial Sequence
  Synthetic
tgtgacacataggauactattgcattugt

SEQ ID NO: 11821 - DNA, 26 bp, Artificial Sequence
  Synthetic
gcagaagcugttgatttcuccaaaat

SEQ ID NO: 11822 - DNA, 23 bp, Artificial Sequence
  Synthetic
gaaggccauagaggagattgcug

SEQ ID NO: 11823 - DNA, 26 bp, Artificial Sequence
  Synthetic
cccagcctgaugatgattctatctua

SEQ ID NO: 11824 - DNA, 21 bp, Artificial Sequence
  Synthetic
gggccttucagtgagauacct

SEQ ID NO: 11825 - DNA, 31 bp, Artificial Sequence
  Synthetic
catatctttgttctcugctcttagctctuac

SEQ ID NO: 11826 - DNA, 24 bp, Artificial Sequence
  Synthetic
gcagagtcaaagcuatgctcacuc

SEQ ID NO: 11827 - DNA, 22 bp, Artificial Sequence
  Synthetic
ggtgaccutccttacaugccat

SEQ ID NO: 11828 - DNA, 22 bp, Artificial Sequence
  Synthetic
ggtcacucagagcaguaaccua

SEQ ID NO: 11829 - DNA, 26 bp, Artificial Sequence
  Synthetic
cacagaaguaggcaacaauttatcug

SEQ ID NO: 11830 - DNA, 32 bp, Artificial Sequence
  Synthetic
agagtagttgcagacugataaattattttcug

SEQ ID NO: 11831 - DNA, 28 bp, Artificial Sequence
  Synthetic
aacatcctgctacuttgaggttttacut

SEQ ID NO: 11832 - DNA, 32 bp, Artificial Sequence
  Synthetic
ttcagtctattttctuttcttccttaggctut

SEQ ID NO: 11833 - DNA, 32 bp, Artificial Sequence
  Synthetic
atatatgagtaaaagaagucagcactauacct

SEQ ID NO: 11834 - DNA, 23 bp, Artificial Sequence
  Synthetic
gatgtttcaguctcagccaugag

SEQ ID NO: 11835 - DNA, 27 bp, Artificial Sequence
  Synthetic
catttccaaagauggagcgaatatugt

SEQ ID NO: 11836 - DNA, 21 bp, Artificial Sequence
  Synthetic
ctcaccccucaggacagttut

SEQ ID NO: 11837 - DNA, 25 bp, Artificial Sequence
  Synthetic
gttgaggagtutggtgctacatuac

SEQ ID NO: 11838 - DNA, 23 bp, Artificial Sequence
  Synthetic
accagatggutcgtacagatucc

SEQ ID NO: 11839 - DNA, 25 bp, Artificial Sequence
  Synthetic
cctagcccugccactagaaatauct

SEQ ID NO: 11840 - DNA, 24 bp, Artificial Sequence
  Synthetic
ccggagaaggaucattaaccucac

SEQ ID NO: 11841 - DNA, 21 bp, Artificial Sequence
  Synthetic
ttccaaaaccutggcagtuga

SEQ ID NO: 11842 - DNA, 21 bp, Artificial Sequence
  Synthetic
gctccgtuaaagcttgcucct

SEQ ID NO: 11843 - DNA, 25 bp, Artificial Sequence
  Synthetic
agccttctucttcagaaacucaaca

SEQ ID NO: 11844 - DNA, 27 bp, Artificial Sequence
  Synthetic
cctcagtaaagaaugcgctatgttcua

SEQ ID NO: 11845 - DNA, 27 bp, Artificial Sequence
  Synthetic
aaagattgtaugaggtcctgtccuagt

SEQ ID NO: 11846 - DNA, 26 bp, Artificial Sequence
  Synthetic
ccatctgccucctattttcttaucgt

SEQ ID NO: 11847 - DNA, 23 bp, Artificial Sequence
  Synthetic
gugaacacggcactuaaacacag

SEQ ID NO: 11848 - DNA, 21 bp, Artificial Sequence
  Synthetic
cacatccuaccccatggctuc

SEQ ID NO: 11849 - DNA, 21 bp, Artificial Sequence
  Synthetic
atgttcagcuggtggtgcaua

SEQ ID NO: 11850 - DNA, 23 bp, Artificial Sequence
  Synthetic
ccctucccttcttttucaaccgt

SEQ ID NO: 11851 - DNA, 25 bp, Artificial Sequence
  Synthetic
cccagctatuccacagatgtttcuc

SEQ ID NO: 11852 - DNA, 22 bp, Artificial Sequence
  Synthetic
cttacttcggcucctccttgug

SEQ ID NO: 11853 - DNA, 22 bp, Artificial Sequence
  Synthetic
ccgcacatugcccagtattgua

SEQ ID NO: 11854 - DNA, 23 bp, Artificial Sequence
  Synthetic
tgtatgggcutcagcaagttuct

SEQ ID NO: 11855 - DNA, 23 bp, Artificial Sequence
  Synthetic
tcacccugaacagcacaatucaa

SEQ ID NO: 11856 - DNA, 21 bp, Artificial Sequence
  Synthetic
gatgcccaggguctacttugt

SEQ ID NO: 11857 - DNA, 24 bp, Artificial Sequence
  Synthetic
tccaagtgaacauctgcagagauc

SEQ ID NO: 11858 - DNA, 28 bp, Artificial Sequence
  Synthetic
gcctcatgttatautagtgtaggccuca

SEQ ID NO: 11859 - DNA, 21 bp, Artificial Sequence
  Synthetic
aggacacgutggcatcauagg

SEQ ID NO: 11860 - DNA, 20 bp, Artificial Sequence
  Synthetic
gtgtuggccagcgttcatuc

SEQ ID NO: 11861 - DNA, 20 bp, Artificial Sequence
  Synthetic
actccugtgttguggcaacc

SEQ ID NO: 11862 - DNA, 22 bp, Artificial Sequence
  Synthetic
gttctaccacucctgcctcuac

SEQ ID NO: 11863 - DNA, 29 bp, Artificial Sequence
  Synthetic
gatattttcttgtucttgagggatgaugc

SEQ ID NO: 11864 - DNA, 23 bp, Artificial Sequence
  Synthetic
atggaauttcagttcugcccagt

SEQ ID NO: 11865 - DNA, 25 bp, Artificial Sequence
  Synthetic
catgagctattuccaccaccctuag

SEQ ID NO: 11866 - DNA, 22 bp, Artificial Sequence
  Synthetic
gttgggacuggguccagaaaaa

SEQ ID NO: 11867 - DNA, 27 bp, Artificial Sequence
  Synthetic
tgggcutgatagaaugaagaagagaac

SEQ ID NO: 11868 - DNA, 23 bp, Artificial Sequence
  Synthetic
ccgctccauctctgaagucaaat

SEQ ID NO: 11869 - DNA, 26 bp, Artificial Sequence
  Synthetic
gaacctgtaaacugaggtacttuggt

SEQ ID NO: 11870 - DNA, 22 bp, Artificial Sequence
  Synthetic
ccagttcaugcaacagagagug

SEQ ID NO: 11871 - DNA, 26 bp, Artificial Sequence
  Synthetic
acaccuagcaaatggaaaauggaaga

SEQ ID NO: 11872 - DNA, 28 bp, Artificial Sequence
  Synthetic
ccaagttatagacugtttttgcttgugt

SEQ ID NO: 11873 - DNA, 22 bp, Artificial Sequence
  Synthetic
caggctgccaagucattcagua

SEQ ID NO: 11874 - DNA, 25 bp, Artificial Sequence
  Synthetic
cagccaaccutcccaacauaaaaag

SEQ ID NO: 11875 - DNA, 27 bp, Artificial Sequence
  Synthetic
catgagttggauatagtttgcacauca

SEQ ID NO: 11876 - DNA, 24 bp, Artificial Sequence
  Synthetic
ctgttttccuccattttcaucgca

SEQ ID NO: 11877 - DNA, 29 bp, Artificial Sequence
  Synthetic
gtttcttctgtcggutttcaagttcttut

SEQ ID NO: 11878 - DNA, 23 bp, Artificial Sequence
  Synthetic
aacaactctcgauctcacggaug

SEQ ID NO: 11879 - DNA, 20 bp, Artificial Sequence
  Synthetic
aaagggtgucgtccaucagg

SEQ ID NO: 11880 - DNA, 28 bp, Artificial Sequence
  Synthetic
tttcactgctaacutttgacgtgtttut

SEQ ID NO: 11881 - DNA, 22 bp, Artificial Sequence
  Synthetic
cugtccttagugacaacagcca

SEQ ID NO: 11882 - DNA, 21 bp, Artificial Sequence
  Synthetic
cctgtgccuctgctgcataut

SEQ ID NO: 11883 - DNA, 29 bp, Artificial Sequence
  Synthetic
agtcgactgtguttaactttgagttttua

SEQ ID NO: 11884 - DNA, 19 bp, Artificial Sequence
  Synthetic
gcgttgcgucggaaguaag

SEQ ID NO: 11885 - DNA, 24 bp, Artificial Sequence
  Synthetic
tttcgagaaacugtggaaugacga

SEQ ID NO: 11886 - DNA, 18 bp, Artificial Sequence
  Synthetic
ccttgggugacgggaguc

SEQ ID NO: 11887 - DNA, 25 bp, Artificial Sequence
  Synthetic
gctctggtttuctgaaggtcttcua

SEQ ID NO: 11888 - DNA, 25 bp, Artificial Sequence
  Synthetic
acctgcattugtactctacatuggg

SEQ ID NO: 11889 - DNA, 20 bp, Artificial Sequence
  Synthetic
ctagacccgcugcctagtut

SEQ ID NO: 11890 - DNA, 22 bp, Artificial Sequence
  Synthetic
gagacacaugtcgtggucagat

SEQ ID NO: 11891 - DNA, 28 bp, Artificial Sequence
  Synthetic
gaagaggacggaautagctgttaatuga

SEQ ID NO: 11892 - DNA, 23 bp, Artificial Sequence
  Synthetic
tggagguggaggaaggacaatua

SEQ ID NO: 11893 - DNA, 20 bp, Artificial Sequence
  Synthetic
gttcccgugtcagtggcuat

SEQ ID NO: 11894 - DNA, 22 bp, Artificial Sequence
  Synthetic
gcaugaaagcagugggaaccat

SEQ ID NO: 11895 - DNA, 27 bp, Artificial Sequence
  Synthetic
cttaagagactaauttcaagccctugg

SEQ ID NO: 11896 - DNA, 17 bp, Artificial Sequence
  Synthetic
gggcuggcaggaguggt

SEQ ID NO: 11897 - DNA, 17 bp, Artificial Sequence
  Synthetic
cacccguccagcauggt

SEQ ID NO: 11898 - DNA, 22 bp, Artificial Sequence
  Synthetic
caagccaagcuggatattgugg

SEQ ID NO: 11899 - DNA, 18 bp, Artificial Sequence
  Synthetic
ctgtcugcaacgcctgug

SEQ ID NO: 11900 - DNA, 18 bp, Artificial Sequence
  Synthetic
cgaaguccccagcaccug

SEQ ID NO: 11901 - DNA, 21 bp, Artificial Sequence
  Synthetic
cccaccuacccctcctatgug

SEQ ID NO: 11902 - DNA, 18 bp, Artificial Sequence
  Synthetic
gugagggaggccacugag

SEQ ID NO: 11903 - DNA, 18 bp, Artificial Sequence
  Synthetic
caaccccuggaccgugag

SEQ ID NO: 11904 - DNA, 17 bp, Artificial Sequence
  Synthetic
cucgtcuggaggcagca

SEQ ID NO: 11905 - DNA, 18 bp, Artificial Sequence
  Synthetic
tcugcacccagacccuga

SEQ ID NO: 11906 - DNA, 18 bp, Artificial Sequence
  Synthetic
gtguacggcccguacgag

SEQ ID NO: 11907 - DNA, 19 bp, Artificial Sequence
  Synthetic
ccctcacccaugccctaug

SEQ ID NO: 11908 - DNA, 24 bp, Artificial Sequence
  Synthetic
tgctatttugccagcccttctuat

SEQ ID NO: 11909 - DNA, 18 bp, Artificial Sequence
  Synthetic
tcgtacguggcgctcauc

SEQ ID NO: 11910 - DNA, 22 bp, Artificial Sequence
  Synthetic
gtagcuggccatcaugacaaag

SEQ ID NO: 11911 - DNA, 22 bp, Artificial Sequence
  Synthetic
catccgcaguctccagaagtut

SEQ ID NO: 11912 - DNA, 17 bp, Artificial Sequence
  Synthetic
ggcugctccucgaccag

SEQ ID NO: 11913 - DNA, 19 bp, Artificial Sequence
  Synthetic
tggaguctccgtugcacag

SEQ ID NO: 11914 - DNA, 24 bp, Artificial Sequence
  Synthetic
gtgctcaguacgggaaagtcauag

SEQ ID NO: 11915 - DNA, 29 bp, Artificial Sequence
  Synthetic
ccacaatctaagutcaatctcctcaugaa

SEQ ID NO: 11916 - DNA, 27 bp, Artificial Sequence
  Synthetic
gtgtagacaaaguagctgatggatuca

SEQ ID NO: 11917 - DNA, 30 bp, Artificial Sequence
  Synthetic
aaaaatcaaagaguacctcauacagaagca

SEQ ID NO: 11918 - DNA, 28 bp, Artificial Sequence
  Synthetic
ttcattttaccccguaggttttacucag

SEQ ID NO: 11919 - DNA, 24 bp, Artificial Sequence
  Synthetic
tcaacagacuggctttctcgttut

SEQ ID NO: 11920 - DNA, 27 bp, Artificial Sequence
  Synthetic
aatggaacaacaacccuaccaatauca

SEQ ID NO: 11921 - DNA, 26 bp, Artificial Sequence
  Synthetic
aggtacctuaacaaaagtauccccaa

SEQ ID NO: 11922 - DNA, 25 bp, Artificial Sequence
  Synthetic
acgctttgtttuccatgtcatctug

SEQ ID NO: 11923 - DNA, 24 bp, Artificial Sequence
  Synthetic
atgcctggaaacuaactcttcugg

SEQ ID NO: 11924 - DNA, 22 bp, Artificial Sequence
  Synthetic
gucaaagccugcacaacagaag

SEQ ID NO: 11925 - DNA, 26 bp, Artificial Sequence
  Synthetic
actggtgaaugaattcacacaacuca

SEQ ID NO: 11926 - DNA, 27 bp, Artificial Sequence
  Synthetic
cctacagatgtuactcccactttctug

SEQ ID NO: 11927 - DNA, 30 bp, Artificial Sequence
  Synthetic
tcctcctactcutaatatcaagctuccaaa

SEQ ID NO: 11928 - DNA, 23 bp, Artificial Sequence
  Synthetic
gaacagcagutttgaggaugacc

SEQ ID NO: 11929 - DNA, 22 bp, Artificial Sequence
  Synthetic
ttcaaaccgccuccagagtuac

SEQ ID NO: 11930 - DNA, 29 bp, Artificial Sequence
  Synthetic
tgttgttacttauttgaactctcuggcaa

SEQ ID NO: 11931 - DNA, 25 bp, Artificial Sequence
  Synthetic
ggcggttcauctcctatttuggaat

SEQ ID NO: 11932 - DNA, 27 bp, Artificial Sequence
  Synthetic
aatgaaaacaccagacuagacugaaat

SEQ ID NO: 11933 - DNA, 24 bp, Artificial Sequence
  Synthetic
cttcaaaaccucactttgccacuc

SEQ ID NO: 11934 - DNA, 20 bp, Artificial Sequence
  Synthetic
agatgagugacccugcaggt

SEQ ID NO: 11935 - DNA, 25 bp, Artificial Sequence
  Synthetic
ctatccagtccauaagccacgtaug

SEQ ID NO: 11936 - DNA, 30 bp, Artificial Sequence
  Synthetic
gctcagctucagaatattgattatctucca

SEQ ID NO: 11937 - DNA, 28 bp, Artificial Sequence
  Synthetic
tctgtgttttucgttggttcatttuagg

SEQ ID NO: 11938 - DNA, 25 bp, Artificial Sequence
  Synthetic
acatgttcauttcagtcgucacaga

SEQ ID NO: 11939 - DNA, 23 bp, Artificial Sequence
  Synthetic
aactggaaaguacaggtgcgaut

SEQ ID NO: 11940 - DNA, 27 bp, Artificial Sequence
  Synthetic
cttctctttautgtggatgtugcgaac

SEQ ID NO: 11941 - DNA, 27 bp, Artificial Sequence
  Synthetic
tggagatgatttutgatagctggcuaa

SEQ ID NO: 11942 - DNA, 28 bp, Artificial Sequence
  Synthetic
agtttacaagcuggaaatctcaaaucca

SEQ ID NO: 11943 - DNA, 29 bp, Artificial Sequence
  Synthetic
tgagactgcttcauctccaaaatctaaut

SEQ ID NO: 11944 - DNA, 21 bp, Artificial Sequence
  Synthetic
gggcttctcaucctttcgcut

SEQ ID NO: 11945 - DNA, 27 bp, Artificial Sequence
  Synthetic
gtacccatttccugatagagactugag

SEQ ID NO: 11946 - DNA, 30 bp, Artificial Sequence
  Synthetic
ggcttactttguctttgaacatttuaccat

SEQ ID NO: 11947 - DNA, 27 bp, Artificial Sequence
  Synthetic
ctttgagaaaaucagtgaccagucaga

SEQ ID NO: 11948 - DNA, 26 bp, Artificial Sequence
  Synthetic
agctaaaagaaaauccaggagctgut

SEQ ID NO: 11949 - DNA, 22 bp, Artificial Sequence
  Synthetic
aggcattucacttccuggaacc

SEQ ID NO: 11950 - DNA, 21 bp, Artificial Sequence
  Synthetic
gcaaacgttutgccacacucc

SEQ ID NO: 11951 - DNA, 21 bp, Artificial Sequence
  Synthetic
gagtcaucccgggtcttctut

SEQ ID NO: 11952 - DNA, 22 bp, Artificial Sequence
  Synthetic
tccttacacucctggatcgugt

SEQ ID NO: 11953 - DNA, 22 bp, Artificial Sequence
  Synthetic
cgaagactgugaccagctctut

SEQ ID NO: 11954 - DNA, 22 bp, Artificial Sequence
  Synthetic
gcaacaaggutgtgctgaucat

SEQ ID NO: 11955 - DNA, 23 bp, Artificial Sequence
  Synthetic
ttaatgagugggccaatauggca

SEQ ID NO: 11956 - DNA, 25 bp, Artificial Sequence
  Synthetic
gggatatcaucagggatgtagaugg

SEQ ID NO: 11957 - DNA, 27 bp, Artificial Sequence
  Synthetic
caactacccugaaataccttuggaaga

SEQ ID NO: 11958 - DNA, 18 bp, Artificial Sequence
  Synthetic
ccaugtgccugcacggat

SEQ ID NO: 11959 - DNA, 22 bp, Artificial Sequence
  Synthetic
accaacuctgaaaucccagcac

SEQ ID NO: 11960 - DNA, 22 bp, Artificial Sequence
  Synthetic
acgctgagautgactcctugac

SEQ ID NO: 11961 - DNA, 23 bp, Artificial Sequence
  Synthetic
aaataagcuctcaggugcagcat

SEQ ID NO: 11962 - DNA, 22 bp, Artificial Sequence
  Synthetic
ccacttctucaaggcctaccut

SEQ ID NO: 11963 - DNA, 21 bp, Artificial Sequence
  Synthetic
gtgtugaaggagguggacact

SEQ ID NO: 11964 - DNA, 21 bp, Artificial Sequence
  Synthetic
gccttggutgatggtcuaggt

SEQ ID NO: 11965 - DNA, 25 bp, Artificial Sequence
  Synthetic
caggtggatuttccatgtcauacag

SEQ ID NO: 11966 - DNA, 22 bp, Artificial Sequence
  Synthetic
gatgcctgucatgcagtaugga

SEQ ID NO: 11967 - DNA, 21 bp, Artificial Sequence
  Synthetic
acaucacgcaggugaaacagt

SEQ ID NO: 11968 - DNA, 24 bp, Artificial Sequence
  Synthetic
ggaggcctugaatagaaagcucaa

SEQ ID NO: 11969 - DNA, 24 bp, Artificial Sequence
  Synthetic
gccttggutatctcctucagacag

SEQ ID NO: 11970 - DNA, 18 bp, Artificial Sequence
  Synthetic
gcccacugtctgggucaa

SEQ ID NO: 11971 - DNA, 21 bp, Artificial Sequence
  Synthetic
gcacactgaaguggcacagua

SEQ ID NO: 11972 - DNA, 17 bp, Artificial Sequence
  Synthetic
gggccccutacuggaca

SEQ ID NO: 11973 - DNA, 19 bp, Artificial Sequence
  Synthetic
cttgaugcctccaaugcgg

SEQ ID NO: 11974 - DNA, 17 bp, Artificial Sequence
  Synthetic
gtggcucaagcacgugg

SEQ ID NO: 11975 - DNA, 21 bp, Artificial Sequence
  Synthetic
ctagacccaaauccucacgca

SEQ ID NO: 11976 - DNA, 23 bp, Artificial Sequence
  Synthetic
cgctctgcuctctctttguagac

SEQ ID NO: 11977 - DNA, 25 bp, Artificial Sequence
  Synthetic
cgcagagtgaugagaaaacccaaua

SEQ ID NO: 11978 - DNA, 19 bp, Artificial Sequence
  Synthetic
catcgcaaggcugtccuca

SEQ ID NO: 11979 - DNA, 17 bp, Artificial Sequence
  Synthetic
gcctcugactgguggct

SEQ ID NO: 11980 - DNA, 18 bp, Artificial Sequence
  Synthetic
gtcugaggagcccgtguc

SEQ ID NO: 11981 - DNA, 18 bp, Artificial Sequence
  Synthetic
cggctugcaggtgucgaa

SEQ ID NO: 11982 - DNA, 27 bp, Artificial Sequence
  Synthetic
gacaacgtgaugaagatcgcagactuc

SEQ ID NO: 11983 - DNA, 21 bp, Artificial Sequence
  Synthetic
caggcgucctactggcaugac

SEQ ID NO: 11984 - DNA, 18 bp, Artificial Sequence
  Synthetic
gcagcccutcaggctgut

SEQ ID NO: 11985 - DNA, 20 bp, Artificial Sequence
  Synthetic
ggacgucacgguaaggacac

SEQ ID NO: 11986 - DNA, 17 bp, Artificial Sequence
  Synthetic
gttugcccacgaccugc

SEQ ID NO: 11987 - DNA, 23 bp, Artificial Sequence
  Synthetic
tctgtgtagcugtctctccauct

SEQ ID NO: 11988 - DNA, 32 bp, Artificial Sequence
  Synthetic
tttgtttatgttcaugtagaaagtgacugaga

SEQ ID NO: 11989 - DNA, 28 bp, Artificial Sequence
  Synthetic
aaaaataactuacccatactgtggugct

SEQ ID NO: 11990 - DNA, 21 bp, Artificial Sequence
  Synthetic
ccttgaugcaccuggaagcat

SEQ ID NO: 11991 - DNA, 30 bp, Artificial Sequence
  Synthetic
tttctgatgactucacactgaaaatatuga

SEQ ID NO: 11992 - DNA, 26 bp, Artificial Sequence
  Synthetic
ccgaagactguactatggaagtuaca

SEQ ID NO: 11993 - DNA, 28 bp, Artificial Sequence
  Synthetic
ggtagctattuccactttaatcttgucc

SEQ ID NO: 11994 - DNA, 24 bp, Artificial Sequence
  Synthetic
agacaaguactgccuccagaaaag

SEQ ID NO: 11995 - DNA, 28 bp, Artificial Sequence
  Synthetic
tgatgatctaaacaucagggagtaucca

SEQ ID NO: 11996 - DNA, 21 bp, Artificial Sequence
  Synthetic
caaaccaccuccgttttuccc

SEQ ID NO: 11997 - DNA, 28 bp, Artificial Sequence
  Synthetic
aaacactcgcaagcuatttttcttucaa

SEQ ID NO: 11998 - DNA, 25 bp, Artificial Sequence
  Synthetic
caacagtggacautcctctggtuat

SEQ ID NO: 11999 - DNA, 28 bp, Artificial Sequence
  Synthetic
ctgtaagatgtuaaaccatgaacacgut

SEQ ID NO: 12000 - DNA, 21 bp, Artificial Sequence
  Synthetic
gagcgtgaucacagtccuaca

SEQ ID NO: 12001 - DNA, 28 bp, Artificial Sequence
  Synthetic
atctcttttccaagugaactgaaatuca

SEQ ID NO: 12002 - DNA, 26 bp, Artificial Sequence
  Synthetic
gtgaagaaggagauagucacaggaga

SEQ ID NO: 12003 - DNA, 22 bp, Artificial Sequence
  Synthetic
ggccaaaaccaugcctattcug

SEQ ID NO: 12004 - DNA, 24 bp, Artificial Sequence
  Synthetic
caccauccatccauccaggaaaat

SEQ ID NO: 12005 - DNA, 21 bp, Artificial Sequence
  Synthetic
gcttctgccutttccgtgauc

SEQ ID NO: 12006 - DNA, 22 bp, Artificial Sequence
  Synthetic
gguttattccugaccccaaggc

SEQ ID NO: 12007 - DNA, 25 bp, Artificial Sequence
  Synthetic
agaggcagauaagaaagagccagua

SEQ ID NO: 12008 - DNA, 23 bp, Artificial Sequence
  Synthetic
aacgttgacuatcagtucagcga

SEQ ID NO: 12009 - DNA, 32 bp, Artificial Sequence
  Synthetic
ctaataatttcttcttucactactgccaguaa

SEQ ID NO: 12010 - DNA, 26 bp, Artificial Sequence
  Synthetic
caggtagaaacugaaaaagacaugcc

SEQ ID NO: 12011 - DNA, 23 bp, Artificial Sequence
  Synthetic
gcattgacgucagaatuggacac

SEQ ID NO: 12012 - DNA, 24 bp, Artificial Sequence
  Synthetic
gagtaagccagggcutttgtttuc

SEQ ID NO: 12013 - DNA, 23 bp, Artificial Sequence
  Synthetic
gtaagcctuacattcaaccgugc

SEQ ID NO: 12014 - DNA, 32 bp, Artificial Sequence
  Synthetic
gttgttgaggagauaaatggaaacaattaugt

SEQ ID NO: 12015 - DNA, 28 bp, Artificial Sequence
  Synthetic
tggagttcctuaaagtcactgttatgug

SEQ ID NO: 12016 - DNA, 30 bp, Artificial Sequence
  Synthetic
gugattcatttatttgtucaaagcaggaag

SEQ ID NO: 12017 - DNA, 23 bp, Artificial Sequence
  Synthetic
tcagccttgautgcaaaccctua

SEQ ID NO: 12018 - DNA, 26 bp, Artificial Sequence
  Synthetic
aatggtttucttttctccuccaacct

SEQ ID NO: 12019 - DNA, 27 bp, Artificial Sequence
  Synthetic
aatcattcttgaugtctctggcuagac

SEQ ID NO: 12020 - DNA, 25 bp, Artificial Sequence
  Synthetic
tagacucagagcatcttctugaagt

SEQ ID NO: 12021 - DNA, 27 bp, Artificial Sequence
  Synthetic
gaagccttccutgatcatcttguagaa

SEQ ID NO: 12022 - DNA, 28 bp, Artificial Sequence
  Synthetic
catcagttagttgugatcttgacacugt

SEQ ID NO: 12023 - DNA, 25 bp, Artificial Sequence
  Synthetic
gaattgauccgcacagaatggtcua

SEQ ID NO: 12024 - DNA, 24 bp, Artificial Sequence
  Synthetic
ctctcatgtgaugtccaggagtug

SEQ ID NO: 12025 - DNA, 29 bp, Artificial Sequence
  Synthetic
gaggaagcagaacutttaaagctgauaga

SEQ ID NO: 12026 - DNA, 26 bp, Artificial Sequence
  Synthetic
taatgaggcuccaaaactttaaugct

SEQ ID NO: 12027 - DNA, 22 bp, Artificial Sequence
  Synthetic
ccggccugtgagtguaaaaaca

SEQ ID NO: 12028 - DNA, 22 bp, Artificial Sequence
  Synthetic
gcttctuggatggaggugacaa

SEQ ID NO: 12029 - DNA, 31 bp, Artificial Sequence
  Synthetic
gcatttaatgaaaucagtgttttgcttcuct

SEQ ID NO: 12030 - DNA, 32 bp, Artificial Sequence
  Synthetic
tctccttttctgacauaatctggatctttaua

SEQ ID NO: 12031 - DNA, 20 bp, Artificial Sequence
  Synthetic
cagctgugccgagaccuaat

SEQ ID NO: 12032 - DNA, 26 bp, Artificial Sequence
  Synthetic
ccutcattttataacauggccagagc

SEQ ID NO: 12033 - DNA, 24 bp, Artificial Sequence
  Synthetic
aaacccatuttccttccuggacat

SEQ ID NO: 12034 - DNA, 23 bp, Artificial Sequence
  Synthetic
gaggaagagauggcctgguaaac

SEQ ID NO: 12035 - DNA, 23 bp, Artificial Sequence
  Synthetic
ccatcgtcauggatccagaugaa

SEQ ID NO: 12036 - DNA, 19 bp, Artificial Sequence
  Synthetic
caggtguagaggcctucgt

SEQ ID NO: 12037 - DNA, 27 bp, Artificial Sequence
  Synthetic
tgaaaaactucacagactacatcauca

SEQ ID NO: 12038 - DNA, 22 bp, Artificial Sequence
  Synthetic
ccctaccuaggactgtgagcug

SEQ ID NO: 12039 - DNA, 25 bp, Artificial Sequence
  Synthetic
tctttggaaatugaatgccaccaug

SEQ ID NO: 12040 - DNA, 25 bp, Artificial Sequence
  Synthetic
tttgttgaccgcutcacatttguac

SEQ ID NO: 12041 - DNA, 22 bp, Artificial Sequence
  Synthetic
gcataggcaggutggagtgaut

SEQ ID NO: 12042 - DNA, 32 bp, Artificial Sequence
  Synthetic
agacaatgtaucataataaatctugggcagag

SEQ ID NO: 12043 - DNA, 27 bp, Artificial Sequence
  Synthetic
tgtactgacgautatggaagtgaguga

SEQ ID NO: 12044 - DNA, 27 bp, Artificial Sequence
  Synthetic
cacttgucaaggcacagaataattucc

SEQ ID NO: 12045 - DNA, 30 bp, Artificial Sequence
  Synthetic
gagatgaagaaauttttgagcacctuaact

SEQ ID NO: 12046 - DNA, 32 bp, Artificial Sequence
  Synthetic
tgttattaatgatauggaaaggaaatgtccuc

SEQ ID NO: 12047 - DNA, 24 bp, Artificial Sequence
  Synthetic
gggctttacuattcccagcuacat

SEQ ID NO: 12048 - DNA, 29 bp, Artificial Sequence
  Synthetic
cttttataactgguaaagagacgugggaa

SEQ ID NO: 12049 - DNA, 23 bp, Artificial Sequence
  Synthetic
gatggccucttctguaagacact

SEQ ID NO: 12050 - DNA, 19 bp, Artificial Sequence
  Synthetic
ctttcaggucctcuccgcc

SEQ ID NO: 12051 - DNA, 20 bp, Artificial Sequence
  Synthetic
tcccgagtuctgggcattuc

SEQ ID NO: 12052 - DNA, 25 bp, Artificial Sequence
  Synthetic
atggttgctguctcatcagcataut

SEQ ID NO: 12053 - DNA, 28 bp, Artificial Sequence
  Synthetic
aaaauaaaggcaacaggcctauaagact

SEQ ID NO: 12054 - DNA, 30 bp, Artificial Sequence
  Synthetic
cattcaaaatcatcugtaaatccagcagua

SEQ ID NO: 12055 - DNA, 23 bp, Artificial Sequence
  Synthetic
gccacaaugtacaggaugcaact

SEQ ID NO: 12056 - DNA, 22 bp, Artificial Sequence
  Synthetic
cacaccagcuttgtgttugagg

SEQ ID NO: 12057 - DNA, 29 bp, Artificial Sequence
  Synthetic
caagaactttgtaautaccagctcagaug

SEQ ID NO: 12058 - DNA, 23 bp, Artificial Sequence
  Synthetic
aatgcaatuccctgtcuccacat

SEQ ID NO: 12059 - DNA, 28 bp, Artificial Sequence
  Synthetic
ggtcagtaatugataggaagagtaucca

SEQ ID NO: 12060 - DNA, 24 bp, Artificial Sequence
  Synthetic
gggcccaaautcaccaataauaga

SEQ ID NO: 12061 - DNA, 25 bp, Artificial Sequence
  Synthetic
ggatctacagaucggacacucaaag

SEQ ID NO: 12062 - DNA, 29 bp, Artificial Sequence
  Synthetic
gaggagtgucatattatacagttugccaa

SEQ ID NO: 12063 - DNA, 26 bp, Artificial Sequence
  Synthetic
catggaaaagugcatacaucagacag

SEQ ID NO: 12064 - DNA, 26 bp, Artificial Sequence
  Synthetic
atgtttaaagguggtagctgtugagt

SEQ ID NO: 12065 - DNA, 28 bp, Artificial Sequence
  Synthetic
cucattgatagttgugaaccaacacaag

SEQ ID NO: 12066 - DNA, 25 bp, Artificial Sequence
  Synthetic
gcaggcauacacacacaatcacaua

SEQ ID NO: 12067 - DNA, 26 bp, Artificial Sequence
  Synthetic
tttatattgucagagacugccaagca

SEQ ID NO: 12068 - DNA, 24 bp, Artificial Sequence
  Synthetic
aaagaggccaagguacttcactua

SEQ ID NO: 12069 - DNA, 30 bp, Artificial Sequence
  Synthetic
cacatcaaactgugatgaagatattuagca

SEQ ID NO: 12070 - DNA, 21 bp, Artificial Sequence
  Synthetic
acgggcagguccacaatacua

SEQ ID NO: 12071 - DNA, 24 bp, Artificial Sequence
  Synthetic
gaacatgcuggtgaacaagaugag

SEQ ID NO: 12072 - DNA, 21 bp, Artificial Sequence
  Synthetic
ccagttcgucgtcttttgcug

SEQ ID NO: 12073 - DNA, 23 bp, Artificial Sequence
  Synthetic
ccctatttucccctgcagaaugt

SEQ ID NO: 12074 - DNA, 29 bp, Artificial Sequence
  Synthetic
actgttaatcguttggtttgttcugaaaa

SEQ ID NO: 12075 - DNA, 26 bp, Artificial Sequence
  Synthetic
ctagatccauagacagcaacagugag

SEQ ID NO: 12076 - DNA, 23 bp, Artificial Sequence
  Synthetic
gatggguggacaauaggacacaa

SEQ ID NO: 12077 - DNA, 26 bp, Artificial Sequence
  Synthetic
attggaaaugaatccttguaccccaa

SEQ ID NO: 12078 - DNA, 20 bp, Artificial Sequence
  Synthetic
cactacgcaugcaggaugga

SEQ ID NO: 12079 - DNA, 27 bp, Artificial Sequence
  Synthetic
cagaagacacugagaattgctgatcut

SEQ ID NO: 12080 - DNA, 29 bp, Artificial Sequence
  Synthetic
ccacaggaatgucttcccattttacuaat

SEQ ID NO: 12081 - DNA, 24 bp, Artificial Sequence
  Synthetic
ttgaggcuagaaagcucaggaaac

SEQ ID NO: 12082 - DNA, 24 bp, Artificial Sequence
  Synthetic
tatacgagaagaaggcugacauga

SEQ ID NO: 12083 - DNA, 25 bp, Artificial Sequence
  Synthetic
caccttccaaaauagcgagtaugga

SEQ ID NO: 12084 - DNA, 23 bp, Artificial Sequence
  Synthetic
tccatcagaacuccactctcucc

SEQ ID NO: 12085 - DNA, 28 bp, Artificial Sequence
  Synthetic
acgttttatugagaattccaaacaucct

SEQ ID NO: 12086 - DNA, 27 bp, Artificial Sequence
  Synthetic
agagaatcttaccugctcttgtacuga

SEQ ID NO: 12087 - DNA, 28 bp, Artificial Sequence
  Synthetic
cccatactccuacttcattcaaagugaa

SEQ ID NO: 12088 - DNA, 28 bp, Artificial Sequence
  Synthetic
ctttcaactaaagugtagcttguagcac

SEQ ID NO: 12089 - DNA, 26 bp, Artificial Sequence
  Synthetic
tgttagauccaccagatactccucaa

SEQ ID NO: 12090 - DNA, 30 bp, Artificial Sequence
  Synthetic
aggttatgagaagugaaagctcaaacuaaa

SEQ ID NO: 12091 - DNA, 21 bp, Artificial Sequence
  Synthetic
tggtcucgaagagtggaguga

SEQ ID NO: 12092 - DNA, 29 bp, Artificial Sequence
  Synthetic
agctccatactcuctttacgtagaactut

SEQ ID NO: 12093 - DNA, 27 bp, Artificial Sequence
  Synthetic
agccttaatuccagatacuccagagat

SEQ ID NO: 12094 - DNA, 22 bp, Artificial Sequence
  Synthetic
gccacuggaaattugaagcagt

SEQ ID NO: 12095 - DNA, 24 bp, Artificial Sequence
  Synthetic
gcacagtauaaggtgagcctucag

SEQ ID NO: 12096 - DNA, 21 bp, Artificial Sequence
  Synthetic
gcatctgcugcagaaactucc

SEQ ID NO: 12097 - DNA, 24 bp, Artificial Sequence
  Synthetic
gtcagcatgaauccagtccagaua

SEQ ID NO: 12098 - DNA, 23 bp, Artificial Sequence
  Synthetic
ggcctagaagaugacatgcauga

SEQ ID NO: 12099 - DNA, 27 bp, Artificial Sequence
  Synthetic
agatggcaattucactgatgtaagugt

SEQ ID NO: 12100 - DNA, 27 bp, Artificial Sequence
  Synthetic
gggtaguaaaagtgaattcuggaccat

SEQ ID NO: 12101 - DNA, 29 bp, Artificial Sequence
  Synthetic
tgaatgaagcacagutcttatttctucca

SEQ ID NO: 12102 - DNA, 27 bp, Artificial Sequence
  Synthetic
acgagcttgttuaaggtatgccttuat

SEQ ID NO: 12103 - DNA, 29 bp, Artificial Sequence
  Synthetic
catgcttaatcugctattcttgcttuagg

SEQ ID NO: 12104 - DNA, 24 bp, Artificial Sequence
  Synthetic
tttttatgggagcccugtccauac

SEQ ID NO: 12105 - DNA, 25 bp, Artificial Sequence
  Synthetic
tgatcgctauctagcaacccuaaca

SEQ ID NO: 12106 - DNA, 22 bp, Artificial Sequence
  Synthetic
ccagaaccagutcacatcugga

SEQ ID NO: 12107 - DNA, 27 bp, Artificial Sequence
  Synthetic
gtgtttaggautcgctgtaugaaggaa

SEQ ID NO: 12108 - DNA, 31 bp, Artificial Sequence
  Synthetic
gtaaacgactacagugtcaaataaactcuca

SEQ ID NO: 12109 - DNA, 26 bp, Artificial Sequence
  Synthetic
tgtcaacatugaagtctggguagaag

SEQ ID NO: 12110 - DNA, 28 bp, Artificial Sequence
  Synthetic
cgttcacaaugcaactcaaattttuagg

SEQ ID NO: 12111 - DNA, 26 bp, Artificial Sequence
  Synthetic
ctaatttagaucgcaaatgcctuggg

SEQ ID NO: 12112 - DNA, 30 bp, Artificial Sequence
  Synthetic
ggtttgtttuccagacaatgtaatuagcat

SEQ ID NO: 12113 - DNA, 25 bp, Artificial Sequence
  Synthetic
ggtgaacttcuagatccatgtggut

SEQ ID NO: 12114 - DNA, 23 bp, Artificial Sequence
  Synthetic
cagcctggcauactttgaagauc

SEQ ID NO: 12115 - DNA, 28 bp, Artificial Sequence
  Synthetic
gtttcctgtgcuctattttatgctaugt

SEQ ID NO: 12116 - DNA, 22 bp, Artificial Sequence
  Synthetic
tgttctcagcuggagaagctug

SEQ ID NO: 12117 - DNA, 24 bp, Artificial Sequence
  Synthetic
cattctgttccugacacccucaat

SEQ ID NO: 12118 - DNA, 24 bp, Artificial Sequence
  Synthetic
ggcaugaaggatatguaccaagca

SEQ ID NO: 12119 - DNA, 29 bp, Artificial Sequence
  Synthetic
ggatcatcuggtatttttacagucaacca

SEQ ID NO: 12120 - DNA, 25 bp, Artificial Sequence
  Synthetic
cagagaactcuctctctctctucca

SEQ ID NO: 12121 - DNA, 20 bp, Artificial Sequence
  Synthetic
tgacauagcccctucccgaa

SEQ ID NO: 12122 - DNA, 21 bp, Artificial Sequence
  Synthetic
aacagttttccuctccgccut

SEQ ID NO: 12123 - DNA, 23 bp, Artificial Sequence
  Synthetic
tcagtcccautcctgagactuca

SEQ ID NO: 12124 - DNA, 21 bp, Artificial Sequence
  Synthetic
cgaagcaacucagaggtggug

SEQ ID NO: 12125 - DNA, 26 bp, Artificial Sequence
  Synthetic
aaggagggaggucctcaaattgtaua

SEQ ID NO: 12126 - DNA, 18 bp, Artificial Sequence
  Synthetic
gcggagagutcggcauga

SEQ ID NO: 12127 - DNA, 21 bp, Artificial Sequence
  Synthetic
ggatgcggaagaugctctuct

SEQ ID NO: 12128 - DNA, 30 bp, Artificial Sequence
  Synthetic
tttgacatttagtuaggtcagttcctgtut

SEQ ID NO: 12129 - DNA, 23 bp, Artificial Sequence
  Synthetic
ggtaaggcgutgtcatggtguag

SEQ ID NO: 12130 - DNA, 20 bp, Artificial Sequence
  Synthetic
tgcgtcggacuctctgtcua

SEQ ID NO: 12131 - DNA, 20 bp, Artificial Sequence
  Synthetic
acucaccugagaacgccaag

SEQ ID NO: 12132 - DNA, 20 bp, Artificial Sequence
  Synthetic
cccuacccagaggacaaugg

SEQ ID NO: 12133 - DNA, 21 bp, Artificial Sequence
  Synthetic
cgtcccaguagatcctgcuct

SEQ ID NO: 12134 - DNA, 25 bp, Artificial Sequence
  Synthetic
ctcaacaaaacaguggacattucct

SEQ ID NO: 12135 - DNA, 28 bp, Artificial Sequence
  Synthetic
ggaaaaagaaaaccacucatctugacat

SEQ ID NO: 12136 - DNA, 18 bp, Artificial Sequence
  Synthetic
ctatggctucggcggcua

SEQ ID NO: 12137 - DNA, 28 bp, Artificial Sequence
  Synthetic
ttgtaaaataggaugacagaactcacug

SEQ ID NO: 12138 - DNA, 22 bp, Artificial Sequence
  Synthetic
gggtgagcacugatgagcatut

SEQ ID NO: 12139 - DNA, 25 bp, Artificial Sequence
  Synthetic
actcaacacccucaacucaaaagag

SEQ ID NO: 12140 - DNA, 23 bp, Artificial Sequence
  Synthetic
cttcagccaaacacutaacugct

SEQ ID NO: 12141 - DNA, 18 bp, Artificial Sequence
  Synthetic
ggtcctgcugggcaauct

SEQ ID NO: 12142 - DNA, 23 bp, Artificial Sequence
  Synthetic
gautacggtgtugggaagaggaa

SEQ ID NO: 12143 - DNA, 21 bp, Artificial Sequence
  Synthetic
ctcgccagucttaacugccat

SEQ ID NO: 12144 - DNA, 20 bp, Artificial Sequence
  Synthetic
gctugagacagccuagcaga

SEQ ID NO: 12145 - DNA, 21 bp, Artificial Sequence
  Synthetic
ggctgagaucaggugaaaggg

SEQ ID NO: 12146 - DNA, 22 bp, Artificial Sequence
  Synthetic
ctttctgctgucttctgccaut

SEQ ID NO: 12147 - DNA, 23 bp, Artificial Sequence
  Synthetic
cagcattagaaccugtgcatcug

SEQ ID NO: 12148 - DNA, 22 bp, Artificial Sequence
  Synthetic
ccaagctcaugctgacagugat

SEQ ID NO: 12149 - DNA, 31 bp, Artificial Sequence
  Synthetic
gggttttatcccugacatacatattcauaca

SEQ ID NO: 12150 - DNA, 22 bp, Artificial Sequence
  Synthetic
gaggaggagguggagactttug

SEQ ID NO: 12151 - DNA, 22 bp, Artificial Sequence
  Synthetic
ccaugccaaatguggaaaccag

SEQ ID NO: 12152 - DNA, 25 bp, Artificial Sequence
  Synthetic
cacaacgatgaugaacagtatgcut

SEQ ID NO: 12153 - DNA, 22 bp, Artificial Sequence
  Synthetic
actgcttuacagacaggaugcc

SEQ ID NO: 12154 - DNA, 26 bp, Artificial Sequence
  Synthetic
ggctaaaaggucctcttttgaaaugt

SEQ ID NO: 12155 - DNA, 27 bp, Artificial Sequence
  Synthetic
cggacatagaguttgatgttgttctut

SEQ ID NO: 12156 - DNA, 24 bp, Artificial Sequence
  Synthetic
attgtttttccucttcccacccut

SEQ ID NO: 12157 - DNA, 28 bp, Artificial Sequence
  Synthetic
tgtaatagatggacutctgtgtctccut

SEQ ID NO: 12158 - DNA, 22 bp, Artificial Sequence
  Synthetic
ccugaggaugaggaggagaaga

SEQ ID NO: 12159 - DNA, 21 bp, Artificial Sequence
  Synthetic
gcccaccucgaagatgtuaca

SEQ ID NO: 12160 - DNA, 23 bp, Artificial Sequence
  Synthetic
gtttgtgcaacucgtctcctcua

SEQ ID NO: 12161 - DNA, 18 bp, Artificial Sequence
  Synthetic
tcctcaucgcccucgaga

SEQ ID NO: 12162 - DNA, 17 bp, Artificial Sequence
  Synthetic
tgcugcagccucagcaa

SEQ ID NO: 12163 - DNA, 20 bp, Artificial Sequence
  Synthetic
acagagugagccgtttgucc

SEQ ID NO: 12164 - DNA, 20 bp, Artificial Sequence
  Synthetic
ctcccugcagaactccaucc

SEQ ID NO: 12165 - DNA, 25 bp, Artificial Sequence
  Synthetic
acttgttgcuattgtccauggagac

SEQ ID NO: 12166 - DNA, 18 bp, Artificial Sequence
  Synthetic
gtcgcccaucauggcaag

SEQ ID NO: 12167 - DNA, 22 bp, Artificial Sequence
  Synthetic
cagattcatggugcctgccaua

SEQ ID NO: 12168 - DNA, 20 bp, Artificial Sequence
  Synthetic
ctgctcacutcggacucact

SEQ ID NO: 12169 - DNA, 21 bp, Artificial Sequence
  Synthetic
ccaaactuccctggtuaggct

SEQ ID NO: 12170 - DNA, 22 bp, Artificial Sequence
  Synthetic
gaactcauggatgctgaugggt

SEQ ID NO: 12171 - DNA, 19 bp, Artificial Sequence
  Synthetic
tgacctgcuttgcccacut

SEQ ID NO: 12172 - DNA, 22 bp, Artificial Sequence
  Synthetic
tctagcggaguttcactugcag

SEQ ID NO: 12173 - DNA, 25 bp, Artificial Sequence
  Synthetic
gcaccugaccaaaaccaacttttua

SEQ ID NO: 12174 - DNA, 27 bp, Artificial Sequence
  Synthetic
acttcgtagggaaguatacagtgtuca

SEQ ID NO: 12175 - DNA, 28 bp, Artificial Sequence
  Synthetic
agttaaccuaagggacacaaagcauaaa

SEQ ID NO: 12176 - DNA, 31 bp, Artificial Sequence
  Synthetic
actagaauaaaggaaagaauggaaagcaact

SEQ ID NO: 12177 - DNA, 21 bp, Artificial Sequence
  Synthetic
gccugcagaggacgtaaugac

SEQ ID NO: 12178 - DNA, 22 bp, Artificial Sequence
  Synthetic
aagtactuggcagctagtcucg

SEQ ID NO: 12179 - DNA, 25 bp, Artificial Sequence
  Synthetic
cauaggaaagagagctugaggcaaa

SEQ ID NO: 12180 - DNA, 22 bp, Artificial Sequence
  Synthetic
ccagtttuagcatgaagcugca

SEQ ID NO: 12181 - DNA, 27 bp, Artificial Sequence
  Synthetic
tttctttauaaggcacagttgguggat

SEQ ID NO: 12182 - DNA, 23 bp, Artificial Sequence
  Synthetic
ggagcagauccacauccacaaaa

SEQ ID NO: 12183 - DNA, 17 bp, Artificial Sequence
  Synthetic
ctugacggcgccatguc

SEQ ID NO: 12184 - DNA, 29 bp, Artificial Sequence
  Synthetic
ccctcattcactutaacttgaacagagut

SEQ ID NO: 12185 - DNA, 27 bp, Artificial Sequence
  Synthetic
ctaactuaccgggagataatuggcaat

SEQ ID NO: 12186 - DNA, 27 bp, Artificial Sequence
  Synthetic
aautattuaccaggcacauaagagact

SEQ ID NO: 12187 - DNA, 29 bp, Artificial Sequence
  Synthetic
catttaaagcagaaugttcaauacccact

SEQ ID NO: 12188 - DNA, 24 bp, Artificial Sequence
  Synthetic
cctgaagcauatgtagcccugaat

SEQ ID NO: 12189 - DNA, 27 bp, Artificial Sequence
  Synthetic
gtgctttgaacagugaatgatcaauga

SEQ ID NO: 12190 - DNA, 22 bp, Artificial Sequence
  Synthetic
acagtgcaccugtttcctgtut

SEQ ID NO: 12191 - DNA, 27 bp, Artificial Sequence
  Synthetic
ggagtgttuctgcaaattcuaagaggt

SEQ ID NO: 12192 - DNA, 25 bp, Artificial Sequence
  Synthetic
caagggugaacaaacgtatgtugag

SEQ ID NO: 12193 - DNA, 23 bp, Artificial Sequence
  Synthetic
tgacgucagcaaataugaaggag

SEQ ID NO: 12194 - DNA, 27 bp, Artificial Sequence
  Synthetic
catagagaccagacugtgaaaacucaa

SEQ ID NO: 12195 - DNA, 26 bp, Artificial Sequence
  Synthetic
attatgcacauacaagtggaucagac

SEQ ID NO: 12196 - DNA, 28 bp, Artificial Sequence
  Synthetic
atcaaacaggaauctgatgaatcuggaa

SEQ ID NO: 12197 - DNA, 21 bp, Artificial Sequence
  Synthetic
gccaauggcagacacaucaag

SEQ ID NO: 12198 - DNA, 25 bp, Artificial Sequence
  Synthetic
tcttacaagcuccgttttaauggca

SEQ ID NO: 12199 - DNA, 25 bp, Artificial Sequence
  Synthetic
ccaccaccaaagaugacagttttuc

SEQ ID NO: 12200 - DNA, 17 bp, Artificial Sequence
  Synthetic
ggctucggcggttguct

SEQ ID NO: 12201 - DNA, 20 bp, Artificial Sequence
  Synthetic
caccttgaugcggtucagga

SEQ ID NO: 12202 - DNA, 27 bp, Artificial Sequence
  Synthetic
tgtggguggacccttattatuagaagt

SEQ ID NO: 12203 - DNA, 26 bp, Artificial Sequence
  Synthetic
tgcactaatcugcatggctaaacuaa

SEQ ID NO: 12204 - DNA, 26 bp, Artificial Sequence
  Synthetic
acacaggttugattatgctcaugaga

SEQ ID NO: 12205 - DNA, 23 bp, Artificial Sequence
  Synthetic
gggttcugacaaggagacactug

SEQ ID NO: 12206 - DNA, 25 bp, Artificial Sequence
  Synthetic
tttctcctgutcacagguaaaaggg

SEQ ID NO: 12207 - DNA, 25 bp, Artificial Sequence
  Synthetic
cggagtcactucttttacagcctua

SEQ ID NO: 12208 - DNA, 17 bp, Artificial Sequence
  Synthetic
gcggaccugtcgtccuc

SEQ ID NO: 12209 - DNA, 18 bp, Artificial Sequence
  Synthetic
ggcgtuccagtgguggat

SEQ ID NO: 12210 - DNA, 21 bp, Artificial Sequence
  Synthetic
cggcagcaugtgagaugaagt

SEQ ID NO: 12211 - DNA, 24 bp, Artificial Sequence
  Synthetic
ccccttcttuttcctgctttucag

SEQ ID NO: 12212 - DNA, 21 bp, Artificial Sequence
  Synthetic
acaugccggaaaccagcttua

SEQ ID NO: 12213 - DNA, 26 bp, Artificial Sequence
  Synthetic
gctcuttgtaacagguagaacagaga

SEQ ID NO: 12214 - DNA, 30 bp, Artificial Sequence
  Synthetic
cttgttaacttagutactttggcacatuca

SEQ ID NO: 12215 - DNA, 28 bp, Artificial Sequence
  Synthetic
ccctgaagatttguaaaggacactcauc

SEQ ID NO: 12216 - DNA, 20 bp, Artificial Sequence
  Synthetic
gctatggcuccaccctucct

SEQ ID NO: 12217 - DNA, 26 bp, Artificial Sequence
  Synthetic
tcagccaacagaagacuactugaaga

SEQ ID NO: 12218 - DNA, 20 bp, Artificial Sequence
  Synthetic
cactgugacgcccagaagua

SEQ ID NO: 12219 - DNA, 22 bp, Artificial Sequence
  Synthetic
tgcaagagcaugatcctgacug

SEQ ID NO: 12220 - DNA, 21 bp, Artificial Sequence
  Synthetic
gggaatggugaagccgaugat

SEQ ID NO: 12221 - DNA, 28 bp, Artificial Sequence
  Synthetic
acatgtcagcugaacctttataaatuca

SEQ ID NO: 12222 - DNA, 23 bp, Artificial Sequence
  Synthetic
caaccaguacagacctgacauca

SEQ ID NO: 12223 - DNA, 22 bp, Artificial Sequence
  Synthetic
agctgaatucactggctuagca

SEQ ID NO: 12224 - DNA, 30 bp, Artificial Sequence
  Synthetic
tcagaacttaataatuacatgccagcctut

SEQ ID NO: 12225 - DNA, 23 bp, Artificial Sequence
  Synthetic
cacctccacutacctacgcuaag

SEQ ID NO: 12226 - DNA, 29 bp, Artificial Sequence
  Synthetic
tgtcctutattcttttacauaggcaacga

SEQ ID NO: 12227 - DNA, 23 bp, Artificial Sequence
  Synthetic
cgttgggauaaaaggctcaucag

SEQ ID NO: 12228 - DNA, 29 bp, Artificial Sequence
  Synthetic
tgtcagaaacautccaaatggttuacaag

SEQ ID NO: 12229 - DNA, 24 bp, Artificial Sequence
  Synthetic
cacacaaguggactaccctaugag

SEQ ID NO: 12230 - DNA, 22 bp, Artificial Sequence
  Synthetic
tttcttccucccgctctcttug

SEQ ID NO: 12231 - DNA, 22 bp, Artificial Sequence
  Synthetic
agagaguccaaccagactucgt

SEQ ID NO: 12232 - DNA, 25 bp, Artificial Sequence
  Synthetic
tgctttgatuccagtttcagaucgt

SEQ ID NO: 12233 - DNA, 24 bp, Artificial Sequence
  Synthetic
tctgtcaucaccaggcaatttcut

SEQ ID NO: 12234 - DNA, 28 bp, Artificial Sequence
  Synthetic
agtctgtatggtugtaaaaagctcacut

SEQ ID NO: 12235 - DNA, 21 bp, Artificial Sequence
  Synthetic
gccatccgaucctgggattug

SEQ ID NO: 12236 - DNA, 22 bp, Artificial Sequence
  Synthetic
tgcutccacacugaccaaaagt

SEQ ID NO: 12237 - DNA, 23 bp, Artificial Sequence
  Synthetic
ggcaaatccauggacattccauc

SEQ ID NO: 12238 - DNA, 20 bp, Artificial Sequence
  Synthetic
gagcgcagagacutgcagua

SEQ ID NO: 12239 - DNA, 21 bp, Artificial Sequence
  Synthetic
gctcctggauctccttgcuca

SEQ ID NO: 12240 - DNA, 22 bp, Artificial Sequence
  Synthetic
tuctctgttaccugcagcagac

SEQ ID NO: 12241 - DNA, 27 bp, Artificial Sequence
  Synthetic
ggatcuactgaaaacaucaaacagcca

SEQ ID NO: 12242 - DNA, 22 bp, Artificial Sequence
  Synthetic
cacctctgaccuttgcactcut

SEQ ID NO: 12243 - DNA, 17 bp, Artificial Sequence
  Synthetic
ccucgggcuccagcaac

SEQ ID NO: 12244 - DNA, 26 bp, Artificial Sequence
  Synthetic
tcauggaaaaggaucaaactctuacc

SEQ ID NO: 12245 - DNA, 24 bp, Artificial Sequence
  Synthetic
tgaaagggcucatcagguacagat

SEQ ID NO: 12246 - DNA, 28 bp, Artificial Sequence
  Synthetic
ttatcutccctttaagucacaaaaggct

SEQ ID NO: 12247 - DNA, 25 bp, Artificial Sequence
  Synthetic
gcaaccttcuaactacggtccaaug

SEQ ID NO: 12248 - DNA, 23 bp, Artificial Sequence
  Synthetic
acgtagaggaaaacugaccucca

SEQ ID NO: 12249 - DNA, 28 bp, Artificial Sequence
  Synthetic
gctgaggtaguaagagaactgaaaauga

SEQ ID NO: 12250 - DNA, 28 bp, Artificial Sequence
  Synthetic
aaaattacctccucttccactccuagaa

SEQ ID NO: 12251 - DNA, 27 bp, Artificial Sequence
  Synthetic
gagtctgaatutttcattccagugcag

SEQ ID NO: 12252 - DNA, 22 bp, Artificial Sequence
  Synthetic
agggcagcgutcttcatgtuaa

SEQ ID NO: 12253 - DNA, 22 bp, Artificial Sequence
  Synthetic
tcatccatggcugaggttgaug

SEQ ID NO: 12254 - DNA, 19 bp, Artificial Sequence
  Synthetic
gtgacctgcuggcagagua

SEQ ID NO: 12255 - DNA, 25 bp, Artificial Sequence
  Synthetic
tgtgtagatcagcugaggcaattut

SEQ ID NO: 12256 - DNA, 24 bp, Artificial Sequence
  Synthetic
gtcttttgcucggtctttgtugat

SEQ ID NO: 12257 - DNA, 22 bp, Artificial Sequence
  Synthetic
cagacccuggaacuggagaaag

SEQ ID NO: 12258 - DNA, 18 bp, Artificial Sequence
  Synthetic
ccauaaggccggcuggag

SEQ ID NO: 12259 - DNA, 19 bp, Artificial Sequence
  Synthetic
cggtguaccaccaccauca

SEQ ID NO: 12260 - DNA, 23 bp, Artificial Sequence
  Synthetic
aggaacgaguccacgtagtagut

SEQ ID NO: 12261 - DNA, 23 bp, Artificial Sequence
  Synthetic
gccggcaacutattaggtgacug

SEQ ID NO: 12262 - DNA, 21 bp, Artificial Sequence
  Synthetic
cgctgaagaagaacucccgut

SEQ ID NO: 12263 - DNA, 21 bp, Artificial Sequence
  Synthetic
cagcccttcucctcagctaug

SEQ ID NO: 12264 - DNA, 23 bp, Artificial Sequence
  Synthetic
gcaggtuggaggagtaggaguat

SEQ ID NO: 12265 - DNA, 27 bp, Artificial Sequence
  Synthetic
caataatggatttugatgagcgtgguc

SEQ ID NO: 12266 - DNA, 23 bp, Artificial Sequence
  Synthetic
gttcuggaaccagattgugacct

SEQ ID NO: 12267 - DNA, 25 bp, Artificial Sequence
  Synthetic
cgtgccttauaccaaggtgcaatua

SEQ ID NO: 12268 - DNA, 18 bp, Artificial Sequence
  Synthetic
tgcgtagcccuggtggua

SEQ ID NO: 12269 - DNA, 19 bp, Artificial Sequence
  Synthetic
ccaacgccaucaagtcgug

SEQ ID NO: 12270 - DNA, 17 bp, Artificial Sequence
  Synthetic
gccgccccutccatgut

SEQ ID NO: 12271 - DNA, 17 bp, Artificial Sequence
  Synthetic
catgcggcucgggcuat

SEQ ID NO: 12272 - DNA, 20 bp, Artificial Sequence
  Synthetic
tggttugcggacacgaauct

SEQ ID NO: 12273 - DNA, 22 bp, Artificial Sequence
  Synthetic
atccaggaacugcaauccagac

SEQ ID NO: 12274 - DNA, 21 bp, Artificial Sequence
  Synthetic
gagtaaggcutccactgcugt

SEQ ID NO: 12275 - DNA, 28 bp, Artificial Sequence
  Synthetic
caggttccttaccutccattattgttuc

SEQ ID NO: 12276 - DNA, 24 bp, Artificial Sequence
  Synthetic
ccatttaccgaugtggttgtccuc

SEQ ID NO: 12277 - DNA, 21 bp, Artificial Sequence
  Synthetic
gatguagcaccaugacaggca

SEQ ID NO: 12278 - DNA, 21 bp, Artificial Sequence
  Synthetic
ctgagtggccucctgtatugt

SEQ ID NO: 12279 - DNA, 19 bp, Artificial Sequence
  Synthetic
ccgaggcaucaagcatucg

SEQ ID NO: 12280 - DNA, 19 bp, Artificial Sequence
  Synthetic
cggcacaucaagctgcaut

SEQ ID NO: 12281 - DNA, 19 bp, Artificial Sequence
  Synthetic
cgggcagaguggaggaauc

SEQ ID NO: 12282 - DNA, 20 bp, Artificial Sequence
  Synthetic
gagatcuctcgtgcuggaca

SEQ ID NO: 12283 - DNA, 24 bp, Artificial Sequence
  Synthetic
cctttctuccaccctcaactcaut

SEQ ID NO: 12284 - DNA, 18 bp, Artificial Sequence
  Synthetic
cguggagaacctgcugct

SEQ ID NO: 12285 - DNA, 22 bp, Artificial Sequence
  Synthetic
ggttggucaggtagaugagacc

SEQ ID NO: 12286 - DNA, 19 bp, Artificial Sequence
  Synthetic
gtgcaacaugtgcggcuac

SEQ ID NO: 12287 - DNA, 21 bp, Artificial Sequence
  Synthetic
ggcagtccutgtgctttucct

SEQ ID NO: 12288 - DNA, 25 bp, Artificial Sequence
  Synthetic
gggttccttgutctgttccattcua

SEQ ID NO: 12289 - DNA, 22 bp, Artificial Sequence
  Synthetic
caaaaacugggagagctucgga

SEQ ID NO: 12290 - DNA, 24 bp, Artificial Sequence
  Synthetic
tgtctcttcgauctgtgattugcc

SEQ ID NO: 12291 - DNA, 25 bp, Artificial Sequence
  Synthetic
tgttgctcuaggtgttgtaugaacc

SEQ ID NO: 12292 - DNA, 20 bp, Artificial Sequence
  Synthetic
gtcaccgaugcctcctctuc

SEQ ID NO: 12293 - DNA, 22 bp, Artificial Sequence
  Synthetic
tcctcgacutgtttgttuggca

SEQ ID NO: 12294 - DNA, 24 bp, Artificial Sequence
  Synthetic
gaactagcucagaacaucaccgat

SEQ ID NO: 12295 - DNA, 23 bp, Artificial Sequence
  Synthetic
ggaagagggaagccutgagaaug

SEQ ID NO: 12296 - DNA, 23 bp, Artificial Sequence
  Synthetic
cccctgagcuaagtctcacauga

SEQ ID NO: 12297 - DNA, 21 bp, Artificial Sequence
  Synthetic
ggtgauacaagacgcccugaa

SEQ ID NO: 12298 - DNA, 24 bp, Artificial Sequence
  Synthetic
gcatuccaacctgagugacagaag

SEQ ID NO: 12299 - DNA, 24 bp, Artificial Sequence
  Synthetic
ctttcagacucaagaacagcugga

SEQ ID NO: 12300 - DNA, 18 bp, Artificial Sequence
  Synthetic
tgagtccagcugggcuct

SEQ ID NO: 12301 - DNA, 21 bp, Artificial Sequence
  Synthetic
gccgacgacugtgaattccug

SEQ ID NO: 12302 - DNA, 23 bp, Artificial Sequence
  Synthetic
tggttagagucaatgggcttugg

SEQ ID NO: 12303 - DNA, 23 bp, Artificial Sequence
  Synthetic
ccagtccuagagaaggaugacct

SEQ ID NO: 12304 - DNA, 21 bp, Artificial Sequence
  Synthetic
gcacugagaaggactgcgtut

SEQ ID NO: 12305 - DNA, 23 bp, Artificial Sequence
  Synthetic
ctgcagccaccuttatgacuaca

SEQ ID NO: 12306 - DNA, 27 bp, Artificial Sequence
  Synthetic
cttacaagttgtucacgtcactttcuc

SEQ ID NO: 12307 - DNA, 21 bp, Artificial Sequence
  Synthetic
ctgagagagggcucttcaugt

SEQ ID NO: 12308 - DNA, 21 bp, Artificial Sequence
  Synthetic
cagucacttuccccacaagga

SEQ ID NO: 12309 - DNA, 21 bp, Artificial Sequence
  Synthetic
cctctgtcuagcaacgcagug

SEQ ID NO: 12310 - DNA, 18 bp, Artificial Sequence
  Synthetic
cacctgaguccgcucgaa

SEQ ID NO: 12311 - DNA, 19 bp, Artificial Sequence
  Synthetic
cggcgacauggatcggaug

SEQ ID NO: 12312 - DNA, 25 bp, Artificial Sequence
  Synthetic
cattttccttggugccactaacuac

SEQ ID NO: 12313 - DNA, 27 bp, Artificial Sequence
  Synthetic
ttgatgttatctutccaaacaccucct

SEQ ID NO: 12314 - DNA, 26 bp, Artificial Sequence
  Synthetic
tcgatatcagugagaaggcuaaagga

SEQ ID NO: 12315 - DNA, 21 bp, Artificial Sequence
  Synthetic
cccttuggaccgucaagaagt

SEQ ID NO: 12316 - DNA, 28 bp, Artificial Sequence
  Synthetic
tgtgtgcatuccctatcaaatatgucaa

SEQ ID NO: 12317 - DNA, 32 bp, Artificial Sequence
  Synthetic
ttctaatttataccucacagtttataaguggg

SEQ ID NO: 12318 - DNA, 25 bp, Artificial Sequence
  Synthetic
caacccctcaugtgaattttcucct

SEQ ID NO: 12319 - DNA, 23 bp, Artificial Sequence
  Synthetic
gcattugggaaaaaccacgtcua

SEQ ID NO: 12320 - DNA, 27 bp, Artificial Sequence
  Synthetic
gggactttggauttcggaggaataaua

SEQ ID NO: 12321 - DNA, 26 bp, Artificial Sequence
  Synthetic
aacaaaaccuatttuccaagcacacc

SEQ ID NO: 12322 - DNA, 27 bp, Artificial Sequence
  Synthetic
gttttgttttuatctccccuccaggat

SEQ ID NO: 12323 - DNA, 30 bp, Artificial Sequence
  Synthetic
acaacaccttttuaaagtacatgttttucc

SEQ ID NO: 12324 - DNA, 27 bp, Artificial Sequence
  Synthetic
ttccaaagaacagutacccatgaacut

SEQ ID NO: 12325 - DNA, 22 bp, Artificial Sequence
  Synthetic
tgttattgtgcucccaccacug

SEQ ID NO: 12326 - DNA, 25 bp, Artificial Sequence
  Synthetic
agtgatgatcucaatgggcaaugaa

SEQ ID NO: 12327 - DNA, 31 bp, Artificial Sequence
  Synthetic
tgtataagatacaauggccaaguacaacaat

SEQ ID NO: 12328 - DNA, 26 bp, Artificial Sequence
  Synthetic
ttcaaccagaucagaattucacagga

SEQ ID NO: 12329 - DNA, 32 bp, Artificial Sequence
  Synthetic
tgtaatgactgtgtucttaaggtaacttcuaa

SEQ ID NO: 12330 - DNA, 21 bp, Artificial Sequence
  Synthetic
acagacatgucccccatccua

SEQ ID NO: 12331 - DNA, 22 bp, Artificial Sequence
  Synthetic
ccaatcacuacatgctgcacug

SEQ ID NO: 12332 - DNA, 21 bp, Artificial Sequence
  Synthetic
catcccaatgucctctcgcuc

SEQ ID NO: 12333 - DNA, 21 bp, Artificial Sequence
  Synthetic
gatggcuggcttacagcuagt

SEQ ID NO: 12334 - DNA, 29 bp, Artificial Sequence
  Synthetic
tcctttcatatatguatggtcacatcuct

SEQ ID NO: 12335 - DNA, 25 bp, Artificial Sequence
  Synthetic
tctccctugcaacaagtaaacagut

SEQ ID NO: 12336 - DNA, 25 bp, Artificial Sequence
  Synthetic
cactatgtccaugtgaacgctacut

SEQ ID NO: 12337 - DNA, 27 bp, Artificial Sequence
  Synthetic
gactgttgctutgacatagtacuagca

SEQ ID NO: 12338 - DNA, 18 bp, Artificial Sequence
  Synthetic
aggcuggaggtctuccgt

SEQ ID NO: 12339 - DNA, 22 bp, Artificial Sequence
  Synthetic
ttttcagacacacaugcucgga

SEQ ID NO: 12340 - DNA, 18 bp, Artificial Sequence
  Synthetic
caccgacggcauctccuc

SEQ ID NO: 12341 - DNA, 19 bp, Artificial Sequence
  Synthetic
ggtgcaguggagtccugat

SEQ ID NO: 12342 - DNA, 18 bp, Artificial Sequence
  Synthetic
cgtgccucctcgauggac

SEQ ID NO: 12343 - DNA, 25 bp, Artificial Sequence
  Synthetic
gccacaaaaacucatgtgtgatuct

SEQ ID NO: 12344 - DNA, 23 bp, Artificial Sequence
  Synthetic
ctcttccugggctctaugaacac

SEQ ID NO: 12345 - DNA, 19 bp, Artificial Sequence
  Synthetic
gttcccggugguagacgac

SEQ ID NO: 12346 - DNA, 29 bp, Artificial Sequence
  Synthetic
tggactctcauagggactacttttaaugg

SEQ ID NO: 12347 - DNA, 23 bp, Artificial Sequence
  Synthetic
agtttctcccucagatgcugact

SEQ ID NO: 12348 - DNA, 23 bp, Artificial Sequence
  Synthetic
tttattgtgcugacccagaugct

SEQ ID NO: 12349 - DNA, 21 bp, Artificial Sequence
  Synthetic
tggaatugccagcacagtcut

SEQ ID NO: 12350 - DNA, 23 bp, Artificial Sequence
  Synthetic
gctctctggagguccattttgut

SEQ ID NO: 12351 - DNA, 25 bp, Artificial Sequence
  Synthetic
gcttctgcaaugtgaatggtttcug

SEQ ID NO: 12352 - DNA, 23 bp, Artificial Sequence
  Synthetic
gttcugacccaagaggactucag

SEQ ID NO: 12353 - DNA, 30 bp, Artificial Sequence
  Synthetic
ttagagctaaataguaaagacgatgtgtug

SEQ ID NO: 12354 - DNA, 23 bp, Artificial Sequence
  Synthetic
cctggtggugttttctcactuca

SEQ ID NO: 12355 - DNA, 28 bp, Artificial Sequence
  Synthetic
ccutaatactucagaaguacaaacacct

SEQ ID NO: 12356 - DNA, 24 bp, Artificial Sequence
  Synthetic
actgcacacaagcucctuagaaag

SEQ ID NO: 12357 - DNA, 21 bp, Artificial Sequence
  Synthetic
acacaccaacacuggctacug

SEQ ID NO: 12358 - DNA, 22 bp, Artificial Sequence
  Synthetic
tgggaauggcttuggagaaaga

SEQ ID NO: 12359 - DNA, 23 bp, Artificial Sequence
  Synthetic
cattttgacugccgggatucaag

SEQ ID NO: 12360 - DNA, 25 bp, Artificial Sequence
  Synthetic
aaactcaagauttgtggaacuggga

SEQ ID NO: 12361 - DNA, 21 bp, Artificial Sequence
  Synthetic
ctctgaugccgagtgactugt

SEQ ID NO: 12362 - DNA, 22 bp, Artificial Sequence
  Synthetic
gaccgagaaaaaugcagtgguc

SEQ ID NO: 12363 - DNA, 21 bp, Artificial Sequence
  Synthetic
gcatttcugccgaggtggaua

SEQ ID NO: 12364 - DNA, 24 bp, Artificial Sequence
  Synthetic
gtguatggtctgaaugaggacacc

SEQ ID NO: 12365 - DNA, 21 bp, Artificial Sequence
  Synthetic
caactccucttgcattugcgt

SEQ ID NO: 12366 - DNA, 23 bp, Artificial Sequence
  Synthetic
ctctgtuagggaagccacaauct

SEQ ID NO: 12367 - DNA, 20 bp, Artificial Sequence
  Synthetic
ctttcggucagctttucgca

SEQ ID NO: 12368 - DNA, 27 bp, Artificial Sequence
  Synthetic
tgtacttttggtcugttttccttggut

SEQ ID NO: 12369 - DNA, 22 bp, Artificial Sequence
  Synthetic
ctcgtgcugaagaaaagcacug

SEQ ID NO: 12370 - DNA, 19 bp, Artificial Sequence
  Synthetic
gccgcccutctgtttcucc

SEQ ID NO: 12371 - DNA, 17 bp, Artificial Sequence
  Synthetic
gguggccggtttcucac

SEQ ID NO: 12372 - DNA, 22 bp, Artificial Sequence
  Synthetic
gggcatctuaggcaggatcaug

SEQ ID NO: 12373 - DNA, 17 bp, Artificial Sequence
  Synthetic
cccggcgcuctccuact

SEQ ID NO: 12374 - DNA, 18 bp, Artificial Sequence
  Synthetic
gggcgaugggttgauggg

SEQ ID NO: 12375 - DNA, 17 bp, Artificial Sequence
  Synthetic
cacutgcagcugcggat

SEQ ID NO: 12376 - DNA, 18 bp, Artificial Sequence
  Synthetic
tgagggccuctgcactug

SEQ ID NO: 12377 - DNA, 19 bp, Artificial Sequence
  Synthetic
gggtgacuttctcccucgg

SEQ ID NO: 12378 - DNA, 18 bp, Artificial Sequence
  Synthetic
gaatcgcucccugcagct

SEQ ID NO: 12379 - DNA, 18 bp, Artificial Sequence
  Synthetic
agggtcccugggagaugt

SEQ ID NO: 12380 - DNA, 17 bp, Artificial Sequence
  Synthetic
cucacgagccagcucca

SEQ ID NO: 12381 - DNA, 20 bp, Artificial Sequence
  Synthetic
guaggaggcagaggtcucca

SEQ ID NO: 12382 - DNA, 24 bp, Artificial Sequence
  Synthetic
ggactacucccactgtctcuacac

SEQ ID NO: 12383 - DNA, 21 bp, Artificial Sequence
  Synthetic
cgttaggtuggcttctcccut

SEQ ID NO: 12384 - DNA, 19 bp, Artificial Sequence
  Synthetic
acauggccagcaaccugat

SEQ ID NO: 12385 - DNA, 17 bp, Artificial Sequence
  Synthetic
ccacccccuctgcugac

SEQ ID NO: 12386 - DNA, 17 bp, Artificial Sequence
  Synthetic
ctggccuccauccagct

SEQ ID NO: 12387 - DNA, 19 bp, Artificial Sequence
  Synthetic
ttgctguggctguggaaga

SEQ ID NO: 12388 - DNA, 18 bp, Artificial Sequence
  Synthetic
cuccagccagcccaaugt

SEQ ID NO: 12389 - DNA, 21 bp, Artificial Sequence
  Synthetic
aguacacccauccccatttuc

SEQ ID NO: 12390 - DNA, 21 bp, Artificial Sequence
  Synthetic
catagccaugacctctgcugt

SEQ ID NO: 12391 - DNA, 22 bp, Artificial Sequence
  Synthetic
gcatcaccccacuctatgccua

SEQ ID NO: 12392 - DNA, 22 bp, Artificial Sequence
  Synthetic
cctcatcacugcttctgtguct

SEQ ID NO: 12393 - DNA, 18 bp, Artificial Sequence
  Synthetic
gggutctgugccagagga

SEQ ID NO: 12394 - DNA, 17 bp, Artificial Sequence
  Synthetic
gctcuggcagtguccca

SEQ ID NO: 12395 - DNA, 18 bp, Artificial Sequence
  Synthetic
ccacgaggcuctcacguc

SEQ ID NO: 12396 - DNA, 20 bp, Artificial Sequence
  Synthetic
ctgcaugaagaccggacuct

SEQ ID NO: 12397 - DNA, 21 bp, Artificial Sequence
  Synthetic
gctgacuacggagacacctug

SEQ ID NO: 12398 - DNA, 17 bp, Artificial Sequence
  Synthetic
gagctcuggctcuggca

SEQ ID NO: 12399 - DNA, 21 bp, Artificial Sequence
  Synthetic
agacguccctgacctuacagt

SEQ ID NO: 12400 - DNA, 22 bp, Artificial Sequence
  Synthetic
ccactcctugcttctcagauga

SEQ ID NO: 12401 - DNA, 23 bp, Artificial Sequence
  Synthetic
ctggugacagaggacaatgugat

SEQ ID NO: 12402 - DNA, 22 bp, Artificial Sequence
  Synthetic
gataccccagcucagatctuct

SEQ ID NO: 12403 - DNA, 25 bp, Artificial Sequence
  Synthetic
tgtcagaccugatctcagaaaugga

SEQ ID NO: 12404 - DNA, 22 bp, Artificial Sequence
  Synthetic
gggaagcucatacucagagacc

SEQ ID NO: 12405 - DNA, 20 bp, Artificial Sequence
  Synthetic
ctctagggugaccccacuct

SEQ ID NO: 12406 - DNA, 27 bp, Artificial Sequence
  Synthetic
cgtccucaaaggagacatttctuaagt

SEQ ID NO: 12407 - DNA, 23 bp, Artificial Sequence
  Synthetic
tcctctagucccccttctttcug

SEQ ID NO: 12408 - DNA, 23 bp, Artificial Sequence
  Synthetic
acgaagacuggtgccatgatuac

SEQ ID NO: 12409 - DNA, 21 bp, Artificial Sequence
  Synthetic
gggtagcaacguggagtucat

SEQ ID NO: 12410 - DNA, 24 bp, Artificial Sequence
  Synthetic
tcccctgtucccattactcuaact

SEQ ID NO: 12411 - DNA, 23 bp, Artificial Sequence
  Synthetic
gaagttcaaaugcccttccagug

SEQ ID NO: 12412 - DNA, 22 bp, Artificial Sequence
  Synthetic
gctggtuacgcaagcauagagg

SEQ ID NO: 12413 - DNA, 21 bp, Artificial Sequence
  Synthetic
ggacgatgugcagagcaucaa

SEQ ID NO: 12414 - DNA, 28 bp, Artificial Sequence
  Synthetic
aaaaaggtccattuttctctggtttguc

SEQ ID NO: 12415 - DNA, 17 bp, Artificial Sequence
  Synthetic
acaggccccucccauca

SEQ ID NO: 12416 - DNA, 18 bp, Artificial Sequence
  Synthetic
catggcaacugccgaugg

SEQ ID NO: 12417 - DNA, 22 bp, Artificial Sequence
  Synthetic
ccaccaacautggcattccuca

SEQ ID NO: 12418 - DNA, 22 bp, Artificial Sequence
  Synthetic
ggctgatggutgagagtagcug

SEQ ID NO: 12419 - DNA, 17 bp, Artificial Sequence
  Synthetic
ccccgcugtcacagugt

SEQ ID NO: 12420 - DNA, 23 bp, Artificial Sequence
  Synthetic
gatacggaaggcacauccaucat

SEQ ID NO: 12421 - DNA, 20 bp, Artificial Sequence
  Synthetic
cagtcaguccgttcggucag

SEQ ID NO: 12422 - DNA, 20 bp, Artificial Sequence
  Synthetic
tcttcguggtcgtccucaga

SEQ ID NO: 12423 - DNA, 23 bp, Artificial Sequence
  Synthetic
agcctggtgutcaagagtcttut

SEQ ID NO: 12424 - DNA, 20 bp, Artificial Sequence
  Synthetic
cacctcaggcuccttggtut

SEQ ID NO: 12425 - DNA, 17 bp, Artificial Sequence
  Synthetic
augccccuacccgagga

SEQ ID NO: 12426 - DNA, 26 bp, Artificial Sequence
  Synthetic
gatgtatctggcucaagaggagaaut

SEQ ID NO: 12427 - DNA, 29 bp, Artificial Sequence
  Synthetic
tguatatgctagtctuggaagaaggaact

SEQ ID NO: 12428 - DNA, 27 bp, Artificial Sequence
  Synthetic
cagaacugtaagcuaaaacgagaaggt

SEQ ID NO: 12429 - DNA, 18 bp, Artificial Sequence
  Synthetic
aagcccucggtcaagcuc

SEQ ID NO: 12430 - DNA, 27 bp, Artificial Sequence
  Synthetic
cacattctccauattgttccugaggag

SEQ ID NO: 12431 - DNA, 21 bp, Artificial Sequence
  Synthetic
caaauagccagccatcucgga

SEQ ID NO: 12432 - DNA, 24 bp, Artificial Sequence
  Synthetic
cacagagtuggacactatgacugg

SEQ ID NO: 12433 - DNA, 27 bp, Artificial Sequence
  Synthetic
aacttttctctggutccagatttguga

SEQ ID NO: 12434 - DNA, 25 bp, Artificial Sequence
  Synthetic
caauatgccatguaggaaagacgac

SEQ ID NO: 12435 - DNA, 27 bp, Artificial Sequence
  Synthetic
gggattgttatttuggtgaatccagut

SEQ ID NO: 12436 - DNA, 27 bp, Artificial Sequence
  Synthetic
acaatagatgcaauataggtggcccua

SEQ ID NO: 12437 - DNA, 25 bp, Artificial Sequence
  Synthetic
catgaagaaaugtggttggtuccat

SEQ ID NO: 12438 - DNA, 24 bp, Artificial Sequence
  Synthetic
actucccaaactcaaugacagagg

SEQ ID NO: 12439 - DNA, 24 bp, Artificial Sequence
  Synthetic
cuttggagtccugagaagacaaca

SEQ ID NO: 12440 - DNA, 18 bp, Artificial Sequence
  Synthetic
agcttuccgcccaucagg

SEQ ID NO: 12441 - DNA, 24 bp, Artificial Sequence
  Synthetic
agccaatcagcaucatcatcauca

SEQ ID NO: 12442 - DNA, 26 bp, Artificial Sequence
  Synthetic
aaatgtgcttucactaacatccucct

SEQ ID NO: 12443 - DNA, 24 bp, Artificial Sequence
  Synthetic
tgtgattcatgugaccgaggttut

SEQ ID NO: 12444 - DNA, 30 bp, Artificial Sequence
  Synthetic
ctcataaggaucaaggatacaaacucaagt

SEQ ID NO: 12445 - DNA, 25 bp, Artificial Sequence
  Synthetic
aaaagaagucagaggaacucatcuc

SEQ ID NO: 12446 - DNA, 21 bp, Artificial Sequence
  Synthetic
gcagcacugcctccgaauaat

SEQ ID NO: 12447 - DNA, 30 bp, Artificial Sequence
  Synthetic
cggaaccauggaaaattggataauaaacaa

SEQ ID NO: 12448 - DNA, 20 bp, Artificial Sequence
  Synthetic
cgggttugcgagtttuacca

SEQ ID NO: 12449 - DNA, 24 bp, Artificial Sequence
  Synthetic
gaaggactuaggccagaaaacuca

SEQ ID NO: 12450 - DNA, 24 bp, Artificial Sequence
  Synthetic
accgtggaagauttaacgaauggg

SEQ ID NO: 12451 - DNA, 28 bp, Artificial Sequence
  Synthetic
ctctacacacguttcatgtaagtactut

SEQ ID NO: 12452 - DNA, 26 bp, Artificial Sequence
  Synthetic
ttggcaatgaguttctggtaauaaca

SEQ ID NO: 12453 - DNA, 26 bp, Artificial Sequence
  Synthetic
gttcacaucaggaagggtaaagucat

SEQ ID NO: 12454 - DNA, 28 bp, Artificial Sequence
  Synthetic
agtggctggguattcattttcttatgut

SEQ ID NO: 12455 - DNA, 24 bp, Artificial Sequence
  Synthetic
acauaggcatcattuccagcagag

SEQ ID NO: 12456 - DNA, 23 bp, Artificial Sequence
  Synthetic
ccuaacaguccagcaggaagaag

SEQ ID NO: 12457 - DNA, 30 bp, Artificial Sequence
  Synthetic
tgcctggccaauatactcttaacttuaaat

SEQ ID NO: 12458 - DNA, 28 bp, Artificial Sequence
  Synthetic
aaaaagaagcuagaagaccttggtgaut

SEQ ID NO: 12459 - DNA, 28 bp, Artificial Sequence
  Synthetic
tgtctcttgtagguttcaagttgactuc

SEQ ID NO: 12460 - DNA, 24 bp, Artificial Sequence
  Synthetic
ttaaaacgugaagctaacccucca

SEQ ID NO: 12461 - DNA, 27 bp, Artificial Sequence
  Synthetic
aaatcatcuggtttgtacucgcaaaac

SEQ ID NO: 12462 - DNA, 23 bp, Artificial Sequence
  Synthetic
aggcatacguaactcaccactug

SEQ ID NO: 12463 - DNA, 29 bp, Artificial Sequence
  Synthetic
atggaccatcgutggtacatatuaaaact

SEQ ID NO: 12464 - DNA, 30 bp, Artificial Sequence
  Synthetic
gatacactguaacaaattctgcatgaugaa

SEQ ID NO: 12465 - DNA, 23 bp, Artificial Sequence
  Synthetic
tgtgctugccagtctatctucag

SEQ ID NO: 12466 - DNA, 23 bp, Artificial Sequence
  Synthetic
gcaccaagaccccuttaacucaa

SEQ ID NO: 12467 - DNA, 22 bp, Artificial Sequence
  Synthetic
cctcgucgcagtagaaauacgg

SEQ ID NO: 12468 - DNA, 22 bp, Artificial Sequence
  Synthetic
tgaaccagaguttcatcugcga

SEQ ID NO: 12469 - DNA, 17 bp, Artificial Sequence
  Synthetic
ggctgccgcugtcttug

SEQ ID NO: 12470 - DNA, 29 bp, Artificial Sequence
  Synthetic
accttgctaaaggagugatttctattucc

SEQ ID NO: 12471 - DNA, 19 bp, Artificial Sequence
  Synthetic
ggctgugaggaggttugct

SEQ ID NO: 12472 - DNA, 18 bp, Artificial Sequence
  Synthetic
gccctgcgugaccagauc

SEQ ID NO: 12473 - DNA, 24 bp, Artificial Sequence
  Synthetic
gtttcaactgutctcgtcgttucc

SEQ ID NO: 12474 - DNA, 26 bp, Artificial Sequence
  Synthetic
ggagggaacauccacctcttctauat

SEQ ID NO: 12475 - DNA, 25 bp, Artificial Sequence
  Synthetic
gaaaggtcagauaatctgccucaga

SEQ ID NO: 12476 - DNA, 31 bp, Artificial Sequence
  Synthetic
aatacctttcagtaugctgtaggtgactaua

SEQ ID NO: 12477 - DNA, 23 bp, Artificial Sequence
  Synthetic
gcttcagcaccucgagatatucc

SEQ ID NO: 12478 - DNA, 26 bp, Artificial Sequence
  Synthetic
tccctagcuacaagacattctuacca

SEQ ID NO: 12479 - DNA, 22 bp, Artificial Sequence
  Synthetic
gtggctttgcautggctgaaut

SEQ ID NO: 12480 - DNA, 26 bp, Artificial Sequence
  Synthetic
aaatggctctguaaattctacccgut

SEQ ID NO: 12481 - DNA, 24 bp, Artificial Sequence
  Synthetic
tcatttgaacccucttggttugct

SEQ ID NO: 12482 - DNA, 30 bp, Artificial Sequence
  Synthetic
tgacagttttagauttgacttttgattgut

SEQ ID NO: 12483 - DNA, 24 bp, Artificial Sequence
  Synthetic
actgcatcgaaguacatacagucc

SEQ ID NO: 12484 - DNA, 29 bp, Artificial Sequence
  Synthetic
gacaaagaagaacutcagcagtctuaaag

SEQ ID NO: 12485 - DNA, 28 bp, Artificial Sequence
  Synthetic
ccacataaacaauccatgaccagtaaut

SEQ ID NO: 12486 - DNA, 30 bp, Artificial Sequence
  Synthetic
tttatggacaacagucaaacaacaattcut

SEQ ID NO: 12487 - DNA, 30 bp, Artificial Sequence
  Synthetic
aggcattagaaagccugtagttttactuac

SEQ ID NO: 12488 - DNA, 29 bp, Artificial Sequence
  Synthetic
tgtgccaaaaauattctgcttaucagaga

SEQ ID NO: 12489 - DNA, 21 bp, Artificial Sequence
  Synthetic
ccuttacaccacugcccaagt

SEQ ID NO: 12490 - DNA, 31 bp, Artificial Sequence
  Synthetic
agtgggcagaatuagcaaaccttataaauaa

SEQ ID NO: 12491 - DNA, 30 bp, Artificial Sequence
  Synthetic
agatagaaagcuggaaaatcaataagauca

SEQ ID NO: 12492 - DNA, 24 bp, Artificial Sequence
  Synthetic
guatgaccctcuacaggacaacac

SEQ ID NO: 12493 - DNA, 26 bp, Artificial Sequence
  Synthetic
acaatgttgtcaugctgtagggatut

SEQ ID NO: 12494 - DNA, 33 bp, Artificial Sequence
  Synthetic
agataataaagggaauatatagggtuaagacca

SEQ ID NO: 12495 - DNA, 25 bp, Artificial Sequence
  Synthetic
actctgttctcgutctccaccaaua

SEQ ID NO: 12496 - DNA, 26 bp, Artificial Sequence
  Synthetic
aatcacugacagagagcaagtttuct

SEQ ID NO: 12497 - DNA, 30 bp, Artificial Sequence
  Synthetic
aactgaaagtaaauaaaaagcacacugacc

SEQ ID NO: 12498 - DNA, 27 bp, Artificial Sequence
  Synthetic
tcaaataagggauaacatggctggaug

SEQ ID NO: 12499 - DNA, 25 bp, Artificial Sequence
  Synthetic
tctttgctggcuagcatcatgatut

SEQ ID NO: 12500 - DNA, 22 bp, Artificial Sequence
  Synthetic
ggaaggcutgtcagtgtuggag

SEQ ID NO: 12501 - DNA, 23 bp, Artificial Sequence
  Synthetic
cacagcgttcuctttgatcccua

SEQ ID NO: 12502 - DNA, 25 bp, Artificial Sequence
  Synthetic
cagagtcatugtcgttatccuccac

SEQ ID NO: 12503 - DNA, 23 bp, Artificial Sequence
  Synthetic
tggtaagcauccccctgtttcua

SEQ ID NO: 12504 - DNA, 23 bp, Artificial Sequence
  Synthetic
ggtggtgcgcuagaaaaacttut

SEQ ID NO: 12505 - DNA, 26 bp, Artificial Sequence
  Synthetic
catcaccaguggacaagauaagaagg

SEQ ID NO: 12506 - DNA, 26 bp, Artificial Sequence
  Synthetic
tgaggcttugaaaaactggtacuact

SEQ ID NO: 12507 - DNA, 27 bp, Artificial Sequence
  Synthetic
accctaauaggagtattcauaccagca

SEQ ID NO: 12508 - DNA, 27 bp, Artificial Sequence
  Synthetic
ctagtgacagaagugcttatgagucaa

SEQ ID NO: 12509 - DNA, 27 bp, Artificial Sequence
  Synthetic
caccttacaaaguagaagaatcugggt

SEQ ID NO: 12510 - DNA, 29 bp, Artificial Sequence
  Synthetic
gagggcttttatuattatttttgcgcgua

SEQ ID NO: 12511 - DNA, 25 bp, Artificial Sequence
  Synthetic
ctctcattcauagcagcctctucat

SEQ ID NO: 12512 - DNA, 24 bp, Artificial Sequence
  Synthetic
tttcagtgtucaccacccacaaua

SEQ ID NO: 12513 - DNA, 21 bp, Artificial Sequence
  Synthetic
ggctagaucggagggaugagg

SEQ ID NO: 12514 - DNA, 21 bp, Artificial Sequence
  Synthetic
ggtgggcugggacacatuaaa

SEQ ID NO: 12515 - DNA, 23 bp, Artificial Sequence
  Synthetic
ccctgttcugtgtcctactucag

SEQ ID NO: 12516 - DNA, 20 bp, Artificial Sequence
  Synthetic
ctgcctggaucagtgcuacc

SEQ ID NO: 12517 - DNA, 21 bp, Artificial Sequence
  Synthetic
aggactcugcatgguaccaga

SEQ ID NO: 12518 - DNA, 21 bp, Artificial Sequence
  Synthetic
ccacatctucacctggcagut

SEQ ID NO: 12519 - DNA, 22 bp, Artificial Sequence
  Synthetic
agcactgtugtacttggtugca

SEQ ID NO: 12520 - DNA, 22 bp, Artificial Sequence
  Synthetic
cccauggaactgaaugggacaa

SEQ ID NO: 12521 - DNA, 21 bp, Artificial Sequence
  Synthetic
gcccagggautgaaggatguc

SEQ ID NO: 12522 - DNA, 18 bp, Artificial Sequence
  Synthetic
agagucccacagcuccct

SEQ ID NO: 12523 - DNA, 22 bp, Artificial Sequence
  Synthetic
ggagatggaggaugaggtgcua

SEQ ID NO: 12524 - DNA, 20 bp, Artificial Sequence
  Synthetic
atcctgagccaacugctguc

SEQ ID NO: 12525 - DNA, 24 bp, Artificial Sequence
  Synthetic
agaaatgacuggagaatgcauccc

SEQ ID NO: 12526 - DNA, 17 bp, Artificial Sequence
  Synthetic
agggcgggugtcuagga

SEQ ID NO: 12527 - DNA, 29 bp, Artificial Sequence
  Synthetic
tgaacccagacagugacaaaattatcuac

SEQ ID NO: 12528 - DNA, 23 bp, Artificial Sequence
  Synthetic
ttccccacacccuactttctauc

SEQ ID NO: 12529 - DNA, 30 bp, Artificial Sequence
  Synthetic
gctttgaaaatgucacctctatcatgttuc

SEQ ID NO: 12530 - DNA, 33 bp, Artificial Sequence
  Synthetic
aaagaagttatgauaatcataaaaccuccacat

SEQ ID NO: 12531 - DNA, 28 bp, Artificial Sequence
  Synthetic
aggaatgctatgauagacgacgagaaua

SEQ ID NO: 12532 - DNA, 26 bp, Artificial Sequence
  Synthetic
gaagccccutttatcttcaucagagt

SEQ ID NO: 12533 - DNA, 28 bp, Artificial Sequence
  Synthetic
caaggcatgguatttggtttagttauct

SEQ ID NO: 12534 - DNA, 28 bp, Artificial Sequence
  Synthetic
cagtttttctgauctagggctttcaaug

SEQ ID NO: 12535 - DNA, 26 bp, Artificial Sequence
  Synthetic
acaaaggacaaauctgtcuggaaagt

SEQ ID NO: 12536 - DNA, 22 bp, Artificial Sequence
  Synthetic
atcaguaattgctcugccacca

SEQ ID NO: 12537 - DNA, 23 bp, Artificial Sequence
  Synthetic
cgttggcaaacgutaaagtugct

SEQ ID NO: 12538 - DNA, 21 bp, Artificial Sequence
  Synthetic
agcttcuacaaagcacugcgt

SEQ ID NO: 12539 - DNA, 26 bp, Artificial Sequence
  Synthetic
ctactttucccttatacagugcaggt

SEQ ID NO: 12540 - DNA, 21 bp, Artificial Sequence
  Synthetic
ccagaggcagacuacagcuga

SEQ ID NO: 12541 - DNA, 28 bp, Artificial Sequence
  Synthetic
gtctcacaaatuggattagtgatugcat

SEQ ID NO: 12542 - DNA, 27 bp, Artificial Sequence
  Synthetic
catttactcuttttgctgauggcacat

SEQ ID NO: 12543 - DNA, 29 bp, Artificial Sequence
  Synthetic
cactcagatttgauaaagaagttgctcut

SEQ ID NO: 12544 - DNA, 21 bp, Artificial Sequence
  Synthetic
cgtgaagacaggugtctugct

SEQ ID NO: 12545 - DNA, 23 bp, Artificial Sequence
  Synthetic
agggacaucaccttttcgcttut

SEQ ID NO: 12546 - DNA, 24 bp, Artificial Sequence
  Synthetic
caccttuggcatttttguccaaac

SEQ ID NO: 12547 - DNA, 26 bp, Artificial Sequence
  Synthetic
ttutcaggtcagaaugaaggaacgat

SEQ ID NO: 12548 - DNA, 20 bp, Artificial Sequence
  Synthetic
ggcgctgugcagatactgua

SEQ ID NO: 12549 - DNA, 25 bp, Artificial Sequence
  Synthetic
gagtctctcautgcttttgtcucca

SEQ ID NO: 12550 - DNA, 25 bp, Artificial Sequence
  Synthetic
ctgcagctttutccttctttgtuca

SEQ ID NO: 12551 - DNA, 23 bp, Artificial Sequence
  Synthetic
ggctttgcttucagccttcttuc

SEQ ID NO: 12552 - DNA, 22 bp, Artificial Sequence
  Synthetic
actcattucacgccaaccauca

SEQ ID NO: 12553 - DNA, 27 bp, Artificial Sequence
  Synthetic
tgaattugaggattacacucagccaat

SEQ ID NO: 12554 - DNA, 24 bp, Artificial Sequence
  Synthetic
agcaatcacgautcagaagtguca

SEQ ID NO: 12555 - DNA, 26 bp, Artificial Sequence
  Synthetic
acagcaaagcagautactcatccaut

SEQ ID NO: 12556 - DNA, 22 bp, Artificial Sequence
  Synthetic
ccgtttctttugctgtgcatug

SEQ ID NO: 12557 - DNA, 25 bp, Artificial Sequence
  Synthetic
agagggtactaaucaccagtgtgut

SEQ ID NO: 12558 - DNA, 24 bp, Artificial Sequence
  Synthetic
caacttaccugagttgcttugcat

SEQ ID NO: 12559 - DNA, 28 bp, Artificial Sequence
  Synthetic
accataacttcuctcttggtttgttuca

SEQ ID NO: 12560 - DNA, 24 bp, Artificial Sequence
  Synthetic
ttttagccuacaggatccaccuct

SEQ ID NO: 12561 - DNA, 21 bp, Artificial Sequence
  Synthetic
ggcaagggaugggaaccuaac

SEQ ID NO: 12562 - DNA, 17 bp, Artificial Sequence
  Synthetic
cggugcaccctccucct

SEQ ID NO: 12563 - DNA, 19 bp, Artificial Sequence
  Synthetic
ccacgccuccatcttcucc

SEQ ID NO: 12564 - DNA, 18 bp, Artificial Sequence
  Synthetic
gcacgauctggagcucct

SEQ ID NO: 12565 - DNA, 25 bp, Artificial Sequence
  Synthetic
cctggagttugcatgaaacttucac

SEQ ID NO: 12566 - DNA, 20 bp, Artificial Sequence
  Synthetic
ccgcccuactacggaaacuc

SEQ ID NO: 12567 - DNA, 17 bp, Artificial Sequence
  Synthetic
aggtcccucccgaccuc

SEQ ID NO: 12568 - DNA, 23 bp, Artificial Sequence
  Synthetic
gagaaagagugcctcaaguacca

SEQ ID NO: 12569 - DNA, 19 bp, Artificial Sequence
  Synthetic
ctgtacucgggcacguagg

SEQ ID NO: 12570 - DNA, 20 bp, Artificial Sequence
  Synthetic
ctcctctcuccccactcuca

SEQ ID NO: 12571 - DNA, 22 bp, Artificial Sequence
  Synthetic
ttgctgaucccagtccactuac

SEQ ID NO: 12572 - DNA, 18 bp, Artificial Sequence
  Synthetic
ggtcaccgccaugggtua

SEQ ID NO: 12573 - DNA, 26 bp, Artificial Sequence
  Synthetic
tgcaaaguggcaaacataatttugct

SEQ ID NO: 12574 - DNA, 23 bp, Artificial Sequence
  Synthetic
cattgttcaaguacccacuggac

SEQ ID NO: 12575 - DNA, 26 bp, Artificial Sequence
  Synthetic
aggagtgcagutcctaatttccuaac

SEQ ID NO: 12576 - DNA, 23 bp, Artificial Sequence
  Synthetic
accccaagacutgctacattugt

SEQ ID NO: 12577 - DNA, 24 bp, Artificial Sequence
  Synthetic
ctgtgcaacaauggaaacatccut

SEQ ID NO: 12578 - DNA, 27 bp, Artificial Sequence
  Synthetic
gcactagcaacaacuctatatcuggat

SEQ ID NO: 12579 - DNA, 24 bp, Artificial Sequence
  Synthetic
tgagctgtgagcugaagatttcut

SEQ ID NO: 12580 - DNA, 24 bp, Artificial Sequence
  Synthetic
acagtcaucagcaaccaaagaugt

SEQ ID NO: 12581 - DNA, 28 bp, Artificial Sequence
  Synthetic
ggaattacccaaauctccaggtgaatut

SEQ ID NO: 12582 - DNA, 26 bp, Artificial Sequence
  Synthetic
aagctctagtcugcagaaatctccua

SEQ ID NO: 12583 - DNA, 24 bp, Artificial Sequence
  Synthetic
guggtgggagugaaggagaaaaat

SEQ ID NO: 12584 - DNA, 24 bp, Artificial Sequence
  Synthetic
gtgtctgugacaaatttgacugct

SEQ ID NO: 12585 - DNA, 23 bp, Artificial Sequence
  Synthetic
ccagaagacugctgaggtaagug

SEQ ID NO: 12586 - DNA, 27 bp, Artificial Sequence
  Synthetic
ctgtactctctuaaaagcattccccut

SEQ ID NO: 12587 - DNA, 22 bp, Artificial Sequence
  Synthetic
caaaagcugttctatgcuggct

SEQ ID NO: 12588 - DNA, 30 bp, Artificial Sequence
  Synthetic
acaaautaaaaacttgacugccaaaaagga

SEQ ID NO: 12589 - DNA, 23 bp, Artificial Sequence
  Synthetic
acacttaccaguctgtgcugaaa

SEQ ID NO: 12590 - DNA, 26 bp, Artificial Sequence
  Synthetic
ggaataattggagcuttgccagguaa

SEQ ID NO: 12591 - DNA, 23 bp, Artificial Sequence
  Synthetic
ctgttagucagtgtagcuggcat

SEQ ID NO: 12592 - DNA, 22 bp, Artificial Sequence
  Synthetic
cactucacacagcuaccaccaa

SEQ ID NO: 12593 - DNA, 24 bp, Artificial Sequence
  Synthetic
ggaacaaaaccaggcuggaaaaug

SEQ ID NO: 12594 - DNA, 24 bp, Artificial Sequence
  Synthetic
ggatggcucagttctcaaagucac

SEQ ID NO: 12595 - DNA, 25 bp, Artificial Sequence
  Synthetic
atccacatugcggagatcatuacat

SEQ ID NO: 12596 - DNA, 18 bp, Artificial Sequence
  Synthetic
tgtcauagccccgtgcug

SEQ ID NO: 12597 - DNA, 28 bp, Artificial Sequence
  Synthetic
acacauaggaaaaacacaactuaccact

SEQ ID NO: 12598 - DNA, 28 bp, Artificial Sequence
  Synthetic
aaagaattttuggccttttacagtuggt

SEQ ID NO: 12599 - DNA, 23 bp, Artificial Sequence
  Synthetic
accttttggcautctggaaagug

SEQ ID NO: 12600 - DNA, 25 bp, Artificial Sequence
  Synthetic
cccatuggacgaccgaaaaauaaat

SEQ ID NO: 12601 - DNA, 30 bp, Artificial Sequence
  Synthetic
aaaacccctaaaggaauctgagagaauaac

SEQ ID NO: 12602 - DNA, 30 bp, Artificial Sequence
  Synthetic
cctacatttctgccuctacacttaaagtua

SEQ ID NO: 12603 - DNA, 25 bp, Artificial Sequence
  Synthetic
tggacgatagugctttgaaaaguct

SEQ ID NO: 12604 - DNA, 26 bp, Artificial Sequence
  Synthetic
gcactctttgaugggctttctcauat

SEQ ID NO: 12605 - DNA, 28 bp, Artificial Sequence
  Synthetic
accgacttcuaatatctctttugccaaa

SEQ ID NO: 12606 - DNA, 30 bp, Artificial Sequence
  Synthetic
caaacaagaaagugcagatgtaaatgugat

SEQ ID NO: 12607 - DNA, 28 bp, Artificial Sequence
  Synthetic
gaagccacatcutatacttgctacuaca

SEQ ID NO: 12608 - DNA, 26 bp, Artificial Sequence
  Synthetic
tccagcaaaugaaattuaccgaagga

SEQ ID NO: 12609 - DNA, 27 bp, Artificial Sequence
  Synthetic
tgtaccttcuaaacacaaaucagcaca

SEQ ID NO: 12610 - DNA, 21 bp, Artificial Sequence
  Synthetic
ccacagugaggaatgcccaut

SEQ ID NO: 12611 - DNA, 21 bp, Artificial Sequence
  Synthetic
ctccaagaugacgctctucca

SEQ ID NO: 12612 - DNA, 23 bp, Artificial Sequence
  Synthetic
ccagagccaaugaacttgaucca

SEQ ID NO: 12613 - DNA, 31 bp, Artificial Sequence
  Synthetic
gcttaagaatgcuacaagattgaagtuacac

SEQ ID NO: 12614 - DNA, 28 bp, Artificial Sequence
  Synthetic
tgtcuaaagagagcagugaagaagaaga

SEQ ID NO: 12615 - DNA, 20 bp, Artificial Sequence
  Synthetic
ggcaacugactgtggttucg

SEQ ID NO: 12616 - DNA, 26 bp, Artificial Sequence
  Synthetic
ccttcccgttuttgtctcttcacuaa

SEQ ID NO: 12617 - DNA, 23 bp, Artificial Sequence
  Synthetic
tcctctctutgttttgccuccac

SEQ ID NO: 12618 - DNA, 22 bp, Artificial Sequence
  Synthetic
tccaaacacaucaccaggugaa

SEQ ID NO: 12619 - DNA, 29 bp, Artificial Sequence
  Synthetic
cttttagcaccauctggatctttttcuac

SEQ ID NO: 12620 - DNA, 27 bp, Artificial Sequence
  Synthetic
cutcaaagaagtacuggaaaaccagga

SEQ ID NO: 12621 - DNA, 23 bp, Artificial Sequence
  Synthetic
gtcagatucgggtacagctucag

SEQ ID NO: 12622 - DNA, 21 bp, Artificial Sequence
  Synthetic
tttcatccguccactcccauc

SEQ ID NO: 12623 - DNA, 21 bp, Artificial Sequence
  Synthetic
tgggacauccatcaugggact

SEQ ID NO: 12624 - DNA, 17 bp, Artificial Sequence
  Synthetic
catcagcuccccuccga

SEQ ID NO: 12625 - DNA, 22 bp, Artificial Sequence
  Synthetic
cgtataagccaaugttggcgut

SEQ ID NO: 12626 - DNA, 20 bp, Artificial Sequence
  Synthetic
cgccuctttugcaacggaac

SEQ ID NO: 12627 - DNA, 18 bp, Artificial Sequence
  Synthetic
agtcugggagcgcccaua

SEQ ID NO: 12628 - DNA, 22 bp, Artificial Sequence
  Synthetic
caccccacgguaacatgatgua

SEQ ID NO: 12629 - DNA, 21 bp, Artificial Sequence
  Synthetic
tgatgccccguaggttttgug

SEQ ID NO: 12630 - DNA, 24 bp, Artificial Sequence
  Synthetic
gttacacttguttaccacgtugct

SEQ ID NO: 12631 - DNA, 28 bp, Artificial Sequence
  Synthetic
actgtagtaacagucttcctcaatucca

SEQ ID NO: 12632 - DNA, 23 bp, Artificial Sequence
  Synthetic
tcctgcccaccautttcataguc

SEQ ID NO: 12633 - DNA, 30 bp, Artificial Sequence
  Synthetic
acagtgttcacauacagtagagtuacaaaa

SEQ ID NO: 12634 - DNA, 25 bp, Artificial Sequence
  Synthetic
ctacaggauccagatctaactuggg

SEQ ID NO: 12635 - DNA, 28 bp, Artificial Sequence
  Synthetic
agaatgaggcaaauctttgtgaacuact

SEQ ID NO: 12636 - DNA, 29 bp, Artificial Sequence
  Synthetic
agcgtatgacacautgattaaagatcuca

SEQ ID NO: 12637 - DNA, 27 bp, Artificial Sequence
  Synthetic
ccaagcttuggatttcatttcugaagt

SEQ ID NO: 12638 - DNA, 20 bp, Artificial Sequence
  Synthetic
cacgtccaccutgagtccua

SEQ ID NO: 12639 - DNA, 26 bp, Artificial Sequence
  Synthetic
tgaaaacutgtaatctuccccaggag

SEQ ID NO: 12640 - DNA, 29 bp, Artificial Sequence
  Synthetic
aaacagaaucatctccugaagaacaagaa

SEQ ID NO: 12641 - DNA, 25 bp, Artificial Sequence
  Synthetic
ccttgttatccugacccaagaugaa

SEQ ID NO: 12642 - DNA, 23 bp, Artificial Sequence
  Synthetic
attctgtguccttcctucagcag

SEQ ID NO: 12643 - DNA, 22 bp, Artificial Sequence
  Synthetic
cgugtttaggtttuggcaacgt

SEQ ID NO: 12644 - DNA, 23 bp, Artificial Sequence
  Synthetic
gatatctcuggcgaguccaaagt

SEQ ID NO: 12645 - DNA, 21 bp, Artificial Sequence
  Synthetic
cctttttgttcuggcggtgut

SEQ ID NO: 12646 - DNA, 23 bp, Artificial Sequence
  Synthetic
gutcacaugccacaaaaggaact

SEQ ID NO: 12647 - DNA, 20 bp, Artificial Sequence
  Synthetic
tgcttugggcaagtggucat

SEQ ID NO: 12648 - DNA, 20 bp, Artificial Sequence
  Synthetic
gacaagauccacaagcuggc

SEQ ID NO: 12649 - DNA, 22 bp, Artificial Sequence
  Synthetic
atcctgugccgaaugaagaaca

SEQ ID NO: 12650 - DNA, 28 bp, Artificial Sequence
  Synthetic
accaagtctttucagcttctatauccag

SEQ ID NO: 12651 - DNA, 18 bp, Artificial Sequence
  Synthetic
atgugaccgaggcggaug

SEQ ID NO: 12652 - DNA, 22 bp, Artificial Sequence
  Synthetic
caaacgagucaagcaagaaugg

SEQ ID NO: 12653 - DNA, 24 bp, Artificial Sequence
  Synthetic
gagcctcatuatggaaagtguggt

SEQ ID NO: 12654 - DNA, 21 bp, Artificial Sequence
  Synthetic
gcagaactuccctccatgcuc

SEQ ID NO: 12655 - DNA, 28 bp, Artificial Sequence
  Synthetic
aacacatccauggaatatgttctttugc

SEQ ID NO: 12656 - DNA, 26 bp, Artificial Sequence
  Synthetic
tttacaatgcaaggguagctgatuct

SEQ ID NO: 12657 - DNA, 20 bp, Artificial Sequence
  Synthetic
tcaccauggcaaccttgucc

SEQ ID NO: 12658 - DNA, 18 bp, Artificial Sequence
  Synthetic
gggaguccccctcaccug

SEQ ID NO: 12659 - DNA, 21 bp, Artificial Sequence
  Synthetic
tcctgatcccauccctcctut

SEQ ID NO: 12660 - DNA, 21 bp, Artificial Sequence
  Synthetic
ggttcaccugtactgguggat

SEQ ID NO: 12661 - DNA, 22 bp, Artificial Sequence
  Synthetic
cctgttggacaucctggauacc

SEQ ID NO: 12662 - DNA, 18 bp, Artificial Sequence
  Synthetic
ccucccaucgaggacgga

SEQ ID NO: 12663 - DNA, 26 bp, Artificial Sequence
  Synthetic
gcacctttgaaucccaagttcaguaa

SEQ ID NO: 12664 - DNA, 17 bp, Artificial Sequence
  Synthetic
gttuggcagcccaccuc

SEQ ID NO: 12665 - DNA, 21 bp, Artificial Sequence
  Synthetic
gatcaaggaccgcuatcugct

SEQ ID NO: 12666 - DNA, 27 bp, Artificial Sequence
  Synthetic
attatacttuggacacacgaaggcaua

SEQ ID NO: 12667 - DNA, 24 bp, Artificial Sequence
  Synthetic
gctcttcguagtggtgcattuagg

SEQ ID NO: 12668 - DNA, 24 bp, Artificial Sequence
  Synthetic
cggctagucactaaagucaaaagc

SEQ ID NO: 12669 - DNA, 20 bp, Artificial Sequence
  Synthetic
gaacccggcauccacaaauc

SEQ ID NO: 12670 - DNA, 23 bp, Artificial Sequence
  Synthetic
gctctctuggagtgtctccucat

SEQ ID NO: 12671 - DNA, 21 bp, Artificial Sequence
  Synthetic
ccgggatuagcgaactuccag

SEQ ID NO: 12672 - DNA, 25 bp, Artificial Sequence
  Synthetic
cccaataaagguctaccatccccua

SEQ ID NO: 12673 - DNA, 26 bp, Artificial Sequence
  Synthetic
gagtggacuaagatcaatgggaugat

SEQ ID NO: 12674 - DNA, 17 bp, Artificial Sequence
  Synthetic
ctuccgagggcccagug

SEQ ID NO: 12675 - DNA, 19 bp, Artificial Sequence
  Synthetic
agtacuggcacgaggacug

SEQ ID NO: 12676 - DNA, 19 bp, Artificial Sequence
  Synthetic
ccgtgagutgcagctugat

SEQ ID NO: 12677 - DNA, 17 bp, Artificial Sequence
  Synthetic
ccgaggcccugaaggug

SEQ ID NO: 12678 - DNA, 20 bp, Artificial Sequence
  Synthetic
gctgctgucaccacctguag

SEQ ID NO: 12679 - DNA, 21 bp, Artificial Sequence
  Synthetic
attcuacgacggcatcugcaa

SEQ ID NO: 12680 - DNA, 18 bp, Artificial Sequence
  Synthetic
aggcugcaggccctagua

SEQ ID NO: 12681 - DNA, 25 bp, Artificial Sequence
  Synthetic
gggatgaacacauctaccccuacat

SEQ ID NO: 12682 - DNA, 21 bp, Artificial Sequence
  Synthetic
gtggctugggctactacagua

SEQ ID NO: 12683 - DNA, 21 bp, Artificial Sequence
  Synthetic
tcatgccugggtagtgttugg

SEQ ID NO: 12684 - DNA, 19 bp, Artificial Sequence
  Synthetic
ggugaagcgggcauagagg

SEQ ID NO: 12685 - DNA, 22 bp, Artificial Sequence
  Synthetic
tggagcattutctggctgucaa

SEQ ID NO: 12686 - DNA, 25 bp, Artificial Sequence
  Synthetic
cttttgcagaaaaucactgcaccua

SEQ ID NO: 12687 - DNA, 30 bp, Artificial Sequence
  Synthetic
tattcagagtctatuctcacaaaaactgut

SEQ ID NO: 12688 - DNA, 22 bp, Artificial Sequence
  Synthetic
tggttgctgcugagatgctauc

SEQ ID NO: 12689 - DNA, 27 bp, Artificial Sequence
  Synthetic
attgtgtgtactutctccttcttcucc

SEQ ID NO: 12690 - DNA, 32 bp, Artificial Sequence
  Synthetic
gttactataagguagccattattcaaaatgug

SEQ ID NO: 12691 - DNA, 27 bp, Artificial Sequence
  Synthetic
gggaaacttaucacaaagcctucagaa

SEQ ID NO: 12692 - DNA, 24 bp, Artificial Sequence
  Synthetic
tatgagcactcucctcactactut

SEQ ID NO: 12693 - DNA, 23 bp, Artificial Sequence
  Synthetic
gcutgaaaatgcugaacgggaac

SEQ ID NO: 12694 - DNA, 26 bp, Artificial Sequence
  Synthetic
ccagttagcgguaaccttaacauagg

SEQ ID NO: 12695 - DNA, 28 bp, Artificial Sequence
  Synthetic
agctgttttatauctcacaaccuggaag

SEQ ID NO: 12696 - DNA, 32 bp, Artificial Sequence
  Synthetic
gatgaatcacaaauaagttaaaccaagagtuc

SEQ ID NO: 12697 - DNA, 30 bp, Artificial Sequence
  Synthetic
aaaataatgtaatguccatttcaggaucca

SEQ ID NO: 12698 - DNA, 24 bp, Artificial Sequence
  Synthetic
gggatcgucatgattgccaugaat

SEQ ID NO: 12699 - DNA, 22 bp, Artificial Sequence
  Synthetic
aacagctttugtcccgtaugga

SEQ ID NO: 12700 - DNA, 30 bp, Artificial Sequence
  Synthetic
acaaatacaaaccacacucacttcatttuc

SEQ ID NO: 12701 - DNA, 30 bp, Artificial Sequence
  Synthetic
attagttgcaacagauattcatcttggaut

SEQ ID NO: 12702 - DNA, 29 bp, Artificial Sequence
  Synthetic
aggctctgtctucaataaagaatcaauga

SEQ ID NO: 12703 - DNA, 22 bp, Artificial Sequence
  Synthetic
cctucacccaaccaaagtucca

SEQ ID NO: 12704 - DNA, 22 bp, Artificial Sequence
  Synthetic
ctgttgcagugactgattuggg

SEQ ID NO: 12705 - DNA, 26 bp, Artificial Sequence
  Synthetic
ccaccacagagaacaucaaacguaat

SEQ ID NO: 12706 - DNA, 22 bp, Artificial Sequence
  Synthetic
gtagacaggaggcuggaatugg

SEQ ID NO: 12707 - DNA, 29 bp, Artificial Sequence
  Synthetic
ttattgaaaagugcagtuacagaggagat

SEQ ID NO: 12708 - DNA, 26 bp, Artificial Sequence
  Synthetic
tcttgatcutgtcccaauacaaacat

SEQ ID NO: 12709 - DNA, 23 bp, Artificial Sequence
  Synthetic
ttgcaggaaugggataccaaguc

SEQ ID NO: 12710 - DNA, 25 bp, Artificial Sequence
  Synthetic
gggtgcgggutgttaataaaactuc

SEQ ID NO: 12711 - DNA, 20 bp, Artificial Sequence
  Synthetic
agcggccagucgaaaguaat

SEQ ID NO: 12712 - DNA, 20 bp, Artificial Sequence
  Synthetic
cctggctcugagggacugaa

SEQ ID NO: 12713 - DNA, 28 bp, Artificial Sequence
  Synthetic
cccatggagaaaauagtgatcaaaagug

SEQ ID NO: 12714 - DNA, 23 bp, Artificial Sequence
  Synthetic
agtctctccuggctccttcttua

SEQ ID NO: 12715 - DNA, 30 bp, Artificial Sequence
  Synthetic
ctccaaataaacaauggacaaagtcagaut

SEQ ID NO: 12716 - DNA, 20 bp, Artificial Sequence
  Synthetic
cttggtgtguttgccagcut

SEQ ID NO: 12717 - DNA, 23 bp, Artificial Sequence
  Synthetic
cctgagctgugaaggacgataug

SEQ ID NO: 12718 - DNA, 17 bp, Artificial Sequence
  Synthetic
ctcagcagccuccucgt

SEQ ID NO: 12719 - DNA, 17 bp, Artificial Sequence
  Synthetic
caggttggugccgaugg

SEQ ID NO: 12720 - DNA, 27 bp, Artificial Sequence
  Synthetic
gttaaaactagucctcgaaaaccucgt

SEQ ID NO: 12721 - DNA, 28 bp, Artificial Sequence
  Synthetic
tgatcttatcuccagatttggtctcuga

SEQ ID NO: 12722 - DNA, 25 bp, Artificial Sequence
  Synthetic
guacaaattguacgacggagaggaa

SEQ ID NO: 12723 - DNA, 22 bp, Artificial Sequence
  Synthetic
gagggcttugtctgacaacugt

SEQ ID NO: 12724 - DNA, 28 bp, Artificial Sequence
  Synthetic
cctccaattaaaautgcccgatuagagt

SEQ ID NO: 12725 - DNA, 23 bp, Artificial Sequence
  Synthetic
cctgagagtcugtggaggtauca

SEQ ID NO: 12726 - DNA, 22 bp, Artificial Sequence
  Synthetic
ccaguatctcugaccacacacc

SEQ ID NO: 12727 - DNA, 23 bp, Artificial Sequence
  Synthetic
gtggctcugacctagaatgctut

SEQ ID NO: 12728 - DNA, 26 bp, Artificial Sequence
  Synthetic
ctgtaacctugcctagtaaucgaact

SEQ ID NO: 12729 - DNA, 25 bp, Artificial Sequence
  Synthetic
gagagctcagaacuactaagcctuc

SEQ ID NO: 12730 - DNA, 21 bp, Artificial Sequence
  Synthetic
gaggagcugtccaaagaucga

SEQ ID NO: 12731 - DNA, 22 bp, Artificial Sequence
  Synthetic
ccuacccacaggauacaaagca

SEQ ID NO: 12732 - DNA, 26 bp, Artificial Sequence
  Synthetic
tccactccttcauctagcactgtuaa

SEQ ID NO: 12733 - DNA, 28 bp, Artificial Sequence
  Synthetic
ggtcggtttgttuaagactcttactcut

SEQ ID NO: 12734 - DNA, 27 bp, Artificial Sequence
  Synthetic
tggagtaccaautaaaaccaggttuga

SEQ ID NO: 12735 - DNA, 23 bp, Artificial Sequence
  Synthetic
gtgcctugtttctagugacaggt

SEQ ID NO: 12736 - DNA, 29 bp, Artificial Sequence
  Synthetic
atggtttattcgtugttttcctaggauga

SEQ ID NO: 12737 - DNA, 27 bp, Artificial Sequence
  Synthetic
aacuatacaccattuaagcaaggagca

SEQ ID NO: 12738 - DNA, 21 bp, Artificial Sequence
  Synthetic
ctcagccaccuacuacaggac

SEQ ID NO: 12739 - DNA, 23 bp, Artificial Sequence
  Synthetic
tgctgttugagacatcagtgcut

SEQ ID NO: 12740 - DNA, 26 bp, Artificial Sequence
  Synthetic
ctttcctaagugacctttctctcucc

SEQ ID NO: 12741 - DNA, 24 bp, Artificial Sequence
  Synthetic
gtacaaagaagcaggaugcctuac

SEQ ID NO: 12742 - DNA, 21 bp, Artificial Sequence
  Synthetic
agugccgaaacagctaucacc

SEQ ID NO: 12743 - DNA, 25 bp, Artificial Sequence
  Synthetic
aagtccaatagucacatggtggtuc

SEQ ID NO: 12744 - DNA, 27 bp, Artificial Sequence
  Synthetic
gacctcatcauggtaggtttttgttut

SEQ ID NO: 12745 - DNA, 27 bp, Artificial Sequence
  Synthetic
ctgtcagaactugcttcagagaaauct

SEQ ID NO: 12746 - DNA, 24 bp, Artificial Sequence
  Synthetic
ggagggaagaggaaauggtttuca

SEQ ID NO: 12747 - DNA, 21 bp, Artificial Sequence
  Synthetic
acttgaccaugctgttggcut

SEQ ID NO: 12748 - DNA, 23 bp, Artificial Sequence
  Synthetic
gggcaacaggugataucaagaat

SEQ ID NO: 12749 - DNA, 22 bp, Artificial Sequence
  Synthetic
tcaagtgaagguggaagcacug

SEQ ID NO: 12750 - DNA, 27 bp, Artificial Sequence
  Synthetic
gttatcttcacuggaaaagctaaugcc

SEQ ID NO: 12751 - DNA, 20 bp, Artificial Sequence
  Synthetic
tcaaacacutccgcugacca

SEQ ID NO: 12752 - DNA, 23 bp, Artificial Sequence
  Synthetic
ccactcugagacagtcaggauca

SEQ ID NO: 12753 - DNA, 25 bp, Artificial Sequence
  Synthetic
ccaagccatugagaaacttcctuct

SEQ ID NO: 12754 - DNA, 20 bp, Artificial Sequence
  Synthetic
gctcgcaagcgcugtgtaua

SEQ ID NO: 12755 - DNA, 20 bp, Artificial Sequence
  Synthetic
ccagccucaagtcccatcut

SEQ ID NO: 12756 - DNA, 28 bp, Artificial Sequence
  Synthetic
aatcattgaaaccagugacttcuacaca

SEQ ID NO: 12757 - DNA, 28 bp, Artificial Sequence
  Synthetic
gagagtaaaggaucacctactgtgacua

SEQ ID NO: 12758 - DNA, 27 bp, Artificial Sequence
  Synthetic
aaaacagtcacutggatggatctucat

SEQ ID NO: 12759 - DNA, 24 bp, Artificial Sequence
  Synthetic
cacattatgugcagatccctcuga

SEQ ID NO: 12760 - DNA, 28 bp, Artificial Sequence
  Synthetic
caacagaucatccattaucaacgaacat

SEQ ID NO: 12761 - DNA, 23 bp, Artificial Sequence
  Synthetic
tctggcttcaaguttccttccuc

SEQ ID NO: 12762 - DNA, 23 bp, Artificial Sequence
  Synthetic
acagaaccaauttcagcctcuga

SEQ ID NO: 12763 - DNA, 23 bp, Artificial Sequence
  Synthetic
ggccatcuggaagcattaggtut

SEQ ID NO: 12764 - DNA, 25 bp, Artificial Sequence
  Synthetic
aacagtgatutcttcagguggagag

SEQ ID NO: 12765 - DNA, 25 bp, Artificial Sequence
  Synthetic
cttgttgtggcugtgacactaguat

SEQ ID NO: 12766 - DNA, 27 bp, Artificial Sequence
  Synthetic
ctccgacaaaaauttactggacaccua

SEQ ID NO: 12767 - DNA, 22 bp, Artificial Sequence
  Synthetic
gcctgcauggatggagtatuct

SEQ ID NO: 12768 - DNA, 27 bp, Artificial Sequence
  Synthetic
ggagaagagaguaaccaucacagaaaa

SEQ ID NO: 12769 - DNA, 21 bp, Artificial Sequence
  Synthetic
acugaaccauaaggagggcua

SEQ ID NO: 12770 - DNA, 26 bp, Artificial Sequence
  Synthetic
cctctuctgttagttcuacacccagt

SEQ ID NO: 12771 - DNA, 24 bp, Artificial Sequence
  Synthetic
tgagacatggguagcaatccttug

SEQ ID NO: 12772 - DNA, 26 bp, Artificial Sequence
  Synthetic
gccccttctgaugtggtttctaauat

SEQ ID NO: 12773 - DNA, 29 bp, Artificial Sequence
  Synthetic
ccggttcaaaauacatgatgctagattua

SEQ ID NO: 12774 - DNA, 23 bp, Artificial Sequence
  Synthetic
gcttuaccgccaagtucaggaat

SEQ ID NO: 12775 - DNA, 22 bp, Artificial Sequence
  Synthetic
tgatagtgtucgtctgctuccc

SEQ ID NO: 12776 - DNA, 20 bp, Artificial Sequence
  Synthetic
aguttcccattugcggacca

SEQ ID NO: 12777 - DNA, 21 bp, Artificial Sequence
  Synthetic
tctctcccggacuaccacauc

SEQ ID NO: 12778 - DNA, 22 bp, Artificial Sequence
  Synthetic
tgatgcuttggctucagcaaga

SEQ ID NO: 12779 - DNA, 21 bp, Artificial Sequence
  Synthetic
cttctgcugatgggucaacct

SEQ ID NO: 12780 - DNA, 29 bp, Artificial Sequence
  Synthetic
gatttccagttttaaugccatcatcctut

SEQ ID NO: 12781 - DNA, 24 bp, Artificial Sequence
  Synthetic
cctcctccucttcttcatcatugg

SEQ ID NO: 12782 - DNA, 27 bp, Artificial Sequence
  Synthetic
ggaacuaacagaucaggagaacttaut

SEQ ID NO: 12783 - DNA, 21 bp, Artificial Sequence
  Synthetic
gccggcauactcaaucaccat

SEQ ID NO: 12784 - DNA, 26 bp, Artificial Sequence
  Synthetic
gtcatctttgccaugcgtaagatcua

SEQ ID NO: 12785 - DNA, 21 bp, Artificial Sequence
  Synthetic
cctccttgcacuccaacacug

SEQ ID NO: 12786 - DNA, 21 bp, Artificial Sequence
  Synthetic
aatcagccagugagggucaac

SEQ ID NO: 12787 - DNA, 22 bp, Artificial Sequence
  Synthetic
gctgcaaaaaccutaagugcca

SEQ ID NO: 12788 - DNA, 22 bp, Artificial Sequence
  Synthetic
cagctugatggagaucgacaca

SEQ ID NO: 12789 - DNA, 20 bp, Artificial Sequence
  Synthetic
ggtactugggcggcactuac

SEQ ID NO: 12790 - DNA, 27 bp, Artificial Sequence
  Synthetic
aacccttatggutttcttatggtuggt

SEQ ID NO: 12791 - DNA, 21 bp, Artificial Sequence
  Synthetic
ttgcaggccaagguaaacuca

SEQ ID NO: 12792 - DNA, 19 bp, Artificial Sequence
  Synthetic
cgaccgagucgtccatgua

SEQ ID NO: 12793 - DNA, 21 bp, Artificial Sequence
  Synthetic
agtattgtgaugcggcuccaa

SEQ ID NO: 12794 - DNA, 24 bp, Artificial Sequence
  Synthetic
tgtcccaaacuaaccaagcatcug

SEQ ID NO: 12795 - DNA, 29 bp, Artificial Sequence
  Synthetic
tctccagaaatggcugaaaatgaagatua

SEQ ID NO: 12796 - DNA, 28 bp, Artificial Sequence
  Synthetic
atgcttgactauaaacagttggaacuca

SEQ ID NO: 12797 - DNA, 28 bp, Artificial Sequence
  Synthetic
gugaaagagagcacugaaaagaaaagag

SEQ ID NO: 12798 - DNA, 29 bp, Artificial Sequence
  Synthetic
ccaacatttaugatacctcuaaggaacct

SEQ ID NO: 12799 - DNA, 25 bp, Artificial Sequence
  Synthetic
aagtatctcuggacgagacucaaca

SEQ ID NO: 12800 - DNA, 28 bp, Artificial Sequence
  Synthetic
cttagaagcagaagaauaagcatgcuct

SEQ ID NO: 12801 - DNA, 23 bp, Artificial Sequence
  Synthetic
guttcttctucaggacacagcca

SEQ ID NO: 12802 - DNA, 29 bp, Artificial Sequence
  Synthetic
tgtaaatcctaaacutgcctgtaagtcug

SEQ ID NO: 12803 - DNA, 24 bp, Artificial Sequence
  Synthetic
aggctcuagccacagatgaacuat

SEQ ID NO: 12804 - DNA, 26 bp, Artificial Sequence
  Synthetic
gcggcaaaugcaaaattttacttcut

SEQ ID NO: 12805 - DNA, 25 bp, Artificial Sequence
  Synthetic
gggtatatugcagtgactctttuca

SEQ ID NO: 12806 - DNA, 19 bp, Artificial Sequence
  Synthetic
tgautccactugcggcagt

SEQ ID NO: 12807 - DNA, 27 bp, Artificial Sequence
  Synthetic
ttcaacagtatatugccaaaccccaua

SEQ ID NO: 12808 - DNA, 23 bp, Artificial Sequence
  Synthetic
gtaggcagaccutagcctttuct

SEQ ID NO: 12809 - DNA, 24 bp, Artificial Sequence
  Synthetic
gaccutatcagauccgcaacaagt

SEQ ID NO: 12810 - DNA, 24 bp, Artificial Sequence
  Synthetic
ccautctgugaaacccagaacagt

SEQ ID NO: 12811 - DNA, 20 bp, Artificial Sequence
  Synthetic
ggacucggaccaaacugaca

SEQ ID NO: 12812 - DNA, 29 bp, Artificial Sequence
  Synthetic
gcctcttttaaagugacaatcaatucagt

SEQ ID NO: 12813 - DNA, 24 bp, Artificial Sequence
  Synthetic
agacctcccutctctgctataugg

SEQ ID NO: 12814 - DNA, 26 bp, Artificial Sequence
  Synthetic
catagaaaatgugctcagcaaacuca

SEQ ID NO: 12815 - DNA, 29 bp, Artificial Sequence
  Synthetic
tgtctttucacacgaggaautaatttuca

SEQ ID NO: 12816 - DNA, 25 bp, Artificial Sequence
  Synthetic
acugaaggaagauaccaaaagacuc

SEQ ID NO: 12817 - DNA, 21 bp, Artificial Sequence
  Synthetic
agagcaacuggaggaggugat

SEQ ID NO: 12818 - DNA, 24 bp, Artificial Sequence
  Synthetic
gttccaggacaggcaugttatuca

SEQ ID NO: 12819 - DNA, 24 bp, Artificial Sequence
  Synthetic
aattttcugggaagactccctugg

SEQ ID NO: 12820 - DNA, 25 bp, Artificial Sequence
  Synthetic
gaggaaacugaaggctttgtacuca

SEQ ID NO: 12821 - DNA, 25 bp, Artificial Sequence
  Synthetic
tggattugaacaagctguacgagag

SEQ ID NO: 12822 - DNA, 30 bp, Artificial Sequence
  Synthetic
catccaucacacaaaaguaatttatctuca

SEQ ID NO: 12823 - DNA, 28 bp, Artificial Sequence
  Synthetic
gtttatttcagcuaaggagttcctggua

SEQ ID NO: 12824 - DNA, 25 bp, Artificial Sequence
  Synthetic
aaaagcccaagacautgataccuga

SEQ ID NO: 12825 - DNA, 28 bp, Artificial Sequence
  Synthetic
agatcttaaagaaaaaguggagccugag

SEQ ID NO: 12826 - DNA, 28 bp, Artificial Sequence
  Synthetic
atcctctatuggaagcaatgtttccuac

SEQ ID NO: 12827 - DNA, 26 bp, Artificial Sequence
  Synthetic
tgggaactucaaggatctactcugaa

SEQ ID NO: 12828 - DNA, 23 bp, Artificial Sequence
  Synthetic
gataaagcugagcggatctguga

SEQ ID NO: 12829 - DNA, 20 bp, Artificial Sequence
  Synthetic
agcttttcuccaccggtucc

SEQ ID NO: 12830 - DNA, 30 bp, Artificial Sequence
  Synthetic
taccatctttgcucatcttttctttatgut

SEQ ID NO: 12831 - DNA, 22 bp, Artificial Sequence
  Synthetic
cctgtacacaugaagccaucgt

SEQ ID NO: 12832 - DNA, 30 bp, Artificial Sequence
  Synthetic
tgctgatgtttcaauaaaaggaattccaua

SEQ ID NO: 12833 - DNA, 31 bp, Artificial Sequence
  Synthetic
tcccagagaacaaautaaaagagtuaaggac

SEQ ID NO: 12834 - DNA, 22 bp, Artificial Sequence
  Synthetic
tgtactcctcutgacctgcugt

SEQ ID NO: 12835 - DNA, 29 bp, Artificial Sequence
  Synthetic
tgaagtaaaaggugcactgtaataaucca

SEQ ID NO: 12836 - DNA, 18 bp, Artificial Sequence
  Synthetic
cuggccggagagcctuat

SEQ ID NO: 12837 - DNA, 18 bp, Artificial Sequence
  Synthetic
gctgcugcccagaccauc

SEQ ID NO: 12838 - DNA, 20 bp, Artificial Sequence
  Synthetic
cggtgacgaccugtcctcua

SEQ ID NO: 12839 - DNA, 19 bp, Artificial Sequence
  Synthetic
cagtgcuggtagcctucga

SEQ ID NO: 12840 - DNA, 23 bp, Artificial Sequence
  Synthetic
caggtaaccauctggtuccagaa

SEQ ID NO: 12841 - DNA, 26 bp, Artificial Sequence
  Synthetic
acaaagcggagacauaaatagauggg

SEQ ID NO: 12842 - DNA, 22 bp, Artificial Sequence
  Synthetic
tccaacctcuatctgcccagut

SEQ ID NO: 12843 - DNA, 18 bp, Artificial Sequence
  Synthetic
cuccaggccguaggagac

SEQ ID NO: 12844 - DNA, 20 bp, Artificial Sequence
  Synthetic
cctucgaccgtttctucgac

SEQ ID NO: 12845 - DNA, 20 bp, Artificial Sequence
  Synthetic
tgtgttcucctccucagcct

SEQ ID NO: 12846 - DNA, 28 bp, Artificial Sequence
  Synthetic
agaaggaugaaagaaaagaaacugagca

SEQ ID NO: 12847 - DNA, 29 bp, Artificial Sequence
  Synthetic
gcggaaagaagaugagutagaaaauaaaa

SEQ ID NO: 12848 - DNA, 26 bp, Artificial Sequence
  Synthetic
agatctcttcugaggtattcaugcca

SEQ ID NO: 12849 - DNA, 27 bp, Artificial Sequence
  Synthetic
aattcagtgacuccttttggtactgut

SEQ ID NO: 12850 - DNA, 18 bp, Artificial Sequence
  Synthetic
ccuccccggattagugcg

SEQ ID NO: 12851 - DNA, 21 bp, Artificial Sequence
  Synthetic
ccagtaccugctccucaccat

SEQ ID NO: 12852 - DNA, 23 bp, Artificial Sequence
  Synthetic
gcagggccuatagttctgggaua

SEQ ID NO: 12853 - DNA, 32 bp, Artificial Sequence
  Synthetic
agtgagatactactuatctcttgattcagcut

SEQ ID NO: 12854 - DNA, 31 bp, Artificial Sequence
  Synthetic
ataagggtttgtgtuagactgatagcatauc

SEQ ID NO: 12855 - DNA, 26 bp, Artificial Sequence
  Synthetic
attaccttttgaucactcccacctuc

SEQ ID NO: 12856 - DNA, 29 bp, Artificial Sequence
  Synthetic
tctgtacaaatagguactcaaaacagcuc

SEQ ID NO: 12857 - DNA, 22 bp, Artificial Sequence
  Synthetic
agccaggcuttcaucaaaggaa

SEQ ID NO: 12858 - DNA, 26 bp, Artificial Sequence
  Synthetic
gaaggaaauagggcgatgaattgaug

SEQ ID NO: 12859 - DNA, 30 bp, Artificial Sequence
  Synthetic
cttacagctaaggaaauttcaggatctuct

SEQ ID NO: 12860 - DNA, 30 bp, Artificial Sequence
  Synthetic
gagagtcatgtgtugaggaaaatgatgaua

SEQ ID NO: 12861 - DNA, 27 bp, Artificial Sequence
  Synthetic
cactctcttcttugtcttgggtttcut

SEQ ID NO: 12862 - DNA, 27 bp, Artificial Sequence
  Synthetic
cccctagtugacctgtctauaagagaa

SEQ ID NO: 12863 - DNA, 29 bp, Artificial Sequence
  Synthetic
tcactattccacuaccaaagtaggucaat

SEQ ID NO: 12864 - DNA, 17 bp, Artificial Sequence
  Synthetic
ggctgagcugcccaaug

SEQ ID NO: 12865 - DNA, 19 bp, Artificial Sequence
  Synthetic
tctccaccacggcuttcug

SEQ ID NO: 12866 - DNA, 24 bp, Artificial Sequence
  Synthetic
gccatggcaaugagaaagaaucaa

SEQ ID NO: 12867 - DNA, 20 bp, Artificial Sequence
  Synthetic
gcccctucttggttgguagc

SEQ ID NO: 12868 - DNA, 21 bp, Artificial Sequence
  Synthetic
tguccccaucacaggcacagg

SEQ ID NO: 12869 - DNA, 20 bp, Artificial Sequence
  Synthetic
ggcccgcugtacgtguccat

SEQ ID NO: 12870 - DNA, 18 bp, Artificial Sequence
  Synthetic
gcttggctucccctcgua

SEQ ID NO: 12871 - DNA, 22 bp, Artificial Sequence
  Synthetic
aagtgaggccaugatgaggtuc

SEQ ID NO: 12872 - DNA, 18 bp, Artificial Sequence
  Synthetic
cacgtcugcccctctcuc

SEQ ID NO: 12873 - DNA, 18 bp, Artificial Sequence
  Synthetic
gcaggccuggacctuacc

SEQ ID NO: 12874 - DNA, 18 bp, Artificial Sequence
  Synthetic
cctgcugccauccaacca

SEQ ID NO: 12875 - DNA, 18 bp, Artificial Sequence
  Synthetic
gctgcugccctcaucacc

SEQ ID NO: 12876 - DNA, 30 bp, Artificial Sequence
  Synthetic
gtggagggatgaaguccttaaaactaaaut

SEQ ID NO: 12877 - DNA, 25 bp, Artificial Sequence
  Synthetic
ggaatgtccucacaccuaccaaaac

SEQ ID NO: 12878 - DNA, 30 bp, Artificial Sequence
  Synthetic
acctttctgattucaaccaaattacaguct

SEQ ID NO: 12879 - DNA, 26 bp, Artificial Sequence
  Synthetic
gctgcaattguctaatgttttccuca

SEQ ID NO: 12880 - DNA, 24 bp, Artificial Sequence
  Synthetic
ctaggtgacuccaacagugaacag

SEQ ID NO: 12881 - DNA, 24 bp, Artificial Sequence
  Synthetic
tgccaaaggaauggaatttcugga

SEQ ID NO: 12882 - DNA, 24 bp, Artificial Sequence
  Synthetic
gaaactggucaacgaagtgtgtut

SEQ ID NO: 12883 - DNA, 27 bp, Artificial Sequence
  Synthetic
aaatttcacaggacutggacagagaut

SEQ ID NO: 12884 - DNA, 22 bp, Artificial Sequence
  Synthetic
tgtgcatcuttgttgctgucct

SEQ ID NO: 12885 - DNA, 24 bp, Artificial Sequence
  Synthetic
gcacgtacucaccatttgtcttug

SEQ ID NO: 12886 - DNA, 26 bp, Artificial Sequence
  Synthetic
ggutaaaacgacaaugaagaggagac

SEQ ID NO: 12887 - DNA, 30 bp, Artificial Sequence
  Synthetic
aggatgtgagagautataatgagttgucca

SEQ ID NO: 12888 - DNA, 28 bp, Artificial Sequence
  Synthetic
caatgtccttatuacttgggagactugt

SEQ ID NO: 12889 - DNA, 21 bp, Artificial Sequence
  Synthetic
cccagccagugagcttattuc

SEQ ID NO: 12890 - DNA, 28 bp, Artificial Sequence
  Synthetic
ctcacaaggaaaugatttucgagagaag

SEQ ID NO: 12891 - DNA, 30 bp, Artificial Sequence
  Synthetic
aaatgctaccaatucaagtgaagattauga

SEQ ID NO: 12892 - DNA, 29 bp, Artificial Sequence
  Synthetic
ttatccataagggutcccctacttuaaga

SEQ ID NO: 12893 - DNA, 26 bp, Artificial Sequence
  Synthetic
tgagatgatgcuaaagtctttgtuca

SEQ ID NO: 12894 - DNA, 21 bp, Artificial Sequence
  Synthetic
gaaucgcaaagcacccatucc

SEQ ID NO: 12895 - DNA, 32 bp, Artificial Sequence
  Synthetic
ataacttatgatgctutagataccctgcttua

SEQ ID NO: 12896 - DNA, 21 bp, Artificial Sequence
  Synthetic
agcactugcagtgtgauggaa

SEQ ID NO: 12897 - DNA, 21 bp, Artificial Sequence
  Synthetic
gaggcctuagacctgcagtut

SEQ ID NO: 12898 - DNA, 32 bp, Artificial Sequence
  Synthetic
gggtataaatacacaugtgcttctagaaauaa

SEQ ID NO: 12899 - DNA, 22 bp, Artificial Sequence
  Synthetic
cgctgagcuggaaaggaaaauc

SEQ ID NO: 12900 - DNA, 22 bp, Artificial Sequence
  Synthetic
gggtgcacuaggtacctuaact

SEQ ID NO: 12901 - DNA, 32 bp, Artificial Sequence
  Synthetic
cctgtcttgataatuctttctgtttcttcaut

SEQ ID NO: 12902 - DNA, 28 bp, Artificial Sequence
  Synthetic
ctagtttttccacaagutctgcaaauct

SEQ ID NO: 12903 - DNA, 22 bp, Artificial Sequence
  Synthetic
aggcaatgcauaggatgaucac

SEQ ID NO: 12904 - DNA, 26 bp, Artificial Sequence
  Synthetic
ggutcttataaataucccgggcaagg

SEQ ID NO: 12905 - DNA, 26 bp, Artificial Sequence
  Synthetic
actgacaggugtaggaaattagtugg

SEQ ID NO: 12906 - DNA, 30 bp, Artificial Sequence
  Synthetic
actcattgctauctttaaaaaccuccaact

SEQ ID NO: 12907 - DNA, 22 bp, Artificial Sequence
  Synthetic
gcatgagcaugtgctgtttugg

SEQ ID NO: 12908 - DNA, 23 bp, Artificial Sequence
  Synthetic
ctcacacugctcauccaaaggaa

SEQ ID NO: 12909 - DNA, 29 bp, Artificial Sequence
  Synthetic
gatcccaaauaaaacagtggatgtuaacg

SEQ ID NO: 12910 - DNA, 26 bp, Artificial Sequence
  Synthetic
tgatagacaccutcatcctcttcugt

SEQ ID NO: 12911 - DNA, 28 bp, Artificial Sequence
  Synthetic
cugaatgcataatgauaggaagaaggct

SEQ ID NO: 12912 - DNA, 32 bp, Artificial Sequence
  Synthetic
gagacaactgttacuttttaatgagtccttua

SEQ ID NO: 12913 - DNA, 32 bp, Artificial Sequence
  Synthetic
agaaatccucuagaagaaagaaattacaauca

SEQ ID NO: 12914 - DNA, 24 bp, Artificial Sequence
  Synthetic
tctctggtuataggatgtguggct

SEQ ID NO: 12915 - DNA, 28 bp, Artificial Sequence
  Synthetic
ctgttgctagcuaaagtttccttttcut

SEQ ID NO: 12916 - DNA, 22 bp, Artificial Sequence
  Synthetic
catcccacaugcagatucccat

SEQ ID NO: 12917 - DNA, 22 bp, Artificial Sequence
  Synthetic
cgcatauggtatcccucaacct

SEQ ID NO: 12918 - DNA, 25 bp, Artificial Sequence
  Synthetic
ttgcagctucccacttacaaaguat

SEQ ID NO: 12919 - DNA, 22 bp, Artificial Sequence
  Synthetic
aaaacagcaggugctugaaacc

SEQ ID NO: 12920 - DNA, 25 bp, Artificial Sequence
  Synthetic
gcgggattucacttgcttaaaauac

SEQ ID NO: 12921 - DNA, 26 bp, Artificial Sequence
  Synthetic
cccagtcaaatuacttagaggccaua

SEQ ID NO: 12922 - DNA, 30 bp, Artificial Sequence
  Synthetic
aaacttcattaugcttatttgcagugaaag

SEQ ID NO: 12923 - DNA, 25 bp, Artificial Sequence
  Synthetic
gagatguacagtgaaauccccgaaa

SEQ ID NO: 12924 - DNA, 23 bp, Artificial Sequence
  Synthetic
agttatgcucagcctttcgctut

SEQ ID NO: 12925 - DNA, 20 bp, Artificial Sequence
  Synthetic
gagaggaccuccgcttccua

SEQ ID NO: 12926 - DNA, 22 bp, Artificial Sequence
  Synthetic
gtctgctctuggtagctccauc

SEQ ID NO: 12927 - DNA, 24 bp, Artificial Sequence
  Synthetic
ttcttcttuccccttcctttgucc

SEQ ID NO: 12928 - DNA, 19 bp, Artificial Sequence
  Synthetic
gcauagcgcccacatucct

SEQ ID NO: 12929 - DNA, 22 bp, Artificial Sequence
  Synthetic
tctttuctttgtgcugccacct

SEQ ID NO: 12930 - DNA, 22 bp, Artificial Sequence
  Synthetic
gttgtctugacactgtguggga

SEQ ID NO: 12931 - DNA, 23 bp, Artificial Sequence
  Synthetic
tgttcatugagcgcttagacugt

SEQ ID NO: 12932 - DNA, 26 bp, Artificial Sequence
  Synthetic
cataggttgacaugaccgaatuaggg

SEQ ID NO: 12933 - DNA, 21 bp, Artificial Sequence
  Synthetic
cagtataacugtgcgccugga

SEQ ID NO: 12934 - DNA, 24 bp, Artificial Sequence
  Synthetic
gggautgcttatcucagacagact

SEQ ID NO: 12935 - DNA, 29 bp, Artificial Sequence
  Synthetic
aaatgctagtactautagtgggagacuct

SEQ ID NO: 12936 - DNA, 23 bp, Artificial Sequence
  Synthetic
ggautgagcauccaccaagaact

SEQ ID NO: 12937 - DNA, 28 bp, Artificial Sequence
  Synthetic
acatgtagaauaggaagtttugcaagca

SEQ ID NO: 12938 - DNA, 19 bp, Artificial Sequence
  Synthetic
aagtccucgctctccucca

SEQ ID NO: 12939 - DNA, 19 bp, Artificial Sequence
  Synthetic
ggccggaguttagccaguc

SEQ ID NO: 12940 - DNA, 22 bp, Artificial Sequence
  Synthetic
aatcatcccuggagcatctgug

SEQ ID NO: 12941 - DNA, 24 bp, Artificial Sequence
  Synthetic
tgaagugaaccccaaaatggucat

SEQ ID NO: 12942 - DNA, 25 bp, Artificial Sequence
  Synthetic
ctctaataccuaccactgaagguca

SEQ ID NO: 12943 - DNA, 25 bp, Artificial Sequence
  Synthetic
gugaatgaaacatugagggaagcaa

SEQ ID NO: 12944 - DNA, 24 bp, Artificial Sequence
  Synthetic
gtatttagagugctctugcaggct

SEQ ID NO: 12945 - DNA, 29 bp, Artificial Sequence
  Synthetic
agctctatgaaaagaucaaagttcctgut

SEQ ID NO: 12946 - DNA, 26 bp, Artificial Sequence
  Synthetic
gttggcaauaaaagccaagtucaact

SEQ ID NO: 12947 - DNA, 22 bp, Artificial Sequence
  Synthetic
ccagcccugagacatcctttug

SEQ ID NO: 12948 - DNA, 23 bp, Artificial Sequence
  Synthetic
taatuagcccaccucagcaagag

SEQ ID NO: 12949 - DNA, 23 bp, Artificial Sequence
  Synthetic
ccccaacaucgctgcatttatut

SEQ ID NO: 12950 - DNA, 25 bp, Artificial Sequence
  Synthetic
tgttgatgguctagaaaaugggcaa

SEQ ID NO: 12951 - DNA, 24 bp, Artificial Sequence
  Synthetic
aactggauaaacaaagcccuggaa

SEQ ID NO: 12952 - DNA, 27 bp, Artificial Sequence
  Synthetic
caagttccaaguttcaaatgtgtcucc

SEQ ID NO: 12953 - DNA, 22 bp, Artificial Sequence
  Synthetic
cttgccttugcctgggtauaga

SEQ ID NO: 12954 - DNA, 28 bp, Artificial Sequence
  Synthetic
gtaccatggagtuttatgagtcagcaua

SEQ ID NO: 12955 - DNA, 30 bp, Artificial Sequence
  Synthetic
ctcttttctgtttugcaagaacttcaucat

SEQ ID NO: 12956 - DNA, 24 bp, Artificial Sequence
  Synthetic
aaacaaaagccugtgctugaagag

SEQ ID NO: 12957 - DNA, 21 bp, Artificial Sequence
  Synthetic
ctgcccuggtttcttctucga

SEQ ID NO: 12958 - DNA, 27 bp, Artificial Sequence
  Synthetic
tgcttgcatgucatttactctgtttug

SEQ ID NO: 12959 - DNA, 30 bp, Artificial Sequence
  Synthetic
ttgagtcagcatuatccatcaaaggaauat

SEQ ID NO: 12960 - DNA, 30 bp, Artificial Sequence
  Synthetic
cttctgtcctugaagactatgatgtttuct

SEQ ID NO: 12961 - DNA, 28 bp, Artificial Sequence
  Synthetic
actggtcatgaauatgcccataaucaaa

SEQ ID NO: 12962 - DNA, 28 bp, Artificial Sequence
  Synthetic
acagagaaagaaagaaguaaugtggtua

SEQ ID NO: 12963 - DNA, 29 bp, Artificial Sequence
  Synthetic
caaccatttcatcutgtttccaaagaaug

SEQ ID NO: 12964 - DNA, 27 bp, Artificial Sequence
  Synthetic
atacaacagtaaagguagaggatgcut

SEQ ID NO: 12965 - DNA, 25 bp, Artificial Sequence
  Synthetic
ctgttctcttccugatgtagctcug

SEQ ID NO: 12966 - DNA, 25 bp, Artificial Sequence
  Synthetic
gcatgcttttuctctttttggtugc

SEQ ID NO: 12967 - DNA, 28 bp, Artificial Sequence
  Synthetic
gtgagtgtttaaauggctgcaagttaut

SEQ ID NO: 12968 - DNA, 29 bp, Artificial Sequence
  Synthetic
aagttgagacatutgcttaactctttugt

SEQ ID NO: 12969 - DNA, 21 bp, Artificial Sequence
  Synthetic
tgccagggccugtaatttcug

SEQ ID NO: 12970 - DNA, 30 bp, Artificial Sequence
  Synthetic
agatgataaaauaagattgcuggaagagca

SEQ ID NO: 12971 - DNA, 28 bp, Artificial Sequence
  Synthetic
cgtagtatttcuggaatcactcaacuga

SEQ ID NO: 12972 - DNA, 28 bp, Artificial Sequence
  Synthetic
tgtggaagaattacutgaaactggacut

SEQ ID NO: 12973 - DNA, 31 bp, Artificial Sequence
  Synthetic
aaaaaccttacacaaautacagagaaaucct

SEQ ID NO: 12974 - DNA, 22 bp, Artificial Sequence
  Synthetic
gccaauacagggaagtggtuac

SEQ ID NO: 12975 - DNA, 23 bp, Artificial Sequence
  Synthetic
tgctacttccugaacatgtgcut

SEQ ID NO: 12976 - DNA, 30 bp, Artificial Sequence
  Synthetic
gcttgtatgatcugtttctagcttgtauga

SEQ ID NO: 12977 - DNA, 27 bp, Artificial Sequence
  Synthetic
ggtagttttgtugtttaagctgcucaa

SEQ ID NO: 12978 - DNA, 31 bp, Artificial Sequence
  Synthetic
ggtagggatcuaagttgtattactgttuacc

SEQ ID NO: 12979 - DNA, 22 bp, Artificial Sequence
  Synthetic
ttcctctggugttcaacugcat

SEQ ID NO: 12980 - DNA, 28 bp, Artificial Sequence
  Synthetic
agttggaggcuaaagaagttcucaaaaa

SEQ ID NO: 12981 - DNA, 23 bp, Artificial Sequence
  Synthetic
tcagcacuctacugaaaccaagt

SEQ ID NO: 12982 - DNA, 28 bp, Artificial Sequence
  Synthetic
ggttttactuggccatgtaattgttuca

SEQ ID NO: 12983 - DNA, 28 bp, Artificial Sequence
  Synthetic
acaaccgttaaugctaaaaacaaaucca

SEQ ID NO: 12984 - DNA, 31 bp, Artificial Sequence
  Synthetic
aatgaaacacucacaaaacttagaacugaac

SEQ ID NO: 12985 - DNA, 28 bp, Artificial Sequence
  Synthetic
atgcaaaacaacaaauccagaatuagca

SEQ ID NO: 12986 - DNA, 23 bp, Artificial Sequence
  Synthetic
cacagtuacagcagttgctucag

SEQ ID NO: 12987 - DNA, 30 bp, Artificial Sequence
  Synthetic
attacacagacacauaacatcaatuaccca

SEQ ID NO: 12988 - DNA, 18 bp, Artificial Sequence
  Synthetic
ggtgacugcgcugggaaa

SEQ ID NO: 12989 - DNA, 21 bp, Artificial Sequence
  Synthetic
ggcgaaaagccuaaggcaaug

SEQ ID NO: 12990 - DNA, 28 bp, Artificial Sequence
  Synthetic
gtttcctcgttgaauacaaagtgtccua

SEQ ID NO: 12991 - DNA, 31 bp, Artificial Sequence
  Synthetic
atcctgttccuccagttgttaatatcaaaut

SEQ ID NO: 12992 - DNA, 24 bp, Artificial Sequence
  Synthetic
accgggcautcatagcaattuagt

SEQ ID NO: 12993 - DNA, 22 bp, Artificial Sequence
  Synthetic
cggctggucaaaagctctuaca

SEQ ID NO: 12994 - DNA, 29 bp, Artificial Sequence
  Synthetic
tgcttgtatagttucatgttttcctguca

SEQ ID NO: 12995 - DNA, 27 bp, Artificial Sequence
  Synthetic
gtcttacccgutcatctgttgaaugat

SEQ ID NO: 12996 - DNA, 22 bp, Artificial Sequence
  Synthetic
cctcaggagcutgcccatuaaa

SEQ ID NO: 12997 - DNA, 28 bp, Artificial Sequence
  Synthetic
agcccaccagaaauggtaaaatactuac

SEQ ID NO: 12998 - DNA, 28 bp, Artificial Sequence
  Synthetic
ccttcttttcucttccttcagauggaat

SEQ ID NO: 12999 - DNA, 29 bp, Artificial Sequence
  Synthetic
acagtgccugattatgttuaagaaaacca

SEQ ID NO: 13000 - DNA, 24 bp, Artificial Sequence
  Synthetic
gtttgaaattacaugaccggcugt

SEQ ID NO: 13001 - DNA, 29 bp, Artificial Sequence
  Synthetic
gggtttcctgaguaaatgatcatguagaa

SEQ ID NO: 13002 - DNA, 27 bp, Artificial Sequence
  Synthetic
ctagcaacaatucaggaacatggtuac

SEQ ID NO: 13003 - DNA, 23 bp, Artificial Sequence
  Synthetic
tgtctcttuagcagcaacuccac

SEQ ID NO: 13004 - DNA, 28 bp, Artificial Sequence
  Synthetic
tttttcttctagcutgccaacaacatut

SEQ ID NO: 13005 - DNA, 22 bp, Artificial Sequence
  Synthetic
ggtggucacatgagaaguccaa

SEQ ID NO: 13006 - DNA, 26 bp, Artificial Sequence
  Synthetic
gtgatgtaaaacutgatcctcgucca

SEQ ID NO: 13007 - DNA, 29 bp, Artificial Sequence
  Synthetic
aagtttgtgtttuaacaggataggtguct

SEQ ID NO: 13008 - DNA, 24 bp, Artificial Sequence
  Synthetic
tccccttaaaguagttgtcaugcc

SEQ ID NO: 13009 - DNA, 24 bp, Artificial Sequence
  Synthetic
acatcacgcauggaagaaguagac

SEQ ID NO: 13010 - DNA, 22 bp, Artificial Sequence
  Synthetic
cutccagacugaagccagaaga

SEQ ID NO: 13011 - DNA, 22 bp, Artificial Sequence
  Synthetic
acaaugggttacauggcagcaa

SEQ ID NO: 13012 - DNA, 29 bp, Artificial Sequence
  Synthetic
ggaaatgctgtautcacatacctttucaa

SEQ ID NO: 13013 - DNA, 21 bp, Artificial Sequence
  Synthetic
gucaccaaagaaggccuggaa

SEQ ID NO: 13014 - DNA, 26 bp, Artificial Sequence
  Synthetic
cagagccuacaagattguaagaacga

SEQ ID NO: 13015 - DNA, 26 bp, Artificial Sequence
  Synthetic
gctttcagagcugttaaggtacuaca

SEQ ID NO: 13016 - DNA, 29 bp, Artificial Sequence
  Synthetic
cccagaaaguacttctttaatcagugaca

SEQ ID NO: 13017 - DNA, 26 bp, Artificial Sequence
  Synthetic
cgtgctccutttgatctgttugaaaa

SEQ ID NO: 13018 - DNA, 28 bp, Artificial Sequence
  Synthetic
ttcctcaucagaaccaauatcttcaaut

SEQ ID NO: 13019 - DNA, 21 bp, Artificial Sequence
  Synthetic
gcagcagugatgtgattucgt

SEQ ID NO: 13020 - DNA, 29 bp, Artificial Sequence
  Synthetic
tcagcaaccaaauaagcagaauaaaaacc

SEQ ID NO: 13021 - DNA, 23 bp, Artificial Sequence
  Synthetic
ggaaugaccaaggctgactugat

SEQ ID NO: 13022 - DNA, 25 bp, Artificial Sequence
  Synthetic
aatgacatcaacugggcaatttcug

SEQ ID NO: 13023 - DNA, 21 bp, Artificial Sequence
  Synthetic
acgcgauggaatttcgtgtug

SEQ ID NO: 13024 - DNA, 23 bp, Artificial Sequence
  Synthetic
cctaccccgccugaaauaaaaca

SEQ ID NO: 13025 - DNA, 20 bp, Artificial Sequence
  Synthetic
ccgcccagagugctgaauac

SEQ ID NO: 13026 - DNA, 22 bp, Artificial Sequence
  Synthetic
gggagaacugaaggaugacgac

SEQ ID NO: 13027 - DNA, 25 bp, Artificial Sequence
  Synthetic
caggcttcuaagtacccugagaaat

SEQ ID NO: 13028 - DNA, 23 bp, Artificial Sequence
  Synthetic
tctcttccccaauctacctgugt

SEQ ID NO: 13029 - DNA, 20 bp, Artificial Sequence
  Synthetic
gccatggagucgatgagcug

SEQ ID NO: 13030 - DNA, 28 bp, Artificial Sequence
  Synthetic
ccccttgccucatattaacaagtaauct

SEQ ID NO: 13031 - DNA, 26 bp, Artificial Sequence
  Synthetic
aguaaattccaaggugaaggaaacca

SEQ ID NO: 13032 - DNA, 18 bp, Artificial Sequence
  Synthetic
ccatgctgcuggcgtcua

SEQ ID NO: 13033 - DNA, 24 bp, Artificial Sequence
  Synthetic
aagagtagaaucttggcacaugct

SEQ ID NO: 13034 - DNA, 19 bp, Artificial Sequence
  Synthetic
gcctctcccuccatgcuca

SEQ ID NO: 13035 - DNA, 20 bp, Artificial Sequence
  Synthetic
ggctctugatctcccugcaa

SEQ ID NO: 13036 - DNA, 24 bp, Artificial Sequence
  Synthetic
cacagagtacauggatgaggctut

SEQ ID NO: 13037 - DNA, 21 bp, Artificial Sequence
  Synthetic
cauctcaggtttugcgcacag

SEQ ID NO: 13038 - DNA, 20 bp, Artificial Sequence
  Synthetic
aggtcaguggatcccctcuc

SEQ ID NO: 13039 - DNA, 24 bp, Artificial Sequence
  Synthetic
caatggaacuatccggaacaucct

SEQ ID NO: 13040 - DNA, 19 bp, Artificial Sequence
  Synthetic
cuggagagucacccactuc

SEQ ID NO: 13041 - DNA, 20 bp, Artificial Sequence
  Synthetic
gctgtgtguccctgcttcua

SEQ ID NO: 13042 - DNA, 22 bp, Artificial Sequence
  Synthetic
cattgaaguctgcgtcucgagt

SEQ ID NO: 13043 - DNA, 25 bp, Artificial Sequence
  Synthetic
tcccaaccaugaagatttcttugct

SEQ ID NO: 13044 - DNA, 21 bp, Artificial Sequence
  Synthetic
gcattgccuttctctgccugt

SEQ ID NO: 13045 - DNA, 25 bp, Artificial Sequence
  Synthetic
acaagaagcugaaggaaatctugct

SEQ ID NO: 13046 - DNA, 22 bp, Artificial Sequence
  Synthetic
gcttccaagcucttggcttuct

SEQ ID NO: 13047 - DNA, 23 bp, Artificial Sequence
  Synthetic
ggagtaaggacauctgagctugt

SEQ ID NO: 13048 - DNA, 17 bp, Artificial Sequence
  Synthetic
tcctccguggctugcag

SEQ ID NO: 13049 - DNA, 20 bp, Artificial Sequence
  Synthetic
acggtggguttctcaaucgt

SEQ ID NO: 13050 - DNA, 23 bp, Artificial Sequence
  Synthetic
gctgaagccugttcttggtctut

SEQ ID NO: 13051 - DNA, 21 bp, Artificial Sequence
  Synthetic
cttgtagcuctccgacucgaa

SEQ ID NO: 13052 - DNA, 20 bp, Artificial Sequence
  Synthetic
ccaggucccctggatgaugt

SEQ ID NO: 13053 - DNA, 21 bp, Artificial Sequence
  Synthetic
ccagtctctuggcaccctuag

SEQ ID NO: 13054 - DNA, 23 bp, Artificial Sequence
  Synthetic
atagcaggauggtgggattgaug

SEQ ID NO: 13055 - DNA, 20 bp, Artificial Sequence
  Synthetic
caggaggaccuggacucaga

SEQ ID NO: 13056 - DNA, 27 bp, Artificial Sequence
  Synthetic
aaatctcttgguagctggtttacctuc

SEQ ID NO: 13057 - DNA, 28 bp, Artificial Sequence
  Synthetic
ggagaggautagtgactuaacgacaaat

SEQ ID NO: 13058 - DNA, 20 bp, Artificial Sequence
  Synthetic
cctgugacacctuaccagca

SEQ ID NO: 13059 - DNA, 22 bp, Artificial Sequence
  Synthetic
tgtaugcagaggcugaggagat

SEQ ID NO: 13060 - DNA, 24 bp, Artificial Sequence
  Synthetic
ccttaagctcautctctgcctuct

SEQ ID NO: 13061 - DNA, 23 bp, Artificial Sequence
  Synthetic
tgacaacauatcccttugccaca

SEQ ID NO: 13062 - DNA, 20 bp, Artificial Sequence
  Synthetic
ggccatgaugacatcgguga

SEQ ID NO: 13063 - DNA, 23 bp, Artificial Sequence
  Synthetic
gtggaaaucaggagctcttccut

SEQ ID NO: 13064 - DNA, 18 bp, Artificial Sequence
  Synthetic
ggtgtugcgtagcguggt

SEQ ID NO: 13065 - DNA, 17 bp, Artificial Sequence
  Synthetic
cctggcugtgccccaua

SEQ ID NO: 13066 - DNA, 20 bp, Artificial Sequence
  Synthetic
cttgggcutctggaactugg

SEQ ID NO: 13067 - DNA, 23 bp, Artificial Sequence
  Synthetic
ggttgggtgutctctctgatuca

SEQ ID NO: 13068 - DNA, 21 bp, Artificial Sequence
  Synthetic
cttguccagggctttgtucac

SEQ ID NO: 13069 - DNA, 26 bp, Artificial Sequence
  Synthetic
gaaaatggagcccautgagaauaacc

SEQ ID NO: 13070 - DNA, 21 bp, Artificial Sequence
  Synthetic
gcugaaacccatgatugccat

SEQ ID NO: 13071 - DNA, 26 bp, Artificial Sequence
  Synthetic
agtatgtcttatugaccctgaccugt

SEQ ID NO: 13072 - DNA, 22 bp, Artificial Sequence
  Synthetic
gatctaagtucactccgugcct

SEQ ID NO: 13073 - DNA, 27 bp, Artificial Sequence
  Synthetic
gtgatggaaauaacgctgacatttgut

SEQ ID NO: 13074 - DNA, 20 bp, Artificial Sequence
  Synthetic
gtacctggcugcctgcaaua

SEQ ID NO: 13075 - DNA, 22 bp, Artificial Sequence
  Synthetic
gaaggucacggtugggaaagat

SEQ ID NO: 13076 - DNA, 19 bp, Artificial Sequence
  Synthetic
ctcacccuccactguacgt

SEQ ID NO: 13077 - DNA, 20 bp, Artificial Sequence
  Synthetic
cctggcucagctctgtgaug

SEQ ID NO: 13078 - DNA, 22 bp, Artificial Sequence
  Synthetic
ggactucctcccaucaccaaat

SEQ ID NO: 13079 - DNA, 26 bp, Artificial Sequence
  Synthetic
cgccaggagauattatactgtccuga

SEQ ID NO: 13080 - DNA, 22 bp, Artificial Sequence
  Synthetic
cccatauggcctctgguagagt

SEQ ID NO: 13081 - DNA, 22 bp, Artificial Sequence
  Synthetic
gcuccagaaggcaggaaugaag

SEQ ID NO: 13082 - DNA, 17 bp, Artificial Sequence
  Synthetic
ccuggagcugggaccct

SEQ ID NO: 13083 - DNA, 20 bp, Artificial Sequence
  Synthetic
cgtcagacuccaccagcuct

SEQ ID NO: 13084 - DNA, 23 bp, Artificial Sequence
  Synthetic
gaagcctccuggacagacuaaag

SEQ ID NO: 13085 - DNA, 21 bp, Artificial Sequence
  Synthetic
caaagccacugtcaaacgugt

SEQ ID NO: 13086 - DNA, 21 bp, Artificial Sequence
  Synthetic
gcguacttaagctucgacgca

SEQ ID NO: 13087 - DNA, 18 bp, Artificial Sequence
  Synthetic
cctcgcgcccutaccuac

SEQ ID NO: 13088 - DNA, 29 bp, Artificial Sequence
  Synthetic
gctggctttaugagtataggtattatgut

SEQ ID NO: 13089 - DNA, 20 bp, Artificial Sequence
  Synthetic
gagctctggcuactgccaua

SEQ ID NO: 13090 - DNA, 21 bp, Artificial Sequence
  Synthetic
tccttcatugcctggcactug

SEQ ID NO: 13091 - DNA, 24 bp, Artificial Sequence
  Synthetic
caccactacucatggaggatugat

SEQ ID NO: 13092 - DNA, 21 bp, Artificial Sequence
  Synthetic
gctaugaacccagaggtcgug

SEQ ID NO: 13093 - DNA, 28 bp, Artificial Sequence
  Synthetic
acaagaatacuaaaccatgcacuaggga

SEQ ID NO: 13094 - DNA, 25 bp, Artificial Sequence
  Synthetic
tggaaagggaguactgtagccttua

SEQ ID NO: 13095 - DNA, 21 bp, Artificial Sequence
  Synthetic
ctgcttuagctgaaggugggt

SEQ ID NO: 13096 - DNA, 24 bp, Artificial Sequence
  Synthetic
tgguctatctgcatuaggacccat

SEQ ID NO: 13097 - DNA, 25 bp, Artificial Sequence
  Synthetic
aagtttcacucacggatuaggacac

SEQ ID NO: 13098 - DNA, 31 bp, Artificial Sequence
  Synthetic
gaggctggtaacucaaatataatggatacut

SEQ ID NO: 13099 - DNA, 21 bp, Artificial Sequence
  Synthetic
acgaggguaacactggguaca

SEQ ID NO: 13100 - DNA, 22 bp, Artificial Sequence
  Synthetic
gggtgaaatgcugacctgtgut

SEQ ID NO: 13101 - DNA, 29 bp, Artificial Sequence
  Synthetic
ggtgagtgctuaaaaacattcagaagtua

SEQ ID NO: 13102 - DNA, 27 bp, Artificial Sequence
  Synthetic
ttcatttgttcauactcaacccacuca

SEQ ID NO: 13103 - DNA, 22 bp, Artificial Sequence
  Synthetic
ggaaagcugaagccacccauag

SEQ ID NO: 13104 - DNA, 24 bp, Artificial Sequence
  Synthetic
ggttgttaatccuggagccaauca

SEQ ID NO: 13105 - DNA, 23 bp, Artificial Sequence
  Synthetic
tgctcagggaggaguagaaguag

SEQ ID NO: 13106 - DNA, 21 bp, Artificial Sequence
  Synthetic
guactagauggcgagcagacc

SEQ ID NO: 13107 - DNA, 22 bp, Artificial Sequence
  Synthetic
cuccaacagcuacagcacaaac

SEQ ID NO: 13108 - DNA, 18 bp, Artificial Sequence
  Synthetic
cttgcgagugggcucagt

SEQ ID NO: 13109 - DNA, 25 bp, Artificial Sequence
  Synthetic
actcctaaaucctgagtaagugcca

SEQ ID NO: 13110 - DNA, 19 bp, Artificial Sequence
  Synthetic
gcauagccgcggttttuca

SEQ ID NO: 13111 - DNA, 17 bp, Artificial Sequence
  Synthetic
gccugcactucgacgac

SEQ ID NO: 13112 - DNA, 17 bp, Artificial Sequence
  Synthetic
gccgcacuggctgauga

SEQ ID NO: 13113 - DNA, 22 bp, Artificial Sequence
  Synthetic
tcagaacuggcaaugagcaact

SEQ ID NO: 13114 - DNA, 17 bp, Artificial Sequence
  Synthetic
gctgcgcgcuttgcaua

SEQ ID NO: 13115 - DNA, 19 bp, Artificial Sequence
  Synthetic
gttaacucccccgugccaa

SEQ ID NO: 13116 - DNA, 24 bp, Artificial Sequence
  Synthetic
gggagtttagutctttcttgccut

SEQ ID NO: 13117 - DNA, 27 bp, Artificial Sequence
  Synthetic
tgctggaucagaggctttaaaatctut

SEQ ID NO: 13118 - DNA, 22 bp, Artificial Sequence
  Synthetic
caaggtgggcaucttgacgtua

SEQ ID NO: 13119 - DNA, 26 bp, Artificial Sequence
  Synthetic
tgtgagtttgccugttttctctcuag

SEQ ID NO: 13120 - DNA, 21 bp, Artificial Sequence
  Synthetic
gcctcagcagcgugtttctua

SEQ ID NO: 13121 - DNA, 21 bp, Artificial Sequence
  Synthetic
gttggtcucctgcggttuaca

SEQ ID NO: 13122 - DNA, 20 bp, Artificial Sequence
  Synthetic
catcucaccacccacacgua

SEQ ID NO: 13123 - DNA, 20 bp, Artificial Sequence
  Synthetic
atctgtgtgcuggtgctcuc

SEQ ID NO: 13124 - DNA, 19 bp, Artificial Sequence
  Synthetic
cggtcaguacacgcaugga

SEQ ID NO: 13125 - DNA, 20 bp, Artificial Sequence
  Synthetic
gccagaugcgagcagttcut

SEQ ID NO: 13126 - DNA, 26 bp, Artificial Sequence
  Synthetic
gcttaaatgaagugaatgcacugagt

SEQ ID NO: 13127 - DNA, 28 bp, Artificial Sequence
  Synthetic
ggcgatacugaggaggattttattguat

SEQ ID NO: 13128 - DNA, 19 bp, Artificial Sequence
  Synthetic
gaacggucacctacgugct

SEQ ID NO: 13129 - DNA, 23 bp, Artificial Sequence
  Synthetic
ccuctctctcuggacacacagaa

SEQ ID NO: 13130 - DNA, 25 bp, Artificial Sequence
  Synthetic
acaaagtauctcgtgacugggaaga

SEQ ID NO: 13131 - DNA, 28 bp, Artificial Sequence
  Synthetic
cggaatgcacuaaattcagttttaugaa

SEQ ID NO: 13132 - DNA, 20 bp, Artificial Sequence
  Synthetic
ggagacgagcucatgagucc

SEQ ID NO: 13133 - DNA, 20 bp, Artificial Sequence
  Synthetic
acctcctgcugacgtcttuc

SEQ ID NO: 13134 - DNA, 20 bp, Artificial Sequence
  Synthetic
agcatgagcucccatccauc

SEQ ID NO: 13135 - DNA, 27 bp, Artificial Sequence
  Synthetic
tttccatctggtutcttccttcttcuc

SEQ ID NO: 13136 - DNA, 20 bp, Artificial Sequence
  Synthetic
agctgcuagaggcctttucg

SEQ ID NO: 13137 - DNA, 27 bp, Artificial Sequence
  Synthetic
tgttctttttcctutcctccctgtaug

SEQ ID NO: 13138 - DNA, 27 bp, Artificial Sequence
  Synthetic
ccttctgggaagaucaggtattaggua

SEQ ID NO: 13139 - DNA, 20 bp, Artificial Sequence
  Synthetic
gtttgauggcccaggcatuc

SEQ ID NO: 13140 - DNA, 20 bp, Artificial Sequence
  Synthetic
cacgagcucagaagcaggua

SEQ ID NO: 13141 - DNA, 28 bp, Artificial Sequence
  Synthetic
ctgacttgaaguttttgtctgtttcucc

SEQ ID NO: 13142 - DNA, 22 bp, Artificial Sequence
  Synthetic
catttacaguctgggcugcagt

SEQ ID NO: 13143 - DNA, 29 bp, Artificial Sequence
  Synthetic
atgcaggtaucacacaaatuacagaagat

SEQ ID NO: 13144 - DNA, 24 bp, Artificial Sequence
  Synthetic
cacaatgcctugtacgtgaagaug

SEQ ID NO: 13145 - DNA, 29 bp, Artificial Sequence
  Synthetic
aggaaaatgcautcataaaggacucagaa

SEQ ID NO: 13146 - DNA, 21 bp, Artificial Sequence
  Synthetic
cagatctgucccacgcuagag

SEQ ID NO: 13147 - DNA, 30 bp, Artificial Sequence
  Synthetic
ctcatgtgtuaagagaaagctatggtttug

SEQ ID NO: 13148 - DNA, 18 bp, Artificial Sequence
  Synthetic
gcugcacaggcccatcua

SEQ ID NO: 13149 - DNA, 20 bp, Artificial Sequence
  Synthetic
ccgtctcuaacagtgucgca

SEQ ID NO: 13150 - DNA, 21 bp, Artificial Sequence
  Synthetic
cagtcaccucatctccuagcc

SEQ ID NO: 13151 - DNA, 23 bp, Artificial Sequence
  Synthetic
gagaucaagcugagcaacaagac

SEQ ID NO: 13152 - DNA, 22 bp, Artificial Sequence
  Synthetic
ccccagtgugtaagaccaacug

SEQ ID NO: 13153 - DNA, 25 bp, Artificial Sequence
  Synthetic
cctgagtctcauggtctttgtgtug

SEQ ID NO: 13154 - DNA, 20 bp, Artificial Sequence
  Synthetic
ggaaacugaggcgctgctua

SEQ ID NO: 13155 - DNA, 24 bp, Artificial Sequence
  Synthetic
tctttcttgtuctgtgcccuacag

SEQ ID NO: 13156 - DNA, 18 bp, Artificial Sequence
  Synthetic
ccucccagtugccccaaa

SEQ ID NO: 13157 - DNA, 28 bp, Artificial Sequence
  Synthetic
gtgattttctutgctcttcttucaccag

SEQ ID NO: 13158 - DNA, 21 bp, Artificial Sequence
  Synthetic
ccttaccuccagcaacugcac

SEQ ID NO: 13159 - DNA, 20 bp, Artificial Sequence
  Synthetic
ggaccctguaccccttcucc

SEQ ID NO: 13160 - DNA, 23 bp, Artificial Sequence
  Synthetic
gcaagttctcutgccttttggug

SEQ ID NO: 13161 - DNA, 29 bp, Artificial Sequence
  Synthetic
attcagagtaaaccutgctgtagattuga

SEQ ID NO: 13162 - DNA, 25 bp, Artificial Sequence
  Synthetic
gtctcguaacggtttttctcuacca

SEQ ID NO: 13163 - DNA, 25 bp, Artificial Sequence
  Synthetic
actccgcatuactacatccaaaucc

SEQ ID NO: 13164 - DNA, 30 bp, Artificial Sequence
  Synthetic
gtugtgctgtttgaauaaaaagaaacaagt

SEQ ID NO: 13165 - DNA, 27 bp, Artificial Sequence
  Synthetic
aaaaataccaatccauacccacctcug

SEQ ID NO: 13166 - DNA, 26 bp, Artificial Sequence
  Synthetic
gtaaatgatgccuggtgtatttugct

SEQ ID NO: 13167 - DNA, 22 bp, Artificial Sequence
  Synthetic
gggagaatuccctttccucaga

SEQ ID NO: 13168 - DNA, 23 bp, Artificial Sequence
  Synthetic
cagctctcccaugtatgtcgaut

SEQ ID NO: 13169 - DNA, 25 bp, Artificial Sequence
  Synthetic
acatgauggaaacgaacaccaauct

SEQ ID NO: 13170 - DNA, 23 bp, Artificial Sequence
  Synthetic
ctcctctttuggaaacagcucca

SEQ ID NO: 13171 - DNA, 24 bp, Artificial Sequence
  Synthetic
cctgaataagautgaagcggcuct

SEQ ID NO: 13172 - DNA, 20 bp, Artificial Sequence
  Synthetic
ggttccacuttgggccugag

SEQ ID NO: 13173 - DNA, 21 bp, Artificial Sequence
  Synthetic
ccauacagcagccaguacgag

SEQ ID NO: 13174 - DNA, 21 bp, Artificial Sequence
  Synthetic
ccugagagagaggaggacuct

SEQ ID NO: 13175 - DNA, 28 bp, Artificial Sequence
  Synthetic
gtatctgtaactguccttgtcatctguc

SEQ ID NO: 13176 - DNA, 26 bp, Artificial Sequence
  Synthetic
gactgctctaucctaacagataugcc

SEQ ID NO: 13177 - DNA, 22 bp, Artificial Sequence
  Synthetic
agaggaugaacacagcctucac

SEQ ID NO: 13178 - DNA, 22 bp, Artificial Sequence
  Synthetic
gaaggugtggcugaacacaaag

SEQ ID NO: 13179 - DNA, 22 bp, Artificial Sequence
  Synthetic
tgtgccagcugactcugaaaag

SEQ ID NO: 13180 - DNA, 19 bp, Artificial Sequence
  Synthetic
gcacgcauccgactgtuca

SEQ ID NO: 13181 - DNA, 19 bp, Artificial Sequence
  Synthetic
ctctcugccacttcugcga

SEQ ID NO: 13182 - DNA, 23 bp, Artificial Sequence
  Synthetic
actggctctagucctttggaguc

SEQ ID NO: 13183 - DNA, 23 bp, Artificial Sequence
  Synthetic
gagautcacattuccggcagaac

SEQ ID NO: 13184 - DNA, 21 bp, Artificial Sequence
  Synthetic
gtggtgtgugccctctacauc

SEQ ID NO: 13185 - DNA, 22 bp, Artificial Sequence
  Synthetic
augaagagagcgtuggaggaac

SEQ ID NO: 13186 - DNA, 25 bp, Artificial Sequence
  Synthetic
agaagagggtutgcaatttctcuca

SEQ ID NO: 13187 - DNA, 19 bp, Artificial Sequence
  Synthetic
cgtggauggtgaggcugac

SEQ ID NO: 13188 - DNA, 23 bp, Artificial Sequence
  Synthetic
gggaaaaagucttccagccauag

SEQ ID NO: 13189 - DNA, 18 bp, Artificial Sequence
  Synthetic
ccagcttccucccggaug

SEQ ID NO: 13190 - DNA, 23 bp, Artificial Sequence
  Synthetic
gactataagtcuccccacgucac

SEQ ID NO: 13191 - DNA, 21 bp, Artificial Sequence
  Synthetic
tcttgctggcuttgtgctuct

SEQ ID NO: 13192 - DNA, 20 bp, Artificial Sequence
  Synthetic
cugcaggcatcuacaccagt

SEQ ID NO: 13193 - DNA, 17 bp, Artificial Sequence
  Synthetic
agggugctggugaacgg

SEQ ID NO: 13194 - DNA, 18 bp, Artificial Sequence
  Synthetic
gcagcuaccactccucca

SEQ ID NO: 13195 - DNA, 17 bp, Artificial Sequence
  Synthetic
cctcgggugtcccucct

SEQ ID NO: 13196 - DNA, 17 bp, Artificial Sequence
  Synthetic
cugagccugacggccaa

SEQ ID NO: 13197 - DNA, 17 bp, Artificial Sequence
  Synthetic
tgggcaggauccccuca

SEQ ID NO: 13198 - DNA, 18 bp, Artificial Sequence
  Synthetic
cccctcaaugggctccut

SEQ ID NO: 13199 - DNA, 17 bp, Artificial Sequence
  Synthetic
ccagggcugagctcucc

SEQ ID NO: 13200 - DNA, 22 bp, Artificial Sequence
  Synthetic
gauccagcagauccagcagaaa

SEQ ID NO: 13201 - DNA, 18 bp, Artificial Sequence
  Synthetic
gguggagcagacgctgug

SEQ ID NO: 13202 - DNA, 22 bp, Artificial Sequence
  Synthetic
ttcttggccuaggaagctgtuc

SEQ ID NO: 13203 - DNA, 25 bp, Artificial Sequence
  Synthetic
ggtggatttagccuttttcctggut

SEQ ID NO: 13204 - DNA, 22 bp, Artificial Sequence
  Synthetic
gccugagccccttttucagaag

SEQ ID NO: 13205 - DNA, 25 bp, Artificial Sequence
  Synthetic
tctcgtagcccutgtagttctucat

SEQ ID NO: 13206 - DNA, 22 bp, Artificial Sequence
  Synthetic
cctgacuccaatccctctucct

SEQ ID NO: 13207 - DNA, 23 bp, Artificial Sequence
  Synthetic
ctcacgttacugatctggtccug

SEQ ID NO: 13208 - DNA, 21 bp, Artificial Sequence
  Synthetic
ggttuggcaggacagttucca

SEQ ID NO: 13209 - DNA, 18 bp, Artificial Sequence
  Synthetic
ctccggccagggutacuc

SEQ ID NO: 13210 - DNA, 19 bp, Artificial Sequence
  Synthetic
cccttttcuccaccgccut

SEQ ID NO: 13211 - DNA, 21 bp, Artificial Sequence
  Synthetic
cggucgggacattttcuccat

SEQ ID NO: 13212 - DNA, 26 bp, Artificial Sequence
  Synthetic
tttcccttcttcugcagcatttagua

SEQ ID NO: 13213 - DNA, 25 bp, Artificial Sequence
  Synthetic
aggtccaugtattccaacuggaaag

SEQ ID NO: 13214 - DNA, 22 bp, Artificial Sequence
  Synthetic
ccgcaauacaccaagtcccaut

SEQ ID NO: 13215 - DNA, 23 bp, Artificial Sequence
  Synthetic
gttcttccucagagaactugcgt

SEQ ID NO: 13216 - DNA, 23 bp, Artificial Sequence
  Synthetic
cugaaagagaaccagaucgccat

SEQ ID NO: 13217 - DNA, 23 bp, Artificial Sequence
  Synthetic
cctgcaaaaaugccatccuacag

SEQ ID NO: 13218 - DNA, 21 bp, Artificial Sequence
  Synthetic
acgtcaaaauggccgatcuga

SEQ ID NO: 13219 - DNA, 26 bp, Artificial Sequence
  Synthetic
accgggauaacaaagagcaauaaaga

SEQ ID NO: 13220 - DNA, 30 bp, Artificial Sequence
  Synthetic
aagtactttattgacucctgcttttctaut

SEQ ID NO: 13221 - DNA, 28 bp, Artificial Sequence
  Synthetic
gcaatcatctcugagtgctaaaatccua

SEQ ID NO: 13222 - DNA, 24 bp, Artificial Sequence
  Synthetic
atttgcatctcauttgttcgccut

SEQ ID NO: 13223 - DNA, 19 bp, Artificial Sequence
  Synthetic
cggtccugtccagacucac

SEQ ID NO: 13224 - DNA, 22 bp, Artificial Sequence
  Synthetic
gcccttucaaggattccuccat

SEQ ID NO: 13225 - DNA, 22 bp, Artificial Sequence
  Synthetic
gcctgtcccauacaccttccua

SEQ ID NO: 13226 - DNA, 21 bp, Artificial Sequence
  Synthetic
cgctgccagauttgttctucc

SEQ ID NO: 13227 - DNA, 17 bp, Artificial Sequence
  Synthetic
guagcgggucccccaac

SEQ ID NO: 13228 - DNA, 24 bp, Artificial Sequence
  Synthetic
gaaaaaggutgcacagucacagaa

SEQ ID NO: 13229 - DNA, 24 bp, Artificial Sequence
  Synthetic
cacagtucacctggucaaaagaga

SEQ ID NO: 13230 - DNA, 30 bp, Artificial Sequence
  Synthetic
gggaacttgacacauctctttaattauagg

SEQ ID NO: 13231 - DNA, 24 bp, Artificial Sequence
  Synthetic
cttttgggaagutggtucaacaca

SEQ ID NO: 13232 - DNA, 24 bp, Artificial Sequence
  Synthetic
caaggaaccuactggtgtcatgua

SEQ ID NO: 13233 - DNA, 28 bp, Artificial Sequence
  Synthetic
tttcctttgcutaattaaacgtugcagt

SEQ ID NO: 13234 - DNA, 21 bp, Artificial Sequence
  Synthetic
cgaaggacaaggutgccctut

SEQ ID NO: 13235 - DNA, 27 bp, Artificial Sequence
  Synthetic
agtaagatccaacagugaaaccactut

SEQ ID NO: 13236 - DNA, 29 bp, Artificial Sequence
  Synthetic
ggtctgaaaautgtctgtgtguacaaaat

SEQ ID NO: 13237 - DNA, 26 bp, Artificial Sequence
  Synthetic
cacaggtttcuctagtttgtcauggt

SEQ ID NO: 13238 - DNA, 29 bp, Artificial Sequence
  Synthetic
aggctctagagautcgaagtagtttauct

SEQ ID NO: 13239 - DNA, 24 bp, Artificial Sequence
  Synthetic
aaaatgggctutaccgtaccauga

SEQ ID NO: 13240 - DNA, 22 bp, Artificial Sequence
  Synthetic
cacctgaagaaacuggcagcua

SEQ ID NO: 13241 - DNA, 30 bp, Artificial Sequence
  Synthetic
gtctatgccaaaauaagtttccagttucat

SEQ ID NO: 13242 - DNA, 25 bp, Artificial Sequence
  Synthetic
ccattcacaucctggtaauccaagt

SEQ ID NO: 13243 - DNA, 30 bp, Artificial Sequence
  Synthetic
tgtctctacuggcacattacttctacuaaa

SEQ ID NO: 13244 - DNA, 28 bp, Artificial Sequence
  Synthetic
cagcaagcugttcaaattattuggaaac

SEQ ID NO: 13245 - DNA, 25 bp, Artificial Sequence
  Synthetic
ttccgcacuattgctttgtttuacc

SEQ ID NO: 13246 - DNA, 22 bp, Artificial Sequence
  Synthetic
ccugttctggttugcacacaga

SEQ ID NO: 13247 - DNA, 28 bp, Artificial Sequence
  Synthetic
tggaattatttguaaatcaggaggcugt

SEQ ID NO: 13248 - DNA, 20 bp, Artificial Sequence
  Synthetic
ggtgcuccagactgatguca

SEQ ID NO: 13249 - DNA, 20 bp, Artificial Sequence
  Synthetic
cttctggccugaggtcucac

SEQ ID NO: 13250 - DNA, 17 bp, Artificial Sequence
  Synthetic
gugcgtcguggaccaga

SEQ ID NO: 13251 - DNA, 20 bp, Artificial Sequence
  Synthetic
gcatguggcacgaggagaug

SEQ ID NO: 13252 - DNA, 18 bp, Artificial Sequence
  Synthetic
aggacagggcugtcgcua

SEQ ID NO: 13253 - DNA, 18 bp, Artificial Sequence
  Synthetic
cgugcgcaaacugcagag

SEQ ID NO: 13254 - DNA, 17 bp, Artificial Sequence
  Synthetic
gcuaagcccggcctcug

SEQ ID NO: 13255 - DNA, 20 bp, Artificial Sequence
  Synthetic
ttcaggutgagctucagcga

SEQ ID NO: 13256 - DNA, 20 bp, Artificial Sequence
  Synthetic
cccagcugctctccauacac

SEQ ID NO: 13257 - DNA, 21 bp, Artificial Sequence
  Synthetic
ggtgacagcuctccctttcuc

SEQ ID NO: 13258 - DNA, 22 bp, Artificial Sequence
  Synthetic
cgagctgcucttcttctgctuc

SEQ ID NO: 13259 - DNA, 21 bp, Artificial Sequence
  Synthetic
gaacccaagauggcccugaaa

SEQ ID NO: 13260 - DNA, 24 bp, Artificial Sequence
  Synthetic
cagagaagguagagaguggaatug

SEQ ID NO: 13261 - DNA, 22 bp, Artificial Sequence
  Synthetic
ccctgcccaucgataatgacug

SEQ ID NO: 13262 - DNA, 22 bp, Artificial Sequence
  Synthetic
ggaggagugaagacagaugggt

SEQ ID NO: 13263 - DNA, 21 bp, Artificial Sequence
  Synthetic
cactcacgacuggatggtgut

SEQ ID NO: 13264 - DNA, 17 bp, Artificial Sequence
  Synthetic
agagcugcggcttgguc

SEQ ID NO: 13265 - DNA, 19 bp, Artificial Sequence
  Synthetic
gaacgtuaacggcgcctuc

SEQ ID NO: 13266 - DNA, 19 bp, Artificial Sequence
  Synthetic
ggguggagagtugcagcag

SEQ ID NO: 13267 - DNA, 17 bp, Artificial Sequence
  Synthetic
cgcagguggaggaggug

SEQ ID NO: 13268 - DNA, 17 bp, Artificial Sequence
  Synthetic
cugcgggcaggagcuat

SEQ ID NO: 13269 - DNA, 18 bp, Artificial Sequence
  Synthetic
catgaagcugtgcugggc

SEQ ID NO: 13270 - DNA, 21 bp, Artificial Sequence
  Synthetic
gggtuccccaccagaaaaugg

SEQ ID NO: 13271 - DNA, 21 bp, Artificial Sequence
  Synthetic
ccgaaacaucctcguggagag

SEQ ID NO: 13272 - DNA, 22 bp, Artificial Sequence
  Synthetic
aaagcacccauacgtcttggut

SEQ ID NO: 13273 - DNA, 19 bp, Artificial Sequence
  Synthetic
gugaaacagcugcagcaca

SEQ ID NO: 13274 - DNA, 22 bp, Artificial Sequence
  Synthetic
ccttccacugggcccaatauga

SEQ ID NO: 13275 - DNA, 22 bp, Artificial Sequence
  Synthetic
ctgctgatucaacagtgcaugg

SEQ ID NO: 13276 - DNA, 22 bp, Artificial Sequence
  Synthetic
ctcctccaccuccaggaactua

SEQ ID NO: 13277 - DNA, 20 bp, Artificial Sequence
  Synthetic
gcaaugtctcugcccggaag

SEQ ID NO: 13278 - DNA, 22 bp, Artificial Sequence
  Synthetic
agaacagccuagacttggguga

SEQ ID NO: 13279 - DNA, 22 bp, Artificial Sequence
  Synthetic
atcttctctcccutcccaccut

SEQ ID NO: 13280 - DNA, 21 bp, Artificial Sequence
  Synthetic
tcagctgguattgggatuggg

SEQ ID NO: 13281 - DNA, 24 bp, Artificial Sequence
  Synthetic
gggactttucacctctgatttcug

SEQ ID NO: 13282 - DNA, 21 bp, Artificial Sequence
  Synthetic
ggtgaggacacugaggcauag

SEQ ID NO: 13283 - DNA, 18 bp, Artificial Sequence
  Synthetic
cugaccacggacucccag

SEQ ID NO: 13284 - DNA, 17 bp, Artificial Sequence
  Synthetic
ggaguccgcccucacct

SEQ ID NO: 13285 - DNA, 22 bp, Artificial Sequence
  Synthetic
ccaagtacaucatggaccugga

SEQ ID NO: 13286 - DNA, 21 bp, Artificial Sequence
  Synthetic
ctgacagtcutcagcagcuct

SEQ ID NO: 13287 - DNA, 18 bp, Artificial Sequence
  Synthetic
cgcagugacctggugagt

SEQ ID NO: 13288 - DNA, 20 bp, Artificial Sequence
  Synthetic
ccuccacggagaagatgugg

SEQ ID NO: 13289 - DNA, 21 bp, Artificial Sequence
  Synthetic
cactccugaagggcacagaug

SEQ ID NO: 13290 - DNA, 20 bp, Artificial Sequence
  Synthetic
ggtcagcauctaggugccaa

SEQ ID NO: 13291 - DNA, 20 bp, Artificial Sequence
  Synthetic
gcgauggagagaaccagguc

SEQ ID NO: 13292 - DNA, 25 bp, Artificial Sequence
  Synthetic
cattttctctcucctcatgcaucca

SEQ ID NO: 13293 - DNA, 21 bp, Artificial Sequence
  Synthetic
ggcuttgatgctucagaaggc

SEQ ID NO: 13294 - DNA, 24 bp, Artificial Sequence
  Synthetic
tgctagagcutactcugagaaggt

SEQ ID NO: 13295 - DNA, 25 bp, Artificial Sequence
  Synthetic
gcagatgtcuggttagcttucagat

SEQ ID NO: 13296 - DNA, 23 bp, Artificial Sequence
  Synthetic
gccacgacucacagaaagaacuc

SEQ ID NO: 13297 - DNA, 21 bp, Artificial Sequence
  Synthetic
gcagctuaagcaggaggtguc

SEQ ID NO: 13298 - DNA, 17 bp, Artificial Sequence
  Synthetic
gucggagaagcggucct

SEQ ID NO: 13299 - DNA, 18 bp, Artificial Sequence
  Synthetic
gcucacccgcaccaucac

SEQ ID NO: 13300 - DNA, 21 bp, Artificial Sequence
  Synthetic
gaggtgugtcttctgtucggt

SEQ ID NO: 13301 - DNA, 23 bp, Artificial Sequence
  Synthetic
tcaagutcgacgugaagaaggag

SEQ ID NO: 13302 - DNA, 20 bp, Artificial Sequence
  Synthetic
ctcggugtgtgccuaagagg

SEQ ID NO: 13303 - DNA, 18 bp, Artificial Sequence
  Synthetic
cgutggagguggcaaggg

SEQ ID NO: 13304 - DNA, 17 bp, Artificial Sequence
  Synthetic
cuccacctucggccagt

SEQ ID NO: 13305 - DNA, 21 bp, Artificial Sequence
  Synthetic
gatctttgucctcgggctuga

SEQ ID NO: 13306 - DNA, 20 bp, Artificial Sequence
  Synthetic
ttgggtgcuccatctuacgg

SEQ ID NO: 13307 - DNA, 20 bp, Artificial Sequence
  Synthetic
gggctgtuccccgattucag

SEQ ID NO: 13308 - DNA, 19 bp, Artificial Sequence
  Synthetic
ccagctugggaggcttcug

SEQ ID NO: 13309 - DNA, 21 bp, Artificial Sequence
  Synthetic
tcttctgguggagggctguat

SEQ ID NO: 13310 - DNA, 20 bp, Artificial Sequence
  Synthetic
ggcttucccgagttaucgca

SEQ ID NO: 13311 - DNA, 23 bp, Artificial Sequence
  Synthetic
cccgtgaagutagaaggagguct

SEQ ID NO: 13312 - DNA, 18 bp, Artificial Sequence
  Synthetic
gcagccucagcggauacc

SEQ ID NO: 13313 - DNA, 17 bp, Artificial Sequence
  Synthetic
cgggaucggcugcgaat

SEQ ID NO: 13314 - DNA, 20 bp, Artificial Sequence
  Synthetic
gcttcggucgatcugagagt

SEQ ID NO: 13315 - DNA, 24 bp, Artificial Sequence
  Synthetic
tgagcttacugcgtttcttctcug

SEQ ID NO: 13316 - DNA, 22 bp, Artificial Sequence
  Synthetic
gtcactgacaaguccccttgut

SEQ ID NO: 13317 - DNA, 21 bp, Artificial Sequence
  Synthetic
tcgtacugacgaaggtgcaug

SEQ ID NO: 13318 - DNA, 27 bp, Artificial Sequence
  Synthetic
gggatctttcutgtcattcaagtuagg

SEQ ID NO: 13319 - DNA, 19 bp, Artificial Sequence
  Synthetic
agtgcctguctgtccacug

SEQ ID NO: 13320 - DNA, 18 bp, Artificial Sequence
  Synthetic
gctcgcugtcgccatuct

SEQ ID NO: 13321 - DNA, 18 bp, Artificial Sequence
  Synthetic
cctucaggcgcagaucca

SEQ ID NO: 13322 - DNA, 21 bp, Artificial Sequence
  Synthetic
gggactccugctcgcttuaac

SEQ ID NO: 13323 - DNA, 21 bp, Artificial Sequence
  Synthetic
gtcggacaguagtucgccaaa

SEQ ID NO: 13324 - DNA, 18 bp, Artificial Sequence
  Synthetic
agccgccgaguacttguc

SEQ ID NO: 13325 - DNA, 19 bp, Artificial Sequence
  Synthetic
agcctcucccccaacuaca

SEQ ID NO: 13326 - DNA, 21 bp, Artificial Sequence
  Synthetic
tgaaggucacgttgaggtugg

SEQ ID NO: 13327 - DNA, 19 bp, Artificial Sequence
  Synthetic
agtaaatugggcgcgcuct

SEQ ID NO: 13328 - DNA, 18 bp, Artificial Sequence
  Synthetic
ctcaucggctccugcaga

SEQ ID NO: 13329 - DNA, 17 bp, Artificial Sequence
  Synthetic
gcgcguggttcucaggt

SEQ ID NO: 13330 - DNA, 17 bp, Artificial Sequence
  Synthetic
ccggguaggcctgggua

SEQ ID NO: 13331 - DNA, 18 bp, Artificial Sequence
  Synthetic
cggcugcagcattucgac

SEQ ID NO: 13332 - DNA, 22 bp, Artificial Sequence
  Synthetic
gggcacgaautttgtcggacua

SEQ ID NO: 13333 - DNA, 19 bp, Artificial Sequence
  Synthetic
ggccagaaagaugcctgug

SEQ ID NO: 13334 - DNA, 19 bp, Artificial Sequence
  Synthetic
ctcctuggttcgucaccct

SEQ ID NO: 13335 - DNA, 21 bp, Artificial Sequence
  Synthetic
cggactuccacagttcaggug

SEQ ID NO: 13336 - DNA, 17 bp, Artificial Sequence
  Synthetic
cctgcgugcaacuccga

SEQ ID NO: 13337 - DNA, 24 bp, Artificial Sequence
  Synthetic
tgagcaugaacacccacttuaagg

SEQ ID NO: 13338 - DNA, 21 bp, Artificial Sequence
  Synthetic
ctgtggtguctgtctguccat

SEQ ID NO: 13339 - DNA, 18 bp, Artificial Sequence
  Synthetic
gacctgccguttgtcgug

SEQ ID NO: 13340 - DNA, 19 bp, Artificial Sequence
  Synthetic
cutctcacugccccaccag

SEQ ID NO: 13341 - DNA, 21 bp, Artificial Sequence
  Synthetic
ctgagccaccutgtctgucat

SEQ ID NO: 13342 - DNA, 19 bp, Artificial Sequence
  Synthetic
agtgggagaaguccuggca

SEQ ID NO: 13343 - DNA, 20 bp, Artificial Sequence
  Synthetic
cccuggcgtuagaggagaag

SEQ ID NO: 13344 - DNA, 22 bp, Artificial Sequence
  Synthetic
cctcctgcaacuggatcatcuc

SEQ ID NO: 13345 - DNA, 18 bp, Artificial Sequence
  Synthetic
gggugccaagcctctguc

SEQ ID NO: 13346 - DNA, 19 bp, Artificial Sequence
  Synthetic
ttcatggccugcaggtuga

SEQ ID NO: 13347 - DNA, 20 bp, Artificial Sequence
  Synthetic
ctcctgactugggctctcug

SEQ ID NO: 13348 - DNA, 24 bp, Artificial Sequence
  Synthetic
ctugaaggagaggaaaugcaaagg

SEQ ID NO: 13349 - DNA, 21 bp, Artificial Sequence
  Synthetic
ccuacgacaagcuggagaaga

SEQ ID NO: 13350 - DNA, 24 bp, Artificial Sequence
  Synthetic
gaaggaattcutctcgtccuccac

SEQ ID NO: 13351 - DNA, 22 bp, Artificial Sequence
  Synthetic
gtttuggacaccaccctccuaa

SEQ ID NO: 13352 - DNA, 18 bp, Artificial Sequence
  Synthetic
cttgucggccagctcugt

SEQ ID NO: 13353 - DNA, 19 bp, Artificial Sequence
  Synthetic
cgaggugaaggtgctgcug

SEQ ID NO: 13354 - DNA, 18 bp, Artificial Sequence
  Synthetic
caucccgagggactuggt

SEQ ID NO: 13355 - DNA, 21 bp, Artificial Sequence
  Synthetic
caggaagaccuggagtcugag

SEQ ID NO: 13356 - DNA, 18 bp, Artificial Sequence
  Synthetic
cctcggugttccggucag

SEQ ID NO: 13357 - DNA, 21 bp, Artificial Sequence
  Synthetic
cucgccaagcucaagaacaag

SEQ ID NO: 13358 - DNA, 19 bp, Artificial Sequence
  Synthetic
gttctcccagcucctggut

SEQ ID NO: 13359 - DNA, 19 bp, Artificial Sequence
  Synthetic
ccuagaggccaggguggag

SEQ ID NO: 13360 - DNA, 21 bp, Artificial Sequence
  Synthetic
catctccgugagcctgttcuc

SEQ ID NO: 13361 - DNA, 20 bp, Artificial Sequence
  Synthetic
agccgagcaugtctcuacct

SEQ ID NO: 13362 - DNA, 21 bp, Artificial Sequence
  Synthetic
tgatcttcagguctcgcucct

SEQ ID NO: 13363 - DNA, 20 bp, Artificial Sequence
  Synthetic
ccagttgcuggccagguaaa

SEQ ID NO: 13364 - DNA, 18 bp, Artificial Sequence
  Synthetic
gccgcaccutcttcucgt

SEQ ID NO: 13365 - DNA, 18 bp, Artificial Sequence
  Synthetic
atgucggagaccgcacug

SEQ ID NO: 13366 - DNA, 21 bp, Artificial Sequence
  Synthetic
cgactccaccuctcctgugaa

SEQ ID NO: 13367 - DNA, 21 bp, Artificial Sequence
  Synthetic
ttcguggagaaggtgaugcag

SEQ ID NO: 13368 - DNA, 25 bp, Artificial Sequence
  Synthetic
gaagcagggtucttaaccaaggaua

SEQ ID NO: 13369 - DNA, 23 bp, Artificial Sequence
  Synthetic
caucaacaaggctcuggacaaga

SEQ ID NO: 13370 - DNA, 20 bp, Artificial Sequence
  Synthetic
ccaagcaccugccccatuat

SEQ ID NO: 13371 - DNA, 20 bp, Artificial Sequence
  Synthetic
tgagcugcctctgatugcac

SEQ ID NO: 13372 - DNA, 24 bp, Artificial Sequence
  Synthetic
gcagcttctuctctacagagguca

SEQ ID NO: 13373 - DNA, 29 bp, Artificial Sequence
  Synthetic
ctctgatctctugctatcctttcttacut

SEQ ID NO: 13374 - DNA, 22 bp, Artificial Sequence
  Synthetic
gccccagtugtggtttcaguag

SEQ ID NO: 13375 - DNA, 22 bp, Artificial Sequence
  Synthetic
ctggcgggagutaatctgaugt

SEQ ID NO: 13376 - DNA, 22 bp, Artificial Sequence
  Synthetic
agtaacgcuccttgaggttgug

SEQ ID NO: 13377 - DNA, 23 bp, Artificial Sequence
  Synthetic
agaatgggaagaaggugaaggug

SEQ ID NO: 13378 - DNA, 18 bp, Artificial Sequence
  Synthetic
ctuccccaccccgtctug

SEQ ID NO: 13379 - DNA, 19 bp, Artificial Sequence
  Synthetic
ctggagcugtcgtcaggug

SEQ ID NO: 13380 - DNA, 21 bp, Artificial Sequence
  Synthetic
gctcuccaggaagtccuccag

SEQ ID NO: 13381 - DNA, 21 bp, Artificial Sequence
  Synthetic
catccccgaagacaguctgug

SEQ ID NO: 13382 - DNA, 22 bp, Artificial Sequence
  Synthetic
ctggctcauggcttcctcauag

SEQ ID NO: 13383 - DNA, 19 bp, Artificial Sequence
  Synthetic
tcctctcccugctctccug

SEQ ID NO: 13384 - DNA, 19 bp, Artificial Sequence
  Synthetic
gctgcaaggcutcctgcut

SEQ ID NO: 13385 - DNA, 17 bp, Artificial Sequence
  Synthetic
ctccagcugccagcuga

SEQ ID NO: 13386 - DNA, 18 bp, Artificial Sequence
  Synthetic
ggcccucctcctucacga

SEQ ID NO: 13387 - DNA, 17 bp, Artificial Sequence
  Synthetic
cgcucactgcucagcac

SEQ ID NO: 13388 - DNA, 25 bp, Artificial Sequence
  Synthetic
ctgatttggucttgataggcucgaa

SEQ ID NO: 13389 - DNA, 20 bp, Artificial Sequence
  Synthetic
ggcctcccugactctugact

SEQ ID NO: 13390 - DNA, 18 bp, Artificial Sequence
  Synthetic
gctgctgcugctggtuga

SEQ ID NO: 13391 - DNA, 21 bp, Artificial Sequence
  Synthetic
ggagcugaagccaaaggugaa

SEQ ID NO: 13392 - DNA, 21 bp, Artificial Sequence
  Synthetic
agcatcuggaagcacacacuc

SEQ ID NO: 13393 - DNA, 19 bp, Artificial Sequence
  Synthetic
agcagcgaugccttauccc

SEQ ID NO: 13394 - DNA, 25 bp, Artificial Sequence
  Synthetic
tgagtacacacagugagaacuggat

SEQ ID NO: 13395 - DNA, 25 bp, Artificial Sequence
  Synthetic
cctggattugagagtttcttggugt

SEQ ID NO: 13396 - DNA, 21 bp, Artificial Sequence
  Synthetic
ggcgtuggagttgtgaatucg

SEQ ID NO: 13397 - DNA, 17 bp, Artificial Sequence
  Synthetic
tctcgccgcucgcttut

SEQ ID NO: 13398 - DNA, 22 bp, Artificial Sequence
  Synthetic
ggtgggaaucttgttaccgugt

SEQ ID NO: 13399 - DNA, 28 bp, Artificial Sequence
  Synthetic
catgaaatcagcaugcaaatgtacacua

SEQ ID NO: 13400 - DNA, 25 bp, Artificial Sequence
  Synthetic
ggcaattaaagcauttcaggaggug

SEQ ID NO: 13401 - DNA, 27 bp, Artificial Sequence
  Synthetic
cccaacaaccuacctttaaacuagact

SEQ ID NO: 13402 - DNA, 29 bp, Artificial Sequence
  Synthetic
ttttggtttgtttuctgcttcgtattcut

SEQ ID NO: 13403 - DNA, 26 bp, Artificial Sequence
  Synthetic
actgaatagcauagctttccttggug

SEQ ID NO: 13404 - DNA, 27 bp, Artificial Sequence
  Synthetic
ggcctatattugtgctgtacaatugga

SEQ ID NO: 13405 - DNA, 26 bp, Artificial Sequence
  Synthetic
gcaagugcagaggtattacuacaact

SEQ ID NO: 13406 - DNA, 29 bp, Artificial Sequence
  Synthetic
ggcctcctcuaaccattattattaacugt

SEQ ID NO: 13407 - DNA, 25 bp, Artificial Sequence
  Synthetic
tcaaacaccaugaatgagcttgtug

SEQ ID NO: 13408 - DNA, 21 bp, Artificial Sequence
  Synthetic
gccaacagcugactcaucact

SEQ ID NO: 13409 - DNA, 22 bp, Artificial Sequence
  Synthetic
tgatgtgcuacagggaacaugg

SEQ ID NO: 13410 - DNA, 22 bp, Artificial Sequence
  Synthetic
cagaaucagaacggacauccca

SEQ ID NO: 13411 - DNA, 25 bp, Artificial Sequence
  Synthetic
gtttcaggcaccgucaatatgttuc

SEQ ID NO: 13412 - DNA, 24 bp, Artificial Sequence
  Synthetic
cctcttcaccaucttcagccatut

SEQ ID NO: 13413 - DNA, 24 bp, Artificial Sequence
  Synthetic
cagaagcagauctgttttcauggg

SEQ ID NO: 13414 - DNA, 27 bp, Artificial Sequence
  Synthetic
aaagctctgttutcctgagatcuaacc

SEQ ID NO: 13415 - DNA, 21 bp, Artificial Sequence
  Synthetic
agcaaggccacguattacugt

SEQ ID NO: 13416 - DNA, 29 bp, Artificial Sequence
  Synthetic
actacaattgcuaaatatgcacaguacca

SEQ ID NO: 13417 - DNA, 28 bp, Artificial Sequence
  Synthetic
gtaatgtgucctttcaaaacuccaaagt

SEQ ID NO: 13418 - DNA, 26 bp, Artificial Sequence
  Synthetic
ggaaatcttcuaagccatgttgguca

SEQ ID NO: 13419 - DNA, 23 bp, Artificial Sequence
  Synthetic
agattctggcugtctttgcaugt

SEQ ID NO: 13420 - DNA, 27 bp, Artificial Sequence
  Synthetic
tgaagcaaatgtuccagtgtataggut

SEQ ID NO: 13421 - DNA, 25 bp, Artificial Sequence
  Synthetic
cctgtaaguggaccaacatuccaag

SEQ ID NO: 13422 - DNA, 28 bp, Artificial Sequence
  Synthetic
aagtctcttggcautatttctagtuggt

SEQ ID NO: 13423 - DNA, 23 bp, Artificial Sequence
  Synthetic
caatgagagcutccctcaatguc

SEQ ID NO: 13424 - DNA, 25 bp, Artificial Sequence
  Synthetic
cggaaactuggaaaactttgtggug

SEQ ID NO: 13425 - DNA, 23 bp, Artificial Sequence
  Synthetic
agagcaaacacugctgcttcaua

SEQ ID NO: 13426 - DNA, 21 bp, Artificial Sequence
  Synthetic
ccagtttguggatcctgcuct

SEQ ID NO: 13427 - DNA, 18 bp, Artificial Sequence
  Synthetic
gtctguaggccucagcgt

SEQ ID NO: 13428 - DNA, 24 bp, Artificial Sequence
  Synthetic
cttccuggagacttugaagacaga

SEQ ID NO: 13429 - DNA, 28 bp, Artificial Sequence
  Synthetic
ggagaaaagaagguactggaaaagucag

SEQ ID NO: 13430 - DNA, 20 bp, Artificial Sequence
  Synthetic
cctcctgacaucccctguga

SEQ ID NO: 13431 - DNA, 20 bp, Artificial Sequence
  Synthetic
gcatttcuccgccacagugt

SEQ ID NO: 13432 - DNA, 20 bp, Artificial Sequence
  Synthetic
ctggtggcuttatggtggug

SEQ ID NO: 13433 - DNA, 21 bp, Artificial Sequence
  Synthetic
aaggcaugaggtggcuaacag

SEQ ID NO: 13434 - DNA, 22 bp, Artificial Sequence
  Synthetic
tgggaatgcuggttagaggcua

SEQ ID NO: 13435 - DNA, 18 bp, Artificial Sequence
  Synthetic
gtggccauccctgcuacc

SEQ ID NO: 13436 - DNA, 20 bp, Artificial Sequence
  Synthetic
ctccagcucttcctccucct

SEQ ID NO: 13437 - DNA, 18 bp, Artificial Sequence
  Synthetic
cagagcgucacgggaguc

SEQ ID NO: 13438 - DNA, 25 bp, Artificial Sequence
  Synthetic
actacatgggucactatggtgaugt

SEQ ID NO: 13439 - DNA, 24 bp, Artificial Sequence
  Synthetic
cccctacctautcttgctctccuc

SEQ ID NO: 13440 - DNA, 18 bp, Artificial Sequence
  Synthetic
gcagtctcugcagggcua

SEQ ID NO: 13441 - DNA, 18 bp, Artificial Sequence
  Synthetic
gcctccucagctcuccga

SEQ ID NO: 13442 - DNA, 25 bp, Artificial Sequence
  Synthetic
agctctgugtcagatttguacaacc

SEQ ID NO: 13443 - DNA, 21 bp, Artificial Sequence
  Synthetic
ggatguaagggaagcccaguc

SEQ ID NO: 13444 - DNA, 22 bp, Artificial Sequence
  Synthetic
ctccttgagagccuggatgtug

SEQ ID NO: 13445 - DNA, 21 bp, Artificial Sequence
  Synthetic
ccacatcagacugagcgtuct

SEQ ID NO: 13446 - DNA, 17 bp, Artificial Sequence
  Synthetic
gccucaggcaccuccac

SEQ ID NO: 13447 - DNA, 24 bp, Artificial Sequence
  Synthetic
agctgaggaguttgttcttcaucc

SEQ ID NO: 13448 - DNA, 26 bp, Artificial Sequence
  Synthetic
gaagaaagggaauagaacttgccugt

SEQ ID NO: 13449 - DNA, 21 bp, Artificial Sequence
  Synthetic
cttggaugagcttccugccat

SEQ ID NO: 13450 - DNA, 22 bp, Artificial Sequence
  Synthetic
cgaactuccaccagaauagggt

SEQ ID NO: 13451 - DNA, 22 bp, Artificial Sequence
  Synthetic
cttatcugcaagatggcugcct

SEQ ID NO: 13452 - DNA, 23 bp, Artificial Sequence
  Synthetic
gaggtcaggcuggctatcaaaua

SEQ ID NO: 13453 - DNA, 22 bp, Artificial Sequence
  Synthetic
cctgcaugaccaaggtgtgaut

SEQ ID NO: 13454 - DNA, 26 bp, Artificial Sequence
  Synthetic
actcaacagucacatcttcctcaaug

SEQ ID NO: 13455 - DNA, 26 bp, Artificial Sequence
  Synthetic
tcataggtattgaugccagatgguct

SEQ ID NO: 13456 - DNA, 26 bp, Artificial Sequence
  Synthetic
gacaagaagcagagcautaagaaguc

SEQ ID NO: 13457 - DNA, 23 bp, Artificial Sequence
  Synthetic
ggatgugaaggtggagucaacat

SEQ ID NO: 13458 - DNA, 25 bp, Artificial Sequence
  Synthetic
tcaaagcuctaagtucgaagaaggg

SEQ ID NO: 13459 - DNA, 28 bp, Artificial Sequence
  Synthetic
agtgtaacacacguccatttgataauga

SEQ ID NO: 13460 - DNA, 22 bp, Artificial Sequence
  Synthetic
ggcccccagaguatcaaggaua

SEQ ID NO: 13461 - DNA, 23 bp, Artificial Sequence
  Synthetic
tgaactactuggaccagatugcc

SEQ ID NO: 13462 - DNA, 21 bp, Artificial Sequence
  Synthetic
gggcctgautttcgcgatgua

SEQ ID NO: 13463 - DNA, 19 bp, Artificial Sequence
  Synthetic
agtcctuaagggcggucca

SEQ ID NO: 13464 - DNA, 22 bp, Artificial Sequence
  Synthetic
tgtcucaggctctgtugaacac

SEQ ID NO: 13465 - DNA, 21 bp, Artificial Sequence
  Synthetic
gctaaggaguctccgcctuac

SEQ ID NO: 13466 - DNA, 21 bp, Artificial Sequence
  Synthetic
cugaggatgtguccgaggaat

SEQ ID NO: 13467 - DNA, 25 bp, Artificial Sequence
  Synthetic
gcacttccttautgaagtcgccaua

SEQ ID NO: 13468 - DNA, 27 bp, Artificial Sequence
  Synthetic
gatgtatggugtgaactactucagcat

SEQ ID NO: 13469 - DNA, 22 bp, Artificial Sequence
  Synthetic
ccttggtgaaaagugagcccua

SEQ ID NO: 13470 - DNA, 30 bp, Artificial Sequence
  Synthetic
tgttctatccattutatctccttcccuagt

SEQ ID NO: 13471 - DNA, 23 bp, Artificial Sequence
  Synthetic
ctcaccttgcugagccttctuag

SEQ ID NO: 13472 - DNA, 22 bp, Artificial Sequence
  Synthetic
agctcucacaggcttccaatut

SEQ ID NO: 13473 - DNA, 22 bp, Artificial Sequence
  Synthetic
tgctttaggcccugtgtctuac

SEQ ID NO: 13474 - DNA, 22 bp, Artificial Sequence
  Synthetic
ccaaugccagagatgaguccaa

SEQ ID NO: 13475 - DNA, 18 bp, Artificial Sequence
  Synthetic
ggtcccuagaggcugggt

SEQ ID NO: 13476 - DNA, 22 bp, Artificial Sequence
  Synthetic
gacctagaucccgactucgaac

SEQ ID NO: 13477 - DNA, 22 bp, Artificial Sequence
  Synthetic
gugtgtacctttucccccagat

SEQ ID NO: 13478 - DNA, 22 bp, Artificial Sequence
  Synthetic
ggatggtccguactgtacccua

SEQ ID NO: 13479 - DNA, 22 bp, Artificial Sequence
  Synthetic
ggccccagaguagaaguaaggg

SEQ ID NO: 13480 - DNA, 22 bp, Artificial Sequence
  Synthetic
ttgctcucgaaaccgugaagaa

SEQ ID NO: 13481 - DNA, 20 bp, Artificial Sequence
  Synthetic
cccccugcataactgcugac

SEQ ID NO: 13482 - DNA, 20 bp, Artificial Sequence
  Synthetic
gctccgacucttctgtugct

SEQ ID NO: 13483 - DNA, 22 bp, Artificial Sequence
  Synthetic
catgactggagguggtgctauc

SEQ ID NO: 13484 - DNA, 23 bp, Artificial Sequence
  Synthetic
gtttcttctucccacagauccct

SEQ ID NO: 13485 - DNA, 22 bp, Artificial Sequence
  Synthetic
tcttcaacaccugtgtgugacc

SEQ ID NO: 13486 - DNA, 29 bp, Artificial Sequence
  Synthetic
ttcctgagcaucaccatttttagatuaca

SEQ ID NO: 13487 - DNA, 24 bp, Artificial Sequence
  Synthetic
ctggaugaggaagggttugaaagt

SEQ ID NO: 13488 - DNA, 28 bp, Artificial Sequence
  Synthetic
tggtgcaautaatggagauagaagacat

SEQ ID NO: 13489 - DNA, 21 bp, Artificial Sequence
  Synthetic
ggaaaacgacacccuttgcug

SEQ ID NO: 13490 - DNA, 26 bp, Artificial Sequence
  Synthetic
aagcagatctauattggcgttgtuga

SEQ ID NO: 13491 - DNA, 25 bp, Artificial Sequence
  Synthetic
gggaagaaatugaagtgccttucag

SEQ ID NO: 13492 - DNA, 25 bp, Artificial Sequence
  Synthetic
aacttcaggugatcagttgtgtuga

SEQ ID NO: 13493 - DNA, 21 bp, Artificial Sequence
  Synthetic
gacatcaaugagtgccuccga

SEQ ID NO: 13494 - DNA, 22 bp, Artificial Sequence
  Synthetic
agcccagugcccaaataaugat

SEQ ID NO: 13495 - DNA, 29 bp, Artificial Sequence
  Synthetic
gaaaaataccaacuaacagcacgatugaa

SEQ ID NO: 13496 - DNA, 20 bp, Artificial Sequence
  Synthetic
agtccaagcugagcagcauc

SEQ ID NO: 13497 - DNA, 19 bp, Artificial Sequence
  Synthetic
cagcacguctcttgcucct

SEQ ID NO: 13498 - DNA, 28 bp, Artificial Sequence
  Synthetic
accaaagactucagaatattgagacugg

SEQ ID NO: 13499 - DNA, 22 bp, Artificial Sequence
  Synthetic
tctgggtucaccaagaggguat

SEQ ID NO: 13500 - DNA, 21 bp, Artificial Sequence
  Synthetic
gtcacttugagagccccacuc

SEQ ID NO: 13501 - DNA, 26 bp, Artificial Sequence
  Synthetic
gaaatgtttttgtucctcctgtgcua

SEQ ID NO: 13502 - DNA, 23 bp, Artificial Sequence
  Synthetic
ctcccaggcacutgatgatacuc

SEQ ID NO: 13503 - DNA, 22 bp, Artificial Sequence
  Synthetic
acagaaucacaugccacacagt

SEQ ID NO: 13504 - DNA, 30 bp, Artificial Sequence
  Synthetic
cattcaggaaaacuacaauggagaaagaag

SEQ ID NO: 13505 - DNA, 24 bp, Artificial Sequence
  Synthetic
gttcacatgcacucctgtgttcua

SEQ ID NO: 13506 - DNA, 27 bp, Artificial Sequence
  Synthetic
ctcgatgtugagaaggatcttcttcut

SEQ ID NO: 13507 - DNA, 24 bp, Artificial Sequence
  Synthetic
ctttacggtacacuaaccctgcut

SEQ ID NO: 13508 - DNA, 22 bp, Artificial Sequence
  Synthetic
gaatgcgaaugattggctggut

SEQ ID NO: 13509 - DNA, 26 bp, Artificial Sequence
  Synthetic
aattgcgttuaaattcttcccuggag

SEQ ID NO: 13510 - DNA, 22 bp, Artificial Sequence
  Synthetic
catgccttucacgttccttucc

SEQ ID NO: 13511 - DNA, 24 bp, Artificial Sequence
  Synthetic
acagacctttcugaggttagcuga

SEQ ID NO: 13512 - DNA, 21 bp, Artificial Sequence
  Synthetic
gagagactuggagccacctuc

SEQ ID NO: 13513 - DNA, 28 bp, Artificial Sequence
  Synthetic
ctcaccttauggtttgattatggucact

SEQ ID NO: 13514 - DNA, 20 bp, Artificial Sequence
  Synthetic
cctcgctcucactgttgcug

SEQ ID NO: 13515 - DNA, 26 bp, Artificial Sequence
  Synthetic
tgctacacuacaaacaucagaaccaa

SEQ ID NO: 13516 - DNA, 22 bp, Artificial Sequence
  Synthetic
aagcagatuaggcgagcatuct

SEQ ID NO: 13517 - DNA, 21 bp, Artificial Sequence
  Synthetic
cggcaactugaccatcctcug

SEQ ID NO: 13518 - DNA, 19 bp, Artificial Sequence
  Synthetic
gggtaggugggtgaacugg

SEQ ID NO: 13519 - DNA, 21 bp, Artificial Sequence
  Synthetic
catggtttcutgccacaugct

SEQ ID NO: 13520 - DNA, 21 bp, Artificial Sequence
  Synthetic
cctcacucaccccatcctuca

SEQ ID NO: 13521 - DNA, 21 bp, Artificial Sequence
  Synthetic
gcagtgcugtgaaaaguggac

SEQ ID NO: 13522 - DNA, 26 bp, Artificial Sequence
  Synthetic
caataactcccuagccaagtctcuac

SEQ ID NO: 13523 - DNA, 28 bp, Artificial Sequence
  Synthetic
ttgagtgtaacuaccttttccctttgut

SEQ ID NO: 13524 - DNA, 21 bp, Artificial Sequence
  Synthetic
agcgatgucttgtgaggugag

SEQ ID NO: 13525 - DNA, 23 bp, Artificial Sequence
  Synthetic
gaggtctcuccattttccaccut

SEQ ID NO: 13526 - DNA, 22 bp, Artificial Sequence
  Synthetic
tcctgtttccacuggtccacua

SEQ ID NO: 13527 - DNA, 28 bp, Artificial Sequence
  Synthetic
ttccuaaaccagaagcatctaguagagt

SEQ ID NO: 13528 - DNA, 21 bp, Artificial Sequence
  Synthetic
gctagucccaaagaggaggug

SEQ ID NO: 13529 - DNA, 22 bp, Artificial Sequence
  Synthetic
accatgctttugctccctttug

SEQ ID NO: 13530 - DNA, 21 bp, Artificial Sequence
  Synthetic
caugtgtggugcagaggagaa

SEQ ID NO: 13531 - DNA, 24 bp, Artificial Sequence
  Synthetic
catcacctucatcttcaaguccct

SEQ ID NO: 13532 - DNA, 20 bp, Artificial Sequence
  Synthetic
gcatcccgggacuggtcuat

SEQ ID NO: 13533 - DNA, 28 bp, Artificial Sequence
  Synthetic
acttgttgtaatcaugttgtgatgaaug

SEQ ID NO: 13534 - DNA, 24 bp, Artificial Sequence
  Synthetic
tcttttccacccuatctccgcuat

SEQ ID NO: 13535 - DNA, 32 bp, Artificial Sequence
  Synthetic
ctgcattcattttcucataacttctttctcua

SEQ ID NO: 13536 - DNA, 25 bp, Artificial Sequence
  Synthetic
gatctcaaacaccuggtcatucaga

SEQ ID NO: 13537 - DNA, 23 bp, Artificial Sequence
  Synthetic
tggagtgaugggatcaugaggaa

SEQ ID NO: 13538 - DNA, 23 bp, Artificial Sequence
  Synthetic
cccaaagttuccagcatctcuca

SEQ ID NO: 13539 - DNA, 18 bp, Artificial Sequence
  Synthetic
ctctccuggccucacgac

SEQ ID NO: 13540 - DNA, 22 bp, Artificial Sequence
  Synthetic
cttgatatccugctggaugcct

SEQ ID NO: 13541 - DNA, 27 bp, Artificial Sequence
  Synthetic
tgtcattatgtcucaactagccacuct

SEQ ID NO: 13542 - DNA, 21 bp, Artificial Sequence
  Synthetic
gaaagggccuctcaccactua

SEQ ID NO: 13543 - DNA, 20 bp, Artificial Sequence
  Synthetic
cagcagucaaatgcctuggt

SEQ ID NO: 13544 - DNA, 21 bp, Artificial Sequence
  Synthetic
ccgatcaucccgattcaugcc

SEQ ID NO: 13545 - DNA, 28 bp, Artificial Sequence
  Synthetic
ctgtattctttcugggtttgtactcugt

SEQ ID NO: 13546 - DNA, 19 bp, Artificial Sequence
  Synthetic
cauggcaagacggccaaug

SEQ ID NO: 13547 - DNA, 24 bp, Artificial Sequence
  Synthetic
catcatcaccutttgccttccuct

SEQ ID NO: 13548 - DNA, 21 bp, Artificial Sequence
  Synthetic
ctttaggccacuggcaaacug

SEQ ID NO: 13549 - DNA, 33 bp, Artificial Sequence
  Synthetic
ccagaatatuaaaggaaacttctctcuaaagaa

SEQ ID NO: 13550 - DNA, 21 bp, Artificial Sequence
  Synthetic
ccctgaugccccttgtcttua

SEQ ID NO: 13551 - DNA, 20 bp, Artificial Sequence
  Synthetic
caagguggagagggacucac

SEQ ID NO: 13552 - DNA, 22 bp, Artificial Sequence
  Synthetic
gtcgctttguccatccatucat

SEQ ID NO: 13553 - DNA, 18 bp, Artificial Sequence
  Synthetic
gcggaccagutcaugcag

SEQ ID NO: 13554 - DNA, 21 bp, Artificial Sequence
  Synthetic
gugatgagagucccaggacag

SEQ ID NO: 13555 - DNA, 20 bp, Artificial Sequence
  Synthetic
cagctgcutcatgaggtugg

SEQ ID NO: 13556 - DNA, 22 bp, Artificial Sequence
  Synthetic
gaacagaccagugacgugaaga

SEQ ID NO: 13557 - DNA, 22 bp, Artificial Sequence
  Synthetic
tgucagacaccagaatgtuggc

SEQ ID NO: 13558 - DNA, 21 bp, Artificial Sequence
  Synthetic
cctttcacccaucaacccgua

SEQ ID NO: 13559 - DNA, 20 bp, Artificial Sequence
  Synthetic
ctgcgcagguagucaaaggt

SEQ ID NO: 13560 - DNA, 26 bp, Artificial Sequence
  Synthetic
cgtaagacagaacugtcaggctttut

SEQ ID NO: 13561 - DNA, 21 bp, Artificial Sequence
  Synthetic
gaatactugcaagccctggug

SEQ ID NO: 13562 - DNA, 27 bp, Artificial Sequence
  Synthetic
tctcttcatccucctcatcttccttut

SEQ ID NO: 13563 - DNA, 23 bp, Artificial Sequence
  Synthetic
ctgcatgaagcauttccacauct

SEQ ID NO: 13564 - DNA, 19 bp, Artificial Sequence
  Synthetic
gacuacacgggcagctuca

SEQ ID NO: 13565 - DNA, 19 bp, Artificial Sequence
  Synthetic
cccaagcgacucggguaag

SEQ ID NO: 13566 - DNA, 18 bp, Artificial Sequence
  Synthetic
ttccugccccagccttuc

SEQ ID NO: 13567 - DNA, 21 bp, Artificial Sequence
  Synthetic
gaaattcgagcuggtgccauc

SEQ ID NO: 13568 - DNA, 22 bp, Artificial Sequence
  Synthetic
gctgtatcugacaggaaccuga

SEQ ID NO: 13569 - DNA, 21 bp, Artificial Sequence
  Synthetic
gcaggaggugaccaugaagag

SEQ ID NO: 13570 - DNA, 24 bp, Artificial Sequence
  Synthetic
ctgtguaggagggacctcttcuat

SEQ ID NO: 13571 - DNA, 21 bp, Artificial Sequence
  Synthetic
gaagagacgcacutcctccug

SEQ ID NO: 13572 - DNA, 21 bp, Artificial Sequence
  Synthetic
gaggtacgaacuccgctaugg

SEQ ID NO: 13573 - DNA, 20 bp, Artificial Sequence
  Synthetic
catctugccagggcattgug

SEQ ID NO: 13574 - DNA, 28 bp, Artificial Sequence
  Synthetic
ctgaaatcugaacaccctatacaguagg

SEQ ID NO: 13575 - DNA, 22 bp, Artificial Sequence
  Synthetic
tgctgtgguagaagaagcctug

SEQ ID NO: 13576 - DNA, 23 bp, Artificial Sequence
  Synthetic
tgtgcacagaaggacutaagcug

SEQ ID NO: 13577 - DNA, 27 bp, Artificial Sequence
  Synthetic
gtatcggagttgauaacaggtctctug

SEQ ID NO: 13578 - DNA, 22 bp, Artificial Sequence
  Synthetic
gccgaagtcugacccttttugt

SEQ ID NO: 13579 - DNA, 23 bp, Artificial Sequence
  Synthetic
guacctgtagtgugcaggaaact

SEQ ID NO: 13580 - DNA, 20 bp, Artificial Sequence
  Synthetic
gactccttugcccctgtgut

SEQ ID NO: 13581 - DNA, 24 bp, Artificial Sequence
  Synthetic
ctgccaatagcutagtggtaggua

SEQ ID NO: 13582 - DNA, 23 bp, Artificial Sequence
  Synthetic
guggagatgugagaccgaaagaa

SEQ ID NO: 13583 - DNA, 24 bp, Artificial Sequence
  Synthetic
agaggauaaggagaggautctcug

SEQ ID NO: 13584 - DNA, 22 bp, Artificial Sequence
  Synthetic
aggcctguggatatagccucaa

SEQ ID NO: 13585 - DNA, 19 bp, Artificial Sequence
  Synthetic
gcccucagagcagctucag

SEQ ID NO: 13586 - DNA, 24 bp, Artificial Sequence
  Synthetic
ggttagaggaagaacuggaauggg

SEQ ID NO: 13587 - DNA, 22 bp, Artificial Sequence
  Synthetic
ccctatgacacucaaccctgug

SEQ ID NO: 13588 - DNA, 18 bp, Artificial Sequence
  Synthetic
gggtgggcugtgagauca

SEQ ID NO: 13589 - DNA, 24 bp, Artificial Sequence
  Synthetic
tcttgagtctugcactccaaucag

SEQ ID NO: 13590 - DNA, 18 bp, Artificial Sequence
  Synthetic
actgctgaccugccccua

SEQ ID NO: 13591 - DNA, 17 bp, Artificial Sequence
  Synthetic
agcccccuccacccuaa

SEQ ID NO: 13592 - DNA, 18 bp, Artificial Sequence
  Synthetic
atccccgacugccugaac

SEQ ID NO: 13593 - DNA, 17 bp, Artificial Sequence
  Synthetic
gaagcugcgggagcuga

SEQ ID NO: 13594 - DNA, 21 bp, Artificial Sequence
  Synthetic
gctccgagutctgagcttuca

SEQ ID NO: 13595 - DNA, 18 bp, Artificial Sequence
  Synthetic
cctgucccccaucgacat

SEQ ID NO: 13596 - DNA, 18 bp, Artificial Sequence
  Synthetic
gcttcaggcuccccacug

SEQ ID NO: 13597 - DNA, 24 bp, Artificial Sequence
  Synthetic
acggactgutctatgacugcaaag

SEQ ID NO: 13598 - DNA, 20 bp, Artificial Sequence
  Synthetic
tcactcacugagcgctctuc

SEQ ID NO: 13599 - DNA, 19 bp, Artificial Sequence
  Synthetic
gggacaagucgtcggaguc

SEQ ID NO: 13600 - DNA, 19 bp, Artificial Sequence
  Synthetic
gcuggagaccaggctcuct

SEQ ID NO: 13601 - DNA, 20 bp, Artificial Sequence
  Synthetic
agccaggucggcagtauagt

SEQ ID NO: 13602 - DNA, 31 bp, Artificial Sequence
  Synthetic
ggagaaggactugataatctgtggaattuaa

SEQ ID NO: 13603 - DNA, 23 bp, Artificial Sequence
  Synthetic
tgaggaaaugctgggaatuccaa

SEQ ID NO: 13604 - DNA, 25 bp, Artificial Sequence
  Synthetic
agagggauggacacattttaaaugg

SEQ ID NO: 13605 - DNA, 24 bp, Artificial Sequence
  Synthetic
gtctggtctttuggagtcactcug

SEQ ID NO: 13606 - DNA, 24 bp, Artificial Sequence
  Synthetic
ggacagagugcctgatgtctuaat

SEQ ID NO: 13607 - DNA, 32 bp, Artificial Sequence
  Synthetic
ccttaaggaataucttccaaagaauaagaaca

SEQ ID NO: 13608 - DNA, 21 bp, Artificial Sequence
  Synthetic
aagcagcacgggugtaactua

SEQ ID NO: 13609 - DNA, 30 bp, Artificial Sequence
  Synthetic
ctttcactctgttutcttttctcttctgut

SEQ ID NO: 13610 - DNA, 22 bp, Artificial Sequence
  Synthetic
gttccaaagcuccacttgucag

SEQ ID NO: 13611 - DNA, 26 bp, Artificial Sequence
  Synthetic
aattgaatcccuaggagaucccagaa

SEQ ID NO: 13612 - DNA, 28 bp, Artificial Sequence
  Synthetic
caactttgaattuccatggtgtgguaag

SEQ ID NO: 13613 - DNA, 21 bp, Artificial Sequence
  Synthetic
accaggtuccagacatggcua

SEQ ID NO: 13614 - DNA, 17 bp, Artificial Sequence
  Synthetic
cctgcagccgugacuca

SEQ ID NO: 13615 - DNA, 21 bp, Artificial Sequence
  Synthetic
ctcccccaauctctuccacag

SEQ ID NO: 13616 - DNA, 20 bp, Artificial Sequence
  Synthetic
caagccagugtcctgacuga

SEQ ID NO: 13617 - DNA, 23 bp, Artificial Sequence
  Synthetic
ccctttgccuacttctccctcua

SEQ ID NO: 13618 - DNA, 31 bp, Artificial Sequence
  Synthetic
gtgagtgattucagggaagtaagaaaaatug

SEQ ID NO: 13619 - DNA, 23 bp, Artificial Sequence
  Synthetic
aagcaactuaaccctgtccctut

SEQ ID NO: 13620 - DNA, 29 bp, Artificial Sequence
  Synthetic
tccttgaaaacautatttatccgcaucct

SEQ ID NO: 13621 - DNA, 30 bp, Artificial Sequence
  Synthetic
aaactattttctccuaacctgtacaugaaa

SEQ ID NO: 13622 - DNA, 27 bp, Artificial Sequence
  Synthetic
ccatttttctgcutctttggagaauga

SEQ ID NO: 13623 - DNA, 20 bp, Artificial Sequence
  Synthetic
ccacatcugggtccccttug

SEQ ID NO: 13624 - DNA, 22 bp, Artificial Sequence
  Synthetic
cctctgcugtgtactcuccact

SEQ ID NO: 13625 - DNA, 23 bp, Artificial Sequence
  Synthetic
tgtgctaaaaugaggagcuccaa

SEQ ID NO: 13626 - DNA, 25 bp, Artificial Sequence
  Synthetic
tctcatacuggacagaaaccgauca

SEQ ID NO: 13627 - DNA, 28 bp, Artificial Sequence
  Synthetic
ttccaaacaatcuatgtatcttccaucc

SEQ ID NO: 13628 - DNA, 23 bp, Artificial Sequence
  Synthetic
agtaactatutcccccaucccca

SEQ ID NO: 13629 - DNA, 23 bp, Artificial Sequence
  Synthetic
gaaccaagtacucagccttccuc

SEQ ID NO: 13630 - DNA, 22 bp, Artificial Sequence
  Synthetic
ccugggagattuccgaacgaag

SEQ ID NO: 13631 - DNA, 28 bp, Artificial Sequence
  Synthetic
ctaactcttcuaagccttcattgctcua

SEQ ID NO: 13632 - DNA, 25 bp, Artificial Sequence
  Synthetic
aactattgccagugatccagaugag

SEQ ID NO: 13633 - DNA, 22 bp, Artificial Sequence
  Synthetic
ccccaccuacactccagaacut

SEQ ID NO: 13634 - DNA, 24 bp, Artificial Sequence
  Synthetic
ctactcuggaccccatcttcttut

SEQ ID NO: 13635 - DNA, 22 bp, Artificial Sequence
  Synthetic
gccccatcuttcttaagcugga

SEQ ID NO: 13636 - DNA, 22 bp, Artificial Sequence
  Synthetic
agaggttggguctgccagatua

SEQ ID NO: 13637 - DNA, 23 bp, Artificial Sequence
  Synthetic
gccacaucagcaaaaccatctug

SEQ ID NO: 13638 - DNA, 23 bp, Artificial Sequence
  Synthetic
gggcttaccucctactgcuagaa

SEQ ID NO: 13639 - DNA, 22 bp, Artificial Sequence
  Synthetic
cagtcagacagacugcctctug

SEQ ID NO: 13640 - DNA, 26 bp, Artificial Sequence
  Synthetic
gtgactctgtuttccttcaggauaca

SEQ ID NO: 13641 - DNA, 17 bp, Artificial Sequence
  Synthetic
ggcauggcactgcugac

SEQ ID NO: 13642 - DNA, 23 bp, Artificial Sequence
  Synthetic
cagctccagcutctatctccaut

SEQ ID NO: 13643 - DNA, 24 bp, Artificial Sequence
  Synthetic
cucttttcatccuagaccccaacc

SEQ ID NO: 13644 - DNA, 24 bp, Artificial Sequence
  Synthetic
ctcccacutcttcctatucccaac

SEQ ID NO: 13645 - DNA, 20 bp, Artificial Sequence
  Synthetic
gccctccuagaccagacuca

SEQ ID NO: 13646 - DNA, 24 bp, Artificial Sequence
  Synthetic
gaaaactacucttctguccacgca

SEQ ID NO: 13647 - DNA, 22 bp, Artificial Sequence
  Synthetic
tccccacuaaagcagtgctuac

SEQ ID NO: 13648 - DNA, 23 bp, Artificial Sequence
  Synthetic
cctgtgaguagccagtacagtuc

SEQ ID NO: 13649 - DNA, 21 bp, Artificial Sequence
  Synthetic
ttgcccgaucatttugccaac

SEQ ID NO: 13650 - DNA, 26 bp, Artificial Sequence
  Synthetic
tgtctacuccatttctcucaaaagcc

SEQ ID NO: 13651 - DNA, 27 bp, Artificial Sequence
  Synthetic
gcactactatacuactctcaggtgucc

SEQ ID NO: 13652 - DNA, 23 bp, Artificial Sequence
  Synthetic
ttccucagagaaaucaggagggt

SEQ ID NO: 13653 - DNA, 26 bp, Artificial Sequence
  Synthetic
ggagcaaagutgtaaagtgaguaggt

SEQ ID NO: 13654 - DNA, 28 bp, Artificial Sequence
  Synthetic
gctacatugagaccctgaaaugaacaat

SEQ ID NO: 13655 - DNA, 25 bp, Artificial Sequence
  Synthetic
ctgtggcutttcttgugaagagaga

SEQ ID NO: 13656 - DNA, 21 bp, Artificial Sequence
  Synthetic
gctacgaucggtactgcuagg

SEQ ID NO: 13657 - DNA, 21 bp, Artificial Sequence
  Synthetic
tggcctgccauaacctccuat

SEQ ID NO: 13658 - DNA, 21 bp, Artificial Sequence
  Synthetic
cccaaccutaagugcaccagt

SEQ ID NO: 13659 - DNA, 21 bp, Artificial Sequence
  Synthetic
ctgagtccuttccctcucacc

SEQ ID NO: 13660 - DNA, 23 bp, Artificial Sequence
  Synthetic
ggtagagcutgcaugaccagaac

SEQ ID NO: 13661 - DNA, 25 bp, Artificial Sequence
  Synthetic
tctgguggccagagcttatatttuc

SEQ ID NO: 13662 - DNA, 30 bp, Artificial Sequence
  Synthetic
ggacgttctcguaacttttcattctctuaa

SEQ ID NO: 13663 - DNA, 21 bp, Artificial Sequence
  Synthetic
ctcacacuccctctcggttuc

SEQ ID NO: 13664 - DNA, 23 bp, Artificial Sequence
  Synthetic
gggccaaagagguataactugac

SEQ ID NO: 13665 - DNA, 27 bp, Artificial Sequence
  Synthetic
gctgacaaaaaugcgtctttgcttuat

SEQ ID NO: 13666 - DNA, 26 bp, Artificial Sequence
  Synthetic
ctgttgtctgcugtacagtagtaucc

SEQ ID NO: 13667 - DNA, 18 bp, Artificial Sequence
  Synthetic
gtctgcuccgtggcugaa

SEQ ID NO: 13668 - DNA, 23 bp, Artificial Sequence
  Synthetic
cctcgccauctctgaagaagtug

SEQ ID NO: 13669 - DNA, 27 bp, Artificial Sequence
  Synthetic
tcagaacttgacutacctcttctcuct

SEQ ID NO: 13670 - DNA, 21 bp, Artificial Sequence
  Synthetic
cgtggaatcuccagggagcua

SEQ ID NO: 13671 - DNA, 21 bp, Artificial Sequence
  Synthetic
caggaaacacccucgaggtuc

SEQ ID NO: 13672 - DNA, 23 bp, Artificial Sequence
  Synthetic
cagaaaagagggcutttgcucat

SEQ ID NO: 13673 - DNA, 23 bp, Artificial Sequence
  Synthetic
tctccucagaactccttcuccaa

SEQ ID NO: 13674 - DNA, 20 bp, Artificial Sequence
  Synthetic
cagcccagcuacaggtucaa

SEQ ID NO: 13675 - DNA, 23 bp, Artificial Sequence
  Synthetic
tgaaagcagauttcatccgucct

SEQ ID NO: 13676 - DNA, 21 bp, Artificial Sequence
  Synthetic
gctctagttugggcgttggut

SEQ ID NO: 13677 - DNA, 21 bp, Artificial Sequence
  Synthetic
gagatggcugggatcacucac

SEQ ID NO: 13678 - DNA, 30 bp, Artificial Sequence
  Synthetic
tcttgttccataguttcagaaacctactug

SEQ ID NO: 13679 - DNA, 27 bp, Artificial Sequence
  Synthetic
atggcttaccuctttaacagugaacat

SEQ ID NO: 13680 - DNA, 25 bp, Artificial Sequence
  Synthetic
ggtcctttttgugtggaaagaaugg

SEQ ID NO: 13681 - DNA, 23 bp, Artificial Sequence
  Synthetic
caacaaaagaagucaccgtgugg

SEQ ID NO: 13682 - DNA, 30 bp, Artificial Sequence
  Synthetic
aaacttgagaagcaacuatacaccuagaag

SEQ ID NO: 13683 - DNA, 26 bp, Artificial Sequence
  Synthetic
tgtggtcaagaguaaccaagaatgut

SEQ ID NO: 13684 - DNA, 24 bp, Artificial Sequence
  Synthetic
cttcacaggugattgaagugggaa

SEQ ID NO: 13685 - DNA, 24 bp, Artificial Sequence
  Synthetic
acacaagtgaacugctgggatuac

SEQ ID NO: 13686 - DNA, 24 bp, Artificial Sequence
  Synthetic
ctccaaactutttgatcccugcaa

SEQ ID NO: 13687 - DNA, 23 bp, Artificial Sequence
  Synthetic
gcttcaagagautctggcaaucc

SEQ ID NO: 13688 - DNA, 27 bp, Artificial Sequence
  Synthetic
actgatcaaattgcuctgctagagaug

SEQ ID NO: 13689 - DNA, 20 bp, Artificial Sequence
  Synthetic
aggacaugctggguccaaag

SEQ ID NO: 13690 - DNA, 25 bp, Artificial Sequence
  Synthetic
ggattgagagcugtcaccaacatua

SEQ ID NO: 13691 - DNA, 17 bp, Artificial Sequence
  Synthetic
cacucagccaggcugct

SEQ ID NO: 13692 - DNA, 28 bp, Artificial Sequence
  Synthetic
ggttcatttucaggcaagatcaattcuc

SEQ ID NO: 13693 - DNA, 25 bp, Artificial Sequence
  Synthetic
gaataaattugaagctctggcugct

SEQ ID NO: 13694 - DNA, 28 bp, Artificial Sequence
  Synthetic
acaaatttggccutttaagctagucaga

SEQ ID NO: 13695 - DNA, 25 bp, Artificial Sequence
  Synthetic
catactcaggaugctgttccactua

SEQ ID NO: 13696 - DNA, 21 bp, Artificial Sequence
  Synthetic
gggaugcacaggtatctugct

SEQ ID NO: 13697 - DNA, 29 bp, Artificial Sequence
  Synthetic
ttctgcagguagctgaaggtaaatuaaat

SEQ ID NO: 13698 - DNA, 28 bp, Artificial Sequence
  Synthetic
gtaaagtgactcaugaatacagccuact

SEQ ID NO: 13699 - DNA, 25 bp, Artificial Sequence
  Synthetic
tggtgaacuaaaggtgccaaaugat

SEQ ID NO: 13700 - DNA, 18 bp, Artificial Sequence
  Synthetic
gccgaagugctcgguaca

SEQ ID NO: 13701 - DNA, 22 bp, Artificial Sequence
  Synthetic
ggtgtgaggcugttgatuggat

SEQ ID NO: 13702 - DNA, 22 bp, Artificial Sequence
  Synthetic
augatcugcaagaacccagacc

SEQ ID NO: 13703 - DNA, 25 bp, Artificial Sequence
  Synthetic
gctcaaacttcutccagatgtccuc

SEQ ID NO: 13704 - DNA, 20 bp, Artificial Sequence
  Synthetic
tgctugagaacgagctgugg

SEQ ID NO: 13705 - DNA, 17 bp, Artificial Sequence
  Synthetic
tgcugcagcttcucgct

SEQ ID NO: 13706 - DNA, 21 bp, Artificial Sequence
  Synthetic
cgutcctccuccaacaccaag

SEQ ID NO: 13707 - DNA, 21 bp, Artificial Sequence
  Synthetic
atagttgugctgctgguggat

SEQ ID NO: 13708 - DNA, 25 bp, Artificial Sequence
  Synthetic
gccaagguggtcatttugaaaaagg

SEQ ID NO: 13709 - DNA, 22 bp, Artificial Sequence
  Synthetic
acugtccagtttugagaagcgt

SEQ ID NO: 13710 - DNA, 30 bp, Artificial Sequence
  Synthetic
tacagtgctugaacatgtaatatcucaaat

SEQ ID NO: 13711 - DNA, 30 bp, Artificial Sequence
  Synthetic
tgacgaaucagaagaagauctttuacaaaa

SEQ ID NO: 13712 - DNA, 22 bp, Artificial Sequence
  Synthetic
atcttgaggcuctcctcaucca

SEQ ID NO: 13713 - DNA, 23 bp, Artificial Sequence
  Synthetic
cctaggccuggaatctcctcuat

SEQ ID NO: 13714 - DNA, 31 bp, Artificial Sequence
  Synthetic
ctgcggtaatcaaguttttagaactcttauc

SEQ ID NO: 13715 - DNA, 25 bp, Artificial Sequence
  Synthetic
ctgaaaaaggutaagggctcugact

SEQ ID NO: 13716 - DNA, 24 bp, Artificial Sequence
  Synthetic
tgcagaatugaggcagacttuaca

SEQ ID NO: 13717 - DNA, 32 bp, Artificial Sequence
  Synthetic
aacattaggtagtugatttataccctgauaga

SEQ ID NO: 13718 - DNA, 32 bp, Artificial Sequence
  Synthetic
catttgatccuaatctcagtgaatuaagagaa

SEQ ID NO: 13719 - DNA, 30 bp, Artificial Sequence
  Synthetic
agacaaaagaattautccaacctccaauga

SEQ ID NO: 13720 - DNA, 32 bp, Artificial Sequence
  Synthetic
gcaaattgacttcuttaaatgaagagtauacc

SEQ ID NO: 13721 - DNA, 23 bp, Artificial Sequence
  Synthetic
ccaaaagccaggugacatucaga

SEQ ID NO: 13722 - DNA, 23 bp, Artificial Sequence
  Synthetic
aaattgggtgutttgtgccaugt

SEQ ID NO: 13723 - DNA, 23 bp, Artificial Sequence
  Synthetic
tcttcaagggacuaggagaugca

SEQ ID NO: 13724 - DNA, 27 bp, Artificial Sequence
  Synthetic
acataaattgcugtctcttctcaugct

SEQ ID NO: 13725 - DNA, 22 bp, Artificial Sequence
  Synthetic
ctcaagtuccagggctttcugt

SEQ ID NO: 13726 - DNA, 17 bp, Artificial Sequence
  Synthetic
gcgguagatgcggugct

SEQ ID NO: 13727 - DNA, 20 bp, Artificial Sequence
  Synthetic
ggccttgtuggcatcacuca

SEQ ID NO: 13728 - DNA, 24 bp, Artificial Sequence
  Synthetic
gutcaaaaucaaaggaagcccaga

SEQ ID NO: 13729 - DNA, 26 bp, Artificial Sequence
  Synthetic
caaactgccaautcaagcctctuaat

SEQ ID NO: 13730 - DNA, 25 bp, Artificial Sequence
  Synthetic
agtgatgaaauaagcagtggagugg

SEQ ID NO: 13731 - DNA, 26 bp, Artificial Sequence
  Synthetic
gatgaaatgcuagttgcttgttuggt

SEQ ID NO: 13732 - DNA, 30 bp, Artificial Sequence
  Synthetic
tcagaactttgaucttgtcatctgtuacaa

SEQ ID NO: 13733 - DNA, 23 bp, Artificial Sequence
  Synthetic
gcaccagggaauctgaauaacgg

SEQ ID NO: 13734 - DNA, 24 bp, Artificial Sequence
  Synthetic
gtcagttttcagaugatcgccaut

SEQ ID NO: 13735 - DNA, 21 bp, Artificial Sequence
  Synthetic
ccgggtaucagaccttccuga

SEQ ID NO: 13736 - DNA, 24 bp, Artificial Sequence
  Synthetic
ctgacacagucagcacuacaagat

SEQ ID NO: 13737 - DNA, 25 bp, Artificial Sequence
  Synthetic
cctctctaguagggttccttcagua

SEQ ID NO: 13738 - DNA, 32 bp, Artificial Sequence
  Synthetic
taugaagaaactacauacagcaagaagaagat

SEQ ID NO: 13739 - DNA, 24 bp, Artificial Sequence
  Synthetic
gcagagagaugacctgctuaagga

SEQ ID NO: 13740 - DNA, 23 bp, Artificial Sequence
  Synthetic
cgcaattugccagaagaauacga

SEQ ID NO: 13741 - DNA, 23 bp, Artificial Sequence
  Synthetic
aagutatagaacagucgccgcat

SEQ ID NO: 13742 - DNA, 27 bp, Artificial Sequence
  Synthetic
gacattcuaataggctgugaggaagag

SEQ ID NO: 13743 - DNA, 30 bp, Artificial Sequence
  Synthetic
gtcacaaatgactutctgataacaaaacut

SEQ ID NO: 13744 - DNA, 30 bp, Artificial Sequence
  Synthetic
aacttgctgagacuataaaatgtcguacat

SEQ ID NO: 13745 - DNA, 21 bp, Artificial Sequence
  Synthetic
gcaagagaagugccctcucaa

SEQ ID NO: 13746 - DNA, 22 bp, Artificial Sequence
  Synthetic
tttaagggaaguttgccuggct

SEQ ID NO: 13747 - DNA, 24 bp, Artificial Sequence
  Synthetic
ccacctttgucagaagtcaacuca

SEQ ID NO: 13748 - DNA, 20 bp, Artificial Sequence
  Synthetic
gcgugggctuacagcagaat

SEQ ID NO: 13749 - DNA, 23 bp, Artificial Sequence
  Synthetic
ggtagaaggauacctcctuggct

SEQ ID NO: 13750 - DNA, 22 bp, Artificial Sequence
  Synthetic
cacacacaaucctcagcuaggt

SEQ ID NO: 13751 - DNA, 25 bp, Artificial Sequence
  Synthetic
ctccagttcttuaagctgcagttug

SEQ ID NO: 13752 - DNA, 19 bp, Artificial Sequence
  Synthetic
cccaagccucttgugcaat

SEQ ID NO: 13753 - DNA, 18 bp, Artificial Sequence
  Synthetic
ggcagguacatgcuggct

SEQ ID NO: 13754 - DNA, 19 bp, Artificial Sequence
  Synthetic
gctctucaaggcgccugag

SEQ ID NO: 13755 - DNA, 19 bp, Artificial Sequence
  Synthetic
cgctgccucgtagaacugg

SEQ ID NO: 13756 - DNA, 26 bp, Artificial Sequence
  Synthetic
ttgcctttauccttgagtguaacaca

SEQ ID NO: 13757 - DNA, 31 bp, Artificial Sequence
  Synthetic
tgactacttgaauacatttgagttcauggat

SEQ ID NO: 13758 - DNA, 26 bp, Artificial Sequence
  Synthetic
acaaatcagctacutggtgatgacut

SEQ ID NO: 13759 - DNA, 20 bp, Artificial Sequence
  Synthetic
ccgtcacuaccgcatguacc

SEQ ID NO: 13760 - DNA, 32 bp, Artificial Sequence
  Synthetic
catagggatagggagauacatactctataugc

SEQ ID NO: 13761 - DNA, 22 bp, Artificial Sequence
  Synthetic
ggccuttgtatcugagcaccaa

SEQ ID NO: 13762 - DNA, 27 bp, Artificial Sequence
  Synthetic
acatgcaaaaucacattatugccaaca

SEQ ID NO: 13763 - DNA, 22 bp, Artificial Sequence
  Synthetic
tcaccaaauggcaccauacgaa

SEQ ID NO: 13764 - DNA, 17 bp, Artificial Sequence
  Synthetic
cgggaugccgaugggat

SEQ ID NO: 13765 - DNA, 18 bp, Artificial Sequence
  Synthetic
cccagucccagctugcag

SEQ ID NO: 13766 - DNA, 18 bp, Artificial Sequence
  Synthetic
gtcgaagcgguaggcgua

SEQ ID NO: 13767 - DNA, 19 bp, Artificial Sequence
  Synthetic
gcgagutcaagcucacgga

SEQ ID NO: 13768 - DNA, 30 bp, Artificial Sequence
  Synthetic
gaaaatgacagcauctttgtaaagcttcut

SEQ ID NO: 13769 - DNA, 26 bp, Artificial Sequence
  Synthetic
agaaaacccaugattcagtccugaac

SEQ ID NO: 13770 - DNA, 27 bp, Artificial Sequence
  Synthetic
agcatuaaaacaaggaaagcaaagugg

SEQ ID NO: 13771 - DNA, 28 bp, Artificial Sequence
  Synthetic
caaatgtucacagaaaaagtgacaguct

SEQ ID NO: 13772 - DNA, 21 bp, Artificial Sequence
  Synthetic
cagctctgcauttcacacgua

SEQ ID NO: 13773 - DNA, 22 bp, Artificial Sequence
  Synthetic
gatctcagguaggctggtgaug

SEQ ID NO: 13774 - DNA, 30 bp, Artificial Sequence
  Synthetic
cgtctattagatuggaggatttacctguga

SEQ ID NO: 13775 - DNA, 24 bp, Artificial Sequence
  Synthetic
acagagaagagcaautggcactua

SEQ ID NO: 13776 - DNA, 30 bp, Artificial Sequence
  Synthetic
gtactgatttgtuaactgtttttctgtugt

SEQ ID NO: 13777 - DNA, 28 bp, Artificial Sequence
  Synthetic
cgaatcttatttcutagcaccctgucaa

SEQ ID NO: 13778 - DNA, 22 bp, Artificial Sequence
  Synthetic
gggtgaauccctttagaauggc

SEQ ID NO: 13779 - DNA, 27 bp, Artificial Sequence
  Synthetic
aacactaccaacuctagaaggacauct

SEQ ID NO: 13780 - DNA, 31 bp, Artificial Sequence
  Synthetic
agcattttcatcttucttcatcatctcatug

SEQ ID NO: 13781 - DNA, 25 bp, Artificial Sequence
  Synthetic
acagaagtcagaauctccacgtgua

SEQ ID NO: 13782 - DNA, 24 bp, Artificial Sequence
  Synthetic
tctagtggtttuccctgtagccut

SEQ ID NO: 13783 - DNA, 19 bp, Artificial Sequence
  Synthetic
cggcaggagguttauggca

SEQ ID NO: 13784 - DNA, 22 bp, Artificial Sequence
  Synthetic
ctccaggutttattggctugca

SEQ ID NO: 13785 - DNA, 27 bp, Artificial Sequence
  Synthetic
agagaacacatgaaugaacgctcttua

SEQ ID NO: 13786 - DNA, 25 bp, Artificial Sequence
  Synthetic
ccctcctctuggaaactttgatgug

SEQ ID NO: 13787 - DNA, 31 bp, Artificial Sequence
  Synthetic
cutattuagagacacaagauaagaggaaaag

SEQ ID NO: 13788 - DNA, 29 bp, Artificial Sequence
  Synthetic
tggacattgaggucttctctattcuacat

SEQ ID NO: 13789 - DNA, 24 bp, Artificial Sequence
  Synthetic
cctcagtgucacagtgttcttugt

SEQ ID NO: 13790 - DNA, 27 bp, Artificial Sequence
  Synthetic
gctgctaagcaaauatgaggtttcaut

SEQ ID NO: 13791 - DNA, 27 bp, Artificial Sequence
  Synthetic
gaagacattaugtggtactccugaact

SEQ ID NO: 13792 - DNA, 29 bp, Artificial Sequence
  Synthetic
gctctttatctcaucagacttttgauggt

SEQ ID NO: 13793 - DNA, 24 bp, Artificial Sequence
  Synthetic
gaagcccaaaguttgtaagtguga

SEQ ID NO: 13794 - DNA, 22 bp, Artificial Sequence
  Synthetic
cgcatgctttucccgtcttcua

SEQ ID NO: 13795 - DNA, 28 bp, Artificial Sequence
  Synthetic
ccaaagtccactucttgaagtgactaut

SEQ ID NO: 13796 - DNA, 26 bp, Artificial Sequence
  Synthetic
cagagtttatccuctttggagcttut

SEQ ID NO: 13797 - DNA, 21 bp, Artificial Sequence
  Synthetic
aatgcccacacaggugaugaa

SEQ ID NO: 13798 - DNA, 24 bp, Artificial Sequence
  Synthetic
caccattttcutggtccatucaca

SEQ ID NO: 13799 - DNA, 20 bp, Artificial Sequence
  Synthetic
atgcaaccaucagugccaga

SEQ ID NO: 13800 - DNA, 30 bp, Artificial Sequence
  Synthetic
gagcaagatagugatgagagttatgaugac

SEQ ID NO: 13801 - DNA, 25 bp, Artificial Sequence
  Synthetic
ggaucctaccaguaagaaaggcaaa

SEQ ID NO: 13802 - DNA, 30 bp, Artificial Sequence
  Synthetic
caaagagattuggaaaaatgagtaacauga

SEQ ID NO: 13803 - DNA, 31 bp, Artificial Sequence
  Synthetic
cataggtagaaauactggctaaatccucaaa

SEQ ID NO: 13804 - DNA, 26 bp, Artificial Sequence
  Synthetic
tccccttgggautagtatctatcuct

SEQ ID NO: 13805 - DNA, 30 bp, Artificial Sequence
  Synthetic
acaatttactcucccatgtaccattctuac

SEQ ID NO: 13806 - DNA, 28 bp, Artificial Sequence
  Synthetic
cttgtgtcttcugctgtttgtttaucag

SEQ ID NO: 13807 - DNA, 26 bp, Artificial Sequence
  Synthetic
gttatcgacauaccgacuaacagcat

SEQ ID NO: 13808 - DNA, 25 bp, Artificial Sequence
  Synthetic
ctttttctcccccucccactatcua

SEQ ID NO: 13809 - DNA, 21 bp, Artificial Sequence
  Synthetic
cctcgugcaggaagtgaacut

SEQ ID NO: 13810 - DNA, 23 bp, Artificial Sequence
  Synthetic
ggccattgucacagaggauaaga

SEQ ID NO: 13811 - DNA, 23 bp, Artificial Sequence
  Synthetic
cctttgttguatcccccuccaag

SEQ ID NO: 13812 - DNA, 30 bp, Artificial Sequence
  Synthetic
gggttggtaggautctattacttacctgut

SEQ ID NO: 13813 - DNA, 28 bp, Artificial Sequence
  Synthetic
ttgagaaggtauaacttggtttgaugct

SEQ ID NO: 13814 - DNA, 25 bp, Artificial Sequence
  Synthetic
cccaaagaaggacutgctgaauaca

SEQ ID NO: 13815 - DNA, 29 bp, Artificial Sequence
  Synthetic
ccggctggaaautttatttgaagaauaca

SEQ ID NO: 13816 - DNA, 22 bp, Artificial Sequence
  Synthetic
ggacaccagugtatgtugggat

SEQ ID NO: 13817 - DNA, 22 bp, Artificial Sequence
  Synthetic
gtgugagcgcaaggctttauag

SEQ ID NO: 13818 - DNA, 21 bp, Artificial Sequence
  Synthetic
cagccctucagtgaagtcucc

SEQ ID NO: 13819 - DNA, 24 bp, Artificial Sequence
  Synthetic
agaagagcaagguataaggguaca

SEQ ID NO: 13820 - DNA, 22 bp, Artificial Sequence
  Synthetic
tggtttgctuctctctcctucc

SEQ ID NO: 13821 - DNA, 31 bp, Artificial Sequence
  Synthetic
gccaaaatcatauaagcaaggaaaugaacac

SEQ ID NO: 13822 - DNA, 27 bp, Artificial Sequence
  Synthetic
cttttaaataggacucccaggagagug

SEQ ID NO: 13823 - DNA, 26 bp, Artificial Sequence
  Synthetic
caagaacctcaccuttttacctgaug

SEQ ID NO: 13824 - DNA, 28 bp, Artificial Sequence
  Synthetic
gttttgttttccautttctcctccaucc

SEQ ID NO: 13825 - DNA, 18 bp, Artificial Sequence
  Synthetic
gugcaccaggagcacuca

SEQ ID NO: 13826 - DNA, 30 bp, Artificial Sequence
  Synthetic
gatttatcctgtuggtctagttcttgttug

SEQ ID NO: 13827 - DNA, 20 bp, Artificial Sequence
  Synthetic
ctgtccgucgtgacacugag

SEQ ID NO: 13828 - DNA, 31 bp, Artificial Sequence
  Synthetic
caggattagtagtuaatgcacgtatttgtut

SEQ ID NO: 13829 - DNA, 21 bp, Artificial Sequence
  Synthetic
ccttttuccagcggagaacug

SEQ ID NO: 13830 - DNA, 25 bp, Artificial Sequence
  Synthetic
ctctatcuccaacctcggagaugat

SEQ ID NO: 13831 - DNA, 26 bp, Artificial Sequence
  Synthetic
gcctattccaggcaauaatgaaaguc

SEQ ID NO: 13832 - DNA, 25 bp, Artificial Sequence
  Synthetic
gggatgacagauttcatgcttucct

SEQ ID NO: 13833 - DNA, 20 bp, Artificial Sequence
  Synthetic
gaggtcuccaggagtgggua

SEQ ID NO: 13834 - DNA, 24 bp, Artificial Sequence
  Synthetic
ctcttuccagaaaaacccaacucc

SEQ ID NO: 13835 - DNA, 20 bp, Artificial Sequence
  Synthetic
agugaggaccauccgtgtua

SEQ ID NO: 13836 - DNA, 24 bp, Artificial Sequence
  Synthetic
gttcgtctgucatccagttcaugt

SEQ ID NO: 13837 - DNA, 20 bp, Artificial Sequence
  Synthetic
cagctccagguctccaaguc

SEQ ID NO: 13838 - DNA, 18 bp, Artificial Sequence
  Synthetic
ccaggcccagcuacctuc

SEQ ID NO: 13839 - DNA, 23 bp, Artificial Sequence
  Synthetic
ttgggctctucatgaaactccuc

SEQ ID NO: 13840 - DNA, 21 bp, Artificial Sequence
  Synthetic
cacagccagugccagaacuaa

SEQ ID NO: 13841 - DNA, 23 bp, Artificial Sequence
  Synthetic
ggucccgggattattuccagaat

SEQ ID NO: 13842 - DNA, 25 bp, Artificial Sequence
  Synthetic
tgttttctttuccctccatggcuat

SEQ ID NO: 13843 - DNA, 21 bp, Artificial Sequence
  Synthetic
gtttggacauggcaagcucag

SEQ ID NO: 13844 - DNA, 27 bp, Artificial Sequence
  Synthetic
agaccatgagtcuctttttaggttgug

SEQ ID NO: 13845 - DNA, 27 bp, Artificial Sequence
  Synthetic
ccatcaagcccaagauttcctcatuat

SEQ ID NO: 13846 - DNA, 28 bp, Artificial Sequence
  Synthetic
aataagcttctguatgtttgggaaauga

SEQ ID NO: 13847 - DNA, 24 bp, Artificial Sequence
  Synthetic
tgtcctttttcugcctctcttugg

SEQ ID NO: 13848 - DNA, 26 bp, Artificial Sequence
  Synthetic
cuatatccgaaagtugcaacgagaac

SEQ ID NO: 13849 - DNA, 26 bp, Artificial Sequence
  Synthetic
tgtcttgaagucggtaaaaagcagua

SEQ ID NO: 13850 - DNA, 25 bp, Artificial Sequence
  Synthetic
aaaatgggauccaaacuggaagaca

SEQ ID NO: 13851 - DNA, 22 bp, Artificial Sequence
  Synthetic
aggattcgcuaacaagtgugct

SEQ ID NO: 13852 - DNA, 24 bp, Artificial Sequence
  Synthetic
tcatggtcaaaauctggactgugg

SEQ ID NO: 13853 - DNA, 23 bp, Artificial Sequence
  Synthetic
ccctcacugaacctctgcataut

SEQ ID NO: 13854 - DNA, 21 bp, Artificial Sequence
  Synthetic
gcagccaaagccuctacgtua

SEQ ID NO: 13855 - DNA, 25 bp, Artificial Sequence
  Synthetic
cacaagtgtuttgtgcgaguagaaa

SEQ ID NO: 13856 - DNA, 28 bp, Artificial Sequence
  Synthetic
tgcttgcatacuaaacggtttttaaauc

SEQ ID NO: 13857 - DNA, 28 bp, Artificial Sequence
  Synthetic
gcagaaccaagaautttauaagaacgca

SEQ ID NO: 13858 - DNA, 22 bp, Artificial Sequence
  Synthetic
ccaaagtaggcuggtcctccut

SEQ ID NO: 13859 - DNA, 20 bp, Artificial Sequence
  Synthetic
gatgacccaccugcatguga

SEQ ID NO: 13860 - DNA, 27 bp, Artificial Sequence
  Synthetic
aaaaggcattttaugagcaaagcauga

SEQ ID NO: 13861 - DNA, 22 bp, Artificial Sequence
  Synthetic
cccccauagccatcctctcuat

SEQ ID NO: 13862 - DNA, 25 bp, Artificial Sequence
  Synthetic
ctatgccutctgtaaaaucaacgca

SEQ ID NO: 13863 - DNA, 21 bp, Artificial Sequence
  Synthetic
ctacccagcagutggctttuc

SEQ ID NO: 13864 - DNA, 24 bp, Artificial Sequence
  Synthetic
gggagtgauaacttgaggtgucat

SEQ ID NO: 13865 - DNA, 22 bp, Artificial Sequence
  Synthetic
gtcaactctutaagcaggcuga

SEQ ID NO: 13866 - DNA, 20 bp, Artificial Sequence
  Synthetic
gaccugcaggactuccaact

SEQ ID NO: 13867 - DNA, 23 bp, Artificial Sequence
  Synthetic
gcgatcagugttttgtgtucacc

SEQ ID NO: 13868 - DNA, 21 bp, Artificial Sequence
  Synthetic
tcgacgtccauctgttcccua

SEQ ID NO: 13869 - DNA, 19 bp, Artificial Sequence
  Synthetic
ctggacacauggcaccugt

SEQ ID NO: 13870 - DNA, 24 bp, Artificial Sequence
  Synthetic
acattgugcagcttgtaguagagg

SEQ ID NO: 13871 - DNA, 17 bp, Artificial Sequence
  Synthetic
ctgcugacgctgcctug

SEQ ID NO: 13872 - DNA, 18 bp, Artificial Sequence
  Synthetic
gtccgcugctgtagucgt

SEQ ID NO: 13873 - DNA, 19 bp, Artificial Sequence
  Synthetic
aaggacggcgucaaguacc

SEQ ID NO: 13874 - DNA, 19 bp, Artificial Sequence
  Synthetic
gcaguggcgtctuggagaa

SEQ ID NO: 13875 - DNA, 18 bp, Artificial Sequence
  Synthetic
cugaccggaggccagaug

SEQ ID NO: 13876 - DNA, 20 bp, Artificial Sequence
  Synthetic
gcgggtuccatgtagttgug

SEQ ID NO: 13877 - DNA, 18 bp, Artificial Sequence
  Synthetic
cugcacccagacccugag

SEQ ID NO: 13878 - DNA, 18 bp, Artificial Sequence
  Synthetic
gctcugcacgcgtgtgua

SEQ ID NO: 13879 - DNA, 20 bp, Artificial Sequence
  Synthetic
cctatgccucctgccagaug

SEQ ID NO: 13880 - DNA, 20 bp, Artificial Sequence
  Synthetic
ggtccagcguccagtagtug

SEQ ID NO: 13881 - DNA, 23 bp, Artificial Sequence
  Synthetic
cgaagtucccgttcuacgagaag

SEQ ID NO: 13882 - DNA, 17 bp, Artificial Sequence
  Synthetic
ggccctuctggctccut

SEQ ID NO: 13883 - DNA, 18 bp, Artificial Sequence
  Synthetic
gtgcgccccaacucttug

SEQ ID NO: 13884 - DNA, 23 bp, Artificial Sequence
  Synthetic
gttttcttttcugcgctctuccc

SEQ ID NO: 13885 - DNA, 20 bp, Artificial Sequence
  Synthetic
gaactcgguggagcccauac

SEQ ID NO: 13886 - DNA, 24 bp, Artificial Sequence
  Synthetic
tgatatttgcagcuggagaaugct

SEQ ID NO: 13887 - DNA, 22 bp, Artificial Sequence
  Synthetic
gaacagtuccctcactctucgg

SEQ ID NO: 13888 - DNA, 27 bp, Artificial Sequence
  Synthetic
tggcaagcutgtgtttcuaaaacaaaa

SEQ ID NO: 13889 - DNA, 21 bp, Artificial Sequence
  Synthetic
gtgccacaaccutgaauccat

SEQ ID NO: 13890 - DNA, 22 bp, Artificial Sequence
  Synthetic
cgugcagaacagagaactugag

SEQ ID NO: 13891 - DNA, 27 bp, Artificial Sequence
  Synthetic
taaaactgtagaacauttaagggcugt

SEQ ID NO: 13892 - DNA, 25 bp, Artificial Sequence
  Synthetic
accaatttaaaacgcutctccccut

SEQ ID NO: 13893 - DNA, 29 bp, Artificial Sequence
  Synthetic
gacttgtggtcauatttaacgttttgcua

SEQ ID NO: 13894 - DNA, 24 bp, Artificial Sequence
  Synthetic
gcaaagcugaactcaucaaaaccc

SEQ ID NO: 13895 - DNA, 25 bp, Artificial Sequence
  Synthetic
gaggagggaagaauggaagacttuc

SEQ ID NO: 13896 - DNA, 23 bp, Artificial Sequence
  Synthetic
gcctcttuggtttttcucagcca

SEQ ID NO: 13897 - DNA, 25 bp, Artificial Sequence
  Synthetic
gutttaatuggcaguaagaaggcat

SEQ ID NO: 13898 - DNA, 30 bp, Artificial Sequence
  Synthetic
agtgccttgctuctcatactaaaatguaat

SEQ ID NO: 13899 - DNA, 22 bp, Artificial Sequence
  Synthetic
aaagtacugagcacccctgtug

SEQ ID NO: 13900 - DNA, 17 bp, Artificial Sequence
  Synthetic
gtgaggcgucgtccgua

SEQ ID NO: 13901 - DNA, 23 bp, Artificial Sequence
  Synthetic
cucccgtaacucacgagaagaag

SEQ ID NO: 13902 - DNA, 30 bp, Artificial Sequence
  Synthetic
ttttagctgtttuggaagatgtattugcat

SEQ ID NO: 13903 - DNA, 28 bp, Artificial Sequence
  Synthetic
ctcatatttgacaccauttggtccatug

SEQ ID NO: 13904 - DNA, 28 bp, Artificial Sequence
  Synthetic
gagagattcugacagtggacuagaaaaa

SEQ ID NO: 13905 - DNA, 26 bp, Artificial Sequence
  Synthetic
catattgaugaactcctggtugacct

SEQ ID NO: 13906 - DNA, 26 bp, Artificial Sequence
  Synthetic
ggcucatctgugaaaagcaacaaaaa

SEQ ID NO: 13907 - DNA, 28 bp, Artificial Sequence
  Synthetic
acattcagataucagaagaaagtugcca

SEQ ID NO: 13908 - DNA, 27 bp, Artificial Sequence
  Synthetic
accatgatgctguactatgggaaaauc

SEQ ID NO: 13909 - DNA, 27 bp, Artificial Sequence
  Synthetic
ttcacagauagcctcaaaaugaggaaa

SEQ ID NO: 13910 - DNA, 26 bp, Artificial Sequence
  Synthetic
ttcttcatcauccagcaagtcugaat

SEQ ID NO: 13911 - DNA, 29 bp, Artificial Sequence
  Synthetic
aactgttgtugggaagacataauaaagga

SEQ ID NO: 13912 - DNA, 28 bp, Artificial Sequence
  Synthetic
acacaatttattacguaccggacatgut

SEQ ID NO: 13913 - DNA, 26 bp, Artificial Sequence
  Synthetic
agcauatcttctaactugcaaaggca

SEQ ID NO: 13914 - DNA, 23 bp, Artificial Sequence
  Synthetic
cgcccugaagttgaacauagagg

SEQ ID NO: 13915 - DNA, 21 bp, Artificial Sequence
  Synthetic
ccaaacgcutcatggtctugt

SEQ ID NO: 13916 - DNA, 21 bp, Artificial Sequence
  Synthetic
cccactggcuctactccuact

SEQ ID NO: 13917 - DNA, 21 bp, Artificial Sequence
  Synthetic
gtcccccuttgatcucaccac

SEQ ID NO: 13918 - DNA, 21 bp, Artificial Sequence
  Synthetic
ccgcagtcugctcctcuaaag

SEQ ID NO: 13919 - DNA, 31 bp, Artificial Sequence
  Synthetic
tggaaagtgacautgaaagtgauaaagagaa

SEQ ID NO: 13920 - DNA, 28 bp, Artificial Sequence
  Synthetic
gtttgtctgtucagtacttgatagucct

SEQ ID NO: 13921 - DNA, 23 bp, Artificial Sequence
  Synthetic
gcatcctgcuggtcttaccttuc

SEQ ID NO: 13922 - DNA, 24 bp, Artificial Sequence
  Synthetic
gagggctggagugttgaaaactua

SEQ ID NO: 13923 - DNA, 20 bp, Artificial Sequence
  Synthetic
caacctucagcggcacatuc

SEQ ID NO: 13924 - DNA, 24 bp, Artificial Sequence
  Synthetic
caaautttccatcugcacaaagcc

SEQ ID NO: 13925 - DNA, 27 bp, Artificial Sequence
  Synthetic
gaaagcgagaaugatctccaagagaua

SEQ ID NO: 13926 - DNA, 22 bp, Artificial Sequence
  Synthetic
caagggtcuactgcagctuact

SEQ ID NO: 13927 - DNA, 24 bp, Artificial Sequence
  Synthetic
aagtacattagautcgctggcugt

SEQ ID NO: 13928 - DNA, 21 bp, Artificial Sequence
  Synthetic
cuctcccacauaaggcccaaa

SEQ ID NO: 13929 - DNA, 22 bp, Artificial Sequence
  Synthetic
ggagggutctcctuacaaagcc

SEQ ID NO: 13930 - DNA, 28 bp, Artificial Sequence
  Synthetic
gcaatgaaaugaggagtattgtctucgt

SEQ ID NO: 13931 - DNA, 21 bp, Artificial Sequence
  Synthetic
cccaaaggaaugggtggtcuc

SEQ ID NO: 13932 - DNA, 28 bp, Artificial Sequence
  Synthetic
gaaatttcctttgutaacatgtctgugt

SEQ ID NO: 13933 - DNA, 21 bp, Artificial Sequence
  Synthetic
ctcaaggucagccaagaugct

SEQ ID NO: 13934 - DNA, 24 bp, Artificial Sequence
  Synthetic
aaguctacatugaaaccacagcct

SEQ ID NO: 13935 - DNA, 21 bp, Artificial Sequence
  Synthetic
ggctgactucacctgcacaut

SEQ ID NO: 13936 - DNA, 20 bp, Artificial Sequence
  Synthetic
ggtacacucctccuggagca

SEQ ID NO: 13937 - DNA, 24 bp, Artificial Sequence
  Synthetic
acccctgtatuctcctccttaugt

SEQ ID NO: 13938 - DNA, 21 bp, Artificial Sequence
  Synthetic
gccatggaucaggtctuccac

SEQ ID NO: 13939 - DNA, 24 bp, Artificial Sequence
  Synthetic
gcaaagtgcutgaggaacaaauct

SEQ ID NO: 13940 - DNA, 22 bp, Artificial Sequence
  Synthetic
ccaggaggagacugtccgtaut

SEQ ID NO: 13941 - DNA, 25 bp, Artificial Sequence
  Synthetic
gccgttcugagatttagtaatugct

SEQ ID NO: 13942 - DNA, 18 bp, Artificial Sequence
  Synthetic
gcugaatgccucccacga

SEQ ID NO: 13943 - DNA, 21 bp, Artificial Sequence
  Synthetic
gcactcggcucctttctguag

SEQ ID NO: 13944 - DNA, 17 bp, Artificial Sequence
  Synthetic
tgccuccgctcacucac

SEQ ID NO: 13945 - DNA, 18 bp, Artificial Sequence
  Synthetic
cagcacguccagcgtgua

SEQ ID NO: 13946 - DNA, 19 bp, Artificial Sequence
  Synthetic
ctgagccggguctcttguc

SEQ ID NO: 13947 - DNA, 21 bp, Artificial Sequence
  Synthetic
acgcctaugaaattgguggct

SEQ ID NO: 13948 - DNA, 20 bp, Artificial Sequence
  Synthetic
cctcaacgcccaugtcttug

SEQ ID NO: 13949 - DNA, 18 bp, Artificial Sequence
  Synthetic
agcccaggccuttctugg

SEQ ID NO: 13950 - DNA, 19 bp, Artificial Sequence
  Synthetic
gctgagagugggcgagtut

SEQ ID NO: 13951 - DNA, 20 bp, Artificial Sequence
  Synthetic
gtccttgucaatgccgaugg

SEQ ID NO: 13952 - DNA, 19 bp, Artificial Sequence
  Synthetic
gggtaaccugcgggagtut

SEQ ID NO: 13953 - DNA, 21 bp, Artificial Sequence
  Synthetic
cttcugggaggccaagtacuc

SEQ ID NO: 13954 - DNA, 18 bp, Artificial Sequence
  Synthetic
cctucccacacccuccca

SEQ ID NO: 13955 - DNA, 18 bp, Artificial Sequence
  Synthetic
cctggctcugcccagtuc

SEQ ID NO: 13956 - DNA, 19 bp, Artificial Sequence
  Synthetic
ctgcccgcagguacaugat

SEQ ID NO: 13957 - DNA, 18 bp, Artificial Sequence
  Synthetic
agagccagcacucacguc

SEQ ID NO: 13958 - DNA, 21 bp, Artificial Sequence
  Synthetic
tgggattggaguctcgagcut

SEQ ID NO: 13959 - DNA, 17 bp, Artificial Sequence
  Synthetic
cacuaggcgcucgacct

SEQ ID NO: 13960 - DNA, 27 bp, Artificial Sequence
  Synthetic
agaaagtgacugagaccgaagatgaua

SEQ ID NO: 13961 - DNA, 25 bp, Artificial Sequence
  Synthetic
ggcacactcuccttactatauagca

SEQ ID NO: 13962 - DNA, 26 bp, Artificial Sequence
  Synthetic
ttgatgctgcauaaaaatagagcuga

SEQ ID NO: 13963 - DNA, 26 bp, Artificial Sequence
  Synthetic
aagtcccattcguatcctcttttgut

SEQ ID NO: 13964 - DNA, 31 bp, Artificial Sequence
  Synthetic
catctaaagtccatuatgtttgagtgttcug

SEQ ID NO: 13965 - DNA, 26 bp, Artificial Sequence
  Synthetic
agaaggaggagaaguaaactcagcut

SEQ ID NO: 13966 - DNA, 30 bp, Artificial Sequence
  Synthetic
taagcatctaatuaggtgaaactgaatuga

SEQ ID NO: 13967 - DNA, 29 bp, Artificial Sequence
  Synthetic
ctaaacctgtatgutgctgttctcattug

SEQ ID NO: 13968 - DNA, 28 bp, Artificial Sequence
  Synthetic
cccagagaaauttagtgataugcagcaa

SEQ ID NO: 13969 - DNA, 26 bp, Artificial Sequence
  Synthetic
tgttggtauaagagatggagguggag

SEQ ID NO: 13970 - DNA, 23 bp, Artificial Sequence
  Synthetic
catgacacauttttggugggcat

SEQ ID NO: 13971 - DNA, 21 bp, Artificial Sequence
  Synthetic
gctggtguccacaagacuagg

SEQ ID NO: 13972 - DNA, 26 bp, Artificial Sequence
  Synthetic
ggactgcagaucacatctctttuaca

SEQ ID NO: 13973 - DNA, 25 bp, Artificial Sequence
  Synthetic
tcgttcttctutttctcgactugct

SEQ ID NO: 13974 - DNA, 18 bp, Artificial Sequence
  Synthetic
gcugcactugggcgagag

SEQ ID NO: 13975 - DNA, 19 bp, Artificial Sequence
  Synthetic
ggtgucccacctgtcugga

SEQ ID NO: 13976 - DNA, 31 bp, Artificial Sequence
  Synthetic
gatgaaacgaaugagaataagcagaaugaat

SEQ ID NO: 13977 - DNA, 23 bp, Artificial Sequence
  Synthetic
cacugcagaaagucaagcattua

SEQ ID NO: 13978 - DNA, 28 bp, Artificial Sequence
  Synthetic
caaagtaagcugtacacattugaggaga

SEQ ID NO: 13979 - DNA, 23 bp, Artificial Sequence
  Synthetic
tcactgtgaautcttcccctucc

SEQ ID NO: 13980 - DNA, 32 bp, Artificial Sequence
  Synthetic
ttttgtccagtagtugtagataatggtttcut

SEQ ID NO: 13981 - DNA, 31 bp, Artificial Sequence
  Synthetic
caacaatcaaatcuacattttctccatcgut

SEQ ID NO: 13982 - DNA, 23 bp, Artificial Sequence
  Synthetic
gaaggaggcacutacacatucct

SEQ ID NO: 13983 - DNA, 26 bp, Artificial Sequence
  Synthetic
catagtacacaagutgagtcctugca

SEQ ID NO: 13984 - DNA, 31 bp, Artificial Sequence
  Synthetic
ttctatagautctagtgcatucaagcacaat

SEQ ID NO: 13985 - DNA, 28 bp, Artificial Sequence
  Synthetic
ctgatatgguagacagagcctaaacauc

SEQ ID NO: 13986 - DNA, 22 bp, Artificial Sequence
  Synthetic
gcaccaucaccacttacctugt

SEQ ID NO: 13987 - DNA, 25 bp, Artificial Sequence
  Synthetic
gcatgcaguaccatacaggaactua

SEQ ID NO: 13988 - DNA, 22 bp, Artificial Sequence
  Synthetic
cccttctacaugtcccactuga

SEQ ID NO: 13989 - DNA, 25 bp, Artificial Sequence
  Synthetic
ggttgcttgauaggtaggtacucac

SEQ ID NO: 13990 - DNA, 25 bp, Artificial Sequence
  Synthetic
ctcatggtcggaucacaaagattug

SEQ ID NO: 13991 - DNA, 27 bp, Artificial Sequence
  Synthetic
gaaactaaaaatccuttgcaggacugt

SEQ ID NO: 13992 - DNA, 22 bp, Artificial Sequence
  Synthetic
ctggaaugccggtcgattcuaa

SEQ ID NO: 13993 - DNA, 22 bp, Artificial Sequence
  Synthetic
cctcaacatcugggtttctguc

SEQ ID NO: 13994 - DNA, 27 bp, Artificial Sequence
  Synthetic
agatttactccaacutagcaaacugca

SEQ ID NO: 13995 - DNA, 22 bp, Artificial Sequence
  Synthetic
gggugacccaaacactgatuct

SEQ ID NO: 13996 - DNA, 21 bp, Artificial Sequence
  Synthetic
gctaccgguttgcacuccaat

SEQ ID NO: 13997 - DNA, 23 bp, Artificial Sequence
  Synthetic
auctgaaggcucaaaccagacaa

SEQ ID NO: 13998 - DNA, 28 bp, Artificial Sequence
  Synthetic
tctggttcttcuaacgggatatctucaa

SEQ ID NO: 13999 - DNA, 21 bp, Artificial Sequence
  Synthetic
aggtagccgauctgcagucaa

SEQ ID NO: 14000 - DNA, 32 bp, Artificial Sequence
  Synthetic
agaaagagaauacaggaauacttcttaaaguc

SEQ ID NO: 14001 - DNA, 27 bp, Artificial Sequence
  Synthetic
aatcaaagaatgtcucctccctgttut

SEQ ID NO: 14002 - DNA, 28 bp, Artificial Sequence
  Synthetic
caaacctgtgauctgaaaagatagcuga

SEQ ID NO: 14003 - DNA, 21 bp, Artificial Sequence
  Synthetic
catcctccugcctcttuggac

SEQ ID NO: 14004 - DNA, 23 bp, Artificial Sequence
  Synthetic
ttgactgcuttcccucaaacact

SEQ ID NO: 14005 - DNA, 22 bp, Artificial Sequence
  Synthetic
gcatcgagcuctcatgtcugaa

SEQ ID NO: 14006 - DNA, 24 bp, Artificial Sequence
  Synthetic
gttcacaaugttcatccaauggga

SEQ ID NO: 14007 - DNA, 26 bp, Artificial Sequence
  Synthetic
tgaggctccaauaaacagcaauaaca

SEQ ID NO: 14008 - DNA, 21 bp, Artificial Sequence
  Synthetic
tcccugggaaagttcugcaac

SEQ ID NO: 14009 - DNA, 25 bp, Artificial Sequence
  Synthetic
cctggagaaucagacgacaagtaut

SEQ ID NO: 14010 - DNA, 32 bp, Artificial Sequence
  Synthetic
catgatcaaaatgucatttgtgctatuagaga

SEQ ID NO: 14011 - DNA, 23 bp, Artificial Sequence
  Synthetic
gcactgcagacagauctacgtut

SEQ ID NO: 14012 - DNA, 32 bp, Artificial Sequence
  Synthetic
ccttccatuaaagagagagagattttuaaaut

SEQ ID NO: 14013 - DNA, 21 bp, Artificial Sequence
  Synthetic
gcugtctcagugacaaaccca

SEQ ID NO: 14014 - DNA, 27 bp, Artificial Sequence
  Synthetic
gatgacagtguaatttcctgtgtcuct

SEQ ID NO: 14015 - DNA, 22 bp, Artificial Sequence
  Synthetic
agcatcauttcgtgugagagca

SEQ ID NO: 14016 - DNA, 22 bp, Artificial Sequence
  Synthetic
tcactccgggutacaccatcua

SEQ ID NO: 14017 - DNA, 29 bp, Artificial Sequence
  Synthetic
agttattgggtaaugttatatgctgugct

SEQ ID NO: 14018 - DNA, 21 bp, Artificial Sequence
  Synthetic
gaccaugccagcatagcugat

SEQ ID NO: 14019 - DNA, 28 bp, Artificial Sequence
  Synthetic
tcattgtacatggcuctcatttttggua

SEQ ID NO: 14020 - DNA, 27 bp, Artificial Sequence
  Synthetic
gtcatttccgaucacttttggaatugt

SEQ ID NO: 14021 - DNA, 27 bp, Artificial Sequence
  Synthetic
ggcacttcatautaatacctcccugaa

SEQ ID NO: 14022 - DNA, 19 bp, Artificial Sequence
  Synthetic
agagugggctcctuaccca

SEQ ID NO: 14023 - DNA, 18 bp, Artificial Sequence
  Synthetic
tccgcgccuccttctcua

SEQ ID NO: 14024 - DNA, 27 bp, Artificial Sequence
  Synthetic
aatgtggtactttuccccctactttut

SEQ ID NO: 14025 - DNA, 25 bp, Artificial Sequence
  Synthetic
aaacctcuggaggaagtgctaaaut

SEQ ID NO: 14026 - DNA, 25 bp, Artificial Sequence
  Synthetic
caagacutagtgcaaugcaagacag

SEQ ID NO: 14027 - DNA, 28 bp, Artificial Sequence
  Synthetic
tttgacacccccauaatattttuccaga

SEQ ID NO: 14028 - DNA, 29 bp, Artificial Sequence
  Synthetic
ttttcaagtcccauagttttacagtucca

SEQ ID NO: 14029 - DNA, 31 bp, Artificial Sequence
  Synthetic
gtaactaactcauagccattatttcuaacca

SEQ ID NO: 14030 - DNA, 30 bp, Artificial Sequence
  Synthetic
tgagtaaaacaaccutatgattcaucagga

SEQ ID NO: 14031 - DNA, 30 bp, Artificial Sequence
  Synthetic
gagggttgttaguggagcatatgatttuat

SEQ ID NO: 14032 - DNA, 23 bp, Artificial Sequence
  Synthetic
attctccaguctctgcatuccac

SEQ ID NO: 14033 - DNA, 30 bp, Artificial Sequence
  Synthetic
tctacccaaaaguaatcatcttaagtgtut

SEQ ID NO: 14034 - DNA, 25 bp, Artificial Sequence
  Synthetic
cgcctccagutagtatcaattcugt

SEQ ID NO: 14035 - DNA, 30 bp, Artificial Sequence
  Synthetic
tgtataactgutattattggugaaggcaat

SEQ ID NO: 14036 - DNA, 28 bp, Artificial Sequence
  Synthetic
gggttctatcacutgcatcatatgttut

SEQ ID NO: 14037 - DNA, 31 bp, Artificial Sequence
  Synthetic
gtgagttttccttuataagcctgtaattugg

SEQ ID NO: 14038 - DNA, 27 bp, Artificial Sequence
  Synthetic
tgtatttttccccutcagtgattcugt

SEQ ID NO: 14039 - DNA, 25 bp, Artificial Sequence
  Synthetic
ctaatcttccutttctgacgugcct

SEQ ID NO: 14040 - DNA, 20 bp, Artificial Sequence
  Synthetic
ggcctugggcaatgatgcua

SEQ ID NO: 14041 - DNA, 29 bp, Artificial Sequence
  Synthetic
gagtattcgucaaccaagaggagtttuaa

SEQ ID NO: 14042 - DNA, 21 bp, Artificial Sequence
  Synthetic
cactctccuggtccatcucct

SEQ ID NO: 14043 - DNA, 21 bp, Artificial Sequence
  Synthetic
tggaggccaaaaugatuccca

SEQ ID NO: 14044 - DNA, 24 bp, Artificial Sequence
  Synthetic
agcatggacutccaaaugagacaa

SEQ ID NO: 14045 - DNA, 27 bp, Artificial Sequence
  Synthetic
ctccccatuaattctactguggaagat

SEQ ID NO: 14046 - DNA, 27 bp, Artificial Sequence
  Synthetic
gatcgagttuccagaacctcaacatua

SEQ ID NO: 14047 - DNA, 24 bp, Artificial Sequence
  Synthetic
gugtccctttttauaggaggagca

SEQ ID NO: 14048 - DNA, 25 bp, Artificial Sequence
  Synthetic
accaggtgguaacttgttttaccut

SEQ ID NO: 14049 - DNA, 22 bp, Artificial Sequence
  Synthetic
tgagacaggugtggguaaccat

SEQ ID NO: 14050 - DNA, 28 bp, Artificial Sequence
  Synthetic
gccttgagcucttataaataaguaccca

SEQ ID NO: 14051 - DNA, 28 bp, Artificial Sequence
  Synthetic
atcctatagatgaguttcgaccagguat

SEQ ID NO: 14052 - DNA, 24 bp, Artificial Sequence
  Synthetic
tctcaagcacucaccattuggaat

SEQ ID NO: 14053 - DNA, 24 bp, Artificial Sequence
  Synthetic
cagatgaggaaauacaguccctut

SEQ ID NO: 14054 - DNA, 25 bp, Artificial Sequence
  Synthetic
cccggccaacaucttcttttuaaag

SEQ ID NO: 14055 - DNA, 25 bp, Artificial Sequence
  Synthetic
tggaaatggagcaaauggagcaaua

SEQ ID NO: 14056 - DNA, 31 bp, Artificial Sequence
  Synthetic
cttacctgctctugtactgaattagattuct

SEQ ID NO: 14057 - DNA, 25 bp, Artificial Sequence
  Synthetic
tgcagtttauccccatactccuact

SEQ ID NO: 14058 - DNA, 28 bp, Artificial Sequence
  Synthetic
cttucaaggaagaucaaaacaggtuaat

SEQ ID NO: 14059 - DNA, 28 bp, Artificial Sequence
  Synthetic
gggaaaatgtugcaatcaagattcguaa

SEQ ID NO: 14060 - DNA, 22 bp, Artificial Sequence
  Synthetic
aaatgttctucacagggcucca

SEQ ID NO: 14061 - DNA, 24 bp, Artificial Sequence
  Synthetic
acaacacaacuctgaauggcaaag

SEQ ID NO: 14062 - DNA, 28 bp, Artificial Sequence
  Synthetic
ccacaatacuaacaagtgacactugact

SEQ ID NO: 14063 - DNA, 27 bp, Artificial Sequence
  Synthetic
aattccagctctutcacatggtgatua

SEQ ID NO: 14064 - DNA, 29 bp, Artificial Sequence
  Synthetic
ctcatgtgaaacutcagttcatttttguc

SEQ ID NO: 14065 - DNA, 18 bp, Artificial Sequence
  Synthetic
gcggcuacatgccucagt

SEQ ID NO: 14066 - DNA, 28 bp, Artificial Sequence
  Synthetic
aacttgcttugacctttcaaaatgugaa

SEQ ID NO: 14067 - DNA, 24 bp, Artificial Sequence
  Synthetic
gagcggccagaagauctacaatua

SEQ ID NO: 14068 - DNA, 28 bp, Artificial Sequence
  Synthetic
gctttttgtcauttgcttctattuccac

SEQ ID NO: 14069 - DNA, 26 bp, Artificial Sequence
  Synthetic
ttactgggaaguttcagagatgcaut

SEQ ID NO: 14070 - DNA, 27 bp, Artificial Sequence
  Synthetic
accagtttcattuccaatgatggtuct

SEQ ID NO: 14071 - DNA, 24 bp, Artificial Sequence
  Synthetic
aaaggaccuactgtucggacaaaa

SEQ ID NO: 14072 - DNA, 22 bp, Artificial Sequence
  Synthetic
ggaagucgttucaacggaccaa

SEQ ID NO: 14073 - DNA, 24 bp, Artificial Sequence
  Synthetic
tcacagacuggcaacaagaagaug

SEQ ID NO: 14074 - DNA, 28 bp, Artificial Sequence
  Synthetic
gcatctgattugccaacaagatttctua

SEQ ID NO: 14075 - DNA, 26 bp, Artificial Sequence
  Synthetic
cctcctttugaagccaauggaaaaat

SEQ ID NO: 14076 - DNA, 24 bp, Artificial Sequence
  Synthetic
agtcacuccagtatccctuaccat

SEQ ID NO: 14077 - DNA, 30 bp, Artificial Sequence
  Synthetic
actaattgaggtttuctgttgtttggttug

SEQ ID NO: 14078 - DNA, 23 bp, Artificial Sequence
  Synthetic
gatgtaacctucccaagggcaut

SEQ ID NO: 14079 - DNA, 24 bp, Artificial Sequence
  Synthetic
cacacaaguttgctgatugcaaag

SEQ ID NO: 14080 - DNA, 27 bp, Artificial Sequence
  Synthetic
tgcagttcaauagtcatgacaaaguct

SEQ ID NO: 14081 - DNA, 31 bp, Artificial Sequence
  Synthetic
cagtgtcaccttuacagatatagcttcatua

SEQ ID NO: 14082 - DNA, 25 bp, Artificial Sequence
  Synthetic
cttacctguagattcagtggugagg

SEQ ID NO: 14083 - DNA, 28 bp, Artificial Sequence
  Synthetic
cagcatggaaacaagautgtgtctuaaa

SEQ ID NO: 14084 - DNA, 30 bp, Artificial Sequence
  Synthetic
ttctttcttacaugaatgggatgttctuct

SEQ ID NO: 14085 - DNA, 24 bp, Artificial Sequence
  Synthetic
gaactacccaccugatggactuac

SEQ ID NO: 14086 - DNA, 21 bp, Artificial Sequence
  Synthetic
cacttccggutgggtccatua

SEQ ID NO: 14087 - DNA, 21 bp, Artificial Sequence
  Synthetic
catgccaaucaggtagccugt

SEQ ID NO: 14088 - DNA, 21 bp, Artificial Sequence
  Synthetic
ctggaggcauaagcctggtut

SEQ ID NO: 14089 - DNA, 23 bp, Artificial Sequence
  Synthetic
gctgagcagagutagctccauac

SEQ ID NO: 14090 - DNA, 23 bp, Artificial Sequence
  Synthetic
aggacaagguggctaucaaaacc

SEQ ID NO: 14091 - DNA, 20 bp, Artificial Sequence
  Synthetic
gtacccccuggcgttugaat

SEQ ID NO: 14092 - DNA, 21 bp, Artificial Sequence
  Synthetic
cccggaacautctgacctuct

SEQ ID NO: 14093 - DNA, 21 bp, Artificial Sequence
  Synthetic
cacacatcggacutgctgcua

SEQ ID NO: 14094 - DNA, 26 bp, Artificial Sequence
  Synthetic
cctaugacgcataaguacaaggaact

SEQ ID NO: 14095 - DNA, 22 bp, Artificial Sequence
  Synthetic
gtggcctgguactcagtctcua

SEQ ID NO: 14096 - DNA, 18 bp, Artificial Sequence
  Synthetic
gcuggtgugggagaacga

SEQ ID NO: 14097 - DNA, 17 bp, Artificial Sequence
  Synthetic
ccgggcuctgtctcugg

SEQ ID NO: 14098 - DNA, 19 bp, Artificial Sequence
  Synthetic
gacccgcagaugtccauga

SEQ ID NO: 14099 - DNA, 21 bp, Artificial Sequence
  Synthetic
aatggcaagutctgctgtcug

SEQ ID NO: 14100 - DNA, 22 bp, Artificial Sequence
  Synthetic
acagagccaagcauaaggtcug

SEQ ID NO: 14101 - DNA, 26 bp, Artificial Sequence
  Synthetic
caagtgtctaaagucccatcgaauct

SEQ ID NO: 14102 - DNA, 22 bp, Artificial Sequence
  Synthetic
ggctctaugcgaaaagactgug

SEQ ID NO: 14103 - DNA, 26 bp, Artificial Sequence
  Synthetic
accacctccautctaacagauaacga

SEQ ID NO: 14104 - DNA, 26 bp, Artificial Sequence
  Synthetic
gttacccauaaaagaaagctgccauc

SEQ ID NO: 14105 - DNA, 18 bp, Artificial Sequence
  Synthetic
ccgaauggctggctuggt

SEQ ID NO: 14106 - DNA, 23 bp, Artificial Sequence
  Synthetic
guagaaagtggcugaagcgagat

SEQ ID NO: 14107 - DNA, 21 bp, Artificial Sequence
  Synthetic
ccgtcctuttcctgctuggag

SEQ ID NO: 14108 - DNA, 21 bp, Artificial Sequence
  Synthetic
cagagcucacaccaacaacug

SEQ ID NO: 14109 - DNA, 21 bp, Artificial Sequence
  Synthetic
aaagcugtccagucccagaag

SEQ ID NO: 14110 - DNA, 20 bp, Artificial Sequence
  Synthetic
gaaagtgggcucctctcugt

SEQ ID NO: 14111 - DNA, 21 bp, Artificial Sequence
  Synthetic
tttggagctguctctggcauc

SEQ ID NO: 14112 - DNA, 24 bp, Artificial Sequence
  Synthetic
atctcctatuaaggaccagccugt

SEQ ID NO: 14113 - DNA, 22 bp, Artificial Sequence
  Synthetic
ggauaaagccaccactgcugaa

SEQ ID NO: 14114 - DNA, 20 bp, Artificial Sequence
  Synthetic
agctctcagaccucggtcuc

SEQ ID NO: 14115 - DNA, 21 bp, Artificial Sequence
  Synthetic
gttgctctuccccattgucct

SEQ ID NO: 14116 - DNA, 22 bp, Artificial Sequence
  Synthetic
ctgtgttgccutgtgaagaugg

SEQ ID NO: 14117 - DNA, 23 bp, Artificial Sequence
  Synthetic
cccaacacaugtgatgtcacuct

SEQ ID NO: 14118 - DNA, 22 bp, Artificial Sequence
  Synthetic
gttgctggagucctgacaugat

SEQ ID NO: 14119 - DNA, 19 bp, Artificial Sequence
  Synthetic
gtccctuggtggatgguca

SEQ ID NO: 14120 - DNA, 29 bp, Artificial Sequence
  Synthetic
gcaaaagtaagtugctgtttgtattucca

SEQ ID NO: 14121 - DNA, 21 bp, Artificial Sequence
  Synthetic
tcatgccaaugcctgtgtcua

SEQ ID NO: 14122 - DNA, 25 bp, Artificial Sequence
  Synthetic
gttcttcacagcagutctgctgaua

SEQ ID NO: 14123 - DNA, 28 bp, Artificial Sequence
  Synthetic
ctctcttctagguactctgtctgatcut

SEQ ID NO: 14124 - DNA, 27 bp, Artificial Sequence
  Synthetic
ccuttgaccttttugagaacaagaaga

SEQ ID NO: 14125 - DNA, 24 bp, Artificial Sequence
  Synthetic
aatgcctaaaaccucccaagacut

SEQ ID NO: 14126 - DNA, 25 bp, Artificial Sequence
  Synthetic
ctctgtcagaguatgtttcucgcat

SEQ ID NO: 14127 - DNA, 26 bp, Artificial Sequence
  Synthetic
aaatgaacucagtgactaaaaugcct

SEQ ID NO: 14128 - DNA, 28 bp, Artificial Sequence
  Synthetic
ttcaaagtgguaatgtcaatcuaaggct

SEQ ID NO: 14129 - DNA, 20 bp, Artificial Sequence
  Synthetic
ggtggagtugtcccgaagug

SEQ ID NO: 14130 - DNA, 22 bp, Artificial Sequence
  Synthetic
ctgcagtucctgatgagauccc

SEQ ID NO: 14131 - DNA, 17 bp, Artificial Sequence
  Synthetic
gcacucgaggcugcagt

SEQ ID NO: 14132 - DNA, 19 bp, Artificial Sequence
  Synthetic
tgtccuacgcggaccugat

SEQ ID NO: 14133 - DNA, 18 bp, Artificial Sequence
  Synthetic
gggtggguacgcacctuc

SEQ ID NO: 14134 - DNA, 18 bp, Artificial Sequence
  Synthetic
gggcugtctccauggaca

SEQ ID NO: 14135 - DNA, 17 bp, Artificial Sequence
  Synthetic
cugccaggccactugga

SEQ ID NO: 14136 - DNA, 17 bp, Artificial Sequence
  Synthetic
actgccacggcugacug

SEQ ID NO: 14137 - DNA, 21 bp, Artificial Sequence
  Synthetic
cccutggtggtauacgggaag

SEQ ID NO: 14138 - DNA, 20 bp, Artificial Sequence
  Synthetic
cutgatgtcucaggccagca

SEQ ID NO: 14139 - DNA, 23 bp, Artificial Sequence
  Synthetic
tggagcaagutctgatugaccaa

SEQ ID NO: 14140 - DNA, 22 bp, Artificial Sequence
  Synthetic
gaacttcacuggtgcuaagcag

SEQ ID NO: 14141 - DNA, 21 bp, Artificial Sequence
  Synthetic
ccccctcauccccatattgut

SEQ ID NO: 14142 - DNA, 28 bp, Artificial Sequence
  Synthetic
agttttactgaagaaautctgaggccut

SEQ ID NO: 14143 - DNA, 26 bp, Artificial Sequence
  Synthetic
gtaccttgatgagutagaaggaggug

SEQ ID NO: 14144 - DNA, 27 bp, Artificial Sequence
  Synthetic
cctgctgagaaagaauagttacagcut

SEQ ID NO: 14145 - DNA, 25 bp, Artificial Sequence
  Synthetic
caatcctcatcuctgagatccaucc

SEQ ID NO: 14146 - DNA, 21 bp, Artificial Sequence
  Synthetic
gtgcttgcautggtcgttuca

SEQ ID NO: 14147 - DNA, 24 bp, Artificial Sequence
  Synthetic
ttcccaauatgaaggguccaacag

SEQ ID NO: 14148 - DNA, 28 bp, Artificial Sequence
  Synthetic
agcttcaagttgugcttctttcatttut

SEQ ID NO: 14149 - DNA, 27 bp, Artificial Sequence
  Synthetic
tacattgttgaacugtaggcttttgug

SEQ ID NO: 14150 - DNA, 26 bp, Artificial Sequence
  Synthetic
ttgggtttctgucagttcagattuca

SEQ ID NO: 14151 - DNA, 28 bp, Artificial Sequence
  Synthetic
ggtagtctctcugttgtcattctugaat

SEQ ID NO: 14152 - DNA, 17 bp, Artificial Sequence
  Synthetic
tgctgcugggcauggac

SEQ ID NO: 14153 - DNA, 19 bp, Artificial Sequence
  Synthetic
gcgaggugaagggagguga

SEQ ID NO: 14154 - DNA, 29 bp, Artificial Sequence
  Synthetic
tcacatcatatctutatggtggtgcauac

SEQ ID NO: 14155 - DNA, 28 bp, Artificial Sequence
  Synthetic
agtcacacaccaaugaagaaagaactua

SEQ ID NO: 14156 - DNA, 23 bp, Artificial Sequence
  Synthetic
ccaagggaaagguctctgtuaga

SEQ ID NO: 14157 - DNA, 24 bp, Artificial Sequence
  Synthetic
acgcattgtagaautccagtggut

SEQ ID NO: 14158 - DNA, 20 bp, Artificial Sequence
  Synthetic
gcggcaccucatgaccauat

SEQ ID NO: 14159 - DNA, 27 bp, Artificial Sequence
  Synthetic
ctcggttgacautaggagcaattcuaa

SEQ ID NO: 14160 - DNA, 26 bp, Artificial Sequence
  Synthetic
agggcaccautctggataatgtuaag

SEQ ID NO: 14161 - DNA, 27 bp, Artificial Sequence
  Synthetic
tgctaataacagcutggctauagaaaa

SEQ ID NO: 14162 - DNA, 22 bp, Artificial Sequence
  Synthetic
cccttagccacuggagactgua

SEQ ID NO: 14163 - DNA, 28 bp, Artificial Sequence
  Synthetic
tctagattattaaggcucaggtgtcugt

SEQ ID NO: 14164 - DNA, 24 bp, Artificial Sequence
  Synthetic
gtaacagguaaagccatguaggga

SEQ ID NO: 14165 - DNA, 28 bp, Artificial Sequence
  Synthetic
ccgtatttaatttcutgagctgcaagug

SEQ ID NO: 14166 - DNA, 22 bp, Artificial Sequence
  Synthetic
gtatutgagggacuggccagaa

SEQ ID NO: 14167 - DNA, 22 bp, Artificial Sequence
  Synthetic
ggtattcagacugtcccctucc

SEQ ID NO: 14168 - DNA, 22 bp, Artificial Sequence
  Synthetic
tgtcaaccacutgccatctgut

SEQ ID NO: 14169 - DNA, 23 bp, Artificial Sequence
  Synthetic
ctggaagatgucatctgctccuc

SEQ ID NO: 14170 - DNA, 23 bp, Artificial Sequence
  Synthetic
gttgtctuggagaagcaagaugg

SEQ ID NO: 14171 - DNA, 17 bp, Artificial Sequence
  Synthetic
ctccggccucacctuga

SEQ ID NO: 14172 - DNA, 28 bp, Artificial Sequence
  Synthetic
ttttagggtgcacutgatctatctgaug

SEQ ID NO: 14173 - DNA, 24 bp, Artificial Sequence
  Synthetic
aaagcagagcacuctggagtuaag

SEQ ID NO: 14174 - DNA, 25 bp, Artificial Sequence
  Synthetic
caatgaugaggccaatcagagugat

SEQ ID NO: 14175 - DNA, 28 bp, Artificial Sequence
  Synthetic
ttccataucatcttcatcuggacaaagg

SEQ ID NO: 14176 - DNA, 24 bp, Artificial Sequence
  Synthetic
ccctuctgaaattaguaccagcca

SEQ ID NO: 14177 - DNA, 26 bp, Artificial Sequence
  Synthetic
tctatgggaaaugcagaacaccauac

SEQ ID NO: 14178 - DNA, 29 bp, Artificial Sequence
  Synthetic
agtgaatcctttucagaatgttgtttucc

SEQ ID NO: 14179 - DNA, 25 bp, Artificial Sequence
  Synthetic
gattacatcttgaguggtggcagua

SEQ ID NO: 14180 - DNA, 27 bp, Artificial Sequence
  Synthetic
tttcatcagaaggcucaaagtaaugga

SEQ ID NO: 14181 - DNA, 24 bp, Artificial Sequence
  Synthetic
ctttatcagaugcctgtcgcaaug

SEQ ID NO: 14182 - DNA, 26 bp, Artificial Sequence
  Synthetic
aatgcaggtaccuttttctcaaguga

SEQ ID NO: 14183 - DNA, 29 bp, Artificial Sequence
  Synthetic
aggattgtcttguagggaatatttggtut

SEQ ID NO: 14184 - DNA, 27 bp, Artificial Sequence
  Synthetic
cattctgaugaaaagggtgcuaaagaa

SEQ ID NO: 14185 - DNA, 28 bp, Artificial Sequence
  Synthetic
tctcctacaucatgtgataaggugaaca

SEQ ID NO: 14186 - DNA, 21 bp, Artificial Sequence
  Synthetic
gcatggtcuctctcctgcuga

SEQ ID NO: 14187 - DNA, 27 bp, Artificial Sequence
  Synthetic
gcccatgaggutctattagtgcttuag

SEQ ID NO: 14188 - DNA, 21 bp, Artificial Sequence
  Synthetic
ctgcagaguggcatgaaagug

SEQ ID NO: 14189 - DNA, 23 bp, Artificial Sequence
  Synthetic
caggtttatgucttgggccctua

SEQ ID NO: 14190 - DNA, 28 bp, Artificial Sequence
  Synthetic
aggttgtcaguaatattgttagccaugt

SEQ ID NO: 14191 - DNA, 29 bp, Artificial Sequence
  Synthetic
atctgaaattacucacaactttcccugaa

SEQ ID NO: 14192 - DNA, 23 bp, Artificial Sequence
  Synthetic
tctucagcagctttucaagagca

SEQ ID NO: 14193 - DNA, 27 bp, Artificial Sequence
  Synthetic
ggtcttgcttaaugaagttgagaagut

SEQ ID NO: 14194 - DNA, 23 bp, Artificial Sequence
  Synthetic
ttttgctccucttgtcctcucac

SEQ ID NO: 14195 - DNA, 27 bp, Artificial Sequence
  Synthetic
gtcaccaatctautgaacagccacaua

SEQ ID NO: 14196 - DNA, 31 bp, Artificial Sequence
  Synthetic
tcattacaactucaagccttatuacagaact

SEQ ID NO: 14197 - DNA, 22 bp, Artificial Sequence
  Synthetic
tcatccaaaugtccccaugcaa

SEQ ID NO: 14198 - DNA, 27 bp, Artificial Sequence
  Synthetic
tcacttacaattugcttgtttccucct

SEQ ID NO: 14199 - DNA, 28 bp, Artificial Sequence
  Synthetic
ccatttcactucatggtacccucaaaat

SEQ ID NO: 14200 - DNA, 22 bp, Artificial Sequence
  Synthetic
tgatcagcucctcagtguggat

SEQ ID NO: 14201 - DNA, 29 bp, Artificial Sequence
  Synthetic
agcacgtttuagcatagtttttatctucc

SEQ ID NO: 14202 - DNA, 24 bp, Artificial Sequence
  Synthetic
gcctugggcagaatatagugaacc

SEQ ID NO: 14203 - DNA, 22 bp, Artificial Sequence
  Synthetic
acaaagtgccucctctcactuc

SEQ ID NO: 14204 - DNA, 26 bp, Artificial Sequence
  Synthetic
cagagagtatttuaccttcccagcut

SEQ ID NO: 14205 - DNA, 25 bp, Artificial Sequence
  Synthetic
gagaggugagaaaagtgtguggaat

SEQ ID NO: 14206 - DNA, 22 bp, Artificial Sequence
  Synthetic
cagtccactaugccggtgatut

SEQ ID NO: 14207 - DNA, 18 bp, Artificial Sequence
  Synthetic
gcgggccutctccttcuc

SEQ ID NO: 14208 - DNA, 21 bp, Artificial Sequence
  Synthetic
gcagaugcacatcguggacat

SEQ ID NO: 14209 - DNA, 23 bp, Artificial Sequence
  Synthetic
tcctggagtcucttctggaacug

SEQ ID NO: 14210 - DNA, 22 bp, Artificial Sequence
  Synthetic
gtggagtttguggagggagaut

SEQ ID NO: 14211 - DNA, 21 bp, Artificial Sequence
  Synthetic
gtctcgtttugttcgctccuc

SEQ ID NO: 14212 - DNA, 17 bp, Artificial Sequence
  Synthetic
ccgctuccccgggacua

SEQ ID NO: 14213 - DNA, 19 bp, Artificial Sequence
  Synthetic
acutggcagugaacagcga

SEQ ID NO: 14214 - DNA, 24 bp, Artificial Sequence
  Synthetic
cgtgtgtaatugttgacaggtugt

SEQ ID NO: 14215 - DNA, 31 bp, Artificial Sequence
  Synthetic
actttattggatacaucttgaccttgugaaa

SEQ ID NO: 14216 - DNA, 23 bp, Artificial Sequence
  Synthetic
gctaccaccaaaguttccacuct

SEQ ID NO: 14217 - DNA, 27 bp, Artificial Sequence
  Synthetic
tgtttttaugggagctttgtccuaagt

SEQ ID NO: 14218 - DNA, 26 bp, Artificial Sequence
  Synthetic
aagcacactcaucctttaaacacgua

SEQ ID NO: 14219 - DNA, 27 bp, Artificial Sequence
  Synthetic
atttattgtaggcaacuttggcttugg

SEQ ID NO: 14220 - DNA, 26 bp, Artificial Sequence
  Synthetic
gcagctucaaaagtttaccttucaat

SEQ ID NO: 14221 - DNA, 25 bp, Artificial Sequence
  Synthetic
cagtcuggaaagaaaagaggcttug

SEQ ID NO: 14222 - DNA, 28 bp, Artificial Sequence
  Synthetic
ctcaactactcucccatcaattgaauga

SEQ ID NO: 14223 - DNA, 25 bp, Artificial Sequence
  Synthetic
ggtttgaaagguaatgagggaucct

SEQ ID NO: 14224 - DNA, 22 bp, Artificial Sequence
  Synthetic
cctcgccaugcccttttcaaua

SEQ ID NO: 14225 - DNA, 19 bp, Artificial Sequence
  Synthetic
agtccggtucgtgttcguc

SEQ ID NO: 14226 - DNA, 26 bp, Artificial Sequence
  Synthetic
tggtgagguacatgtugaacagaaac

SEQ ID NO: 14227 - DNA, 21 bp, Artificial Sequence
  Synthetic
gatgtgcgucttctgctccua

SEQ ID NO: 14228 - DNA, 17 bp, Artificial Sequence
  Synthetic
gcgtgcacugggtucca

SEQ ID NO: 14229 - DNA, 17 bp, Artificial Sequence
  Synthetic
tgagcgtuggccgcuat

SEQ ID NO: 14230 - DNA, 20 bp, Artificial Sequence
  Synthetic
gggctatcuccatgcauccc

SEQ ID NO: 14231 - DNA, 26 bp, Artificial Sequence
  Synthetic
actactcagcaaauccactcctcuaa

SEQ ID NO: 14232 - DNA, 17 bp, Artificial Sequence
  Synthetic
cccttcucggcgctcut

SEQ ID NO: 14233 - DNA, 17 bp, Artificial Sequence
  Synthetic
cccgcaguctcguccaa

SEQ ID NO: 14234 - DNA, 25 bp, Artificial Sequence
  Synthetic
tggcaaauacatgtuagaggagcag

SEQ ID NO: 14235 - DNA, 20 bp, Artificial Sequence
  Synthetic
cacgtcagcutacgtcucca

SEQ ID NO: 14236 - DNA, 23 bp, Artificial Sequence
  Synthetic
ggcgtatucccgttcaagttcut

SEQ ID NO: 14237 - DNA, 21 bp, Artificial Sequence
  Synthetic
ccgatcccugtgtaactugcc

SEQ ID NO: 14238 - DNA, 20 bp, Artificial Sequence
  Synthetic
caugtacttguccgcgaagg

SEQ ID NO: 14239 - DNA, 18 bp, Artificial Sequence
  Synthetic
cgctgcccuatggcuact

SEQ ID NO: 14240 - DNA, 24 bp, Artificial Sequence
  Synthetic
gttgtcguagagaaacaugacggt

SEQ ID NO: 14241 - DNA, 19 bp, Artificial Sequence
  Synthetic
cgcgctcutcacttctugg

SEQ ID NO: 14242 - DNA, 22 bp, Artificial Sequence
  Synthetic
ttgccctgtutccatgtggtua

SEQ ID NO: 14243 - DNA, 20 bp, Artificial Sequence
  Synthetic
gaagccaucctcagcuccat

SEQ ID NO: 14244 - DNA, 30 bp, Artificial Sequence
  Synthetic
aaagtcaauaagcaguagatataaggtugt

SEQ ID NO: 14245 - DNA, 28 bp, Artificial Sequence
  Synthetic
cagatacagauccacgggtttuagaaaa

SEQ ID NO: 14246 - DNA, 27 bp, Artificial Sequence
  Synthetic
gggttctttatcuctctctctttcuca

SEQ ID NO: 14247 - DNA, 25 bp, Artificial Sequence
  Synthetic
ccacacagctauctcataaggtcuc

SEQ ID NO: 14248 - DNA, 27 bp, Artificial Sequence
  Synthetic
cgacttccuaacggaaaactaaagugt

SEQ ID NO: 14249 - DNA, 23 bp, Artificial Sequence
  Synthetic
gaagacaggaugctttcctccut

SEQ ID NO: 14250 - DNA, 21 bp, Artificial Sequence
  Synthetic
acauaaagagcgcugccacaa

SEQ ID NO: 14251 - DNA, 20 bp, Artificial Sequence
  Synthetic
ctctgcucctaaggcugcat

SEQ ID NO: 14252 - DNA, 24 bp, Artificial Sequence
  Synthetic
cgaaatgaugaagtcccacgugat

SEQ ID NO: 14253 - DNA, 20 bp, Artificial Sequence
  Synthetic
ggcttgugcagctgguacat

SEQ ID NO: 14254 - DNA, 17 bp, Artificial Sequence
  Synthetic
acgggcugtcgcucaag

SEQ ID NO: 14255 - DNA, 24 bp, Artificial Sequence
  Synthetic
tgtacaugacgtgauccaggaaga

SEQ ID NO: 14256 - DNA, 18 bp, Artificial Sequence
  Synthetic
atgcaugtccucggcact

SEQ ID NO: 14257 - DNA, 23 bp, Artificial Sequence
  Synthetic
actgcaagaagugguaaccgaaa

SEQ ID NO: 14258 - DNA, 23 bp, Artificial Sequence
  Synthetic
ctctggcutttctccaugggaat

SEQ ID NO: 14259 - DNA, 23 bp, Artificial Sequence
  Synthetic
ccttcttguttccatcctugcag

SEQ ID NO: 14260 - DNA, 27 bp, Artificial Sequence
  Synthetic
ttttccctccutagctattgttuggag

SEQ ID NO: 14261 - DNA, 25 bp, Artificial Sequence
  Synthetic
ttttatgccaagaacuctcgaugga

SEQ ID NO: 14262 - DNA, 23 bp, Artificial Sequence
  Synthetic
ccatggccutaatgaacgacugt

SEQ ID NO: 14263 - DNA, 24 bp, Artificial Sequence
  Synthetic
gccactucagctgctatugaaact

SEQ ID NO: 14264 - DNA, 20 bp, Artificial Sequence
  Synthetic
ccctcaugccccagtacuca

SEQ ID NO: 14265 - DNA, 24 bp, Artificial Sequence
  Synthetic
aaacttctcuttccaatccuggca

SEQ ID NO: 14266 - DNA, 21 bp, Artificial Sequence
  Synthetic
ggtgggaatucacaggtgcuc

SEQ ID NO: 14267 - DNA, 20 bp, Artificial Sequence
  Synthetic
gagtucgccgagcuagagaa

SEQ ID NO: 14268 - DNA, 18 bp, Artificial Sequence
  Synthetic
gtgctccucgtcccacuc

SEQ ID NO: 14269 - DNA, 27 bp, Artificial Sequence
  Synthetic
cctggttcaagacacugttcttcttut

SEQ ID NO: 14270 - DNA, 30 bp, Artificial Sequence
  Synthetic
tgcaaatttaacatucaaatctaccgtgut

SEQ ID NO: 14271 - DNA, 24 bp, Artificial Sequence
  Synthetic
agcaaactcatuccccttctctuc

SEQ ID NO: 14272 - DNA, 20 bp, Artificial Sequence
  Synthetic
tgtgtggtugggcatgctua

SEQ ID NO: 14273 - DNA, 20 bp, Artificial Sequence
  Synthetic
ctgctctgucccctacaugg

SEQ ID NO: 14274 - DNA, 24 bp, Artificial Sequence
  Synthetic
gggagaggaggacuaggaatuagg

SEQ ID NO: 14275 - DNA, 24 bp, Artificial Sequence
  Synthetic
tgtaagctcuctttcctctugggt

SEQ ID NO: 14276 - DNA, 22 bp, Artificial Sequence
  Synthetic
tggtgtgguactccatctuggt

SEQ ID NO: 14277 - DNA, 26 bp, Artificial Sequence
  Synthetic
gattcttuaccagagaattccuggct

SEQ ID NO: 14278 - DNA, 20 bp, Artificial Sequence
  Synthetic
ggucggtctuccaagcaaca

SEQ ID NO: 14279 - DNA, 26 bp, Artificial Sequence
  Synthetic
cttattcatcucatcctccttuccct

SEQ ID NO: 14280 - DNA, 21 bp, Artificial Sequence
  Synthetic
gctctcgccutgaacctgtut

SEQ ID NO: 14281 - DNA, 30 bp, Artificial Sequence
  Synthetic
gatacttcatautcacattcatcucggact

SEQ ID NO: 14282 - DNA, 20 bp, Artificial Sequence
  Synthetic
cctgccagcgacaugtctut

SEQ ID NO: 14283 - DNA, 24 bp, Artificial Sequence
  Synthetic
aagaagttgaugaaccggtcctut

SEQ ID NO: 14284 - DNA, 24 bp, Artificial Sequence
  Synthetic
actctggatugcattcctacaugg

SEQ ID NO: 14285 - DNA, 22 bp, Artificial Sequence
  Synthetic
aatgtcatcautcaggcuggct

SEQ ID NO: 14286 - DNA, 21 bp, Artificial Sequence
  Synthetic
gcagcgcgutgacttatucat

SEQ ID NO: 14287 - DNA, 26 bp, Artificial Sequence
  Synthetic
tgcacaauaccagauagaacagacac

SEQ ID NO: 14288 - DNA, 21 bp, Artificial Sequence
  Synthetic
ctttgttcagugtggctggug

SEQ ID NO: 14289 - DNA, 26 bp, Artificial Sequence
  Synthetic
aaaacatgtaugccagctgtuagaga

SEQ ID NO: 14290 - DNA, 24 bp, Artificial Sequence
  Synthetic
tccagattgaaaugcacagtuggt

SEQ ID NO: 14291 - DNA, 30 bp, Artificial Sequence
  Synthetic
acatgataggauagaatcttcctuaccaca

SEQ ID NO: 14292 - DNA, 32 bp, Artificial Sequence
  Synthetic
tgtgtatctctaauagctaaaattcactucct

SEQ ID NO: 14293 - DNA, 24 bp, Artificial Sequence
  Synthetic
ttcacggtaacugaagatgctugt

SEQ ID NO: 14294 - DNA, 23 bp, Artificial Sequence
  Synthetic
gctatggatgutgccaagctgua

SEQ ID NO: 14295 - DNA, 26 bp, Artificial Sequence
  Synthetic
ccatctaacaugaaaaaggcttuggt

SEQ ID NO: 14296 - DNA, 31 bp, Artificial Sequence
  Synthetic
tgttaaaagtuggaaataagagctgugagaa

SEQ ID NO: 14297 - DNA, 30 bp, Artificial Sequence
  Synthetic
aacataattacacuggcttccttattuaca

SEQ ID NO: 14298 - DNA, 23 bp, Artificial Sequence
  Synthetic
gctacgaugcaagaguacacact

SEQ ID NO: 14299 - DNA, 32 bp, Artificial Sequence
  Synthetic
tgaggtatatguataggtatttcucagaacaa

SEQ ID NO: 14300 - DNA, 30 bp, Artificial Sequence
  Synthetic
cataattaaatgtuacgcagtgcuaaccaa

SEQ ID NO: 14301 - DNA, 32 bp, Artificial Sequence
  Synthetic
tatactccatggtuaaataaaatgccactuac

SEQ ID NO: 14302 - DNA, 31 bp, Artificial Sequence
  Synthetic
attgtaaattattctatutcagccacgggua

SEQ ID NO: 14303 - DNA, 23 bp, Artificial Sequence
  Synthetic
gcacctgutttgttgtguacact

SEQ ID NO: 14304 - DNA, 26 bp, Artificial Sequence
  Synthetic
cccttgtaaguagtctttctguacct

SEQ ID NO: 14305 - DNA, 24 bp, Artificial Sequence
  Synthetic
ggacaccagutcagaaaaggaugg

SEQ ID NO: 14306 - DNA, 25 bp, Artificial Sequence
  Synthetic
ggcatcttcuaaattgcaactugct

SEQ ID NO: 14307 - DNA, 20 bp, Artificial Sequence
  Synthetic
tgcagaacutccacagcuga

SEQ ID NO: 14308 - DNA, 21 bp, Artificial Sequence
  Synthetic
ctccaattcugctggcaaucc

SEQ ID NO: 14309 - DNA, 24 bp, Artificial Sequence
  Synthetic
gtcagagtugacagtgtcttccuc

SEQ ID NO: 14310 - DNA, 17 bp, Artificial Sequence
  Synthetic
gtctgggcugggctgua

SEQ ID NO: 14311 - DNA, 18 bp, Artificial Sequence
  Synthetic
tccuggacgacgccttug

SEQ ID NO: 14312 - DNA, 19 bp, Artificial Sequence
  Synthetic
tgtaggugccatcgctguc

SEQ ID NO: 14313 - DNA, 23 bp, Artificial Sequence
  Synthetic
gguaagtcaguggcaaaaagggt

SEQ ID NO: 14314 - DNA, 19 bp, Artificial Sequence
  Synthetic
ccgggctuagccgagttut

SEQ ID NO: 14315 - DNA, 20 bp, Artificial Sequence
  Synthetic
cggguccccagtaagaucca

SEQ ID NO: 14316 - DNA, 23 bp, Artificial Sequence
  Synthetic
gacatcagaaacucacagccuga

SEQ ID NO: 14317 - DNA, 21 bp, Artificial Sequence
  Synthetic
ccctcggaaaauggagacgug

SEQ ID NO: 14318 - DNA, 22 bp, Artificial Sequence
  Synthetic
ctgtgcggcauagtttccagua

SEQ ID NO: 14319 - DNA, 28 bp, Artificial Sequence
  Synthetic
aggaattatugaaagacctttcttccut

SEQ ID NO: 14320 - DNA, 20 bp, Artificial Sequence
  Synthetic
cttctgguggaaaccucgct

SEQ ID NO: 14321 - DNA, 21 bp, Artificial Sequence
  Synthetic
acttgttttgggugccacgua

SEQ ID NO: 14322 - DNA, 24 bp, Artificial Sequence
  Synthetic
ccattcaaaaauccctgtgtgcut

SEQ ID NO: 14323 - DNA, 27 bp, Artificial Sequence
  Synthetic
agagaaatcauggttaagcttucagca

SEQ ID NO: 14324 - DNA, 23 bp, Artificial Sequence
  Synthetic
gattaaaggaguctggucacgga

SEQ ID NO: 14325 - DNA, 29 bp, Artificial Sequence
  Synthetic
tccctaggttuacgaactatttacugact

SEQ ID NO: 14326 - DNA, 17 bp, Artificial Sequence
  Synthetic
gcggcgucacccaucag

SEQ ID NO: 14327 - DNA, 18 bp, Artificial Sequence
  Synthetic
cacagagcugaccgucgt

SEQ ID NO: 14328 - DNA, 26 bp, Artificial Sequence
  Synthetic
ggattcaugggaaatgagugaagact

SEQ ID NO: 14329 - DNA, 22 bp, Artificial Sequence
  Synthetic
ccatggtcaagcutcccttcug

SEQ ID NO: 14330 - DNA, 26 bp, Artificial Sequence
  Synthetic
tgttgagaaaaagcuggaugcaaaat

SEQ ID NO: 14331 - DNA, 21 bp, Artificial Sequence
  Synthetic
acaaaaacacaccgucgctug

SEQ ID NO: 14332 - DNA, 27 bp, Artificial Sequence
  Synthetic
gggaaaagcguattaaatactugagga

SEQ ID NO: 14333 - DNA, 22 bp, Artificial Sequence
  Synthetic
ctcauggagaaagacgugggat

SEQ ID NO: 14334 - DNA, 23 bp, Artificial Sequence
  Synthetic
gggtatgtucttggagagauggt

SEQ ID NO: 14335 - DNA, 22 bp, Artificial Sequence
  Synthetic
ctttaaugccacagccgtuagg

SEQ ID NO: 14336 - DNA, 28 bp, Artificial Sequence
  Synthetic
ccgatgtcacutcttcatcttguaaaga

SEQ ID NO: 14337 - DNA, 25 bp, Artificial Sequence
  Synthetic
cgatgagauggataactttcugcca

SEQ ID NO: 14338 - DNA, 24 bp, Artificial Sequence
  Synthetic
aaatcagagcugggttagugcaat

SEQ ID NO: 14339 - DNA, 29 bp, Artificial Sequence
  Synthetic
ctgatggtaattcugtcaatttctcgtut

SEQ ID NO: 14340 - DNA, 20 bp, Artificial Sequence
  Synthetic
ccgcgacagguacttgtuga

SEQ ID NO: 14341 - DNA, 18 bp, Artificial Sequence
  Synthetic
gggccucactgcccttug

SEQ ID NO: 14342 - DNA, 26 bp, Artificial Sequence
  Synthetic
gatgcggaaauttttggattttucca

SEQ ID NO: 14343 - DNA, 19 bp, Artificial Sequence
  Synthetic
ccggcggcgacuttgatua

SEQ ID NO: 14344 - DNA, 17 bp, Artificial Sequence
  Synthetic
ggcugcccgctauccat

SEQ ID NO: 14345 - DNA, 19 bp, Artificial Sequence
  Synthetic
ggugccgtuaggcagaagg

SEQ ID NO: 14346 - DNA, 22 bp, Artificial Sequence
  Synthetic
ccatgtgtucctcacaagugga

SEQ ID NO: 14347 - DNA, 23 bp, Artificial Sequence
  Synthetic
ccacttcucaccccatcactuac

SEQ ID NO: 14348 - DNA, 19 bp, Artificial Sequence
  Synthetic
ctgctggacuctcgcucac

SEQ ID NO: 14349 - DNA, 19 bp, Artificial Sequence
  Synthetic
gaucccccuggaacaccac

SEQ ID NO: 14350 - DNA, 21 bp, Artificial Sequence
  Synthetic
cagcaagaagguggagaucgt

SEQ ID NO: 14351 - DNA, 21 bp, Artificial Sequence
  Synthetic
acctgtgaugtcaggugcaag

SEQ ID NO: 14352 - DNA, 22 bp, Artificial Sequence
  Synthetic
acaggcgagaugatcctctcuc

SEQ ID NO: 14353 - DNA, 25 bp, Artificial Sequence
  Synthetic
tctgagccacauagactacauccat

SEQ ID NO: 14354 - DNA, 23 bp, Artificial Sequence
  Synthetic
accatctcaaauggtgggaugac

SEQ ID NO: 14355 - DNA, 18 bp, Artificial Sequence
  Synthetic
ggttcuggccagggctuc

SEQ ID NO: 14356 - DNA, 21 bp, Artificial Sequence
  Synthetic
actgctcgucttccgaaaugg

SEQ ID NO: 14357 - DNA, 23 bp, Artificial Sequence
  Synthetic
gggaattcagucccttactggut

SEQ ID NO: 14358 - DNA, 21 bp, Artificial Sequence
  Synthetic
ggtgtccacautcctcacguc

SEQ ID NO: 14359 - DNA, 24 bp, Artificial Sequence
  Synthetic
gtggttgaggaugtaggtgaugat

SEQ ID NO: 14360 - DNA, 20 bp, Artificial Sequence
  Synthetic
gggaggguccagtcgtaguc

SEQ ID NO: 14361 - DNA, 21 bp, Artificial Sequence
  Synthetic
ccctccaggugagctcctuat

SEQ ID NO: 14362 - DNA, 17 bp, Artificial Sequence
  Synthetic
ccgggcuacgctuacgg

SEQ ID NO: 14363 - DNA, 21 bp, Artificial Sequence
  Synthetic
cucccaguagcaagaagggaa

SEQ ID NO: 14364 - DNA, 17 bp, Artificial Sequence
  Synthetic
gacggtuccccggtgut

SEQ ID NO: 14365 - DNA, 17 bp, Artificial Sequence
  Synthetic
gctccggcuctcctucc

SEQ ID NO: 14366 - DNA, 23 bp, Artificial Sequence
  Synthetic
tggaagagcgaaacuaccgtcua

SEQ ID NO: 14367 - DNA, 17 bp, Artificial Sequence
  Synthetic
gggaacauccgcctgug

SEQ ID NO: 14368 - DNA, 26 bp, Artificial Sequence
  Synthetic
ggagatggauactctctagtcuagcc

SEQ ID NO: 14369 - DNA, 22 bp, Artificial Sequence
  Synthetic
tgcctguggaggaactttucaa

SEQ ID NO: 14370 - DNA, 22 bp, Artificial Sequence
  Synthetic
cgaggccaaaguctgctatcut

SEQ ID NO: 14371 - DNA, 21 bp, Artificial Sequence
  Synthetic
acaagtcggcuagttgcaugg

SEQ ID NO: 14372 - DNA, 28 bp, Artificial Sequence
  Synthetic
ggttgatgauattcttatgctucccgat

SEQ ID NO: 14373 - DNA, 23 bp, Artificial Sequence
  Synthetic
cctcctcccutcccaagtaaaug

SEQ ID NO: 14374 - DNA, 21 bp, Artificial Sequence
  Synthetic
tgagtgtgcaaaucccccauc

SEQ ID NO: 14375 - DNA, 20 bp, Artificial Sequence
  Synthetic
gggtcggucatcgtcuacaa

SEQ ID NO: 14376 - DNA, 25 bp, Artificial Sequence
  Synthetic
aaagatcguacgtaacucaggacac

SEQ ID NO: 14377 - DNA, 19 bp, Artificial Sequence
  Synthetic
gggtggugctggtctguaa

SEQ ID NO: 14378 - DNA, 21 bp, Artificial Sequence
  Synthetic
gcgggtcacugtacacctuac

SEQ ID NO: 14379 - DNA, 22 bp, Artificial Sequence
  Synthetic
cctctttagccauggcaagguc

SEQ ID NO: 14380 - DNA, 22 bp, Artificial Sequence
  Synthetic
cattttucaaccagcgcagugt

SEQ ID NO: 14381 - DNA, 21 bp, Artificial Sequence
  Synthetic
tgcctgtcuctcttggcttuc

SEQ ID NO: 14382 - DNA, 17 bp, Artificial Sequence
  Synthetic
gggtgcggutgcttucc

SEQ ID NO: 14383 - DNA, 18 bp, Artificial Sequence
  Synthetic
ccccugtggaaguggagt

SEQ ID NO: 14384 - DNA, 19 bp, Artificial Sequence
  Synthetic
cgccagcagcgutcatgua

SEQ ID NO: 14385 - DNA, 24 bp, Artificial Sequence
  Synthetic
acaugaaccagauagcacagtauc

SEQ ID NO: 14386 - DNA, 19 bp, Artificial Sequence
  Synthetic
gccctugcaatctcugcgt

SEQ ID NO: 14387 - DNA, 21 bp, Artificial Sequence
  Synthetic
ctcagctggcuccatctcauc

SEQ ID NO: 14388 - DNA, 18 bp, Artificial Sequence
  Synthetic
ggctgcugctgctggtua

SEQ ID NO: 14389 - DNA, 18 bp, Artificial Sequence
  Synthetic
cucacccagagcagcugt

SEQ ID NO: 14390 - DNA, 20 bp, Artificial Sequence
  Synthetic
ggtguagccactcucaaggg

SEQ ID NO: 14391 - DNA, 21 bp, Artificial Sequence
  Synthetic
cgaggacccucagatguccat

SEQ ID NO: 14392 - DNA, 29 bp, Artificial Sequence
  Synthetic
ttccctactcttcugcatattagcatcua

SEQ ID NO: 14393 - DNA, 20 bp, Artificial Sequence
  Synthetic
gagacugcccagaaugacga

SEQ ID NO: 14394 - DNA, 19 bp, Artificial Sequence
  Synthetic
cttcactgcuggctgcauc

SEQ ID NO: 14395 - DNA, 25 bp, Artificial Sequence
  Synthetic
tttccattccuaaagctggacguaa

SEQ ID NO: 14396 - DNA, 29 bp, Artificial Sequence
  Synthetic
ctgaagacaauaaaccacagtaagugagt

SEQ ID NO: 14397 - DNA, 24 bp, Artificial Sequence
  Synthetic
ttccctagagaauacttccgucgt

SEQ ID NO: 14398 - DNA, 21 bp, Artificial Sequence
  Synthetic
gtgggctutgtgagaatuggt

SEQ ID NO: 14399 - DNA, 21 bp, Artificial Sequence
  Synthetic
aaaagcccugaggctcugaag

SEQ ID NO: 14400 - DNA, 24 bp, Artificial Sequence
  Synthetic
tcctgggtttutctgttcttccuc

SEQ ID NO: 14401 - DNA, 27 bp, Artificial Sequence
  Synthetic
agugaaaagaaaucagaagttauggct

SEQ ID NO: 14402 - DNA, 23 bp, Artificial Sequence
  Synthetic
ggataagttttucccggcggaua

SEQ ID NO: 14403 - DNA, 25 bp, Artificial Sequence
  Synthetic
acctatcaucttacatgctucacca

SEQ ID NO: 14404 - DNA, 22 bp, Artificial Sequence
  Synthetic
cacagagaagguccacuggaaa

SEQ ID NO: 14405 - DNA, 24 bp, Artificial Sequence
  Synthetic
cttgacutgtgttttcuccaccag

SEQ ID NO: 14406 - DNA, 27 bp, Artificial Sequence
  Synthetic
tctttcugtaaatctcatuggcaggag

SEQ ID NO: 14407 - DNA, 21 bp, Artificial Sequence
  Synthetic
cgtttacaggcugcccaaaut

SEQ ID NO: 14408 - DNA, 22 bp, Artificial Sequence
  Synthetic
ggcaaactgcugttactgctua

SEQ ID NO: 14409 - DNA, 30 bp, Artificial Sequence
  Synthetic
caggaaatcaugactgagaaagatauggaa

SEQ ID NO: 14410 - DNA, 27 bp, Artificial Sequence
  Synthetic
agccatctauccgctctaaatatccut

SEQ ID NO: 14411 - DNA, 26 bp, Artificial Sequence
  Synthetic
tttagaucaaaaggtccctucagcaa

SEQ ID NO: 14412 - DNA, 21 bp, Artificial Sequence
  Synthetic
gcggaucacaacactccaugt

SEQ ID NO: 14413 - DNA, 27 bp, Artificial Sequence
  Synthetic
ttttaagatcccugaagctttcuaggt

SEQ ID NO: 14414 - DNA, 24 bp, Artificial Sequence
  Synthetic
ggaaatcacauaccactgtugcca

SEQ ID NO: 14415 - DNA, 22 bp, Artificial Sequence
  Synthetic
gtgtttttctucacagccggut

SEQ ID NO: 14416 - DNA, 28 bp, Artificial Sequence
  Synthetic
cgctttatcaguttattccaauccacat

SEQ ID NO: 14417 - DNA, 30 bp, Artificial Sequence
  Synthetic
ggagttgagtgtuaaagatggaacaattut

SEQ ID NO: 14418 - DNA, 17 bp, Artificial Sequence
  Synthetic
ggccugaggccgaguca

SEQ ID NO: 14419 - DNA, 18 bp, Artificial Sequence
  Synthetic
agugaggaggctcucgca

SEQ ID NO: 14420 - DNA, 28 bp, Artificial Sequence
  Synthetic
atgttgcagutaagtgattataugggat

SEQ ID NO: 14421 - DNA, 28 bp, Artificial Sequence
  Synthetic
gcctccaattatcucctacttcagttut

SEQ ID NO: 14422 - DNA, 29 bp, Artificial Sequence
  Synthetic
tctccattcagatuttaggacagcaaaut

SEQ ID NO: 14423 - DNA, 24 bp, Artificial Sequence
  Synthetic
ccttgcttcugttcacagtucaca

SEQ ID NO: 14424 - DNA, 28 bp, Artificial Sequence
  Synthetic
tttcagctgatgaguaaagaatctccug

SEQ ID NO: 14425 - DNA, 28 bp, Artificial Sequence
  Synthetic
cccattcttcucattaacatctgaugct

SEQ ID NO: 14426 - DNA, 24 bp, Artificial Sequence
  Synthetic
tgutctaaggagaaugaggaggca

SEQ ID NO: 14427 - DNA, 23 bp, Artificial Sequence
  Synthetic
atctgccaaaguggtcagtucat

SEQ ID NO: 14428 - DNA, 29 bp, Artificial Sequence
  Synthetic
tgtcagtcuagaggaagagtuaagaaagg

SEQ ID NO: 14429 - DNA, 25 bp, Artificial Sequence
  Synthetic
agctacatgtcauaactgagagcut

SEQ ID NO: 14430 - DNA, 28 bp, Artificial Sequence
  Synthetic
gggtttcataucgaaagttgtgtaacug

SEQ ID NO: 14431 - DNA, 25 bp, Artificial Sequence
  Synthetic
agtgtaagtgugaacaccacaauct

SEQ ID NO: 14432 - DNA, 27 bp, Artificial Sequence
  Synthetic
gaagcagtaguaggtgatgtttaccug

SEQ ID NO: 14433 - DNA, 28 bp, Artificial Sequence
  Synthetic
agcaagcccacutaaaaactatccuaat

SEQ ID NO: 14434 - DNA, 23 bp, Artificial Sequence
  Synthetic
gaatgacccugcauaaaaaggca

SEQ ID NO: 14435 - DNA, 23 bp, Artificial Sequence
  Synthetic
acaacttctcuaccttgctgugg

SEQ ID NO: 14436 - DNA, 19 bp, Artificial Sequence
  Synthetic
acctcgacuacgacucggt

SEQ ID NO: 14437 - DNA, 19 bp, Artificial Sequence
  Synthetic
tgggcagcagcucgaatut

SEQ ID NO: 14438 - DNA, 19 bp, Artificial Sequence
  Synthetic
agaagcuggcctccuacca

SEQ ID NO: 14439 - DNA, 20 bp, Artificial Sequence
  Synthetic
ctgtcgtugagaggguaggg

SEQ ID NO: 14440 - DNA, 23 bp, Artificial Sequence
  Synthetic
ggtcagagtcuggatcacctuct

SEQ ID NO: 14441 - DNA, 22 bp, Artificial Sequence
  Synthetic
actgtccaacutgaccctctug

SEQ ID NO: 14442 - DNA, 27 bp, Artificial Sequence
  Synthetic
caaaagctcattuctgaagaggactug

SEQ ID NO: 14443 - DNA, 28 bp, Artificial Sequence
  Synthetic
aggacatttctgutagaaggaatcgtut

SEQ ID NO: 14444 - DNA, 28 bp, Artificial Sequence
  Synthetic
agttcttcaggugtatctttaccatucc

SEQ ID NO: 14445 - DNA, 28 bp, Artificial Sequence
  Synthetic
acaatccatgcauaaaaaggaaaaugct

SEQ ID NO: 14446 - DNA, 32 bp, Artificial Sequence
  Synthetic
tcttgtagattttacuttcctcgttggtatug

SEQ ID NO: 14447 - DNA, 32 bp, Artificial Sequence
  Synthetic
aagauaatataatcataccugagcaaagaggt

SEQ ID NO: 14448 - DNA, 30 bp, Artificial Sequence
  Synthetic
gcgaataagguacagatttcgcagattuat

SEQ ID NO: 14449 - DNA, 32 bp, Artificial Sequence
  Synthetic
aggttcttttactucaaatttctctgtguaga

SEQ ID NO: 14450 - DNA, 30 bp, Artificial Sequence
  Synthetic
tgcgattttccuaatattattgatgucagt

SEQ ID NO: 14451 - DNA, 30 bp, Artificial Sequence
  Synthetic
accattattcaaucataaagcaaactuacc

SEQ ID NO: 14452 - DNA, 30 bp, Artificial Sequence
  Synthetic
ccattagtaaacugaagaaagcaggtaauc

SEQ ID NO: 14453 - DNA, 28 bp, Artificial Sequence
  Synthetic
aaagtgttaccacuaataagtgugacat

SEQ ID NO: 14454 - DNA, 32 bp, Artificial Sequence
  Synthetic
gagcaattcatacuttcagtgtatttugaagt

SEQ ID NO: 14455 - DNA, 26 bp, Artificial Sequence
  Synthetic
ttggttcatatgaguaggcctctgua

SEQ ID NO: 14456 - DNA, 30 bp, Artificial Sequence
  Synthetic
ttttaatgcagatatuctggttcaggagut

SEQ ID NO: 14457 - DNA, 18 bp, Artificial Sequence
  Synthetic
catggcccaugccaacug

SEQ ID NO: 14458 - DNA, 30 bp, Artificial Sequence
  Synthetic
tggtttacttgugaattatttaacccuact

SEQ ID NO: 14459 - DNA, 23 bp, Artificial Sequence
  Synthetic
cactgcagatutcccacaaagug

SEQ ID NO: 14460 - DNA, 32 bp, Artificial Sequence
  Synthetic
gtcaacttgaaugtatatcagtttaguccaga

SEQ ID NO: 14461 - DNA, 22 bp, Artificial Sequence
  Synthetic
gtaggaucccggtctucaaagg

SEQ ID NO: 14462 - DNA, 25 bp, Artificial Sequence
  Synthetic
gcaccuaagagacttugaaagggaa

SEQ ID NO: 14463 - DNA, 22 bp, Artificial Sequence
  Synthetic
autacacaggaugccaaacaca

SEQ ID NO: 14464 - DNA, 23 bp, Artificial Sequence
  Synthetic
gtatauccacagggatcuggcaa

SEQ ID NO: 14465 - DNA, 31 bp, Artificial Sequence
  Synthetic
ggactttcaccaggutcttttactttauagt

SEQ ID NO: 14466 - DNA, 32 bp, Artificial Sequence
  Synthetic
ggtttgttttaggaauttatgcgtatgatugg

SEQ ID NO: 14467 - DNA, 29 bp, Artificial Sequence
  Synthetic
gaaaatgcatgacuaccctggatuaaaaa

SEQ ID NO: 14468 - DNA, 25 bp, Artificial Sequence
  Synthetic
tcccttttggutgcatcatttugag

SEQ ID NO: 14469 - DNA, 25 bp, Artificial Sequence
  Synthetic
tccgtaaacuacagagttaccugga

SEQ ID NO: 14470 - DNA, 23 bp, Artificial Sequence
  Synthetic
cagggaugaaagttttgcaugct

SEQ ID NO: 14471 - DNA, 23 bp, Artificial Sequence
  Synthetic
ttctucacccctacaucacgaac

SEQ ID NO: 14472 - DNA, 26 bp, Artificial Sequence
  Synthetic
atgagaaaagcauctcctagttugca

SEQ ID NO: 14473 - DNA, 28 bp, Artificial Sequence
  Synthetic
tgtggtatcccguaaatttattgauggt

SEQ ID NO: 14474 - DNA, 22 bp, Artificial Sequence
  Synthetic
tgaaaugggcggccttttacua

SEQ ID NO: 14475 - DNA, 29 bp, Artificial Sequence
  Synthetic
agaaaatagttccuaagatggcctucaag

SEQ ID NO: 14476 - DNA, 23 bp, Artificial Sequence
  Synthetic
ctgctgcuggtatgaatacucct

SEQ ID NO: 14477 - DNA, 24 bp, Artificial Sequence
  Synthetic
gcutgagaggaaucaaagaaggat

SEQ ID NO: 14478 - DNA, 24 bp, Artificial Sequence
  Synthetic
tcaautggcaaaaugaaaccagca

SEQ ID NO: 14479 - DNA, 25 bp, Artificial Sequence
  Synthetic
gcgtgtgatcuagatggtagaaugg

SEQ ID NO: 14480 - DNA, 20 bp, Artificial Sequence
  Synthetic
cgtactuaccgagcuagcca

SEQ ID NO: 14481 - DNA, 19 bp, Artificial Sequence
  Synthetic
gcagagaaugtccgccauc

SEQ ID NO: 14482 - DNA, 25 bp, Artificial Sequence
  Synthetic
gcatcttcatgugaccccttagtut

SEQ ID NO: 14483 - DNA, 31 bp, Artificial Sequence
  Synthetic
gactatgtcaagtuctaagactctgtacuct

SEQ ID NO: 14484 - DNA, 27 bp, Artificial Sequence
  Synthetic
ttcagaaactcuagggtaagtagguga

SEQ ID NO: 14485 - DNA, 23 bp, Artificial Sequence
  Synthetic
gtgcccaaaaaguggcaatuagt

SEQ ID NO: 14486 - DNA, 21 bp, Artificial Sequence
  Synthetic
cgtcuaccccatugcagagaa

SEQ ID NO: 14487 - DNA, 24 bp, Artificial Sequence
  Synthetic
ggcttatgggcutttactccucag

SEQ ID NO: 14488 - DNA, 21 bp, Artificial Sequence
  Synthetic
caggctgauccctcttucagg

SEQ ID NO: 14489 - DNA, 22 bp, Artificial Sequence
  Synthetic
agacagtccuagggtggatugg

SEQ ID NO: 14490 - DNA, 21 bp, Artificial Sequence
  Synthetic
ggtaggcaaaugctgucagga

SEQ ID NO: 14491 - DNA, 21 bp, Artificial Sequence
  Synthetic
ttgtaggctuggagcttcugg

SEQ ID NO: 14492 - DNA, 24 bp, Artificial Sequence
  Synthetic
cttaaacccagacugaagauggca

SEQ ID NO: 14493 - DNA, 21 bp, Artificial Sequence
  Synthetic
gttcttcccutggagcugact

SEQ ID NO: 14494 - DNA, 20 bp, Artificial Sequence
  Synthetic
aucttgaggcugcaaaccga

SEQ ID NO: 14495 - DNA, 21 bp, Artificial Sequence
  Synthetic
tcctaaguccgcttctgguct

SEQ ID NO: 14496 - DNA, 22 bp, Artificial Sequence
  Synthetic
cggatattcucggtgtctgugg

SEQ ID NO: 14497 - DNA, 25 bp, Artificial Sequence
  Synthetic
gcagattagguaacaaagtguccct

SEQ ID NO: 14498 - DNA, 29 bp, Artificial Sequence
  Synthetic
gaacttgatcatautcactaagcgcuact

SEQ ID NO: 14499 - DNA, 27 bp, Artificial Sequence
  Synthetic
tgagtattgtuaaccttgcagaauggt

SEQ ID NO: 14500 - DNA, 31 bp, Artificial Sequence
  Synthetic
ggaaagatactcacuatttggtagagucaga

SEQ ID NO: 14501 - DNA, 24 bp, Artificial Sequence
  Synthetic
gctcaugcacaattagtucgagaa

SEQ ID NO: 14502 - DNA, 17 bp, Artificial Sequence
  Synthetic
ttgtcccugcggagcug

SEQ ID NO: 14503 - DNA, 17 bp, Artificial Sequence
  Synthetic
gcgggagggugtgtgug

SEQ ID NO: 14504 - DNA, 22 bp, Artificial Sequence
  Synthetic
agtacuaggatgcuggaccaca

SEQ ID NO: 14505 - DNA, 19 bp, Artificial Sequence
  Synthetic
cugcagacgguagcaggac

SEQ ID NO: 14506 - DNA, 24 bp, Artificial Sequence
  Synthetic
aggatcuagggaaaccatgtguga

SEQ ID NO: 14507 - DNA, 22 bp, Artificial Sequence
  Synthetic
ttgccctcugacgtatctcuct

SEQ ID NO: 14508 - DNA, 26 bp, Artificial Sequence
  Synthetic
ccagagacuaccacaacattttcuga

SEQ ID NO: 14509 - DNA, 28 bp, Artificial Sequence
  Synthetic
acattctcatggucttctcctttuacag

SEQ ID NO: 14510 - DNA, 24 bp, Artificial Sequence
  Synthetic
tgtcguacagtcttuccaacacac

SEQ ID NO: 14511 - DNA, 22 bp, Artificial Sequence
  Synthetic
ggaggctcucctcatctgucat

SEQ ID NO: 14512 - DNA, 22 bp, Artificial Sequence
  Synthetic
gcatacccaagaccutgaguga

SEQ ID NO: 14513 - DNA, 28 bp, Artificial Sequence
  Synthetic
ccccatgtacaaauaaattgtaggcaut

SEQ ID NO: 14514 - DNA, 28 bp, Artificial Sequence
  Synthetic
caagaaagauctactgaatctugagcca

SEQ ID NO: 14515 - DNA, 24 bp, Artificial Sequence
  Synthetic
gtcgugaaggcactgauaaaagag

SEQ ID NO: 14516 - DNA, 28 bp, Artificial Sequence
  Synthetic
catacaatgttuctccttcaacuacgga

SEQ ID NO: 14517 - DNA, 25 bp, Artificial Sequence
  Synthetic
acttcatctucgacgacacttgtut

SEQ ID NO: 14518 - DNA, 20 bp, Artificial Sequence
  Synthetic
cctcccagugagaggaucgt

SEQ ID NO: 14519 - DNA, 25 bp, Artificial Sequence
  Synthetic
cacaaatuagcagaagucagccaaa

SEQ ID NO: 14520 - DNA, 27 bp, Artificial Sequence
  Synthetic
agttaacttugaagatacgttgugcat

SEQ ID NO: 14521 - DNA, 29 bp, Artificial Sequence
  Synthetic
tcccatacctcuccaatttttacaugaag

SEQ ID NO: 14522 - DNA, 22 bp, Artificial Sequence
  Synthetic
tgttatcugacacagtgcgcut

SEQ ID NO: 14523 - DNA, 28 bp, Artificial Sequence
  Synthetic
tgtttaaaaagtguttgcatgcttcuga

SEQ ID NO: 14524 - DNA, 24 bp, Artificial Sequence
  Synthetic
gctgctcauggttgaatttcugga

SEQ ID NO: 14525 - DNA, 25 bp, Artificial Sequence
  Synthetic
tctaggcutttattgatugcaccca

SEQ ID NO: 14526 - DNA, 26 bp, Artificial Sequence
  Synthetic
atcttctagggauattcccactgugt

SEQ ID NO: 14527 - DNA, 22 bp, Artificial Sequence
  Synthetic
agggcagcaugaagttatcucc

SEQ ID NO: 14528 - DNA, 18 bp, Artificial Sequence
  Synthetic
acucacccagagcucggt

SEQ ID NO: 14529 - DNA, 17 bp, Artificial Sequence
  Synthetic
gcggacuccgggcttuc

SEQ ID NO: 14530 - DNA, 20 bp, Artificial Sequence
  Synthetic
gcattgtccucaggcacgua

SEQ ID NO: 14531 - DNA, 20 bp, Artificial Sequence
  Synthetic
tgcttgtccugtgctctcuc

SEQ ID NO: 14532 - DNA, 21 bp, Artificial Sequence
  Synthetic
gagaaggtuccctgctcagut

SEQ ID NO: 14533 - DNA, 21 bp, Artificial Sequence
  Synthetic
cagatgucagcagcgaaucct

SEQ ID NO: 14534 - DNA, 20 bp, Artificial Sequence
  Synthetic
tggaagaugctgcacauggg

SEQ ID NO: 14535 - DNA, 17 bp, Artificial Sequence
  Synthetic
gtctcugcgagccugga

SEQ ID NO: 14536 - DNA, 17 bp, Artificial Sequence
  Synthetic
cctgcccuttccccgut

SEQ ID NO: 14537 - DNA, 17 bp, Artificial Sequence
  Synthetic
agccguggtggauggac

SEQ ID NO: 14538 - DNA, 19 bp, Artificial Sequence
  Synthetic
caccccaucaccaccuacc

SEQ ID NO: 14539 - DNA, 19 bp, Artificial Sequence
  Synthetic
gggaagagcuggctccuac

SEQ ID NO: 14540 - DNA, 22 bp, Artificial Sequence
  Synthetic
gugcattucagaggcagcaaaa

SEQ ID NO: 14541 - DNA, 22 bp, Artificial Sequence
  Synthetic
ggaagtccuccagtgagtcaug

SEQ ID NO: 14542 - DNA, 21 bp, Artificial Sequence
  Synthetic
gaagcacuaatcggctugcat

SEQ ID NO: 14543 - DNA, 23 bp, Artificial Sequence
  Synthetic
caacagccuccaatcatctccut

SEQ ID NO: 14544 - DNA, 28 bp, Artificial Sequence
  Synthetic
gttgcagggaagauactacattttugat

SEQ ID NO: 14545 - DNA, 24 bp, Artificial Sequence
  Synthetic
gaaatctctgcacutacccccaut

SEQ ID NO: 14546 - DNA, 31 bp, Artificial Sequence
  Synthetic
ctcagagcatgaaugattggaagtaaattut

SEQ ID NO: 14547 - DNA, 25 bp, Artificial Sequence
  Synthetic
caguattggacattaucggcaccat

SEQ ID NO: 14548 - DNA, 21 bp, Artificial Sequence
  Synthetic
cuagagggucagagggcaaag

SEQ ID NO: 14549 - DNA, 28 bp, Artificial Sequence
  Synthetic
aacaucactaatacctugaggaaaaggg

SEQ ID NO: 14550 - DNA, 27 bp, Artificial Sequence
  Synthetic
ctgttactucacagcctaaaagcttug

SEQ ID NO: 14551 - DNA, 25 bp, Artificial Sequence
  Synthetic
caggcccaugcttactttgtttaut

SEQ ID NO: 14552 - DNA, 25 bp, Artificial Sequence
  Synthetic
ggtgaatttcccuccatttttcugg

SEQ ID NO: 14553 - DNA, 22 bp, Artificial Sequence
  Synthetic
caagctccaucatgccgauact

SEQ ID NO: 14554 - DNA, 24 bp, Artificial Sequence
  Synthetic
atctagtactccugtctccagcuc

SEQ ID NO: 14555 - DNA, 27 bp, Artificial Sequence
  Synthetic
aaatgagaaacccaccuattacctguc

SEQ ID NO: 14556 - DNA, 25 bp, Artificial Sequence
  Synthetic
agtttggaaaauctgcctccaguag

SEQ ID NO: 14557 - DNA, 23 bp, Artificial Sequence
  Synthetic
ccatctgcccauctgtcttgaut

SEQ ID NO: 14558 - DNA, 28 bp, Artificial Sequence
  Synthetic
gcttcagcauaagctttttaauaagcct

SEQ ID NO: 14559 - DNA, 26 bp, Artificial Sequence
  Synthetic
gctgtttcctauatgagggctctuac

SEQ ID NO: 14560 - DNA, 23 bp, Artificial Sequence
  Synthetic
gtaccaccuaatgcaacacaucc

SEQ ID NO: 14561 - DNA, 28 bp, Artificial Sequence
  Synthetic
gtatcuacaaaggaacacatugaaagcc

SEQ ID NO: 14562 - DNA, 29 bp, Artificial Sequence
  Synthetic
cttaatacagtcuggaatactctguccat

SEQ ID NO: 14563 - DNA, 27 bp, Artificial Sequence
  Synthetic
actctgtataaagugggtttgcaagut

SEQ ID NO: 14564 - DNA, 23 bp, Artificial Sequence
  Synthetic
acutttcctaagucagccaaggg

SEQ ID NO: 14565 - DNA, 25 bp, Artificial Sequence
  Synthetic
tgcttgtgagaucactttgactuct

SEQ ID NO: 14566 - DNA, 28 bp, Artificial Sequence
  Synthetic
atcccattccaauatgtagcttctgtut

SEQ ID NO: 14567 - DNA, 27 bp, Artificial Sequence
  Synthetic
agcatgaagctaugataatgggaaguc

SEQ ID NO: 14568 - DNA, 25 bp, Artificial Sequence
  Synthetic
atttcatauggaatgctgugaccca

SEQ ID NO: 14569 - DNA, 24 bp, Artificial Sequence
  Synthetic
agaacctgtauacctctgagcugt

SEQ ID NO: 14570 - DNA, 23 bp, Artificial Sequence
  Synthetic
aagcccatugaatgcatctagut

SEQ ID NO: 14571 - DNA, 25 bp, Artificial Sequence
  Synthetic
cattcatggauccttcatcacuggt

SEQ ID NO: 14572 - DNA, 24 bp, Artificial Sequence
  Synthetic
gtcgcagaucacgaggtgaaatua

SEQ ID NO: 14573 - DNA, 24 bp, Artificial Sequence
  Synthetic
gtgaagaagguggaggtttuagct

SEQ ID NO: 14574 - DNA, 23 bp, Artificial Sequence
  Synthetic
ctuccacggcaaaatcuaaagcc

SEQ ID NO: 14575 - DNA, 22 bp, Artificial Sequence
  Synthetic
tgcctagcaucctgtgctttut

SEQ ID NO: 14576 - DNA, 27 bp, Artificial Sequence
  Synthetic
tgauagtcactggugaaagaaccaaaa

SEQ ID NO: 14577 - DNA, 30 bp, Artificial Sequence
  Synthetic
gagtaccagguttggatttcatattuacca

SEQ ID NO: 14578 - DNA, 27 bp, Artificial Sequence
  Synthetic
gttgtctgtttcuttttgctaggtuga

SEQ ID NO: 14579 - DNA, 26 bp, Artificial Sequence
  Synthetic
cagatgacagcccutttcatcattut

SEQ ID NO: 14580 - DNA, 21 bp, Artificial Sequence
  Synthetic
ccgtctctccuacctggcaua

SEQ ID NO: 14581 - DNA, 22 bp, Artificial Sequence
  Synthetic
tcttgtcgaucatgtggaggug

SEQ ID NO: 14582 - DNA, 22 bp, Artificial Sequence
  Synthetic
caccauttttacccuccccact

SEQ ID NO: 14583 - DNA, 17 bp, Artificial Sequence
  Synthetic
gtgacuggccggctcuc

SEQ ID NO: 14584 - DNA, 29 bp, Artificial Sequence
  Synthetic
ctcatgagctcutatgtgttatgttugga

SEQ ID NO: 14585 - DNA, 23 bp, Artificial Sequence
  Synthetic
tgagttgucaaagggctcatuca

SEQ ID NO: 14586 - DNA, 22 bp, Artificial Sequence
  Synthetic
ggaacaaagcgcgguctatcua

SEQ ID NO: 14587 - DNA, 26 bp, Artificial Sequence
  Synthetic
ccttctgaagtcuccttctgttctuc

SEQ ID NO: 14588 - DNA, 27 bp, Artificial Sequence
  Synthetic
gatgatcucatcaaaccugaggaagag

SEQ ID NO: 14589 - DNA, 25 bp, Artificial Sequence
  Synthetic
tctttttccguggagatttctggut

SEQ ID NO: 14590 - DNA, 22 bp, Artificial Sequence
  Synthetic
tugtaacagugagcccaaggag

SEQ ID NO: 14591 - DNA, 24 bp, Artificial Sequence
  Synthetic
tctcagagtcgauttccatggtug

SEQ ID NO: 14592 - DNA, 22 bp, Artificial Sequence
  Synthetic
gccatctcugcagaacauggaa

SEQ ID NO: 14593 - DNA, 22 bp, Artificial Sequence
  Synthetic
gtagaatcguagctgctugggt

SEQ ID NO: 14594 - DNA, 20 bp, Artificial Sequence
  Synthetic
gcugaaauccccgagacgag

SEQ ID NO: 14595 - DNA, 29 bp, Artificial Sequence
  Synthetic
ctgtaaggcaaugaatgatcaataagugt

SEQ ID NO: 14596 - DNA, 20 bp, Artificial Sequence
  Synthetic
tgccacccaucagucacaaa

SEQ ID NO: 14597 - DNA, 26 bp, Artificial Sequence
  Synthetic
gttgagagtgutcatgttcatgtuca

SEQ ID NO: 14598 - DNA, 25 bp, Artificial Sequence
  Synthetic
tcaatggctccuacatgagaaggua

SEQ ID NO: 14599 - DNA, 24 bp, Artificial Sequence
  Synthetic
ggtgccaacaaaugtttttgcaut

SEQ ID NO: 14600 - DNA, 22 bp, Artificial Sequence
  Synthetic
gacugacatcaacuccaaggga

SEQ ID NO: 14601 - DNA, 25 bp, Artificial Sequence
  Synthetic
gctactccuaactgtgacttucact

SEQ ID NO: 14602 - DNA, 28 bp, Artificial Sequence
  Synthetic
agaataccaagugcagatguaaaccaaa

SEQ ID NO: 14603 - DNA, 30 bp, Artificial Sequence
  Synthetic
acttccctaggaaaaugataactctcaugt

SEQ ID NO: 14604 - DNA, 28 bp, Artificial Sequence
  Synthetic
ggctgagaccugagttgataaaattuct

SEQ ID NO: 14605 - DNA, 30 bp, Artificial Sequence
  Synthetic
ggaaagctgauacctatttcaataccuaca

SEQ ID NO: 14606 - DNA, 27 bp, Artificial Sequence
  Synthetic
cctcaaggacautactagtgacucaga

SEQ ID NO: 14607 - DNA, 29 bp, Artificial Sequence
  Synthetic
gccagctautaagaatctttucaaacact

SEQ ID NO: 14608 - DNA, 23 bp, Artificial Sequence
  Synthetic
cactgcuccagaaaccttctuct

SEQ ID NO: 14609 - DNA, 20 bp, Artificial Sequence
  Synthetic
gcuacacugagcagggagac

SEQ ID NO: 14610 - DNA, 22 bp, Artificial Sequence
  Synthetic
aacacuacgcatgtcucacaag

SEQ ID NO: 14611 - DNA, 21 bp, Artificial Sequence
  Synthetic
cucccagagaccaacgtucaa

SEQ ID NO: 14612 - DNA, 27 bp, Artificial Sequence
  Synthetic
aggaagaaaggugaagtacgtacagua

SEQ ID NO: 14613 - DNA, 24 bp, Artificial Sequence
  Synthetic
gcattttccuctacattugcaggg

SEQ ID NO: 14614 - DNA, 26 bp, Artificial Sequence
  Synthetic
agacatttutagttggatuccaccca

SEQ ID NO: 14615 - DNA, 25 bp, Artificial Sequence
  Synthetic
ctcctatgacautaaccgtgtucct

SEQ ID NO: 14616 - DNA, 23 bp, Artificial Sequence
  Synthetic
ctttgtcaatucccactgctucc

SEQ ID NO: 14617 - DNA, 22 bp, Artificial Sequence
  Synthetic
tcacuacaccccaucaccagat

SEQ ID NO: 14618 - DNA, 22 bp, Artificial Sequence
  Synthetic
gctgaagtcuggcttcttgguc

SEQ ID NO: 14619 - DNA, 22 bp, Artificial Sequence
  Synthetic
ctcctcctgugatctgcaauct

SEQ ID NO: 14620 - DNA, 31 bp, Artificial Sequence
  Synthetic
cctgccctatataautggagaccttacauat

SEQ ID NO: 14621 - DNA, 24 bp, Artificial Sequence
  Synthetic
gacaatgcuaagaccttcctggut

SEQ ID NO: 14622 - DNA, 27 bp, Artificial Sequence
  Synthetic
acaggtataattucccttgtcagaugg

SEQ ID NO: 14623 - DNA, 24 bp, Artificial Sequence
  Synthetic
ctttcttgccuccttcagcttcut

SEQ ID NO: 14624 - DNA, 28 bp, Artificial Sequence
  Synthetic
gcatccaatuacaattagagatcucact

SEQ ID NO: 14625 - DNA, 21 bp, Artificial Sequence
  Synthetic
ggcctctaugcttgtacugcc

SEQ ID NO: 14626 - DNA, 27 bp, Artificial Sequence
  Synthetic
tgtggtatccucaactaaacugaagga

SEQ ID NO: 14627 - DNA, 24 bp, Artificial Sequence
  Synthetic
ccacauggagatauggaagaggac

SEQ ID NO: 14628 - DNA, 18 bp, Artificial Sequence
  Synthetic
gccgucccgggagactua

SEQ ID NO: 14629 - DNA, 20 bp, Artificial Sequence
  Synthetic
cagcactcacugaccctcuc

SEQ ID NO: 14630 - DNA, 17 bp, Artificial Sequence
  Synthetic
ccggugcgcatgtacug

SEQ ID NO: 14631 - DNA, 17 bp, Artificial Sequence
  Synthetic
tcccugagccctgucct

SEQ ID NO: 14632 - DNA, 20 bp, Artificial Sequence
  Synthetic
cagcctgcacuggtagagug

SEQ ID NO: 14633 - DNA, 26 bp, Artificial Sequence
  Synthetic
tcttgtgucagatggactaugaggaa

SEQ ID NO: 14634 - DNA, 22 bp, Artificial Sequence
  Synthetic
gccagtactugtccaatgccut

SEQ ID NO: 14635 - DNA, 20 bp, Artificial Sequence
  Synthetic
gttgctguctgtctguccgt

SEQ ID NO: 14636 - DNA, 23 bp, Artificial Sequence
  Synthetic
gctgagacccaaaacutgtctut

SEQ ID NO: 14637 - DNA, 26 bp, Artificial Sequence
  Synthetic
gataaagttcuaactgcccuggagac

SEQ ID NO: 14638 - DNA, 21 bp, Artificial Sequence
  Synthetic
gaagccaguggactagcacut

SEQ ID NO: 14639 - DNA, 20 bp, Artificial Sequence
  Synthetic
aggtttcucagcagcctgug

SEQ ID NO: 14640 - DNA, 18 bp, Artificial Sequence
  Synthetic
ggacgucacagugaccga

SEQ ID NO: 14641 - DNA, 19 bp, Artificial Sequence
  Synthetic
ctaccugcgccacauccat

SEQ ID NO: 14642 - DNA, 22 bp, Artificial Sequence
  Synthetic
cagugaacaccuccccaaagat

SEQ ID NO: 14643 - DNA, 25 bp, Artificial Sequence
  Synthetic
gtcagaagcauttctgtgtagguga

SEQ ID NO: 14644 - DNA, 18 bp, Artificial Sequence
  Synthetic
cacagaggucgcagcuca

SEQ ID NO: 14645 - DNA, 21 bp, Artificial Sequence
  Synthetic
cctgatgctuggccttctcuc

SEQ ID NO: 14646 - DNA, 25 bp, Artificial Sequence
  Synthetic
ccttcatcutctcactcuggaaagt

SEQ ID NO: 14647 - DNA, 17 bp, Artificial Sequence
  Synthetic
ggccagggugcagtguc

SEQ ID NO: 14648 - DNA, 17 bp, Artificial Sequence
  Synthetic
ggacugccctccuccca

SEQ ID NO: 14649 - DNA, 23 bp, Artificial Sequence
  Synthetic
gggtgaguaagagactgatcugt

SEQ ID NO: 14650 - DNA, 17 bp, Artificial Sequence
  Synthetic
gcacatugcggtugcga

SEQ ID NO: 14651 - DNA, 17 bp, Artificial Sequence
  Synthetic
gctgccucccugaggat

SEQ ID NO: 14652 - DNA, 19 bp, Artificial Sequence
  Synthetic
agctgtcugctccccatug

SEQ ID NO: 14653 - DNA, 23 bp, Artificial Sequence
  Synthetic
ccctctttcatuacctcccccut

SEQ ID NO: 14654 - DNA, 20 bp, Artificial Sequence
  Synthetic
gggaacgtuggtagggauga

SEQ ID NO: 14655 - DNA, 18 bp, Artificial Sequence
  Synthetic
cgctccaucgacgacgug

SEQ ID NO: 14656 - DNA, 23 bp, Artificial Sequence
  Synthetic
cutcccaatgatugcaacacaaa

SEQ ID NO: 14657 - DNA, 22 bp, Artificial Sequence
  Synthetic
gagactuctacccguagcagga

SEQ ID NO: 14658 - DNA, 32 bp, Artificial Sequence
  Synthetic
aagtgatatauaaacacaagaattugcagcag

SEQ ID NO: 14659 - DNA, 28 bp, Artificial Sequence
  Synthetic
ctggaataggcaacaugtttgtgattua

SEQ ID NO: 14660 - DNA, 28 bp, Artificial Sequence
  Synthetic
gcggttugaaagtactgtttuacaagat

SEQ ID NO: 14661 - DNA, 25 bp, Artificial Sequence
  Synthetic
ctgacaactugcaatgagtaugcac

SEQ ID NO: 14662 - DNA, 23 bp, Artificial Sequence
  Synthetic
ggacttacucgcagtcguacaag

SEQ ID NO: 14663 - DNA, 27 bp, Artificial Sequence
  Synthetic
ttcctgtgguaataagctgctatucag

SEQ ID NO: 14664 - DNA, 32 bp, Artificial Sequence
  Synthetic
aatatataacactcacutctttacagcttcuc

SEQ ID NO: 14665 - DNA, 30 bp, Artificial Sequence
  Synthetic
ttttggatgactucattgatcttgttauct

SEQ ID NO: 14666 - DNA, 30 bp, Artificial Sequence
  Synthetic
ttctcaattgttuaaagaatcacacaugga

SEQ ID NO: 14667 - DNA, 24 bp, Artificial Sequence
  Synthetic
gacgtucaatgtctguggagaaga

SEQ ID NO: 14668 - DNA, 31 bp, Artificial Sequence
  Synthetic
gtcttatacagcaaauaccatacacaaguaa

SEQ ID NO: 14669 - DNA, 26 bp, Artificial Sequence
  Synthetic
gaaaacattacauacctgccucgagt

SEQ ID NO: 14670 - DNA, 24 bp, Artificial Sequence
  Synthetic
acagtugacgagcttuagaaaccc

SEQ ID NO: 14671 - DNA, 26 bp, Artificial Sequence
  Synthetic
ggaatcgagugcattttctgacatut

SEQ ID NO: 14672 - DNA, 23 bp, Artificial Sequence
  Synthetic
ctgtggucagttcctugaaaagc

SEQ ID NO: 14673 - DNA, 26 bp, Artificial Sequence
  Synthetic
tgcctaauttgaatcagucaggaaca

SEQ ID NO: 14674 - DNA, 22 bp, Artificial Sequence
  Synthetic
gtgcagttgugttggatgugat

SEQ ID NO: 14675 - DNA, 26 bp, Artificial Sequence
  Synthetic
ccacctacctuagggccaagtaauaa

SEQ ID NO: 14676 - DNA, 27 bp, Artificial Sequence
  Synthetic
gaacacttaccagaauactgagcagut

SEQ ID NO: 14677 - DNA, 28 bp, Artificial Sequence
  Synthetic
gggaatgaugcaacataatatgcttuca

SEQ ID NO: 14678 - DNA, 23 bp, Artificial Sequence
  Synthetic
ccttacctguctctgttgtuggg

SEQ ID NO: 14679 - DNA, 22 bp, Artificial Sequence
  Synthetic
atctcuaccaagccagccttug

SEQ ID NO: 14680 - DNA, 22 bp, Artificial Sequence
  Synthetic
gccggcctugtacatgtagtua

SEQ ID NO: 14681 - DNA, 21 bp, Artificial Sequence
  Synthetic
cctcttcugctggaccaucac

SEQ ID NO: 14682 - DNA, 21 bp, Artificial Sequence
  Synthetic
tgagucaagcccggtgaguat

SEQ ID NO: 14683 - DNA, 26 bp, Artificial Sequence
  Synthetic
gagaacatgaucaatgccaccauaaa

SEQ ID NO: 14684 - DNA, 21 bp, Artificial Sequence
  Synthetic
tcataggcaaggucccugaca

SEQ ID NO: 14685 - DNA, 25 bp, Artificial Sequence
  Synthetic
aatggctttguggacaactcattuc

SEQ ID NO: 14686 - DNA, 21 bp, Artificial Sequence
  Synthetic
gtgctttcuctttcccgguct

SEQ ID NO: 14687 - DNA, 18 bp, Artificial Sequence
  Synthetic
ccgagagugcacagugct

SEQ ID NO: 14688 - DNA, 21 bp, Artificial Sequence
  Synthetic
gtcatcgtccucagcctctuc

SEQ ID NO: 14689 - DNA, 18 bp, Artificial Sequence
  Synthetic
gggttccucgccccctua

SEQ ID NO: 14690 - DNA, 29 bp, Artificial Sequence
  Synthetic
gatccatctgtgutttcccctctaaauaa

SEQ ID NO: 14691 - DNA, 27 bp, Artificial Sequence
  Synthetic
gtaactctgaaaugtcctttccatgug

SEQ ID NO: 14692 - DNA, 29 bp, Artificial Sequence
  Synthetic
ggaacacctccacutacaaaagaagauaa

SEQ ID NO: 14693 - DNA, 25 bp, Artificial Sequence
  Synthetic
tttgccctcugtaagagttgctuag

SEQ ID NO: 14694 - DNA, 22 bp, Artificial Sequence
  Synthetic
tctcgatctaguagccccagug

SEQ ID NO: 14695 - DNA, 28 bp, Artificial Sequence
  Synthetic
actgaatacctuctgcttctcctaucat

SEQ ID NO: 14696 - DNA, 25 bp, Artificial Sequence
  Synthetic
gaaccgacattuaggtggacttcut

SEQ ID NO: 14697 - DNA, 19 bp, Artificial Sequence
  Synthetic
ccaacgtccucgggagtua

SEQ ID NO: 14698 - DNA, 24 bp, Artificial Sequence
  Synthetic
tcucactccaugaggacaagaagt

SEQ ID NO: 14699 - DNA, 28 bp, Artificial Sequence
  Synthetic
ggaatgagaaggaaaaguaaaagtuggg

SEQ ID NO: 14700 - DNA, 29 bp, Artificial Sequence
  Synthetic
ggaaaaagggaucagaaattcagaguagt

SEQ ID NO: 14701 - DNA, 25 bp, Artificial Sequence
  Synthetic
cagtcccagaaucatgtgaugaaga

SEQ ID NO: 14702 - DNA, 22 bp, Artificial Sequence
  Synthetic
aagctcagcuctgcaagatuga

SEQ ID NO: 14703 - DNA, 28 bp, Artificial Sequence
  Synthetic
gttctcataacuggatgtaatugaacca

SEQ ID NO: 14704 - DNA, 23 bp, Artificial Sequence
  Synthetic
tgctccacccaucaaaccaatua

SEQ ID NO: 14705 - DNA, 22 bp, Artificial Sequence
  Synthetic
gaccaccaaacutgggcttauc

SEQ ID NO: 14706 - DNA, 29 bp, Artificial Sequence
  Synthetic
ctcactatagacagaugatgttgttgugt

SEQ ID NO: 14707 - DNA, 22 bp, Artificial Sequence
  Synthetic
caggatccuctcttgctgaugg

SEQ ID NO: 14708 - DNA, 27 bp, Artificial Sequence
  Synthetic
tcttcacaggucagtcagtacuaaagt

SEQ ID NO: 14709 - DNA, 24 bp, Artificial Sequence
  Synthetic
ggcagagaaacaaauctctccuca

SEQ ID NO: 14710 - DNA, 31 bp, Artificial Sequence
  Synthetic
cccaaagtatauaagaagggtatggttgaut

SEQ ID NO: 14711 - DNA, 21 bp, Artificial Sequence
  Synthetic
ggcgctcgutctcctcuaaac

SEQ ID NO: 14712 - DNA, 29 bp, Artificial Sequence
  Synthetic
cttcttttctagauctgtaccaagtgugt

SEQ ID NO: 14713 - DNA, 22 bp, Artificial Sequence
  Synthetic
aagctggcaaaacuggctttut

SEQ ID NO: 14714 - DNA, 21 bp, Artificial Sequence
  Synthetic
ctggccctugaaaaagagcug

SEQ ID NO: 14715 - DNA, 27 bp, Artificial Sequence
  Synthetic
aagactaccuaagaacaagctcucaga

SEQ ID NO: 14716 - DNA, 26 bp, Artificial Sequence
  Synthetic
cagauggaggauagccagaaatuaaa

SEQ ID NO: 14717 - DNA, 30 bp, Artificial Sequence
  Synthetic
caaagcaaaaaguagaagagaacaagtuca

SEQ ID NO: 14718 - DNA, 23 bp, Artificial Sequence
  Synthetic
tttcagcagugggatgtuaccaa

SEQ ID NO: 14719 - DNA, 22 bp, Artificial Sequence
  Synthetic
gggtttgggagcuggaatgaut

SEQ ID NO: 14720 - DNA, 26 bp, Artificial Sequence
  Synthetic
gagtggacacaugtaaattgtgctut

SEQ ID NO: 14721 - DNA, 27 bp, Artificial Sequence
  Synthetic
cacaggaagaauatctggaaacugaga

SEQ ID NO: 14722 - DNA, 24 bp, Artificial Sequence
  Synthetic
tgtggacttugaaggaatcagcut

SEQ ID NO: 14723 - DNA, 24 bp, Artificial Sequence
  Synthetic
cacctggcugagggtcattttaua

SEQ ID NO: 14724 - DNA, 30 bp, Artificial Sequence
  Synthetic
tctagttttacatutacctgatagcugact

SEQ ID NO: 14725 - DNA, 26 bp, Artificial Sequence
  Synthetic
cggtctggtgauggaggacttauaat

SEQ ID NO: 14726 - DNA, 22 bp, Artificial Sequence
  Synthetic
tccuaccccaaccactcaugaa

SEQ ID NO: 14727 - DNA, 28 bp, Artificial Sequence
  Synthetic
agagtaagtatucccagttctcatugga

SEQ ID NO: 14728 - DNA, 23 bp, Artificial Sequence
  Synthetic
accaaagugctgagtuccaagag

SEQ ID NO: 14729 - DNA, 28 bp, Artificial Sequence
  Synthetic
tcttuagaagaaaacgacacugaagagg

SEQ ID NO: 14730 - DNA, 20 bp, Artificial Sequence
  Synthetic
cctggucaggtgacaacugg

SEQ ID NO: 14731 - DNA, 20 bp, Artificial Sequence
  Synthetic
cttgcatggguggagcttug

SEQ ID NO: 14732 - DNA, 27 bp, Artificial Sequence
  Synthetic
actatcagaaucttccaguacaggaca

SEQ ID NO: 14733 - DNA, 27 bp, Artificial Sequence
  Synthetic
accataggatcutactccatagagugg

SEQ ID NO: 14734 - DNA, 23 bp, Artificial Sequence
  Synthetic
gugttgatgaugggacagagagt

SEQ ID NO: 14735 - DNA, 26 bp, Artificial Sequence
  Synthetic
ccagcatctucaggtctatcaatcut

SEQ ID NO: 14736 - DNA, 28 bp, Artificial Sequence
  Synthetic
gccttcagacatuatggactttgtacua

SEQ ID NO: 14737 - DNA, 25 bp, Artificial Sequence
  Synthetic
gcagctgcugagaaaatactucaaa

SEQ ID NO: 14738 - DNA, 22 bp, Artificial Sequence
  Synthetic
cacatggaugcagaccacauct

SEQ ID NO: 14739 - DNA, 23 bp, Artificial Sequence
  Synthetic
ggcacatacutctggttcuggat

SEQ ID NO: 14740 - DNA, 27 bp, Artificial Sequence
  Synthetic
cttctcaatcttugttcccttctgcua

SEQ ID NO: 14741 - DNA, 22 bp, Artificial Sequence
  Synthetic
ccaauaagcaggccugaaggag

SEQ ID NO: 14742 - DNA, 28 bp, Artificial Sequence
  Synthetic
cgaactguccccaacatcauaaaaagat

SEQ ID NO: 14743 - DNA, 21 bp, Artificial Sequence
  Synthetic
cacagacccugatgtgaggug

SEQ ID NO: 14744 - DNA, 21 bp, Artificial Sequence
  Synthetic
ataacagccgcutcacctuct

SEQ ID NO: 14745 - DNA, 22 bp, Artificial Sequence
  Synthetic
tgctatuaggagcgtcuaccgt

SEQ ID NO: 14746 - DNA, 28 bp, Artificial Sequence
  Synthetic
ggtttgtctugaaaagatacaaaugcct

SEQ ID NO: 14747 - DNA, 24 bp, Artificial Sequence
  Synthetic
gaggtggacaaaacugagagctua

SEQ ID NO: 14748 - DNA, 27 bp, Artificial Sequence
  Synthetic
ttggtatuaagaagggtttacgugcat

SEQ ID NO: 14749 - DNA, 24 bp, Artificial Sequence
  Synthetic
tggaataacaccuccagccatuac

SEQ ID NO: 14750 - DNA, 23 bp, Artificial Sequence
  Synthetic
atcgtcagccucctgaauacaac

SEQ ID NO: 14751 - DNA, 24 bp, Artificial Sequence
  Synthetic
atccaggaaautctgaugcaaaca

SEQ ID NO: 14752 - DNA, 26 bp, Artificial Sequence
  Synthetic
tgtaagagaaacautgatgcagguga

SEQ ID NO: 14753 - DNA, 22 bp, Artificial Sequence
  Synthetic
gggtcatacuggtccctttcua

SEQ ID NO: 14754 - DNA, 26 bp, Artificial Sequence
  Synthetic
aagaaatgccggaagutcctaaacua

SEQ ID NO: 14755 - DNA, 23 bp, Artificial Sequence
  Synthetic
ggacataagagagcucagccauc

SEQ ID NO: 14756 - DNA, 22 bp, Artificial Sequence
  Synthetic
gctcatgautcagaggcugagg

SEQ ID NO: 14757 - DNA, 27 bp, Artificial Sequence
  Synthetic
ctcgtccatauagctgttgtagtucat

SEQ ID NO: 14758 - DNA, 29 bp, Artificial Sequence
  Synthetic
gttataacctgttuatgttttgcctcuca

SEQ ID NO: 14759 - DNA, 20 bp, Artificial Sequence
  Synthetic
ggcctgtgucatgtctggua

SEQ ID NO: 14760 - DNA, 22 bp, Artificial Sequence
  Synthetic
gctgaggtgutctgttctcucc

SEQ ID NO: 14761 - DNA, 22 bp, Artificial Sequence
  Synthetic
tcattttgaacuccccgtuggt

SEQ ID NO: 14762 - DNA, 21 bp, Artificial Sequence
  Synthetic
cctgtcactucctccagctuc

SEQ ID NO: 14763 - DNA, 24 bp, Artificial Sequence
  Synthetic
agctagaaggccacugatgaguaa

SEQ ID NO: 14764 - DNA, 27 bp, Artificial Sequence
  Synthetic
ctgcttcttugcacagtttauacagat

SEQ ID NO: 14765 - DNA, 28 bp, Artificial Sequence
  Synthetic
tgtaacctaaacautccccaatcttgut

SEQ ID NO: 14766 - DNA, 21 bp, Artificial Sequence
  Synthetic
gggatguccagcaccttttuc

SEQ ID NO: 14767 - DNA, 25 bp, Artificial Sequence
  Synthetic
tgcagacaaaucaaaggagcugaat

SEQ ID NO: 14768 - DNA, 20 bp, Artificial Sequence
  Synthetic
gcctgcaaaauccgccauat

SEQ ID NO: 14769 - DNA, 19 bp, Artificial Sequence
  Synthetic
cucggaagagcccttuggt

SEQ ID NO: 14770 - DNA, 27 bp, Artificial Sequence
  Synthetic
ggttcaagacuactagaggactucaca

SEQ ID NO: 14771 - DNA, 23 bp, Artificial Sequence
  Synthetic
aagctttaaccugaaagccucca

SEQ ID NO: 14772 - DNA, 23 bp, Artificial Sequence
  Synthetic
ctggcucaacacagatagttugg

SEQ ID NO: 14773 - DNA, 23 bp, Artificial Sequence
  Synthetic
ttctgtcacucctggtatcccut

SEQ ID NO: 14774 - DNA, 23 bp, Artificial Sequence
  Synthetic
tcaccaagcaaacucaagaugct

SEQ ID NO: 14775 - DNA, 25 bp, Artificial Sequence
  Synthetic
ggaguggcaaaaauaggaggaaaaa

SEQ ID NO: 14776 - DNA, 26 bp, Artificial Sequence
  Synthetic
aatccaugaaacaggcattaccugat

SEQ ID NO: 14777 - DNA, 24 bp, Artificial Sequence
  Synthetic
gaacatuccagcctttcuacccaa

SEQ ID NO: 14778 - DNA, 26 bp, Artificial Sequence
  Synthetic
atcagcttcutcatgacauccaaagt

SEQ ID NO: 14779 - DNA, 25 bp, Artificial Sequence
  Synthetic
ctagtctctatguggaactcccuga

SEQ ID NO: 14780 - DNA, 24 bp, Artificial Sequence
  Synthetic
ggacaaaggccutcaattctucca

SEQ ID NO: 14781 - DNA, 27 bp, Artificial Sequence
  Synthetic
ctaggattgctuaggtttgaattcuga

SEQ ID NO: 14782 - DNA, 28 bp, Artificial Sequence
  Synthetic
gtccagaguaaaggagtaaaguaaggga

SEQ ID NO: 14783 - DNA, 25 bp, Artificial Sequence
  Synthetic
gtctctaccauccaactgatctgug

SEQ ID NO: 14784 - DNA, 21 bp, Artificial Sequence
  Synthetic
cattctggauctgctgccauc

SEQ ID NO: 14785 - DNA, 23 bp, Artificial Sequence
  Synthetic
agtagtggttcugtgctgggaua

SEQ ID NO: 14786 - DNA, 28 bp, Artificial Sequence
  Synthetic
ttcatgatgguaactaactgaugcagaa

SEQ ID NO: 14787 - DNA, 21 bp, Artificial Sequence
  Synthetic
gggagccaaagacauggtaug

SEQ ID NO: 14788 - DNA, 30 bp, Artificial Sequence
  Synthetic
tgtgatccctuaagatagttttcaaugcaa

SEQ ID NO: 14789 - DNA, 23 bp, Artificial Sequence
  Synthetic
gaagtggauttccggugaaggat

SEQ ID NO: 14790 - DNA, 26 bp, Artificial Sequence
  Synthetic
catctctccaaagcuctgaagtguat

SEQ ID NO: 14791 - DNA, 30 bp, Artificial Sequence
  Synthetic
gtaactaagagccutaaagctttctucagt

SEQ ID NO: 14792 - DNA, 29 bp, Artificial Sequence
  Synthetic
acgagctaacuaaacacataccatgauat

SEQ ID NO: 14793 - DNA, 24 bp, Artificial Sequence
  Synthetic
ttaccaacaggucagacgcattua

SEQ ID NO: 14794 - DNA, 24 bp, Artificial Sequence
  Synthetic
gaagtttggguatcagtgcugaga

SEQ ID NO: 14795 - DNA, 28 bp, Artificial Sequence
  Synthetic
acttttacactgautctccagcatgaut

SEQ ID NO: 14796 - DNA, 26 bp, Artificial Sequence
  Synthetic
aggauttttctctcuaccacagggat

SEQ ID NO: 14797 - DNA, 26 bp, Artificial Sequence
  Synthetic
gacccctgcuctgttattcttatuca

SEQ ID NO: 14798 - DNA, 20 bp, Artificial Sequence
  Synthetic
tcccaacucggcucaaagac

SEQ ID NO: 14799 - DNA, 19 bp, Artificial Sequence
  Synthetic
gggctucagccagctttuc

SEQ ID NO: 14800 - DNA, 24 bp, Artificial Sequence
  Synthetic
ctaaagtggtugccaccttgtuac

SEQ ID NO: 14801 - DNA, 26 bp, Artificial Sequence
  Synthetic
gggagauccgacaatacagatugaaa

SEQ ID NO: 14802 - DNA, 28 bp, Artificial Sequence
  Synthetic
cctactaggaccauaggtacatctucag

SEQ ID NO: 14803 - DNA, 25 bp, Artificial Sequence
  Synthetic
tttaugacaaaagttguggacaggt

SEQ ID NO: 14804 - DNA, 23 bp, Artificial Sequence
  Synthetic
aaagaatggucctgcaccaguaa

SEQ ID NO: 14805 - DNA, 29 bp, Artificial Sequence
  Synthetic
tgaatataaacttguggtagttggagcug

SEQ ID NO: 14806 - DNA, 25 bp, Artificial Sequence
  Synthetic
agccttaugtacgtctaugaggaca

SEQ ID NO: 14807 - DNA, 18 bp, Artificial Sequence
  Synthetic
gctgcugcccagaccauc

SEQ ID NO: 14808 - DNA, 17 bp, Artificial Sequence
  Synthetic
cgucacgacgcccucat

SEQ ID NO: 14809 - DNA, 17 bp, Artificial Sequence
  Synthetic
gctcgggucccttccut

SEQ ID NO: 14810 - DNA, 20 bp, Artificial Sequence
  Synthetic
cctcatcuccactccaccug

SEQ ID NO: 14811 - DNA, 17 bp, Artificial Sequence
  Synthetic
cggcgcggutcttcuct

SEQ ID NO: 14812 - DNA, 20 bp, Artificial Sequence
  Synthetic
ccuatccctacucggcccaa

SEQ ID NO: 14813 - DNA, 19 bp, Artificial Sequence
  Synthetic
gatctcggugacgguggaa

SEQ ID NO: 14814 - DNA, 22 bp, Artificial Sequence
  Synthetic
cgtttctucgacaacgccuact

SEQ ID NO: 14815 - DNA, 22 bp, Artificial Sequence
  Synthetic
gggatttgtgutctcctccuca

SEQ ID NO: 14816 - DNA, 22 bp, Artificial Sequence
  Synthetic
tctcgggaaaucctctgctgua

SEQ ID NO: 14817 - DNA, 17 bp, Artificial Sequence
  Synthetic
ccuggccacaguccagt

SEQ ID NO: 14818 - DNA, 25 bp, Artificial Sequence
  Synthetic
accagcuccaagaagaaaacatcuc

SEQ ID NO: 14819 - DNA, 28 bp, Artificial Sequence
  Synthetic
acacctgauaggtttctataucggagaa

SEQ ID NO: 14820 - DNA, 20 bp, Artificial Sequence
  Synthetic
cccggautagtgcguacgag

SEQ ID NO: 14821 - DNA, 21 bp, Artificial Sequence
  Synthetic
ccagtaccugctccucaccat

SEQ ID NO: 14822 - DNA, 33 bp, Artificial Sequence
  Synthetic
caactaacatttagutttctttaatgcucagaa

SEQ ID NO: 14823 - DNA, 24 bp, Artificial Sequence
  Synthetic
gcacgccaaacaaauctccuagaa

SEQ ID NO: 14824 - DNA, 25 bp, Artificial Sequence
  Synthetic
tcaggtacauctgtgagugagaaca

SEQ ID NO: 14825 - DNA, 29 bp, Artificial Sequence
  Synthetic
accagtaagcuaacttgttgtaaauaacc

SEQ ID NO: 14826 - DNA, 26 bp, Artificial Sequence
  Synthetic
acgccacaaauctgatagtattuccc

SEQ ID NO: 14827 - DNA, 26 bp, Artificial Sequence
  Synthetic
actttgaacaguaagagtcttgccut

SEQ ID NO: 14828 - DNA, 23 bp, Artificial Sequence
  Synthetic
caaagttgcuagcattcctguga

SEQ ID NO: 14829 - DNA, 22 bp, Artificial Sequence
  Synthetic
ctgtugcaatgtgauggaaggg

SEQ ID NO: 14830 - DNA, 28 bp, Artificial Sequence
  Synthetic
ccaagaagaugtgaaagagttugaaagg

SEQ ID NO: 14831 - DNA, 26 bp, Artificial Sequence
  Synthetic
catggacaaugcaaccattttuaggt

SEQ ID NO: 14832 - DNA, 17 bp, Artificial Sequence
  Synthetic
cuagcgtgguggacccg

SEQ ID NO: 14833 - DNA, 20 bp, Artificial Sequence
  Synthetic
ccttcuccagccaggaggua

SEQ ID NO: 14834 - DNA, 18 bp, Artificial Sequence
  Synthetic
ctucacgccacccaucct

SEQ ID NO: 14835 - DNA, 18 bp, Artificial Sequence
  Synthetic
gccccuctaggctcucct

SEQ ID NO: 14836 - DNA, 21 bp, Artificial Sequence
  Synthetic
tgatugaagagcccacaggug

SEQ ID NO: 14837 - DNA, 21 bp, Artificial Sequence
  Synthetic
ctcctcctugctagggttcut

SEQ ID NO: 14838 - DNA, 17 bp, Artificial Sequence
  Synthetic
cctuccggcacaagcug

SEQ ID NO: 14839 - DNA, 17 bp, Artificial Sequence
  Synthetic
cccaccutcccacgugt

SEQ ID NO: 14840 - DNA, 20 bp, Artificial Sequence
  Synthetic
acagctuggagcagacaucc

SEQ ID NO: 14841 - DNA, 19 bp, Artificial Sequence
  Synthetic
cccauccccaccagctuac

SEQ ID NO: 14842 - DNA, 17 bp, Artificial Sequence
  Synthetic
gcucaggaggctgcuct

SEQ ID NO: 14843 - DNA, 17 bp, Artificial Sequence
  Synthetic
tgcaggugctggaugct

SEQ ID NO: 14844 - DNA, 20 bp, Artificial Sequence
  Synthetic
atggcctctucctcccagua

SEQ ID NO: 14845 - DNA, 20 bp, Artificial Sequence
  Synthetic
gatgcaucagagcagagugg

SEQ ID NO: 14846 - DNA, 25 bp, Artificial Sequence
  Synthetic
caaatccauctctctgcugaaaggt

SEQ ID NO: 14847 - DNA, 24 bp, Artificial Sequence
  Synthetic
cgcataacaugtgcatctacauca

SEQ ID NO: 14848 - DNA, 19 bp, Artificial Sequence
  Synthetic
ccagcagcugcccaactua

SEQ ID NO: 14849 - DNA, 25 bp, Artificial Sequence
  Synthetic
cttatctccuctgggtttuccacag

SEQ ID NO: 14850 - DNA, 27 bp, Artificial Sequence
  Synthetic
aaaaggagcauaccgacttaaatucca

SEQ ID NO: 14851 - DNA, 29 bp, Artificial Sequence
  Synthetic
caaaagtgaagacuggctctatttuacag

SEQ ID NO: 14852 - DNA, 28 bp, Artificial Sequence
  Synthetic
gggtaaaaacugaaattgtgttcctuga

SEQ ID NO: 14853 - DNA, 30 bp, Artificial Sequence
  Synthetic
ttgctttgtgtaugcctataattgaaacug

SEQ ID NO: 14854 - DNA, 23 bp, Artificial Sequence
  Synthetic
agacaaatggugagtacgugcat

SEQ ID NO: 14855 - DNA, 32 bp, Artificial Sequence
  Synthetic
ctcagataatgaguacttctacgttgattuca

SEQ ID NO: 14856 - DNA, 27 bp, Artificial Sequence
  Synthetic
ggaattcctgauggtggaataucacaa

SEQ ID NO: 14857 - DNA, 23 bp, Artificial Sequence
  Synthetic
tgggtgucgagcagtactcuaaa

SEQ ID NO: 14858 - DNA, 30 bp, Artificial Sequence
  Synthetic
aatcaaattcucggcaatttaacttactuc

SEQ ID NO: 14859 - DNA, 28 bp, Artificial Sequence
  Synthetic
gcatatccaagutttgcaatcauaagca

SEQ ID NO: 14860 - DNA, 26 bp, Artificial Sequence
  Synthetic
ccacacuacagcgactaaaaauagga

SEQ ID NO: 14861 - DNA, 29 bp, Artificial Sequence
  Synthetic
actatgatacggautctgtttgctttugt

SEQ ID NO: 14862 - DNA, 24 bp, Artificial Sequence
  Synthetic
ctgatagttgcuaagaaccgguca

SEQ ID NO: 14863 - DNA, 27 bp, Artificial Sequence
  Synthetic
ccagcugttgtuaaaaaggaggaaaaa

SEQ ID NO: 14864 - DNA, 28 bp, Artificial Sequence
  Synthetic
cctttgaaauattgtggtatuccaggct

SEQ ID NO: 14865 - DNA, 24 bp, Artificial Sequence
  Synthetic
acccaagcuggagaatacctacut

SEQ ID NO: 14866 - DNA, 23 bp, Artificial Sequence
  Synthetic
gagaagcccauttagccatggua

SEQ ID NO: 14867 - DNA, 28 bp, Artificial Sequence
  Synthetic
gcctgtgaucaagtgtgttttaaucaat

SEQ ID NO: 14868 - DNA, 21 bp, Artificial Sequence
  Synthetic
aggaccaccgagutgtaguct

SEQ ID NO: 14869 - DNA, 19 bp, Artificial Sequence
  Synthetic
gggctguctgatgucagca

SEQ ID NO: 14870 - DNA, 31 bp, Artificial Sequence
  Synthetic
aagtttgagaaagaaaucttacctgacauca

SEQ ID NO: 14871 - DNA, 26 bp, Artificial Sequence
  Synthetic
ccaatcaaugccatacugacaggaaa

SEQ ID NO: 14872 - DNA, 22 bp, Artificial Sequence
  Synthetic
ggugaaaagcgagctgucagat

SEQ ID NO: 14873 - DNA, 20 bp, Artificial Sequence
  Synthetic
tttccacautgtcucccgca

SEQ ID NO: 14874 - DNA, 26 bp, Artificial Sequence
  Synthetic
cccugguagagaagaaaaacaguaaa

SEQ ID NO: 14875 - DNA, 26 bp, Artificial Sequence
  Synthetic
acagttacggutctaatgcttuccag

SEQ ID NO: 14876 - DNA, 20 bp, Artificial Sequence
  Synthetic
ggcccuccccttctccatua

SEQ ID NO: 14877 - DNA, 23 bp, Artificial Sequence
  Synthetic
actcttccutgcttcucacacag

SEQ ID NO: 14878 - DNA, 23 bp, Artificial Sequence
  Synthetic
agggtccaacauttgtttgccua

SEQ ID NO: 14879 - DNA, 23 bp, Artificial Sequence
  Synthetic
tcactctaacaugcacctgtgug

SEQ ID NO: 14880 - DNA, 32 bp, Artificial Sequence
  Synthetic
gctgatgaaagaugagaaataataaauggaag

SEQ ID NO: 14881 - DNA, 23 bp, Artificial Sequence
  Synthetic
ccatcagcagutccaccacttua

SEQ ID NO: 14882 - DNA, 22 bp, Artificial Sequence
  Synthetic
ctttttgtugcagtgcucacct

SEQ ID NO: 14883 - DNA, 25 bp, Artificial Sequence
  Synthetic
aggagcacuccatcactcttaauct

SEQ ID NO: 14884 - DNA, 30 bp, Artificial Sequence
  Synthetic
aaattctgaatagccauttccttgtaatug

SEQ ID NO: 14885 - DNA, 25 bp, Artificial Sequence
  Synthetic
cgtatttgacgauctctcctgtcut

SEQ ID NO: 14886 - DNA, 21 bp, Artificial Sequence
  Synthetic
ggtgccagaaccacutgatug

SEQ ID NO: 14887 - DNA, 23 bp, Artificial Sequence
  Synthetic
ctcttgacttcugtcccgttcut

SEQ ID NO: 14888 - DNA, 26 bp, Artificial Sequence
  Synthetic
cttcactttcauagagagccgguaag

SEQ ID NO: 14889 - DNA, 20 bp, Artificial Sequence
  Synthetic
cctccctgaaugaggcccua

SEQ ID NO: 14890 - DNA, 25 bp, Artificial Sequence
  Synthetic
gguagcagtacaatugaggacaaga

SEQ ID NO: 14891 - DNA, 23 bp, Artificial Sequence
  Synthetic
tgaacauaagccgaagtgctcug

SEQ ID NO: 14892 - DNA, 26 bp, Artificial Sequence
  Synthetic
gctcccttccutcagtcatgtgtaua

SEQ ID NO: 14893 - DNA, 22 bp, Artificial Sequence
  Synthetic
actgtggcaaugcctaccauac

SEQ ID NO: 14894 - DNA, 23 bp, Artificial Sequence
  Synthetic
gccttaggcauggcaactagaut

SEQ ID NO: 14895 - DNA, 32 bp, Artificial Sequence
  Synthetic
caggatctagtucaggttcaaaatuaaaagat

SEQ ID NO: 14896 - DNA, 26 bp, Artificial Sequence
  Synthetic
tctttttcuaaaaggagtgccaucca

SEQ ID NO: 14897 - DNA, 27 bp, Artificial Sequence
  Synthetic
ggtaaagcccucttgtcttatctctut

SEQ ID NO: 14898 - DNA, 21 bp, Artificial Sequence
  Synthetic
gtgauccccagagccaguaag

SEQ ID NO: 14899 - DNA, 24 bp, Artificial Sequence
  Synthetic
cctcatugccctatctggugaaag

SEQ ID NO: 14900 - DNA, 25 bp, Artificial Sequence
  Synthetic
tcattccgaaugatggattccaugt

SEQ ID NO: 14901 - DNA, 20 bp, Artificial Sequence
  Synthetic
ccaccccaugcagatgagug

SEQ ID NO: 14902 - DNA, 24 bp, Artificial Sequence
  Synthetic
cagaagucagcaactcctucaaga

SEQ ID NO: 14903 - DNA, 23 bp, Artificial Sequence
  Synthetic
ttgaatucacccagcccaaacua

SEQ ID NO: 14904 - DNA, 23 bp, Artificial Sequence
  Synthetic
catcctgtucggtcataaugggt

SEQ ID NO: 14905 - DNA, 22 bp, Artificial Sequence
  Synthetic
agttttccaaauggccugcaag

SEQ ID NO: 14906 - DNA, 18 bp, Artificial Sequence
  Synthetic
cctgcuccgcacctucag

SEQ ID NO: 14907 - DNA, 21 bp, Artificial Sequence
  Synthetic
caagagcgugccctactucaa

SEQ ID NO: 14908 - DNA, 17 bp, Artificial Sequence
  Synthetic
ctggagguggccgagut

SEQ ID NO: 14909 - DNA, 18 bp, Artificial Sequence
  Synthetic
cccctctuggctctccug

SEQ ID NO: 14910 - DNA, 24 bp, Artificial Sequence
  Synthetic
cctcttcatucctttccccaugag

SEQ ID NO: 14911 - DNA, 27 bp, Artificial Sequence
  Synthetic
ctcaggctcuccttatttttcctctut

SEQ ID NO: 14912 - DNA, 30 bp, Artificial Sequence
  Synthetic
accttgaaactagagauggatgaactttuc

SEQ ID NO: 14913 - DNA, 23 bp, Artificial Sequence
  Synthetic
agcaacugttcuccagaaagcat

SEQ ID NO: 14914 - DNA, 24 bp, Artificial Sequence
  Synthetic
gcggtttguttactctgtuccagt

SEQ ID NO: 14915 - DNA, 23 bp, Artificial Sequence
  Synthetic
atgtaagaaagugtcuggcccat

SEQ ID NO: 14916 - DNA, 22 bp, Artificial Sequence
  Synthetic
ccagtcauggaactccagaauc

SEQ ID NO: 14917 - DNA, 24 bp, Artificial Sequence
  Synthetic
gcuccaaaaggagaugaagaaggt

SEQ ID NO: 14918 - DNA, 28 bp, Artificial Sequence
  Synthetic
tgagaatttcugacatcttcctccuaca

SEQ ID NO: 14919 - DNA, 23 bp, Artificial Sequence
  Synthetic
ccttatctggucctgggactuct

SEQ ID NO: 14920 - DNA, 22 bp, Artificial Sequence
  Synthetic
acatgccgacaaucaggaucat

SEQ ID NO: 14921 - DNA, 27 bp, Artificial Sequence
  Synthetic
ctctctgcugggaatgagaattuaaga

SEQ ID NO: 14922 - DNA, 28 bp, Artificial Sequence
  Synthetic
gccatcaggtttuctgtaatttctcgua

SEQ ID NO: 14923 - DNA, 24 bp, Artificial Sequence
  Synthetic
ctctaaaagcugttgcctgaaucg

SEQ ID NO: 14924 - DNA, 30 bp, Artificial Sequence
  Synthetic
agtaattttcctcutcttctggctttucat

SEQ ID NO: 14925 - DNA, 28 bp, Artificial Sequence
  Synthetic
ggaggtttccatuctggatttctttcut

SEQ ID NO: 14926 - DNA, 27 bp, Artificial Sequence
  Synthetic
gtagaacctgucccagttacuaaacag

SEQ ID NO: 14927 - DNA, 28 bp, Artificial Sequence
  Synthetic
acagaatatcucaattccaagcuccaaa

SEQ ID NO: 14928 - DNA, 27 bp, Artificial Sequence
  Synthetic
gatgaaccccutattcatgcaacuact

SEQ ID NO: 14929 - DNA, 25 bp, Artificial Sequence
  Synthetic
ctttgtcagttucggtcttcagtut

SEQ ID NO: 14930 - DNA, 26 bp, Artificial Sequence
  Synthetic
ccatggtgtauatgtgccacattuca

SEQ ID NO: 14931 - DNA, 25 bp, Artificial Sequence
  Synthetic
gcagcgaguaacttgtccttttcut

SEQ ID NO: 14932 - DNA, 21 bp, Artificial Sequence
  Synthetic
cagcaagtucgtgagcagaug

SEQ ID NO: 14933 - DNA, 30 bp, Artificial Sequence
  Synthetic
gatgattcaagaaaauactctgccatucaa

SEQ ID NO: 14934 - DNA, 22 bp, Artificial Sequence
  Synthetic
cugagagaaggugggaagaagt

SEQ ID NO: 14935 - DNA, 31 bp, Artificial Sequence
  Synthetic
ccaaaatgccaaautatactttctucacaga

SEQ ID NO: 14936 - DNA, 33 bp, Artificial Sequence
  Synthetic
aagctttctctuaaatacttttatgtugacact

SEQ ID NO: 14937 - DNA, 28 bp, Artificial Sequence
  Synthetic
acaagtatcagutagtggtgacuacaca

SEQ ID NO: 14938 - DNA, 33 bp, Artificial Sequence
  Synthetic
taaatgctatttttccutgttctaggatauaca

SEQ ID NO: 14939 - DNA, 28 bp, Artificial Sequence
  Synthetic
gaaattcugagatcaatgcucaaaagca

SEQ ID NO: 14940 - DNA, 28 bp, Artificial Sequence
  Synthetic
tgttcaaaaacccautcaaatgatugct

SEQ ID NO: 14941 - DNA, 29 bp, Artificial Sequence
  Synthetic
gagtctgtagctuctgaacttctgattut

SEQ ID NO: 14942 - DNA, 26 bp, Artificial Sequence
  Synthetic
ttcctattuccaggtttctttugcct

SEQ ID NO: 14943 - DNA, 29 bp, Artificial Sequence
  Synthetic
tcccaactgcacaauaaaactagattuct

SEQ ID NO: 14944 - DNA, 30 bp, Artificial Sequence
  Synthetic
ggaagtggtuacaggtgagaaatuaaaaac

SEQ ID NO: 14945 - DNA, 23 bp, Artificial Sequence
  Synthetic
tgctacttccugaacatgtgcut

SEQ ID NO: 14946 - DNA, 25 bp, Artificial Sequence
  Synthetic
gtttaagtcccaaautgagcagcut

SEQ ID NO: 14947 - DNA, 29 bp, Artificial Sequence
  Synthetic
gcagaaatggcaaaaauactcatatguca

SEQ ID NO: 14948 - DNA, 29 bp, Artificial Sequence
  Synthetic
atttaaatgcagugcaaaatactgaugaa

SEQ ID NO: 14949 - DNA, 22 bp, Artificial Sequence
  Synthetic
tgttcacuttgtccugcagcat

SEQ ID NO: 14950 - DNA, 23 bp, Artificial Sequence
  Synthetic
tcgttcttugcaggttcuagagc

SEQ ID NO: 14951 - DNA, 25 bp, Artificial Sequence
  Synthetic
ggccaugaaggaagaaggtaaugat

SEQ ID NO: 14952 - DNA, 28 bp, Artificial Sequence
  Synthetic
agtgtgttaacttutcctttgttgcaut

SEQ ID NO: 14953 - DNA, 31 bp, Artificial Sequence
  Synthetic
agaagcaagttugaaaagattctgttguaag

SEQ ID NO: 14954 - DNA, 29 bp, Artificial Sequence
  Synthetic
gagaggagcttutatcttctacaaaauga

SEQ ID NO: 14955 - DNA, 28 bp, Artificial Sequence
  Synthetic
tgtctccagcagcutttactattttuga

SEQ ID NO: 14956 - DNA, 26 bp, Artificial Sequence
  Synthetic
gagagcttagguatcctggaaaagut

SEQ ID NO: 14957 - DNA, 31 bp, Artificial Sequence
  Synthetic
gggcttattatauggaaagtcatgtuagaga

SEQ ID NO: 14958 - DNA, 28 bp, Artificial Sequence
  Synthetic
gtcttttggucagcaatagcttaaauga

SEQ ID NO: 14959 - DNA, 29 bp, Artificial Sequence
  Synthetic
gcacaatacucacaaagaaggatcttgua

SEQ ID NO: 14960 - DNA, 28 bp, Artificial Sequence
  Synthetic
cctgatagautggtgtgaugaaaaggaa

SEQ ID NO: 14961 - DNA, 33 bp, Artificial Sequence
  Synthetic
ccatgattagtutaatccttgaataugaaaagg

SEQ ID NO: 14962 - DNA, 26 bp, Artificial Sequence
  Synthetic
augcaaatccaaaaucacgaaacagt

SEQ ID NO: 14963 - DNA, 23 bp, Artificial Sequence
  Synthetic
ggcatcacguaaaaggtcaaugg

SEQ ID NO: 14964 - DNA, 26 bp, Artificial Sequence
  Synthetic
ccatccctgguctcatcaattatucc

SEQ ID NO: 14965 - DNA, 27 bp, Artificial Sequence
  Synthetic
tcttccatatgutacagcctatcucca

SEQ ID NO: 14966 - DNA, 26 bp, Artificial Sequence
  Synthetic
gccactttutaatcagtgtuacagca

SEQ ID NO: 14967 - DNA, 22 bp, Artificial Sequence
  Synthetic
ggagtcatcuccaggactguga

SEQ ID NO: 14968 - DNA, 27 bp, Artificial Sequence
  Synthetic
tccaattttaggutcttgttccaugct

SEQ ID NO: 14969 - DNA, 24 bp, Artificial Sequence
  Synthetic
gcctttcaggccuatcaatcucac

SEQ ID NO: 14970 - DNA, 29 bp, Artificial Sequence
  Synthetic
gaaaatgttgttcuctaatcacactgcut

SEQ ID NO: 14971 - DNA, 28 bp, Artificial Sequence
  Synthetic
acttattaactucaacctctgugacacc

SEQ ID NO: 14972 - DNA, 24 bp, Artificial Sequence
  Synthetic
aggcgatguagttttaagtuggca

SEQ ID NO: 14973 - DNA, 21 bp, Artificial Sequence
  Synthetic
catggauacaccccctgaugt

SEQ ID NO: 14974 - DNA, 23 bp, Artificial Sequence
  Synthetic
cttccgucacattctgauaccca

SEQ ID NO: 14975 - DNA, 23 bp, Artificial Sequence
  Synthetic
aacaaagagautgcaggugacca

SEQ ID NO: 14976 - DNA, 22 bp, Artificial Sequence
  Synthetic
gtcuacaagggcccaactguat

SEQ ID NO: 14977 - DNA, 24 bp, Artificial Sequence
  Synthetic
ccacgtacugttctgtcttuggag

SEQ ID NO: 14978 - DNA, 22 bp, Artificial Sequence
  Synthetic
agtcatcccucagccagagaut

SEQ ID NO: 14979 - DNA, 28 bp, Artificial Sequence
  Synthetic
gaaacaggtattgaugaagatgacccua

SEQ ID NO: 14980 - DNA, 25 bp, Artificial Sequence
  Synthetic
gtctcaataauggaatggucagggt

SEQ ID NO: 14981 - DNA, 25 bp, Artificial Sequence
  Synthetic
gacatctccaugctgtattgucaca

SEQ ID NO: 14982 - DNA, 21 bp, Artificial Sequence
  Synthetic
aagtuccaggccttcttuggt

SEQ ID NO: 14983 - DNA, 21 bp, Artificial Sequence
  Synthetic
cagcctttguggaacgtctuc

SEQ ID NO: 14984 - DNA, 25 bp, Artificial Sequence
  Synthetic
gtagutctctttatctuccgccagt

SEQ ID NO: 14985 - DNA, 23 bp, Artificial Sequence
  Synthetic
gactcggaggauctccctcuaaa

SEQ ID NO: 14986 - DNA, 21 bp, Artificial Sequence
  Synthetic
caagctugaagcacccaucag

SEQ ID NO: 14987 - DNA, 28 bp, Artificial Sequence
  Synthetic
cgaucaagaagagcucaacaaaacaaag

SEQ ID NO: 14988 - DNA, 24 bp, Artificial Sequence
  Synthetic
cctccaagtacucagtttggtcut

SEQ ID NO: 14989 - DNA, 24 bp, Artificial Sequence
  Synthetic
aacggcaaaccutgctttauagac

SEQ ID NO: 14990 - DNA, 28 bp, Artificial Sequence
  Synthetic
cagctcttucccagagtctaatttacug

SEQ ID NO: 14991 - DNA, 22 bp, Artificial Sequence
  Synthetic
acccagaaucggattttggtut

SEQ ID NO: 14992 - DNA, 27 bp, Artificial Sequence
  Synthetic
ccagtagccuaagcaatataaauggct

SEQ ID NO: 14993 - DNA, 22 bp, Artificial Sequence
  Synthetic
tctctggcauctgatggtguct

SEQ ID NO: 14994 - DNA, 29 bp, Artificial Sequence
  Synthetic
ctttcataaaaccuctctttctuccacct

SEQ ID NO: 14995 - DNA, 22 bp, Artificial Sequence
  Synthetic
caccauagaagcccacgatgua

SEQ ID NO: 14996 - DNA, 23 bp, Artificial Sequence
  Synthetic
agatcaagcuctgtgacttuggg

SEQ ID NO: 14997 - DNA, 22 bp, Artificial Sequence
  Synthetic
cctctcccugaccguacaagaa

SEQ ID NO: 14998 - DNA, 23 bp, Artificial Sequence
  Synthetic
caaggagccaggcauttttctua

SEQ ID NO: 14999 - DNA, 25 bp, Artificial Sequence
  Synthetic
guatacgctuccagagaacaaggag

SEQ ID NO: 15000 - DNA, 29 bp, Artificial Sequence
  Synthetic
acacatatgctttuaaaaacatctggcut

SEQ ID NO: 15001 - DNA, 17 bp, Artificial Sequence
  Synthetic
cccugggcaggcaguag

SEQ ID NO: 15002 - DNA, 17 bp, Artificial Sequence
  Synthetic
cccaugccctgcacuca

SEQ ID NO: 15003 - DNA, 23 bp, Artificial Sequence
  Synthetic
gcccugagagaaaggctttcuac

SEQ ID NO: 15004 - DNA, 22 bp, Artificial Sequence
  Synthetic
tcatguacagcggccatttcut

SEQ ID NO: 15005 - DNA, 19 bp, Artificial Sequence
  Synthetic
ggguaccgttccuggagag

SEQ ID NO: 15006 - DNA, 24 bp, Artificial Sequence
  Synthetic
cgtgggatguttttgcagatgaug

SEQ ID NO: 15007 - DNA, 21 bp, Artificial Sequence
  Synthetic
gctgcagugggaccactatua

SEQ ID NO: 15008 - DNA, 17 bp, Artificial Sequence
  Synthetic
ggcugctctugcgaggt

SEQ ID NO: 15009 - DNA, 18 bp, Artificial Sequence
  Synthetic
cctgctcgutcgctcucc

SEQ ID NO: 15010 - DNA, 26 bp, Artificial Sequence
  Synthetic
cattggguagaaaagaaauggauact

SEQ ID NO: 15011 - DNA, 27 bp, Artificial Sequence
  Synthetic
gaatatactuaaccgggctccttctug

SEQ ID NO: 15012 - DNA, 20 bp, Artificial Sequence
  Synthetic
ccttgtacugctcggccauc

SEQ ID NO: 15013 - DNA, 22 bp, Artificial Sequence
  Synthetic
cgcugaaaccacctgtttucct

SEQ ID NO: 15014 - DNA, 17 bp, Artificial Sequence
  Synthetic
cuccacccaugccccaa

SEQ ID NO: 15015 - DNA, 18 bp, Artificial Sequence
  Synthetic
cuggcagcugcagcaaag

SEQ ID NO: 15016 - DNA, 24 bp, Artificial Sequence
  Synthetic
ccatttcggcuttgagcatttugt

SEQ ID NO: 15017 - DNA, 24 bp, Artificial Sequence
  Synthetic
agucgaggagaaaaacauctctuc

SEQ ID NO: 15018 - DNA, 23 bp, Artificial Sequence
  Synthetic
ctccttcuggaacctcttctucc

SEQ ID NO: 15019 - DNA, 22 bp, Artificial Sequence
  Synthetic
gtcttcgctuctcagagtcugt

SEQ ID NO: 15020 - DNA, 17 bp, Artificial Sequence
  Synthetic
ctgcgccuccagctuct

SEQ ID NO: 15021 - DNA, 20 bp, Artificial Sequence
  Synthetic
acagccuccctgttauccct

SEQ ID NO: 15022 - DNA, 21 bp, Artificial Sequence
  Synthetic
cgaggtcucgcttctgcttut

SEQ ID NO: 15023 - DNA, 21 bp, Artificial Sequence
  Synthetic
ggttcattcugctgggtcuct

SEQ ID NO: 15024 - DNA, 27 bp, Artificial Sequence
  Synthetic
tggtttacctuccagttctgaaaucat

SEQ ID NO: 15025 - DNA, 23 bp, Artificial Sequence
  Synthetic
ggaacgaaaacucctugaggaga

SEQ ID NO: 15026 - DNA, 21 bp, Artificial Sequence
  Synthetic
cctgugacacctuaccagcat

SEQ ID NO: 15027 - DNA, 21 bp, Artificial Sequence
  Synthetic
tgtaugcagaggcugaggaga

SEQ ID NO: 15028 - DNA, 20 bp, Artificial Sequence
  Synthetic
ccacctccugtcccaaaugt

SEQ ID NO: 15029 - DNA, 20 bp, Artificial Sequence
  Synthetic
ctgaccgccaugaaggugat

SEQ ID NO: 15030 - DNA, 20 bp, Artificial Sequence
  Synthetic
ggaggtctcuggtggactuc

SEQ ID NO: 15031 - DNA, 22 bp, Artificial Sequence
  Synthetic
ggaggaatggaugctggaggua

SEQ ID NO: 15032 - DNA, 22 bp, Artificial Sequence
  Synthetic
gggtgttcaautctccagcuca

SEQ ID NO: 15033 - DNA, 22 bp, Artificial Sequence
  Synthetic
gcctggcugaccaagaataugg

SEQ ID NO: 15034 - DNA, 17 bp, Artificial Sequence
  Synthetic
ctcaccggucgcucgat

SEQ ID NO: 15035 - DNA, 22 bp, Artificial Sequence
  Synthetic
gctgugcatcaacuacaccaac

SEQ ID NO: 15036 - DNA, 27 bp, Artificial Sequence
  Synthetic
tcattacctgttcutttgtctgagcut

SEQ ID NO: 15037 - DNA, 26 bp, Artificial Sequence
  Synthetic
tcacgatgttucttttctccauccag

SEQ ID NO: 15038 - DNA, 21 bp, Artificial Sequence
  Synthetic
ggaaggcucaagccauccaat

SEQ ID NO: 15039 - DNA, 23 bp, Artificial Sequence
  Synthetic
gaatcccuaactcccuccaaacc

SEQ ID NO: 15040 - DNA, 23 bp, Artificial Sequence
  Synthetic
ttggctaaaucatggcctcugat

SEQ ID NO: 15041 - DNA, 24 bp, Artificial Sequence
  Synthetic
agatgatgtucccgtgtcttucag

SEQ ID NO: 15042 - DNA, 17 bp, Artificial Sequence
  Synthetic
tcagcuccgccatgucc

SEQ ID NO: 15043 - DNA, 18 bp, Artificial Sequence
  Synthetic
gguccccucggagaagca

SEQ ID NO: 15044 - DNA, 18 bp, Artificial Sequence
  Synthetic
gcctctcuccccacugac

SEQ ID NO: 15045 - DNA, 19 bp, Artificial Sequence
  Synthetic
gtgaggcccggcuactuac

SEQ ID NO: 15046 - DNA, 23 bp, Artificial Sequence
  Synthetic
cctttcaacgugactgtgaccut

SEQ ID NO: 15047 - DNA, 22 bp, Artificial Sequence
  Synthetic
cactgauccccacattccucac

SEQ ID NO: 15048 - DNA, 23 bp, Artificial Sequence
  Synthetic
gcttctccucctgcttgtcauag

SEQ ID NO: 15049 - DNA, 25 bp, Artificial Sequence
  Synthetic
accatgaugacagtcatgtttucca

SEQ ID NO: 15050 - DNA, 21 bp, Artificial Sequence
  Synthetic
cucacggagcuacaagaacca

SEQ ID NO: 15051 - DNA, 22 bp, Artificial Sequence
  Synthetic
gcatcuagcacagtcactgugt

SEQ ID NO: 15052 - DNA, 17 bp, Artificial Sequence
  Synthetic
ctggccggccuggauat

SEQ ID NO: 15053 - DNA, 20 bp, Artificial Sequence
  Synthetic
ggaggaaugaccacccacug

SEQ ID NO: 15054 - DNA, 26 bp, Artificial Sequence
  Synthetic
tcctttttatucatcagtgctugagt

SEQ ID NO: 15055 - DNA, 23 bp, Artificial Sequence
  Synthetic
actcuggaagcccaaaaauagca

SEQ ID NO: 15056 - DNA, 20 bp, Artificial Sequence
  Synthetic
ccagggatauggctcgacug

SEQ ID NO: 15057 - DNA, 23 bp, Artificial Sequence
  Synthetic
aattcaccccuctttucaagcct

SEQ ID NO: 15058 - DNA, 26 bp, Artificial Sequence
  Synthetic
cttttcucacaggtaactauggccaa

SEQ ID NO: 15059 - DNA, 17 bp, Artificial Sequence
  Synthetic
ccacggucctgctgucc

SEQ ID NO: 15060 - DNA, 23 bp, Artificial Sequence
  Synthetic
aaacaaccttutgtagccgtugg

SEQ ID NO: 15061 - DNA, 27 bp, Artificial Sequence
  Synthetic
tgcaaatgaacaaucagacaaagcaut

SEQ ID NO: 15062 - DNA, 23 bp, Artificial Sequence
  Synthetic
gagaggcaacgguctctttugat

SEQ ID NO: 15063 - DNA, 25 bp, Artificial Sequence
  Synthetic
gttggaagacucaaaagaacccuca

SEQ ID NO: 15064 - DNA, 22 bp, Artificial Sequence
  Synthetic
gctccagacugattgtctucct

SEQ ID NO: 15065 - DNA, 22 bp, Artificial Sequence
  Synthetic
gcaccagguctgcctttctuac

SEQ ID NO: 15066 - DNA, 22 bp, Artificial Sequence
  Synthetic
cutctauaaaaggcgcccgaag

SEQ ID NO: 15067 - DNA, 19 bp, Artificial Sequence
  Synthetic
gttcgguctcggacuccat

SEQ ID NO: 15068 - DNA, 27 bp, Artificial Sequence
  Synthetic
cttctgaatguttttaagcacucacca

SEQ ID NO: 15069 - DNA, 24 bp, Artificial Sequence
  Synthetic
gutaccatcaugaagaggcagaca

SEQ ID NO: 15070 - DNA, 22 bp, Artificial Sequence
  Synthetic
gtcctggtutctccggtuacac

SEQ ID NO: 15071 - DNA, 30 bp, Artificial Sequence
  Synthetic
acaggtaacauggataaaattccctucaat

SEQ ID NO: 15072 - DNA, 30 bp, Artificial Sequence
  Synthetic
cagctacattttcugtttttctcagtaucc

SEQ ID NO: 15073 - DNA, 28 bp, Artificial Sequence
  Synthetic
aaaagagcaaaauctgcttagtgugaac

SEQ ID NO: 15074 - DNA, 18 bp, Artificial Sequence
  Synthetic
cccagccaucgcaaacug

SEQ ID NO: 15075 - DNA, 27 bp, Artificial Sequence
  Synthetic
ttttgcttgcucacaaaagcataucat

SEQ ID NO: 15076 - DNA, 18 bp, Artificial Sequence
  Synthetic
gtggcgagcauggctcua

SEQ ID NO: 15077 - DNA, 17 bp, Artificial Sequence
  Synthetic
tggugagcagcggctuc

SEQ ID NO: 15078 - DNA, 17 bp, Artificial Sequence
  Synthetic
cgcgcguagccaucgaa

SEQ ID NO: 15079 - DNA, 25 bp, Artificial Sequence
  Synthetic
cctggaagacuactactggaugacc

SEQ ID NO: 15080 - DNA, 28 bp, Artificial Sequence
  Synthetic
ggttccttttucacttcaaacttcauca

SEQ ID NO: 15081 - DNA, 17 bp, Artificial Sequence
  Synthetic
ccuctccugcagcccat

SEQ ID NO: 15082 - DNA, 19 bp, Artificial Sequence
  Synthetic
gcgcgcuttgcauaaggaa

SEQ ID NO: 15083 - DNA, 20 bp, Artificial Sequence
  Synthetic
gaggcgagaagcaugaagug

SEQ ID NO: 15084 - DNA, 23 bp, Artificial Sequence
  Synthetic
ccgagcuacagctagaagaugaa

SEQ ID NO: 15085 - DNA, 20 bp, Artificial Sequence
  Synthetic
cccggagugccagtcaatut

SEQ ID NO: 15086 - DNA, 20 bp, Artificial Sequence
  Synthetic
gctgugccggaacattctut

SEQ ID NO: 15087 - DNA, 21 bp, Artificial Sequence
  Synthetic
cttgaagcuggtccagctcut

SEQ ID NO: 15088 - DNA, 21 bp, Artificial Sequence
  Synthetic
agaggacaccutggctgguaa

SEQ ID NO: 15089 - DNA, 29 bp, Artificial Sequence
  Synthetic
gccttatttagaaugacagcacagguaat

SEQ ID NO: 15090 - DNA, 20 bp, Artificial Sequence
  Synthetic
ggagacgugctgcagagaug

SEQ ID NO: 15091 - DNA, 22 bp, Artificial Sequence
  Synthetic
tcgacttcauactggccaagug

SEQ ID NO: 15092 - DNA, 25 bp, Artificial Sequence
  Synthetic
ctaccatcucagagttgaccaagug

SEQ ID NO: 15093 - DNA, 22 bp, Artificial Sequence
  Synthetic
ccaccaauacagccccttctut

SEQ ID NO: 15094 - DNA, 25 bp, Artificial Sequence
  Synthetic
ccctaatacagugtgtgctgcuaac

SEQ ID NO: 15095 - DNA, 22 bp, Artificial Sequence
  Synthetic
tttgctgttcuaggcaggacut

SEQ ID NO: 15096 - DNA, 23 bp, Artificial Sequence
  Synthetic
cctcttucaacacctcucggaag

SEQ ID NO: 15097 - DNA, 27 bp, Artificial Sequence
  Synthetic
cagttcctcaugttcagattgttcuca

SEQ ID NO: 15098 - DNA, 21 bp, Artificial Sequence
  Synthetic
cgactguggaagaagagcuca

SEQ ID NO: 15099 - DNA, 17 bp, Artificial Sequence
  Synthetic
guctgcgcucccagagg

SEQ ID NO: 15100 - DNA, 19 bp, Artificial Sequence
  Synthetic
gaggcagccaucaggtuct

SEQ ID NO: 15101 - DNA, 24 bp, Artificial Sequence
  Synthetic
caaagcagaatugcgatgtctgug

SEQ ID NO: 15102 - DNA, 27 bp, Artificial Sequence
  Synthetic
caaggutaggaaaauggaaaagcacaa

SEQ ID NO: 15103 - DNA, 30 bp, Artificial Sequence
  Synthetic
gctgacttaattguattgttttcctgugat

SEQ ID NO: 15104 - DNA, 27 bp, Artificial Sequence
  Synthetic
tcaactcaagagucaaaagaaacugga

SEQ ID NO: 15105 - DNA, 25 bp, Artificial Sequence
  Synthetic
gttctcattcugtgtcttcccugaa

SEQ ID NO: 15106 - DNA, 19 bp, Artificial Sequence
  Synthetic
ggaacgcagugaccaugct

SEQ ID NO: 15107 - DNA, 26 bp, Artificial Sequence
  Synthetic
gtctccttcuggaatacttgaucacc

SEQ ID NO: 15108 - DNA, 19 bp, Artificial Sequence
  Synthetic
caacugagcagccuccaca

SEQ ID NO: 15109 - DNA, 20 bp, Artificial Sequence
  Synthetic
ctctttcugctgcatuggca

SEQ ID NO: 15110 - DNA, 21 bp, Artificial Sequence
  Synthetic
ggctcctuccgctaaactcut

SEQ ID NO: 15111 - DNA, 29 bp, Artificial Sequence
  Synthetic
agaccatgatguccataaataacttuggt

SEQ ID NO: 15112 - DNA, 21 bp, Artificial Sequence
  Synthetic
caggtacuctgttgccuccat

SEQ ID NO: 15113 - DNA, 30 bp, Artificial Sequence
  Synthetic
ccctgttagagtutgctcagtatttatugg

SEQ ID NO: 15114 - DNA, 28 bp, Artificial Sequence
  Synthetic
tgaactagaatgautagcataggccuca

SEQ ID NO: 15115 - DNA, 22 bp, Artificial Sequence
  Synthetic
cctggccuggagcttgaattut

SEQ ID NO: 15116 - DNA, 20 bp, Artificial Sequence
  Synthetic
tcactugcagcagccactua

SEQ ID NO: 15117 - DNA, 21 bp, Artificial Sequence
  Synthetic
ctgcggcaugaaacagacaug

SEQ ID NO: 15118 - DNA, 21 bp, Artificial Sequence
  Synthetic
cgccttctugatgtcctccuc

SEQ ID NO: 15119 - DNA, 19 bp, Artificial Sequence
  Synthetic
gcuccgagctgtaugagca

SEQ ID NO: 15120 - DNA, 23 bp, Artificial Sequence
  Synthetic
gctgatttcccutcctcagugac

SEQ ID NO: 15121 - DNA, 26 bp, Artificial Sequence
  Synthetic
tgatgtgtgtugggttttctctctut

SEQ ID NO: 15122 - DNA, 18 bp, Artificial Sequence
  Synthetic
ccccucgggagccactua

SEQ ID NO: 15123 - DNA, 20 bp, Artificial Sequence
  Synthetic
cacccucagggaaccugaat

SEQ ID NO: 15124 - DNA, 20 bp, Artificial Sequence
  Synthetic
gactcaccautggtggucgt

SEQ ID NO: 15125 - DNA, 26 bp, Artificial Sequence
  Synthetic
tgtgacctuttctttcttcuccaaca

SEQ ID NO: 15126 - DNA, 17 bp, Artificial Sequence
  Synthetic
accugcagcagcgugat

SEQ ID NO: 15127 - DNA, 17 bp, Artificial Sequence
  Synthetic
caggcugcgctgugaac

SEQ ID NO: 15128 - DNA, 27 bp, Artificial Sequence
  Synthetic
gcactgaagtugaattttgcaaaucca

SEQ ID NO: 15129 - DNA, 27 bp, Artificial Sequence
  Synthetic
tctttgcttgagutgagcctttgatua

SEQ ID NO: 15130 - DNA, 32 bp, Artificial Sequence
  Synthetic
agtggaugaaaaagaauaaaaacaacttctua

SEQ ID NO: 15131 - DNA, 24 bp, Artificial Sequence
  Synthetic
cctgccaucttcatttgucccaat

SEQ ID NO: 15132 - DNA, 29 bp, Artificial Sequence
  Synthetic
gaagccttatguaacttaggaagaagcua

SEQ ID NO: 15133 - DNA, 24 bp, Artificial Sequence
  Synthetic
tgtctuggcaatagaguccacaag

SEQ ID NO: 15134 - DNA, 21 bp, Artificial Sequence
  Synthetic
agatccuccgcagctgaguaa

SEQ ID NO: 15135 - DNA, 22 bp, Artificial Sequence
  Synthetic
gtcccctucctccatguaaagt

SEQ ID NO: 15136 - DNA, 19 bp, Artificial Sequence
  Synthetic
cccagcccugatggttucc

SEQ ID NO: 15137 - DNA, 18 bp, Artificial Sequence
  Synthetic
gccucggagtcucggaac

SEQ ID NO: 15138 - DNA, 21 bp, Artificial Sequence
  Synthetic
cacagacaggutctggtuggt

SEQ ID NO: 15139 - DNA, 24 bp, Artificial Sequence
  Synthetic
gcagagtgucctttttgugagaag

SEQ ID NO: 15140 - DNA, 20 bp, Artificial Sequence
  Synthetic
cccaggaagutgcaccgaua

SEQ ID NO: 15141 - DNA, 22 bp, Artificial Sequence
  Synthetic
gggtttggguagtagagcaugg

SEQ ID NO: 15142 - DNA, 22 bp, Artificial Sequence
  Synthetic
gcuatcacaaaaucgggacgag

SEQ ID NO: 15143 - DNA, 18 bp, Artificial Sequence
  Synthetic
accctccgauctcggugt

SEQ ID NO: 15144 - DNA, 22 bp, Artificial Sequence
  Synthetic
ccgttcctcuggtgtaggaaug

SEQ ID NO: 15145 - DNA, 22 bp, Artificial Sequence
  Synthetic
ctggcagcuttggctuaaagag

SEQ ID NO: 15146 - DNA, 19 bp, Artificial Sequence
  Synthetic
caugtgggcucccacagag

SEQ ID NO: 15147 - DNA, 22 bp, Artificial Sequence
  Synthetic
acccgggauatatcagccauga

SEQ ID NO: 15148 - DNA, 20 bp, Artificial Sequence
  Synthetic
cctccgugcagaagagagug

SEQ ID NO: 15149 - DNA, 25 bp, Artificial Sequence
  Synthetic
aggtttcatggagucaataggcaut

SEQ ID NO: 15150 - DNA, 21 bp, Artificial Sequence
  Synthetic
agcttgctauggcatcgtuca

SEQ ID NO: 15151 - DNA, 21 bp, Artificial Sequence
  Synthetic
ctcagagucccctagcucaac

SEQ ID NO: 15152 - DNA, 23 bp, Artificial Sequence
  Synthetic
tggccuaaggaccatcaguagaa

SEQ ID NO: 15153 - DNA, 21 bp, Artificial Sequence
  Synthetic
aggtgacguggaaagcttguc

SEQ ID NO: 15154 - DNA, 23 bp, Artificial Sequence
  Synthetic
tgguttcatctcugggaggagaa

SEQ ID NO: 15155 - DNA, 23 bp, Artificial Sequence
  Synthetic
ggcttttugagccatgtttguga

SEQ ID NO: 15156 - DNA, 18 bp, Artificial Sequence
  Synthetic
caguacacgcgggagugg

SEQ ID NO: 15157 - DNA, 21 bp, Artificial Sequence
  Synthetic
ctgtgggcutggagtactugt

SEQ ID NO: 15158 - DNA, 20 bp, Artificial Sequence
  Synthetic
ccugagacaggccugaagga

SEQ ID NO: 15159 - DNA, 18 bp, Artificial Sequence
  Synthetic
cagcaguggcgguaaagc

SEQ ID NO: 15160 - DNA, 19 bp, Artificial Sequence
  Synthetic
ctctctccuccagccucct

SEQ ID NO: 15161 - DNA, 20 bp, Artificial Sequence
  Synthetic
tgucagtctguccccaacct

SEQ ID NO: 15162 - DNA, 18 bp, Artificial Sequence
  Synthetic
agtggucgggtcgacuga

SEQ ID NO: 15163 - DNA, 17 bp, Artificial Sequence
  Synthetic
cgtcgcccugcttcucc

SEQ ID NO: 15164 - DNA, 20 bp, Artificial Sequence
  Synthetic
ctgacugcagcctgugacat

SEQ ID NO: 15165 - DNA, 21 bp, Artificial Sequence
  Synthetic
ccttgagtcuccccctcctuc

SEQ ID NO: 15166 - DNA, 22 bp, Artificial Sequence
  Synthetic
cttgggatuaggagcaggagug

SEQ ID NO: 15167 - DNA, 18 bp, Artificial Sequence
  Synthetic
ctggagcugctgctctug

SEQ ID NO: 15168 - DNA, 17 bp, Artificial Sequence
  Synthetic
gctgctguctgcgggua

SEQ ID NO: 15169 - DNA, 19 bp, Artificial Sequence
  Synthetic
gcagtgaggacuggagguc

SEQ ID NO: 15170 - DNA, 20 bp, Artificial Sequence
  Synthetic
cgcugacaaaggagccucag

SEQ ID NO: 15171 - DNA, 19 bp, Artificial Sequence
  Synthetic
tctgggucaaggctcucca

SEQ ID NO: 15172 - DNA, 23 bp, Artificial Sequence
  Synthetic
gagaccugcaagatgacacugaa

SEQ ID NO: 15173 - DNA, 21 bp, Artificial Sequence
  Synthetic
gccaatgucaccttgcggtua

SEQ ID NO: 15174 - DNA, 24 bp, Artificial Sequence
  Synthetic
cgagcuccagagaaucaagaagac

SEQ ID NO: 15175 - DNA, 21 bp, Artificial Sequence
  Synthetic
tcattcacatcugccaggcut

SEQ ID NO: 15176 - DNA, 23 bp, Artificial Sequence
  Synthetic
cagggtcguggagagtuagaaaa

SEQ ID NO: 15177 - DNA, 19 bp, Artificial Sequence
  Synthetic
gcacgtugacgatggtguc

SEQ ID NO: 15178 - DNA, 25 bp, Artificial Sequence
  Synthetic
ggaaaagcucagcaacatttuaggg

SEQ ID NO: 15179 - DNA, 18 bp, Artificial Sequence
  Synthetic
ccguagggaggcgggaua

SEQ ID NO: 15180 - DNA, 22 bp, Artificial Sequence
  Synthetic
aacccutccctaugacggagat

SEQ ID NO: 15181 - DNA, 19 bp, Artificial Sequence
  Synthetic
ggctgcugaggtccaugac

SEQ ID NO: 15182 - DNA, 21 bp, Artificial Sequence
  Synthetic
aggaaatguttgacccucgca

SEQ ID NO: 15183 - DNA, 22 bp, Artificial Sequence
  Synthetic
atctgtctguggatcccacuct

SEQ ID NO: 15184 - DNA, 25 bp, Artificial Sequence
  Synthetic
gcaaaugcaagaacatactugccaa

SEQ ID NO: 15185 - DNA, 22 bp, Artificial Sequence
  Synthetic
tgcctctgguaaagtgctgaug

SEQ ID NO: 15186 - DNA, 26 bp, Artificial Sequence
  Synthetic
ccccatctctcuctttctctctcuac

SEQ ID NO: 15187 - DNA, 27 bp, Artificial Sequence
  Synthetic
gacaaaauccagaagggaatggttuac

SEQ ID NO: 15188 - DNA, 25 bp, Artificial Sequence
  Synthetic
cccatgcctutctcttgtcattuct

SEQ ID NO: 15189 - DNA, 22 bp, Artificial Sequence
  Synthetic
atgaggctacutctggcatgug

SEQ ID NO: 15190 - DNA, 21 bp, Artificial Sequence
  Synthetic
ctgaggcggcugtacuaacag

SEQ ID NO: 15191 - DNA, 21 bp, Artificial Sequence
  Synthetic
ccaccucttgtgctuccaaag

SEQ ID NO: 15192 - DNA, 23 bp, Artificial Sequence
  Synthetic
cagtcctgaauagctacagugct

SEQ ID NO: 15193 - DNA, 24 bp, Artificial Sequence
  Synthetic
cgcacttatguaattccccacucc

SEQ ID NO: 15194 - DNA, 17 bp, Artificial Sequence
  Synthetic
gagggccaugtcgcugt

SEQ ID NO: 15195 - DNA, 19 bp, Artificial Sequence
  Synthetic
tgatccaggagcucgcuga

SEQ ID NO: 15196 - DNA, 20 bp, Artificial Sequence
  Synthetic
cccagagucaaaggcaguct

SEQ ID NO: 15197 - DNA, 30 bp, Artificial Sequence
  Synthetic
attctctatcautctctctcctuggaagaa

SEQ ID NO: 15198 - DNA, 24 bp, Artificial Sequence
  Synthetic
cgtctcugaatccaagtugcaaat

SEQ ID NO: 15199 - DNA, 29 bp, Artificial Sequence
  Synthetic
gtaattcattttugaaccactggtaguga

SEQ ID NO: 15200 - DNA, 20 bp, Artificial Sequence
  Synthetic
cttgacggcugcccttctua

SEQ ID NO: 15201 - DNA, 23 bp, Artificial Sequence
  Synthetic
gcatgcaggagauttggttucaa

SEQ ID NO: 15202 - DNA, 26 bp, Artificial Sequence
  Synthetic
tttggtggatgugtacgaattgacua

SEQ ID NO: 15203 - DNA, 29 bp, Artificial Sequence
  Synthetic
ctcccttgtcuaaaaggagtaaaaacuca

SEQ ID NO: 15204 - DNA, 23 bp, Artificial Sequence
  Synthetic
tgucaaggaguagaagctttuga

SEQ ID NO: 15205 - DNA, 28 bp, Artificial Sequence
  Synthetic
ttttaccttcugcaacttcatccaguaa

SEQ ID NO: 15206 - DNA, 29 bp, Artificial Sequence
  Synthetic
cctcttatcaucagaaaaccuaccaaagt

SEQ ID NO: 15207 - DNA, 28 bp, Artificial Sequence
  Synthetic
ctccggtggttugtaaactatacttgua

SEQ ID NO: 15208 - DNA, 28 bp, Artificial Sequence
  Synthetic
gggtgtgtaugtgtgaatatttucagat

SEQ ID NO: 15209 - DNA, 22 bp, Artificial Sequence
  Synthetic
cccaacatucacttcctgctug

SEQ ID NO: 15210 - DNA, 20 bp, Artificial Sequence
  Synthetic
cgctcaccaugcttcatguc

SEQ ID NO: 15211 - DNA, 28 bp, Artificial Sequence
  Synthetic
tgcagtactattucacaggcatcuaaaa

SEQ ID NO: 15212 - DNA, 25 bp, Artificial Sequence
  Synthetic
acgaactatgcugtcaaaactucca

SEQ ID NO: 15213 - DNA, 27 bp, Artificial Sequence
  Synthetic
actgtttgtuagagacctaggtaccut

SEQ ID NO: 15214 - DNA, 30 bp, Artificial Sequence
  Synthetic
atcagaaaagcaguaaacattagaggtuca

SEQ ID NO: 15215 - DNA, 27 bp, Artificial Sequence
  Synthetic
ctgaagguacacgtgttgtttugaaat

SEQ ID NO: 15216 - DNA, 18 bp, Artificial Sequence
  Synthetic
gtgucctctguccgcaga

SEQ ID NO: 15217 - DNA, 17 bp, Artificial Sequence
  Synthetic
actcgucgcggtaggug

SEQ ID NO: 15218 - DNA, 20 bp, Artificial Sequence
  Synthetic
acctacauctcctcgugcca

SEQ ID NO: 15219 - DNA, 23 bp, Artificial Sequence
  Synthetic
aagggtcgauaagagcatugagg

SEQ ID NO: 15220 - DNA, 17 bp, Artificial Sequence
  Synthetic
ggcccagggucatgugg

SEQ ID NO: 15221 - DNA, 19 bp, Artificial Sequence
  Synthetic
caccugccaccacctuaca

SEQ ID NO: 15222 - DNA, 17 bp, Artificial Sequence
  Synthetic
cccaggcucacctugct

SEQ ID NO: 15223 - DNA, 17 bp, Artificial Sequence
  Synthetic
cccccgugtgtcggtuc

SEQ ID NO: 15224 - DNA, 17 bp, Artificial Sequence
  Synthetic
cgggucccaccacacug

SEQ ID NO: 15225 - DNA, 19 bp, Artificial Sequence
  Synthetic
aggugaaggccgagaguga

SEQ ID NO: 15226 - DNA, 19 bp, Artificial Sequence
  Synthetic
acgtgctutccagctuggt

SEQ ID NO: 15227 - DNA, 18 bp, Artificial Sequence
  Synthetic
caaggagcuggagcguga

SEQ ID NO: 15228 - DNA, 19 bp, Artificial Sequence
  Synthetic
gcaaaguagcctcggugga

SEQ ID NO: 15229 - DNA, 20 bp, Artificial Sequence
  Synthetic
tccugaaccuggaaggcaac

SEQ ID NO: 15230 - DNA, 22 bp, Artificial Sequence
  Synthetic
gaagtgcuggatgtcacatugc

SEQ ID NO: 15231 - DNA, 22 bp, Artificial Sequence
  Synthetic
gacttcatcuccccacctcuct

SEQ ID NO: 15232 - DNA, 21 bp, Artificial Sequence
  Synthetic
acctcgttcutgctcagctuc

SEQ ID NO: 15233 - DNA, 17 bp, Artificial Sequence
  Synthetic
ggcccuccttguccaca

SEQ ID NO: 15234 - DNA, 18 bp, Artificial Sequence
  Synthetic
ctgguacaccagguggca

SEQ ID NO: 15235 - DNA, 22 bp, Artificial Sequence
  Synthetic
tgacugagaaggcagagauggt

SEQ ID NO: 15236 - DNA, 22 bp, Artificial Sequence
  Synthetic
agtgaaggcaugagtcucacac

SEQ ID NO: 15237 - DNA, 20 bp, Artificial Sequence
  Synthetic
cucaggcacgaucccatuat

SEQ ID NO: 15238 - DNA, 21 bp, Artificial Sequence
  Synthetic
agtcagcgaucttgacgtgug

SEQ ID NO: 15239 - DNA, 21 bp, Artificial Sequence
  Synthetic
gggtaccugccggattaucct

SEQ ID NO: 15240 - DNA, 21 bp, Artificial Sequence
  Synthetic
tgaatcucccgctgaaagucc

SEQ ID NO: 15241 - DNA, 20 bp, Artificial Sequence
  Synthetic
ctggacaucagtcccgcuat

SEQ ID NO: 15242 - DNA, 19 bp, Artificial Sequence
  Synthetic
gcctcuggaccggctcaua

SEQ ID NO: 15243 - DNA, 19 bp, Artificial Sequence
  Synthetic
gggatuaccgactgcucct

SEQ ID NO: 15244 - DNA, 20 bp, Artificial Sequence
  Synthetic
ccagggucactcagctugat

SEQ ID NO: 15245 - DNA, 25 bp, Artificial Sequence
  Synthetic
gtttgccaaacagacucttcatuca

SEQ ID NO: 15246 - DNA, 22 bp, Artificial Sequence
  Synthetic
gactccaaaaguctgguccaca

SEQ ID NO: 15247 - DNA, 24 bp, Artificial Sequence
  Synthetic
atgggtcctucaccaagattuacc

SEQ ID NO: 15248 - DNA, 21 bp, Artificial Sequence
  Synthetic
ccagaucagccactcatucca

SEQ ID NO: 15249 - DNA, 20 bp, Artificial Sequence
  Synthetic
cttccttcuggttggccuca

SEQ ID NO: 15250 - DNA, 19 bp, Artificial Sequence
  Synthetic
gtgccaccucctugcagaa

SEQ ID NO: 15251 - DNA, 18 bp, Artificial Sequence
  Synthetic
ggcacccucgggttucac

SEQ ID NO: 15252 - DNA, 18 bp, Artificial Sequence
  Synthetic
gcccacguggaaggtcuc

SEQ ID NO: 15253 - DNA, 18 bp, Artificial Sequence
  Synthetic
tgauccagggccugagct

SEQ ID NO: 15254 - DNA, 20 bp, Artificial Sequence
  Synthetic
ttgcatgccagucctcaugt

SEQ ID NO: 15255 - DNA, 22 bp, Artificial Sequence
  Synthetic
caattgguttgggcuggagaag

SEQ ID NO: 15256 - DNA, 21 bp, Artificial Sequence
  Synthetic
gatccacuagggatgcacuca

SEQ ID NO: 15257 - DNA, 20 bp, Artificial Sequence
  Synthetic
tcatgcagccucttguccac

SEQ ID NO: 15258 - DNA, 20 bp, Artificial Sequence
  Synthetic
ggacaccugtgtcagcaugt

SEQ ID NO: 15259 - DNA, 20 bp, Artificial Sequence
  Synthetic
ggugggaggaaaagggctuc

SEQ ID NO: 15260 - DNA, 21 bp, Artificial Sequence
  Synthetic
cccacacccgcuctacaauat

SEQ ID NO: 15261 - DNA, 22 bp, Artificial Sequence
  Synthetic
cccaggaccutcacaacatcug

SEQ ID NO: 15262 - DNA, 25 bp, Artificial Sequence
  Synthetic
gccaatctttcucactgtgtctcuc

SEQ ID NO: 15263 - DNA, 20 bp, Artificial Sequence
  Synthetic
cutccggtaaugcaccacct

SEQ ID NO: 15264 - DNA, 22 bp, Artificial Sequence
  Synthetic
cttgaccttguaggcgtctcuc

SEQ ID NO: 15265 - DNA, 22 bp, Artificial Sequence
  Synthetic
gcccagtcutgcaggtauaaac

SEQ ID NO: 15266 - DNA, 19 bp, Artificial Sequence
  Synthetic
ggcgacgcutggtgaugat

SEQ ID NO: 15267 - DNA, 18 bp, Artificial Sequence
  Synthetic
ccgcugcaaagctucgac

SEQ ID NO: 15268 - DNA, 17 bp, Artificial Sequence
  Synthetic
ctcuggccccatgcuca

SEQ ID NO: 15269 - DNA, 17 bp, Artificial Sequence
  Synthetic
cgccuccccagctctuc

SEQ ID NO: 15270 - DNA, 18 bp, Artificial Sequence
  Synthetic
tgagucccccgaaucgga

SEQ ID NO: 15271 - DNA, 19 bp, Artificial Sequence
  Synthetic
tctcaggcucggtcucgaa

SEQ ID NO: 15272 - DNA, 17 bp, Artificial Sequence
  Synthetic
tccccggagucccctuc

SEQ ID NO: 15273 - DNA, 22 bp, Artificial Sequence
  Synthetic
ccttcucacctccttuccacct

SEQ ID NO: 15274 - DNA, 20 bp, Artificial Sequence
  Synthetic
cuagcccagucgaagagaug

SEQ ID NO: 15275 - DNA, 19 bp, Artificial Sequence
  Synthetic
ctgaaugccgggtugagga

SEQ ID NO: 15276 - DNA, 24 bp, Artificial Sequence
  Synthetic
ctgcagucaacttctctuacaggt

SEQ ID NO: 15277 - DNA, 24 bp, Artificial Sequence
  Synthetic
gctcaaatggcauagtctccucag

SEQ ID NO: 15278 - DNA, 20 bp, Artificial Sequence
  Synthetic
cactcccgucaacauggaca

SEQ ID NO: 15279 - DNA, 22 bp, Artificial Sequence
  Synthetic
ggagaggguacttttccuccct

SEQ ID NO: 15280 - DNA, 21 bp, Artificial Sequence
  Synthetic
cgcgtguactacgaugaaggg

SEQ ID NO: 15281 - DNA, 23 bp, Artificial Sequence
  Synthetic
acgagaaagtugcggagtaagut

SEQ ID NO: 15282 - DNA, 23 bp, Artificial Sequence
  Synthetic
gcaguaagctcaucgacaaacaa

SEQ ID NO: 15283 - DNA, 17 bp, Artificial Sequence
  Synthetic
cacugcggagccccuag

SEQ ID NO: 15284 - DNA, 21 bp, Artificial Sequence
  Synthetic
tcgtcaguacgagctgctcua

SEQ ID NO: 15285 - DNA, 22 bp, Artificial Sequence
  Synthetic
ggaagggaaaggutgctttgut

SEQ ID NO: 15286 - DNA, 18 bp, Artificial Sequence
  Synthetic
gtcacccacgucgtcugt

SEQ ID NO: 15287 - DNA, 19 bp, Artificial Sequence
  Synthetic
gccacttuggcccccatua

SEQ ID NO: 15288 - DNA, 20 bp, Artificial Sequence
  Synthetic
gctgaactgcugcctctgua

SEQ ID NO: 15289 - DNA, 19 bp, Artificial Sequence
  Synthetic
cctcgaccccugacagcua

SEQ ID NO: 15290 - DNA, 17 bp, Artificial Sequence
  Synthetic
gctcgugctcaccucgt

SEQ ID NO: 15291 - DNA, 18 bp, Artificial Sequence
  Synthetic
cgaaaaggcgcucacguc

SEQ ID NO: 15292 - DNA, 21 bp, Artificial Sequence
  Synthetic
ccactguccctttttcugcga

SEQ ID NO: 15293 - DNA, 19 bp, Artificial Sequence
  Synthetic
aguagcagcggcuccaaag

SEQ ID NO: 15294 - DNA, 20 bp, Artificial Sequence
  Synthetic
gagcugggcttgtugaagga

SEQ ID NO: 15295 - DNA, 17 bp, Artificial Sequence
  Synthetic
cgguccaggcgugaact

SEQ ID NO: 15296 - DNA, 17 bp, Artificial Sequence
  Synthetic
gccugctgcucgaaggt

SEQ ID NO: 15297 - DNA, 18 bp, Artificial Sequence
  Synthetic
cccaaccuggctcagcua

SEQ ID NO: 15298 - DNA, 21 bp, Artificial Sequence
  Synthetic
cctctuggccacgttcatgua

SEQ ID NO: 15299 - DNA, 20 bp, Artificial Sequence
  Synthetic
cacgcgcaautcgagtaucc

SEQ ID NO: 15300 - DNA, 18 bp, Artificial Sequence
  Synthetic
cccacugagggcuccaga

SEQ ID NO: 15301 - DNA, 17 bp, Artificial Sequence
  Synthetic
gggcauggtgggctugt

SEQ ID NO: 15302 - DNA, 18 bp, Artificial Sequence
  Synthetic
ctcggtuagggctcuggt

SEQ ID NO: 15303 - DNA, 17 bp, Artificial Sequence
  Synthetic
cctucgccgagggcuat

SEQ ID NO: 15304 - DNA, 21 bp, Artificial Sequence
  Synthetic
cgctcauagcaggauccacag

SEQ ID NO: 15305 - DNA, 23 bp, Artificial Sequence
  Synthetic
aagtatguttgggcuggaccaat

SEQ ID NO: 15306 - DNA, 21 bp, Artificial Sequence
  Synthetic
gccatcuacctcttcgucgga

SEQ ID NO: 15307 - DNA, 22 bp, Artificial Sequence
  Synthetic
actttgagatgugtgggctgug

SEQ ID NO: 15308 - DNA, 20 bp, Artificial Sequence
  Synthetic
gctggttguggcccagatut

SEQ ID NO: 15309 - DNA, 21 bp, Artificial Sequence
  Synthetic
aagtacaaggccuccaucacc

SEQ ID NO: 15310 - DNA, 19 bp, Artificial Sequence
  Synthetic
ggtcgtugatcagcuccgt

SEQ ID NO: 15311 - DNA, 19 bp, Artificial Sequence
  Synthetic
ggguaggcccctcactuct

SEQ ID NO: 15312 - DNA, 20 bp, Artificial Sequence
  Synthetic
gagcccuggcaccttcauat

SEQ ID NO: 15313 - DNA, 18 bp, Artificial Sequence
  Synthetic
ggaggcgcacaucgacuc

SEQ ID NO: 15314 - DNA, 20 bp, Artificial Sequence
  Synthetic
acaccgacccuctgtgauga

SEQ ID NO: 15315 - DNA, 18 bp, Artificial Sequence
  Synthetic
gcuggagcggcucaacaa

SEQ ID NO: 15316 - DNA, 17 bp, Artificial Sequence
  Synthetic
guccaccagcaggucgt

SEQ ID NO: 15317 - DNA, 20 bp, Artificial Sequence
  Synthetic
gccuggaaactgcugaggag

SEQ ID NO: 15318 - DNA, 20 bp, Artificial Sequence
  Synthetic
ccgatgggcuctgaagcuaa

SEQ ID NO: 15319 - DNA, 19 bp, Artificial Sequence
  Synthetic
gccaguccgacagcaaguc

SEQ ID NO: 15320 - DNA, 21 bp, Artificial Sequence
  Synthetic
ctccactttcutgcgcttgug

SEQ ID NO: 15321 - DNA, 23 bp, Artificial Sequence
  Synthetic
cccactcacguctttgctttcut

SEQ ID NO: 15322 - DNA, 24 bp, Artificial Sequence
  Synthetic
tctcagcuttattccuggaagcac

SEQ ID NO: 15323 - DNA, 27 bp, Artificial Sequence
  Synthetic
ttggaggtgaaacuctccttatacuga

SEQ ID NO: 15324 - DNA, 24 bp, Artificial Sequence
  Synthetic
ccaagtcagugatcattgccucat

SEQ ID NO: 15325 - DNA, 24 bp, Artificial Sequence
  Synthetic
ctgtgcucaaccaacactaaaugc

SEQ ID NO: 15326 - DNA, 17 bp, Artificial Sequence
  Synthetic
cttcuccgccugcaggt

SEQ ID NO: 15327 - DNA, 17 bp, Artificial Sequence
  Synthetic
ctgtgugccgaggcuga

SEQ ID NO: 15328 - DNA, 20 bp, Artificial Sequence
  Synthetic
ccttcuagcacgcacctugg

SEQ ID NO: 15329 - DNA, 22 bp, Artificial Sequence
  Synthetic
tccucaccacacagagcattug

SEQ ID NO: 15330 - DNA, 19 bp, Artificial Sequence
  Synthetic
gggacagcagcucaacuca

SEQ ID NO: 15331 - DNA, 23 bp, Artificial Sequence
  Synthetic
gaggcaaugggtaaaaugaccag

SEQ ID NO: 15332 - DNA, 18 bp, Artificial Sequence
  Synthetic
gccctuccgcgtctugaa

SEQ ID NO: 15333 - DNA, 22 bp, Artificial Sequence
  Synthetic
gtgtgcctguctctctctccua

SEQ ID NO: 15334 - DNA, 19 bp, Artificial Sequence
  Synthetic
tgggctuctggaactuggg

SEQ ID NO: 15335 - DNA, 20 bp, Artificial Sequence
  Synthetic
tgcactcaccugtgctgaug

SEQ ID NO: 15336 - DNA, 20 bp, Artificial Sequence
  Synthetic
tccaggaucccgaugaagga

SEQ ID NO: 15337 - DNA, 22 bp, Artificial Sequence
  Synthetic
ccuttgtatcugacaccacgct

SEQ ID NO: 15338 - DNA, 20 bp, Artificial Sequence
  Synthetic
cccacacucgaccauaggag

SEQ ID NO: 15339 - DNA, 24 bp, Artificial Sequence
  Synthetic
cgtacaacaaauaccgcttccugt

SEQ ID NO: 15340 - DNA, 23 bp, Artificial Sequence
  Synthetic
gaggagtugtcattctucacggt

SEQ ID NO: 15341 - DNA, 17 bp, Artificial Sequence
  Synthetic
ccatcguccccctucca

SEQ ID NO: 15342 - DNA, 19 bp, Artificial Sequence
  Synthetic
ggtgggcacacacuacguc

SEQ ID NO: 15343 - DNA, 26 bp, Artificial Sequence
  Synthetic
ttctgtgtggucatcaatcctuacaa

SEQ ID NO: 15344 - DNA, 26 bp, Artificial Sequence
  Synthetic
gttcatcttcuggatgtcatcctugt

SEQ ID NO: 15345 - DNA, 20 bp, Artificial Sequence
  Synthetic
gccaagaagcuggtaugggt

SEQ ID NO: 15346 - DNA, 23 bp, Artificial Sequence
  Synthetic
atcgaggaaguctguggagaaga

SEQ ID NO: 15347 - DNA, 23 bp, Artificial Sequence
  Synthetic
tcggaatugcactttgttccuga

SEQ ID NO: 15348 - DNA, 20 bp, Artificial Sequence
  Synthetic
cagaaggugatggctgugct

SEQ ID NO: 15349 - DNA, 29 bp, Artificial Sequence
  Synthetic
ttggcttctgatauccatttactctctug

SEQ ID NO: 15350 - DNA, 19 bp, Artificial Sequence
  Synthetic
gctguagcgagacgctcut

SEQ ID NO: 15351 - DNA, 19 bp, Artificial Sequence
  Synthetic
accttgucctcaccgugac

SEQ ID NO: 15352 - DNA, 18 bp, Artificial Sequence
  Synthetic
cagcuggcagcuggagaa

SEQ ID NO: 15353 - DNA, 18 bp, Artificial Sequence
  Synthetic
gcagaucgaggcgcugac

SEQ ID NO: 15354 - DNA, 21 bp, Artificial Sequence
  Synthetic
accatcucaccaaaggtgucc

SEQ ID NO: 15355 - DNA, 17 bp, Artificial Sequence
  Synthetic
gctccagcugagguggt

SEQ ID NO: 15356 - DNA, 22 bp, Artificial Sequence
  Synthetic
cagtggcucaagttttccagug

SEQ ID NO: 15357 - DNA, 22 bp, Artificial Sequence
  Synthetic
ccactaccaauagcagcuccag

SEQ ID NO: 15358 - DNA, 24 bp, Artificial Sequence
  Synthetic
gatgtactgguggtacttgagcut

SEQ ID NO: 15359 - DNA, 18 bp, Artificial Sequence
  Synthetic
ctgaggcugccccugaat

SEQ ID NO: 15360 - DNA, 20 bp, Artificial Sequence
  Synthetic
cacagaacccugggacucat

SEQ ID NO: 15361 - DNA, 21 bp, Artificial Sequence
  Synthetic
ctgggcuggaagtggaatcuc

SEQ ID NO: 15362 - DNA, 30 bp, Artificial Sequence
  Synthetic
ctctaaatggaaauataaccagcaaugcaa

SEQ ID NO: 15363 - DNA, 28 bp, Artificial Sequence
  Synthetic
ggtaatcttuacggttcttctcucaaca

SEQ ID NO: 15364 - DNA, 17 bp, Artificial Sequence
  Synthetic
cggagtgucgctcgcua

SEQ ID NO: 15365 - DNA, 17 bp, Artificial Sequence
  Synthetic
gcccguacctguccagt

SEQ ID NO: 15366 - DNA, 27 bp, Artificial Sequence
  Synthetic
taggactuaaaacatcttggauaccgt

SEQ ID NO: 15367 - DNA, 28 bp, Artificial Sequence
  Synthetic
tggaaguagaccaaaucaagaccataua

SEQ ID NO: 15368 - DNA, 29 bp, Artificial Sequence
  Synthetic
agatgcttttgugtgactctaaatugact

SEQ ID NO: 15369 - DNA, 25 bp, Artificial Sequence
  Synthetic
ttgccatgaagugatcggaauacat

SEQ ID NO: 15370 - DNA, 26 bp, Artificial Sequence
  Synthetic
cacactgtagauctcctgggagauaa

SEQ ID NO: 15371 - DNA, 22 bp, Artificial Sequence
  Synthetic
tctggtaaguctcacctuccga

SEQ ID NO: 15372 - DNA, 30 bp, Artificial Sequence
  Synthetic
cctcaggatgccautaaatgctactuaaat

SEQ ID NO: 15373 - DNA, 20 bp, Artificial Sequence
  Synthetic
cctccttcugcctgagtgut

SEQ ID NO: 15374 - DNA, 25 bp, Artificial Sequence
  Synthetic
tcattucagggaaaggttgctuaga

SEQ ID NO: 15375 - DNA, 30 bp, Artificial Sequence
  Synthetic
gcatcagtttctgugctggatttaaatuat

SEQ ID NO: 15376 - DNA, 22 bp, Artificial Sequence
  Synthetic
ctttggccaauggaccctttuc

SEQ ID NO: 15377 - DNA, 23 bp, Artificial Sequence
  Synthetic
tgcggttaugaggtagagugagt

SEQ ID NO: 15378 - DNA, 24 bp, Artificial Sequence
  Synthetic
ctuaaccaaagagaguaagcctuc

SEQ ID NO: 15379 - DNA, 25 bp, Artificial Sequence
  Synthetic
gacttagaauctccatggcuaggac

SEQ ID NO: 15380 - DNA, 25 bp, Artificial Sequence
  Synthetic
ggagaagggauggaagaatcucaga

SEQ ID NO: 15381 - DNA, 25 bp, Artificial Sequence
  Synthetic
tcactutgatgaacttucccacact

SEQ ID NO: 15382 - DNA, 23 bp, Artificial Sequence
  Synthetic
tgtacaaauccgaacaacccugt

SEQ ID NO: 15383 - DNA, 23 bp, Artificial Sequence
  Synthetic
tctgccagugctggaaaagtuaa

SEQ ID NO: 15384 - DNA, 30 bp, Artificial Sequence
  Synthetic
agaagtcatcauaaagaccactcagauagt

SEQ ID NO: 15385 - DNA, 24 bp, Artificial Sequence
  Synthetic
tcctcctccucccagaactuaaaa

SEQ ID NO: 15386 - DNA, 27 bp, Artificial Sequence
  Synthetic
ttcttttcacauttcaggtcaucagga

SEQ ID NO: 15387 - DNA, 28 bp, Artificial Sequence
  Synthetic
ttggaaacctacutttcacagaagucat

SEQ ID NO: 15388 - DNA, 24 bp, Artificial Sequence
  Synthetic
actgttcatugggttcaggctaut

SEQ ID NO: 15389 - DNA, 28 bp, Artificial Sequence
  Synthetic
aggaacagtccuattggatataatccut

SEQ ID NO: 15390 - DNA, 28 bp, Artificial Sequence
  Synthetic
tgtcttctaagaacuctgaagcaatguc

SEQ ID NO: 15391 - DNA, 27 bp, Artificial Sequence
  Synthetic
agggaagaggcuttataaaacaacugt

SEQ ID NO: 15392 - DNA, 27 bp, Artificial Sequence
  Synthetic
gagttattucccctaactucacaagca

SEQ ID NO: 15393 - DNA, 28 bp, Artificial Sequence
  Synthetic
aggtctcauttaatgtccauggaacaat

SEQ ID NO: 15394 - DNA, 18 bp, Artificial Sequence
  Synthetic
gcggcacuggcctacuac

SEQ ID NO: 15395 - DNA, 24 bp, Artificial Sequence
  Synthetic
gtattctgaccuagccaaggauct

SEQ ID NO: 15396 - DNA, 23 bp, Artificial Sequence
  Synthetic
tccctguccccaatagtgctuat

SEQ ID NO: 15397 - DNA, 24 bp, Artificial Sequence
  Synthetic
cacctcaactuccctgtcctttut

SEQ ID NO: 15398 - DNA, 22 bp, Artificial Sequence
  Synthetic
gtcaguaaacgggcaggtacuc

SEQ ID NO: 15399 - DNA, 19 bp, Artificial Sequence
  Synthetic
gcgtcaccuggtgtagcut

SEQ ID NO: 15400 - DNA, 17 bp, Artificial Sequence
  Synthetic
gccctguggtgctguca

SEQ ID NO: 15401 - DNA, 18 bp, Artificial Sequence
  Synthetic
ctggaggccaugctcugt

SEQ ID NO: 15402 - DNA, 27 bp, Artificial Sequence
  Synthetic
gtcagaatacaaaagucaagggacuca

SEQ ID NO: 15403 - DNA, 19 bp, Artificial Sequence
  Synthetic
gtgacaguggctgagccua

SEQ ID NO: 15404 - DNA, 22 bp, Artificial Sequence
  Synthetic
cctctttggcuctagctccuct

SEQ ID NO: 15405 - DNA, 23 bp, Artificial Sequence
  Synthetic
cctgtctttcugcctgtctguaa

SEQ ID NO: 15406 - DNA, 23 bp, Artificial Sequence
  Synthetic
gggcuaggagacaagaatcugag

SEQ ID NO: 15407 - DNA, 20 bp, Artificial Sequence
  Synthetic
acggcuacaggctgaaccua

SEQ ID NO: 15408 - DNA, 19 bp, Artificial Sequence
  Synthetic
gggatgaggugggatuggg

SEQ ID NO: 15409 - DNA, 18 bp, Artificial Sequence
  Synthetic
agcacggccucctcuaca

SEQ ID NO: 15410 - DNA, 22 bp, Artificial Sequence
  Synthetic
cgttaagagacgcugtagguca

SEQ ID NO: 15411 - DNA, 22 bp, Artificial Sequence
  Synthetic
ggaggagcugagacagcuagag

SEQ ID NO: 15412 - DNA, 22 bp, Artificial Sequence
  Synthetic
ctgggtcuccactcaacttuga

SEQ ID NO: 15413 - DNA, 22 bp, Artificial Sequence
  Synthetic
cctagcccugctgtggauaaag

SEQ ID NO: 15414 - DNA, 20 bp, Artificial Sequence
  Synthetic
ctcaucagcacuccaagcgt

SEQ ID NO: 15415 - DNA, 24 bp, Artificial Sequence
  Synthetic
gagtttggaccugaaaccucacat

SEQ ID NO: 15416 - DNA, 21 bp, Artificial Sequence
  Synthetic
ccgaaccutcagcttaugcag

SEQ ID NO: 15417 - DNA, 20 bp, Artificial Sequence
  Synthetic
catgggccuttcuggaggaa

SEQ ID NO: 15418 - DNA, 22 bp, Artificial Sequence
  Synthetic
ggttcagguctagcttctcugg

SEQ ID NO: 15419 - DNA, 20 bp, Artificial Sequence
  Synthetic
ttggccacacucaacctuga

SEQ ID NO: 15420 - DNA, 21 bp, Artificial Sequence
  Synthetic
ggagcccacacugacttgaut

SEQ ID NO: 15421 - DNA, 24 bp, Artificial Sequence
  Synthetic
gcagatatctcuggcatgaaggug

SEQ ID NO: 15422 - DNA, 20 bp, Artificial Sequence
  Synthetic
actaccucagccctccauca

SEQ ID NO: 15423 - DNA, 25 bp, Artificial Sequence
  Synthetic
tgacatgttcucctttgggttucag

SEQ ID NO: 15424 - DNA, 23 bp, Artificial Sequence
  Synthetic
cttgctcuccaggaaggtctuag

SEQ ID NO: 15425 - DNA, 25 bp, Artificial Sequence
  Synthetic
tttacagccauttttctctcuccca

SEQ ID NO: 15426 - DNA, 24 bp, Artificial Sequence
  Synthetic
gggtttgtatuccttgtccttcuc

SEQ ID NO: 15427 - DNA, 21 bp, Artificial Sequence
  Synthetic
accacagctutggatgccaut

SEQ ID NO: 15428 - DNA, 22 bp, Artificial Sequence
  Synthetic
gagccctggauttcccagaaut

SEQ ID NO: 15429 - DNA, 22 bp, Artificial Sequence
  Synthetic
gtgtggagugctgtattccuct

SEQ ID NO: 15430 - DNA, 19 bp, Artificial Sequence
  Synthetic
gcgguaggaaatcgucgga

SEQ ID NO: 15431 - DNA, 17 bp, Artificial Sequence
  Synthetic
cgctuagggccuagcct

SEQ ID NO: 15432 - DNA, 30 bp, Artificial Sequence
  Synthetic
aagggcagatataauattgacttcaaacut

SEQ ID NO: 15433 - DNA, 26 bp, Artificial Sequence
  Synthetic
gagaaacctttagugtcctggtacug

SEQ ID NO: 15434 - DNA, 22 bp, Artificial Sequence
  Synthetic
cctcgtatgcugtccagtcuaa

SEQ ID NO: 15435 - DNA, 20 bp, Artificial Sequence
  Synthetic
gtgaggcagggautggucag

SEQ ID NO: 15436 - DNA, 22 bp, Artificial Sequence
  Synthetic
ccttcttgtcutgcccttgucc

SEQ ID NO: 15437 - DNA, 22 bp, Artificial Sequence
  Synthetic
gtcagagggaggaaucacucac

SEQ ID NO: 15438 - DNA, 25 bp, Artificial Sequence
  Synthetic
ccctagtgcuatgctggaaaaugag

SEQ ID NO: 15439 - DNA, 22 bp, Artificial Sequence
  Synthetic
tccaatcuccaaggtgacucca

SEQ ID NO: 15440 - DNA, 25 bp, Artificial Sequence
  Synthetic
actgacagtcuttctctccttcugt

SEQ ID NO: 15441 - DNA, 21 bp, Artificial Sequence
  Synthetic
ctctgccccautctcatccug

SEQ ID NO: 15442 - DNA, 26 bp, Artificial Sequence
  Synthetic
cgcattgacgaauttgagtctatgua

SEQ ID NO: 15443 - DNA, 25 bp, Artificial Sequence
  Synthetic
cattaaatgcutggcatgacuccag

SEQ ID NO: 15444 - DNA, 17 bp, Artificial Sequence
  Synthetic
gcuaaccagccguccga

SEQ ID NO: 15445 - DNA, 17 bp, Artificial Sequence
  Synthetic
gggagccuccctuccga

SEQ ID NO: 15446 - DNA, 19 bp, Artificial Sequence
  Synthetic
gccacugacctccccuaca

SEQ ID NO: 15447 - DNA, 19 bp, Artificial Sequence
  Synthetic
tcttgccuccctcagggut

SEQ ID NO: 15448 - DNA, 21 bp, Artificial Sequence
  Synthetic
ggcggaggaaauaccagctuc

SEQ ID NO: 15449 - DNA, 20 bp, Artificial Sequence
  Synthetic
gtaaccccaggaugcugcaa

SEQ ID NO: 15450 - DNA, 22 bp, Artificial Sequence
  Synthetic
agtctggtucccaccctttcua

SEQ ID NO: 15451 - DNA, 30 bp, Artificial Sequence
  Synthetic
actccaggtuctccatatacataucaagat

SEQ ID NO: 15452 - DNA, 26 bp, Artificial Sequence
  Synthetic
cacatggttagucctctacttcaugg

SEQ ID NO: 15453 - DNA, 22 bp, Artificial Sequence
  Synthetic
cttcttcttccuggtgcacuga

SEQ ID NO: 15454 - DNA, 23 bp, Artificial Sequence
  Synthetic
atcttcatcaucaccgcagtcuc

SEQ ID NO: 15455 - DNA, 25 bp, Artificial Sequence
  Synthetic
ctgttaauaacacactgugcagacc

SEQ ID NO: 15456 - DNA, 23 bp, Artificial Sequence
  Synthetic
ctctccacgagutcttgtccaut

SEQ ID NO: 15457 - DNA, 26 bp, Artificial Sequence
  Synthetic
agtttactugcctcttaugcacagat

SEQ ID NO: 15458 - DNA, 22 bp, Artificial Sequence
  Synthetic
cucaccccaauaaggcccaaat

SEQ ID NO: 15459 - DNA, 28 bp, Artificial Sequence
  Synthetic
ttgtgaatggcaugtacagaatctauga

SEQ ID NO: 15460 - DNA, 25 bp, Artificial Sequence
  Synthetic
aaatactttcaggucacgtctugct

SEQ ID NO: 15461 - DNA, 26 bp, Artificial Sequence
  Synthetic
tctctacatctugggttctgacauca

SEQ ID NO: 15462 - DNA, 22 bp, Artificial Sequence
  Synthetic
cagacugaagcagctgtuccat

SEQ ID NO: 15463 - DNA, 24 bp, Artificial Sequence
  Synthetic
tgtgtgagagagagaucctgctua

SEQ ID NO: 15464 - DNA, 25 bp, Artificial Sequence
  Synthetic
aaatcaccacaacugaauagagcca

SEQ ID NO: 15465 - DNA, 28 bp, Artificial Sequence
  Synthetic
actctcguaacagagtactccauaaact

SEQ ID NO: 15466 - DNA, 19 bp, Artificial Sequence
  Synthetic
gctggtatucgtcgcggua

SEQ ID NO: 15467 - DNA, 22 bp, Artificial Sequence
  Synthetic
cccaaaaagucacacctgtguc

SEQ ID NO: 15468 - DNA, 26 bp, Artificial Sequence
  Synthetic
agtgtgctcagautttatgtccctut

SEQ ID NO: 15469 - DNA, 32 bp, Artificial Sequence
  Synthetic
cccattcttacagutatttctacttttgtgua

SEQ ID NO: 15470 - DNA, 22 bp, Artificial Sequence
  Synthetic
catgacactguccttgtgcuct

SEQ ID NO: 15471 - DNA, 22 bp, Artificial Sequence
  Synthetic
gcttgcttugggtggagagtua

SEQ ID NO: 15472 - DNA, 19 bp, Artificial Sequence
  Synthetic
gccatccuattgcgagugg

SEQ ID NO: 15473 - DNA, 22 bp, Artificial Sequence
  Synthetic
gcagaagguggaggtgttugag

SEQ ID NO: 15474 - DNA, 27 bp, Artificial Sequence
  Synthetic
cagaagacttcucaaattgttgccaut

SEQ ID NO: 15475 - DNA, 27 bp, Artificial Sequence
  Synthetic
ttccttcuaaaaggccatgaagatcug

SEQ ID NO: 15476 - DNA, 30 bp, Artificial Sequence
  Synthetic
gacaguaaaacagaaaggactataaugaca

SEQ ID NO: 15477 - DNA, 25 bp, Artificial Sequence
  Synthetic
tggtgcaggaaguacatgaaaucag

SEQ ID NO: 15478 - DNA, 21 bp, Artificial Sequence
  Synthetic
cagcuaagggaccagggtcua

SEQ ID NO: 15479 - DNA, 23 bp, Artificial Sequence
  Synthetic
ggcutctaagtcuaccacgacag

SEQ ID NO: 15480 - DNA, 25 bp, Artificial Sequence
  Synthetic
ggtatcaatcuggatggcttucacc

SEQ ID NO: 15481 - DNA, 22 bp, Artificial Sequence
  Synthetic
gcaggcaaaaacugggaaacua

SEQ ID NO: 15482 - DNA, 25 bp, Artificial Sequence
  Synthetic
catgacgcaguttcttcttctcauc

SEQ ID NO: 15483 - DNA, 20 bp, Artificial Sequence
  Synthetic
gttggucacagctccagugt

SEQ ID NO: 15484 - DNA, 21 bp, Artificial Sequence
  Synthetic
tcacctgagggugaactgtug

SEQ ID NO: 15485 - DNA, 26 bp, Artificial Sequence
  Synthetic
gtccagttctguctataacccagtut

SEQ ID NO: 15486 - DNA, 20 bp, Artificial Sequence
  Synthetic
ctggcggaugatctctcguc

SEQ ID NO: 15487 - DNA, 23 bp, Artificial Sequence
  Synthetic
atcctgtcutttggattgtucgt

SEQ ID NO: 15488 - DNA, 23 bp, Artificial Sequence
  Synthetic
agctttaccuaaaccccaugcag

SEQ ID NO: 15489 - DNA, 28 bp, Artificial Sequence
  Synthetic
ggaagattgguagtttaaggagattugg

SEQ ID NO: 15490 - DNA, 24 bp, Artificial Sequence
  Synthetic
cagugggagaagagaggtuattut

SEQ ID NO: 15491 - DNA, 20 bp, Artificial Sequence
  Synthetic
gugccgagcataugccaaag

SEQ ID NO: 15492 - DNA, 32 bp, Artificial Sequence
  Synthetic
tgtatatatcgtttuctatgtgctgatctuct

SEQ ID NO: 15493 - DNA, 19 bp, Artificial Sequence
  Synthetic
gaatggcugagacggcuga

SEQ ID NO: 15494 - DNA, 27 bp, Artificial Sequence
  Synthetic
caagtaguaaagacaacagggactuca

SEQ ID NO: 15495 - DNA, 24 bp, Artificial Sequence
  Synthetic
catctctuccccctcctgtttuag

SEQ ID NO: 15496 - DNA, 24 bp, Artificial Sequence
  Synthetic
cagggacucagaggaaaucagaaa

SEQ ID NO: 15497 - DNA, 22 bp, Artificial Sequence
  Synthetic
gcaaattguggtagctctuggg

SEQ ID NO: 15498 - DNA, 22 bp, Artificial Sequence
  Synthetic
ggaacugcacacatttgagucc

SEQ ID NO: 15499 - DNA, 22 bp, Artificial Sequence
  Synthetic
tgctggtcaacaugggaaacut

SEQ ID NO: 15500 - DNA, 22 bp, Artificial Sequence
  Synthetic
ccatcgucccagcaaagtctut

SEQ ID NO: 15501 - DNA, 22 bp, Artificial Sequence
  Synthetic
agcccuacaggaagtacccuac

SEQ ID NO: 15502 - DNA, 24 bp, Artificial Sequence
  Synthetic
tctccccauatgagctgaugacaa

SEQ ID NO: 15503 - DNA, 26 bp, Artificial Sequence
  Synthetic
gattggaagaaucaaagagcagagug

SEQ ID NO: 15504 - DNA, 23 bp, Artificial Sequence
  Synthetic
ctcccaattgucctaagctccut

SEQ ID NO: 15505 - DNA, 22 bp, Artificial Sequence
  Synthetic
catgcucatgtggtuagccaga

SEQ ID NO: 15506 - DNA, 20 bp, Artificial Sequence
  Synthetic
ggagggcaagagugatgcug

SEQ ID NO: 15507 - DNA, 24 bp, Artificial Sequence
  Synthetic
tcaagatgggcuactgaaaaugct

SEQ ID NO: 15508 - DNA, 20 bp, Artificial Sequence
  Synthetic
cgtccutcctcuccaaccaa

SEQ ID NO: 15509 - DNA, 21 bp, Artificial Sequence
  Synthetic
ctttctguggctgtgagguct

SEQ ID NO: 15510 - DNA, 20 bp, Artificial Sequence
  Synthetic
aggccttggugagagctgua

SEQ ID NO: 15511 - DNA, 23 bp, Artificial Sequence
  Synthetic
tgguacacgacaagtacugcaaa

SEQ ID NO: 15512 - DNA, 22 bp, Artificial Sequence
  Synthetic
tgggaauggagccatctcctua

SEQ ID NO: 15513 - DNA, 27 bp, Artificial Sequence
  Synthetic
caacccttcttugacaacatttttgug

SEQ ID NO: 15514 - DNA, 22 bp, Artificial Sequence
  Synthetic
gcacaaaggugagtgtgttgut

SEQ ID NO: 15515 - DNA, 27 bp, Artificial Sequence
  Synthetic
cttctatgaccaacugaaccaucacat

SEQ ID NO: 15516 - DNA, 22 bp, Artificial Sequence
  Synthetic
gggcaaggccccautatatcug

SEQ ID NO: 15517 - DNA, 25 bp, Artificial Sequence
  Synthetic
ggataauggcagttcucacacacat

SEQ ID NO: 15518 - DNA, 18 bp, Artificial Sequence
  Synthetic
tctcaggucgacggcuga

SEQ ID NO: 15519 - DNA, 18 bp, Artificial Sequence
  Synthetic
cgacggguccccactuac

SEQ ID NO: 15520 - DNA, 24 bp, Artificial Sequence
  Synthetic
tctacatctccccucgaatcacut

SEQ ID NO: 15521 - DNA, 23 bp, Artificial Sequence
  Synthetic
gggaatggaguagggcatugaaa

SEQ ID NO: 15522 - DNA, 20 bp, Artificial Sequence
  Synthetic
cggugaagagccugaagcag

SEQ ID NO: 15523 - DNA, 24 bp, Artificial Sequence
  Synthetic
cccaccatuctccatgtatucagt

SEQ ID NO: 15524 - DNA, 27 bp, Artificial Sequence
  Synthetic
cggaattatatucatcgtgacctucgg

SEQ ID NO: 15525 - DNA, 22 bp, Artificial Sequence
  Synthetic
cccagaccacccutaaatcuca

SEQ ID NO: 15526 - DNA, 20 bp, Artificial Sequence
  Synthetic
tcatgaggcugtgcuggaag

SEQ ID NO: 15527 - DNA, 22 bp, Artificial Sequence
  Synthetic
caagucaggcuggagagaaagg

SEQ ID NO: 15528 - DNA, 24 bp, Artificial Sequence
  Synthetic
ttctctgtagccaucctcttcuca

SEQ ID NO: 15529 - DNA, 19 bp, Artificial Sequence
  Synthetic
acctgcgtucgcgattcut

SEQ ID NO: 15530 - DNA, 22 bp, Artificial Sequence
  Synthetic
gttgtgctgutgctgatggaug

SEQ ID NO: 15531 - DNA, 27 bp, Artificial Sequence
  Synthetic
cttctcttgauctcttttcucggacag

SEQ ID NO: 15532 - DNA, 17 bp, Artificial Sequence
  Synthetic
gtggcccccuctuggat

SEQ ID NO: 15533 - DNA, 17 bp, Artificial Sequence
  Synthetic
cucccagccucgaagcc

SEQ ID NO: 15534 - DNA, 19 bp, Artificial Sequence
  Synthetic
gggatuccgcttcgtcucc

SEQ ID NO: 15535 - DNA, 24 bp, Artificial Sequence
  Synthetic
agcgaggacauctggaagaaatuc

SEQ ID NO: 15536 - DNA, 21 bp, Artificial Sequence
  Synthetic
ctgaagggaggaugggcuaag

SEQ ID NO: 15537 - DNA, 23 bp, Artificial Sequence
  Synthetic
cataggtgatcuccaccctcugt

SEQ ID NO: 15538 - DNA, 22 bp, Artificial Sequence
  Synthetic
gatacgtgugccagttuccaga

SEQ ID NO: 15539 - DNA, 22 bp, Artificial Sequence
  Synthetic
ggtgacaggaggauggctctua

SEQ ID NO: 15540 - DNA, 21 bp, Artificial Sequence
  Synthetic
ctctggaccaguctccatgug

SEQ ID NO: 15541 - DNA, 25 bp, Artificial Sequence
  Synthetic
ctaggtctggaauccccaaagtaug

SEQ ID NO: 15542 - DNA, 22 bp, Artificial Sequence
  Synthetic
tgtuacctgtcaauggcagcaa

SEQ ID NO: 15543 - DNA, 21 bp, Artificial Sequence
  Synthetic
gcucactcccaugacaccaac

SEQ ID NO: 15544 - DNA, 21 bp, Artificial Sequence
  Synthetic
gcatcuggaattggaguggca

SEQ ID NO: 15545 - DNA, 22 bp, Artificial Sequence
  Synthetic
gtagtgagguctgtgggcatut

SEQ ID NO: 15546 - DNA, 20 bp, Artificial Sequence
  Synthetic
tgaccgcuctgcatctagug

SEQ ID NO: 15547 - DNA, 22 bp, Artificial Sequence
  Synthetic
gucacagagugaaccaagaaug

SEQ ID NO: 15548 - DNA, 21 bp, Artificial Sequence
  Synthetic
cacccacatugccaaccatuc

SEQ ID NO: 15549 - DNA, 22 bp, Artificial Sequence
  Synthetic
gggtaggguagggaagtucaca

SEQ ID NO: 15550 - DNA, 22 bp, Artificial Sequence
  Synthetic
gaguggagaatgtucacccaga

SEQ ID NO: 15551 - DNA, 19 bp, Artificial Sequence
  Synthetic
gccctcaccuccctgtcut

SEQ ID NO: 15552 - DNA, 19 bp, Artificial Sequence
  Synthetic
cagcccaacgcugtagtuc

SEQ ID NO: 15553 - DNA, 27 bp, Artificial Sequence
  Synthetic
tgaguaacaagagagaauggagggaat

SEQ ID NO: 15554 - DNA, 21 bp, Artificial Sequence
  Synthetic
ggcacagggutgagtgtcaua

SEQ ID NO: 15555 - DNA, 19 bp, Artificial Sequence
  Synthetic
ccaagcagccauggagcua

SEQ ID NO: 15556 - DNA, 24 bp, Artificial Sequence
  Synthetic
ctgattggagugcaagacucaaga

SEQ ID NO: 15557 - DNA, 22 bp, Artificial Sequence
  Synthetic
ttgaccuctgatccuacccaca

SEQ ID NO: 15558 - DNA, 17 bp, Artificial Sequence
  Synthetic
tgctccucgcctgccua

SEQ ID NO: 15559 - DNA, 22 bp, Artificial Sequence
  Synthetic
ggcctcugtctcctcauaccat

SEQ ID NO: 15560 - DNA, 21 bp, Artificial Sequence
  Synthetic
gcaacccaguccaactuggat

SEQ ID NO: 15561 - DNA, 22 bp, Artificial Sequence
  Synthetic
cgcagcagutgcaaacatttug

SEQ ID NO: 15562 - DNA, 18 bp, Artificial Sequence
  Synthetic
tgauccgctccugggact

SEQ ID NO: 15563 - DNA, 17 bp, Artificial Sequence
  Synthetic
accugccccagcagaug

SEQ ID NO: 15564 - DNA, 24 bp, Artificial Sequence
  Synthetic
gcatcgtcauagaaggtcgttucc

SEQ ID NO: 15565 - DNA, 26 bp, Artificial Sequence
  Synthetic
gctcttagagaaacuttccctgucaa

SEQ ID NO: 15566 - DNA, 18 bp, Artificial Sequence
  Synthetic
cggacuccgacgactugt

SEQ ID NO: 15567 - DNA, 19 bp, Artificial Sequence
  Synthetic
gcttcuccacggcgguaaa

SEQ ID NO: 15568 - DNA, 28 bp, Artificial Sequence
  Synthetic
ggcagtuagagagaaggugaaaagaaaa

SEQ ID NO: 15569 - DNA, 21 bp, Artificial Sequence
  Synthetic
tcagagtugcactgagtgugg

SEQ ID NO: 15570 - DNA, 28 bp, Artificial Sequence
  Synthetic
agtgcttcaaauccttcaataaggtuct

SEQ ID NO: 15571 - DNA, 31 bp, Artificial Sequence
  Synthetic
agttcccagatcuaacatttttactgttgut

SEQ ID NO: 15572 - DNA, 25 bp, Artificial Sequence
  Synthetic
gaatcacaguaagtcagcagcucat

SEQ ID NO: 15573 - DNA, 23 bp, Artificial Sequence
  Synthetic
tgcctcccaggaaaugaagttut

SEQ ID NO: 15574 - DNA, 30 bp, Artificial Sequence
  Synthetic
gcatattttagcugctgtttgaggtttaut

SEQ ID NO: 15575 - DNA, 21 bp, Artificial Sequence
  Synthetic
ctctcccauggttccctcaut

SEQ ID NO: 15576 - DNA, 22 bp, Artificial Sequence
  Synthetic
gtttcuccccaagctgggtuaa

SEQ ID NO: 15577 - DNA, 22 bp, Artificial Sequence
  Synthetic
atcatguaaggagctggcugac

SEQ ID NO: 15578 - DNA, 18 bp, Artificial Sequence
  Synthetic
tgctgacutgccccugac

SEQ ID NO: 15579 - DNA, 19 bp, Artificial Sequence
  Synthetic
gtgagggcaucgacaguga

SEQ ID NO: 15580 - DNA, 26 bp, Artificial Sequence
  Synthetic
caccccttugaaagagaacacactua

SEQ ID NO: 15581 - DNA, 22 bp, Artificial Sequence
  Synthetic
gctggccugagacattcctaug

SEQ ID NO: 15582 - DNA, 22 bp, Artificial Sequence
  Synthetic
atctgggtcucagcacatuact

SEQ ID NO: 15583 - DNA, 21 bp, Artificial Sequence
  Synthetic
gccaccucaagaagcagaucc

SEQ ID NO: 15584 - DNA, 24 bp, Artificial Sequence
  Synthetic
accaaaggcaacugataaggtuct

SEQ ID NO: 15585 - DNA, 22 bp, Artificial Sequence
  Synthetic
tccctgguagatggctactucc

SEQ ID NO: 15586 - DNA, 22 bp, Artificial Sequence
  Synthetic
cauacgctatgugacacgggaa

SEQ ID NO: 15587 - DNA, 24 bp, Artificial Sequence
  Synthetic
tgacgguggaaacgttctctacua

SEQ ID NO: 15588 - DNA, 23 bp, Artificial Sequence
  Synthetic
gtagaaacaccaccauccucaca

SEQ ID NO: 15589 - DNA, 25 bp, Artificial Sequence
  Synthetic
cgagcaggauggacatgatatugag

SEQ ID NO: 15590 - DNA, 22 bp, Artificial Sequence
  Synthetic
ggcagguaccaggtcagtacut

SEQ ID NO: 15591 - DNA, 22 bp, Artificial Sequence
  Synthetic
cctcttugccctgtaugacgag

SEQ ID NO: 15592 - DNA, 22 bp, Artificial Sequence
  Synthetic
cctccaggtucacctcagtcut

SEQ ID NO: 15593 - DNA, 27 bp, Artificial Sequence
  Synthetic
ttgccataagaacutttagcacauaga

SEQ ID NO: 15594 - DNA, 26 bp, Artificial Sequence
  Synthetic
actaacautatgatccugaccccaca

SEQ ID NO: 15595 - DNA, 20 bp, Artificial Sequence
  Synthetic
cctggcacuccggtttctuc

SEQ ID NO: 15596 - DNA, 23 bp, Artificial Sequence
  Synthetic
tcagtgtccuctacctcagtgut

SEQ ID NO: 15597 - DNA, 23 bp, Artificial Sequence
  Synthetic
ccagtcttcguaggaaggtcuga

SEQ ID NO: 15598 - DNA, 24 bp, Artificial Sequence
  Synthetic
tgtgtgtgtcugcatacatcugat

SEQ ID NO: 15599 - DNA, 21 bp, Artificial Sequence
  Synthetic
gctccuctccatcaugggact

SEQ ID NO: 15600 - DNA, 21 bp, Artificial Sequence
  Synthetic
gggaaactgucttccccugat

SEQ ID NO: 15601 - DNA, 28 bp, Artificial Sequence
  Synthetic
gagtcagagaaugggagaagtaaugaag

SEQ ID NO: 15602 - DNA, 22 bp, Artificial Sequence
  Synthetic
acaucgaggaaaagtcaucgcc

SEQ ID NO: 15603 - DNA, 21 bp, Artificial Sequence
  Synthetic
gaggccuctctctuacccact

SEQ ID NO: 15604 - DNA, 22 bp, Artificial Sequence
  Synthetic
tgggagcucttcctgatcugaa

SEQ ID NO: 15605 - DNA, 24 bp, Artificial Sequence
  Synthetic
cctgctttattugggtactccuga

SEQ ID NO: 15606 - DNA, 22 bp, Artificial Sequence
  Synthetic
gtgtggtucagagggactguag

SEQ ID NO: 15607 - DNA, 22 bp, Artificial Sequence
  Synthetic
ggaaggcaugcaaggaatugag

SEQ ID NO: 15608 - DNA, 27 bp, Artificial Sequence
  Synthetic
tattctattccttucctccttgcttuc

SEQ ID NO: 15609 - DNA, 24 bp, Artificial Sequence
  Synthetic
ttgcctaguacatgtccauccaac

SEQ ID NO: 15610 - DNA, 24 bp, Artificial Sequence
  Synthetic
cctgttccuctgtagttgtuccat

SEQ ID NO: 15611 - DNA, 26 bp, Artificial Sequence
  Synthetic
gtctggaagaaagutcccttcatuct

SEQ ID NO: 15612 - DNA, 21 bp, Artificial Sequence
  Synthetic
ccccaucaggagggtcttuca

SEQ ID NO: 15613 - DNA, 23 bp, Artificial Sequence
  Synthetic
ggacaccccuttgtgactcauac

SEQ ID NO: 15614 - DNA, 26 bp, Artificial Sequence
  Synthetic
ggaaacagaacaaaagugaagaccuc

SEQ ID NO: 15615 - DNA, 27 bp, Artificial Sequence
  Synthetic
acattcattgcuccaacttctcttcuc

SEQ ID NO: 15616 - DNA, 23 bp, Artificial Sequence
  Synthetic
caccuacaaggucaaagacagca

SEQ ID NO: 15617 - DNA, 22 bp, Artificial Sequence
  Synthetic
agtccagtucgaaggaguggat

SEQ ID NO: 15618 - DNA, 22 bp, Artificial Sequence
  Synthetic
ctccagaaacuaggcctgacug

SEQ ID NO: 15619 - DNA, 29 bp, Artificial Sequence
  Synthetic
tcatcacccctugaagaaatatttgtgut

SEQ ID NO: 15620 - DNA, 27 bp, Artificial Sequence
  Synthetic
ttttctcaaaagagugtcccttctuca

SEQ ID NO: 15621 - DNA, 28 bp, Artificial Sequence
  Synthetic
ccgttcagaagautgaattgaaacctua

SEQ ID NO: 15622 - DNA, 18 bp, Artificial Sequence
  Synthetic
gcctcugaaggaggcugt

SEQ ID NO: 15623 - DNA, 22 bp, Artificial Sequence
  Synthetic
agccacttcugccaacttguag

SEQ ID NO: 15624 - DNA, 17 bp, Artificial Sequence
  Synthetic
ggccagggacugcacuc

SEQ ID NO: 15625 - DNA, 19 bp, Artificial Sequence
  Synthetic
gcccugaccactgctttuc

SEQ ID NO: 15626 - DNA, 21 bp, Artificial Sequence
  Synthetic
gggaaaggacucaggctugat

SEQ ID NO: 15627 - DNA, 26 bp, Artificial Sequence
  Synthetic
aaacctccaguttaattcctctcugg

SEQ ID NO: 15628 - DNA, 23 bp, Artificial Sequence
  Synthetic
ccttaacttcauggtgccatcug

SEQ ID NO: 15629 - DNA, 21 bp, Artificial Sequence
  Synthetic
cacccaguctcctttctucct

SEQ ID NO: 15630 - DNA, 24 bp, Artificial Sequence
  Synthetic
aactgagacaucctgaaauggaag

SEQ ID NO: 15631 - DNA, 24 bp, Artificial Sequence
  Synthetic
ccagtgatuctctttctguccaca

SEQ ID NO: 15632 - DNA, 20 bp, Artificial Sequence
  Synthetic
gccacuaaggctgtcugcat

SEQ ID NO: 15633 - DNA, 21 bp, Artificial Sequence
  Synthetic
ctgctcagugctcttctccug

SEQ ID NO: 15634 - DNA, 21 bp, Artificial Sequence
  Synthetic
ggtgccaggagaaugtgguat

SEQ ID NO: 15635 - DNA, 22 bp, Artificial Sequence
  Synthetic
ccccacctguggtctcatttuc

SEQ ID NO: 15636 - DNA, 29 bp, Artificial Sequence
  Synthetic
ttctttccttacaugctcagtttcctauc

SEQ ID NO: 15637 - DNA, 27 bp, Artificial Sequence
  Synthetic
acaagcaagutcaaataacaauggcaa

SEQ ID NO: 15638 - DNA, 23 bp, Artificial Sequence
  Synthetic
ctggcatctguacagtccagaut

SEQ ID NO: 15639 - DNA, 25 bp, Artificial Sequence
  Synthetic
tgactctgacutgcaatggattuca

SEQ ID NO: 15640 - DNA, 21 bp, Artificial Sequence
  Synthetic
aucactuaccaaaggccagca

SEQ ID NO: 15641 - DNA, 28 bp, Artificial Sequence
  Synthetic
gctttaugcagagaagaaguttacugag

SEQ ID NO: 15642 - DNA, 19 bp, Artificial Sequence
  Synthetic
cgggtccuctgcggtttut

SEQ ID NO: 15643 - DNA, 23 bp, Artificial Sequence
  Synthetic
ctggaagaaugtgacctugacca

SEQ ID NO: 15644 - DNA, 23 bp, Artificial Sequence
  Synthetic
ccttttctgutgccttcttucct

SEQ ID NO: 15645 - DNA, 24 bp, Artificial Sequence
  Synthetic
aatcccaaugcaagacaauggaga

SEQ ID NO: 15646 - DNA, 27 bp, Artificial Sequence
  Synthetic
agcaaactaactuaccttacctccuct

SEQ ID NO: 15647 - DNA, 24 bp, Artificial Sequence
  Synthetic
catatgctgcucctgctgatcaua

SEQ ID NO: 15648 - DNA, 23 bp, Artificial Sequence
  Synthetic
cattgtgtugcacactaacuggt

SEQ ID NO: 15649 - DNA, 28 bp, Artificial Sequence
  Synthetic
ttctgtagttcuttttctggaaguggaa

SEQ ID NO: 15650 - DNA, 27 bp, Artificial Sequence
  Synthetic
attgagttttgggutcatttgtgtugt

SEQ ID NO: 15651 - DNA, 25 bp, Artificial Sequence
  Synthetic
ccaacacctaacugctctgatacug

SEQ ID NO: 15652 - DNA, 26 bp, Artificial Sequence
  Synthetic
atagcttagugagaggatgtgaauga

SEQ ID NO: 15653 - DNA, 27 bp, Artificial Sequence
  Synthetic
cagtacctctugcttggagagtuaaat

SEQ ID NO: 15654 - DNA, 29 bp, Artificial Sequence
  Synthetic
tgaacagagaacagauacagaaaacaugg

SEQ ID NO: 15655 - DNA, 25 bp, Artificial Sequence
  Synthetic
cttctttagtcutctggcacaguga

SEQ ID NO: 15656 - DNA, 27 bp, Artificial Sequence
  Synthetic
tccgtttttaagaaaugggagtctgut

SEQ ID NO: 15657 - DNA, 27 bp, Artificial Sequence
  Synthetic
ccttaaaggaaacugctatcgaactug

SEQ ID NO: 15658 - DNA, 24 bp, Artificial Sequence
  Synthetic
ccacgcagutttctguaaaggaaa

SEQ ID NO: 15659 - DNA, 27 bp, Artificial Sequence
  Synthetic
catgttgcctuagtaatgtctctcuct

SEQ ID NO: 15660 - DNA, 20 bp, Artificial Sequence
  Synthetic
gagcucaaccagagcgucat

SEQ ID NO: 15661 - DNA, 29 bp, Artificial Sequence
  Synthetic
gtatattggaacuttctgtttcactugct

SEQ ID NO: 15662 - DNA, 24 bp, Artificial Sequence
  Synthetic
tcaaacucctataccugcccaaga

SEQ ID NO: 15663 - DNA, 22 bp, Artificial Sequence
  Synthetic
atgcacatugctgctgcaauag

SEQ ID NO: 15664 - DNA, 24 bp, Artificial Sequence
  Synthetic
gccauaccacgagaggaaaaugat

SEQ ID NO: 15665 - DNA, 24 bp, Artificial Sequence
  Synthetic
tcagaagctuagatatgtggguca

SEQ ID NO: 15666 - DNA, 20 bp, Artificial Sequence
  Synthetic
ggtcugggcgccataauact

SEQ ID NO: 15667 - DNA, 28 bp, Artificial Sequence
  Synthetic
tttctcttuaacagctgataagaugcga

SEQ ID NO: 15668 - DNA, 23 bp, Artificial Sequence
  Synthetic
ccggacgaagaugacttctacut

SEQ ID NO: 15669 - DNA, 21 bp, Artificial Sequence
  Synthetic
gttcucaagcagcatcuccgt

SEQ ID NO: 15670 - DNA, 17 bp, Artificial Sequence
  Synthetic
ggtuccaccgcccaguc

SEQ ID NO: 15671 - DNA, 17 bp, Artificial Sequence
  Synthetic
gcgggauccacgcacuc

SEQ ID NO: 15672 - DNA, 22 bp, Artificial Sequence
  Synthetic
gctgatccucaaacgatgccut

SEQ ID NO: 15673 - DNA, 22 bp, Artificial Sequence
  Synthetic
gctcaagcucttagccttuggg

SEQ ID NO: 15674 - DNA, 20 bp, Artificial Sequence
  Synthetic
gaacacgcucggacttgcua

SEQ ID NO: 15675 - DNA, 18 bp, Artificial Sequence
  Synthetic
ggucctacugcccaccca

SEQ ID NO: 15676 - DNA, 32 bp, Artificial Sequence
  Synthetic
cagagtgttgtgcutagtaaaatgaatttuga

SEQ ID NO: 15677 - DNA, 30 bp, Artificial Sequence
  Synthetic
ttaccttataugccaaataccaatcatuct

SEQ ID NO: 15678 - DNA, 32 bp, Artificial Sequence
  Synthetic
tagataatucaaagaggaggaattutgaucac

SEQ ID NO: 15679 - DNA, 25 bp, Artificial Sequence
  Synthetic
tccatttcuggcaatacagcacuat

SEQ ID NO: 15680 - DNA, 24 bp, Artificial Sequence
  Synthetic
gttcctctgtutttcatggcguag

SEQ ID NO: 15681 - DNA, 27 bp, Artificial Sequence
  Synthetic
actggttaacaaguctttgtcctugag

SEQ ID NO: 15682 - DNA, 26 bp, Artificial Sequence
  Synthetic
cagcaaactuacaagattgtuaccga

SEQ ID NO: 15683 - DNA, 23 bp, Artificial Sequence
  Synthetic
ccaccaccaacuttaugaggaca

SEQ ID NO: 15684 - DNA, 30 bp, Artificial Sequence
  Synthetic
ctttttctttucttcttgattaucaaggct

SEQ ID NO: 15685 - DNA, 32 bp, Artificial Sequence
  Synthetic
atttaacaccattctuctggatatctacagua

SEQ ID NO: 15686 - DNA, 30 bp, Artificial Sequence
  Synthetic
ttattcagtattccugtgtacattttcugt

SEQ ID NO: 15687 - DNA, 25 bp, Artificial Sequence
  Synthetic
ctccaaaatggcuggtcgtacauat

SEQ ID NO: 15688 - DNA, 30 bp, Artificial Sequence
  Synthetic
tgtatgtgtatgtuaccacattttatguga

SEQ ID NO: 15689 - DNA, 21 bp, Artificial Sequence
  Synthetic
agcccatgcuaacccaaaucc

SEQ ID NO: 15690 - DNA, 27 bp, Artificial Sequence
  Synthetic
tccctaagcatguaatagagtgtgcua

SEQ ID NO: 15691 - DNA, 32 bp, Artificial Sequence
  Synthetic
gagaagctaagtuaaactatgaaaacaaacug

SEQ ID NO: 15692 - DNA, 20 bp, Artificial Sequence
  Synthetic
ggtgcttutaggagcuccgt

SEQ ID NO: 15693 - DNA, 17 bp, Artificial Sequence
  Synthetic
ctggccgaggccutgut

SEQ ID NO: 15694 - DNA, 28 bp, Artificial Sequence
  Synthetic
gtgcagaugaagccttaaauaaagacaa

SEQ ID NO: 15695 - DNA, 22 bp, Artificial Sequence
  Synthetic
cctttctucccccatcacccua

SEQ ID NO: 15696 - DNA, 21 bp, Artificial Sequence
  Synthetic
tcuaggaaggaaacgcccuca

SEQ ID NO: 15697 - DNA, 24 bp, Artificial Sequence
  Synthetic
gataccaaacaguagggcgacuac

SEQ ID NO: 15698 - DNA, 26 bp, Artificial Sequence
  Synthetic
attctggcttucctgaaattgcatut

SEQ ID NO: 15699 - DNA, 21 bp, Artificial Sequence
  Synthetic
acagatcuccctccucaccac

SEQ ID NO: 15700 - DNA, 31 bp, Artificial Sequence
  Synthetic
acaattctaaagagtucattgtcctgttcuc

SEQ ID NO: 15701 - DNA, 21 bp, Artificial Sequence
  Synthetic
aacatcaccccaaugccauca

SEQ ID NO: 15702 - DNA, 29 bp, Artificial Sequence
  Synthetic
ggagatttttctgaauggaacaaatggut

SEQ ID NO: 15703 - DNA, 30 bp, Artificial Sequence
  Synthetic
tctatggcatcuagacgatcattaauagca

SEQ ID NO: 15704 - DNA, 30 bp, Artificial Sequence
  Synthetic
gaagaagttgcugatggttttaagtcuaaa

SEQ ID NO: 15705 - DNA, 25 bp, Artificial Sequence
  Synthetic
ctgcttugggagtaataaguccagt

SEQ ID NO: 15706 - DNA, 25 bp, Artificial Sequence
  Synthetic
ggagggatgtaucattgaaggacug

SEQ ID NO: 15707 - DNA, 22 bp, Artificial Sequence
  Synthetic
agcuggcaaacagcactactua

SEQ ID NO: 15708 - DNA, 31 bp, Artificial Sequence
  Synthetic
gaaactgttacuaccagtcataaaagaccut

SEQ ID NO: 15709 - DNA, 30 bp, Artificial Sequence
  Synthetic
gtctagtaaacacuctatcaattggtguga

SEQ ID NO: 15710 - DNA, 22 bp, Artificial Sequence
  Synthetic
tgagagggcacutctcttgcua

SEQ ID NO: 15711 - DNA, 32 bp, Artificial Sequence
  Synthetic
tttaggacaagcucccttaatgaatttauaga

SEQ ID NO: 15712 - DNA, 27 bp, Artificial Sequence
  Synthetic
gctgtccataaautgctgactttgaut

SEQ ID NO: 15713 - DNA, 30 bp, Artificial Sequence
  Synthetic
ttcctagaaagaaaauggaaaaatggucat

SEQ ID NO: 15714 - DNA, 23 bp, Artificial Sequence
  Synthetic
gagaagtacauggacgtgucagg

SEQ ID NO: 15715 - DNA, 26 bp, Artificial Sequence
  Synthetic
cgaaagtggacaccaugtcgatauag

SEQ ID NO: 15716 - DNA, 24 bp, Artificial Sequence
  Synthetic
ggaggaagaagagagugcctuaca

SEQ ID NO: 15717 - DNA, 27 bp, Artificial Sequence
  Synthetic
ccaaatggtcacutgtctctcagauag

SEQ ID NO: 15718 - DNA, 23 bp, Artificial Sequence
  Synthetic
ggagtcaugaacgacttugacga

SEQ ID NO: 15719 - DNA, 21 bp, Artificial Sequence
  Synthetic
gggaaagucatcuggcaggac

SEQ ID NO: 15720 - DNA, 20 bp, Artificial Sequence
  Synthetic
tctcacccccuggtctctut

SEQ ID NO: 15721 - DNA, 21 bp, Artificial Sequence
  Synthetic
gtgaggutgagcauccgagag

SEQ ID NO: 15722 - DNA, 30 bp, Artificial Sequence
  Synthetic
ctagtttgatctucaagttttctccaagut

SEQ ID NO: 15723 - DNA, 24 bp, Artificial Sequence
  Synthetic
cactaccugctaccataucagaga

SEQ ID NO: 15724 - DNA, 21 bp, Artificial Sequence
  Synthetic
gtggacgtcucctgtccttuc

SEQ ID NO: 15725 - DNA, 20 bp, Artificial Sequence
  Synthetic
agtuggacccaacgctucat

SEQ ID NO: 15726 - DNA, 29 bp, Artificial Sequence
  Synthetic
cgcccatcatatutcttcagaatagtgut

SEQ ID NO: 15727 - DNA, 23 bp, Artificial Sequence
  Synthetic
cctctcacuggcttctcctcuac

SEQ ID NO: 15728 - DNA, 19 bp, Artificial Sequence
  Synthetic
gaccgugccacccagaaua

SEQ ID NO: 15729 - DNA, 29 bp, Artificial Sequence
  Synthetic
ctataaagaagcauaatgttggcgucaaa

SEQ ID NO: 15730 - DNA, 20 bp, Artificial Sequence
  Synthetic
gccccguctagtggtaaugg

SEQ ID NO: 15731 - DNA, 18 bp, Artificial Sequence
  Synthetic
cgccggcutctcctacug

SEQ ID NO: 15732 - DNA, 22 bp, Artificial Sequence
  Synthetic
gttcatgtugggcttgctctug

SEQ ID NO: 15733 - DNA, 20 bp, Artificial Sequence
  Synthetic
atccagcugtggcagttuct

SEQ ID NO: 15734 - DNA, 28 bp, Artificial Sequence
  Synthetic
gagaaggaaaacuatggtaggaaacugg

SEQ ID NO: 15735 - DNA, 24 bp, Artificial Sequence
  Synthetic
agutatgcuggcacaagcaaaaat

SEQ ID NO: 15736 - DNA, 28 bp, Artificial Sequence
  Synthetic
ttgagatcatctccuaactccctatguc

SEQ ID NO: 15737 - DNA, 29 bp, Artificial Sequence
  Synthetic
gtacatcaggguactttgaacattccaua

SEQ ID NO: 15738 - DNA, 21 bp, Artificial Sequence
  Synthetic
cagagaaccugcagcaugaca

SEQ ID NO: 15739 - DNA, 22 bp, Artificial Sequence
  Synthetic
tgctctttgcauactgcaguga

SEQ ID NO: 15740 - DNA, 29 bp, Artificial Sequence
  Synthetic
actatgaaugagcagaaaaucatagcuaa

SEQ ID NO: 15741 - DNA, 24 bp, Artificial Sequence
  Synthetic
cctgtgtgaggaugagctcttuac

SEQ ID NO: 15742 - DNA, 25 bp, Artificial Sequence
  Synthetic
gtttgacctggugatgcttttcauc

SEQ ID NO: 15743 - DNA, 25 bp, Artificial Sequence
  Synthetic
tgaacagagaaugtactcuggagca

SEQ ID NO: 15744 - DNA, 25 bp, Artificial Sequence
  Synthetic
aatgaagcugaagttgatacugcct

SEQ ID NO: 15745 - DNA, 21 bp, Artificial Sequence
  Synthetic
ccaccaccucccaccaatuat

SEQ ID NO: 15746 - DNA, 22 bp, Artificial Sequence
  Synthetic
gcgaguggagttugggaaagat

SEQ ID NO: 15747 - DNA, 25 bp, Artificial Sequence
  Synthetic
cagcttttcatgutggatcaggtug

SEQ ID NO: 15748 - DNA, 23 bp, Artificial Sequence
  Synthetic
agaatacgacacucaggauggga

SEQ ID NO: 15749 - DNA, 25 bp, Artificial Sequence
  Synthetic
tgtggaatuccccatgaacatucaa

SEQ ID NO: 15750 - DNA, 24 bp, Artificial Sequence
  Synthetic
gagagaagtuggagtccatgtcug

SEQ ID NO: 15751 - DNA, 23 bp, Artificial Sequence
  Synthetic
acttcuagggagtcttgugggaa

SEQ ID NO: 15752 - DNA, 23 bp, Artificial Sequence
  Synthetic
ggttgttttcugagggcaaugat

SEQ ID NO: 15753 - DNA, 28 bp, Artificial Sequence
  Synthetic
gggtcacattcugaatttttctcttcug

SEQ ID NO: 15754 - DNA, 25 bp, Artificial Sequence
  Synthetic
ggaactaatccuttcctccatguga

SEQ ID NO: 15755 - DNA, 25 bp, Artificial Sequence
  Synthetic
gtcctatgctuctgcctacacuaac

SEQ ID NO: 15756 - DNA, 23 bp, Artificial Sequence
  Synthetic
tgtagttgauggaccaggaguga

SEQ ID NO: 15757 - DNA, 22 bp, Artificial Sequence
  Synthetic
atttcagtgccutggtgacugt

SEQ ID NO: 15758 - DNA, 28 bp, Artificial Sequence
  Synthetic
gaggtcaagtucccatatgtaagatucc

SEQ ID NO: 15759 - DNA, 26 bp, Artificial Sequence
  Synthetic
gctcatuggaagaaaccaaacatcuc

SEQ ID NO: 15760 - DNA, 27 bp, Artificial Sequence
  Synthetic
ggaatacaguaagggaagtattuggct

SEQ ID NO: 15761 - DNA, 23 bp, Artificial Sequence
  Synthetic
gtgtcaagcaguctccatacuca

SEQ ID NO: 15762 - DNA, 23 bp, Artificial Sequence
  Synthetic
ggaaaccutccagtuggacacaa

SEQ ID NO: 15763 - DNA, 20 bp, Artificial Sequence
  Synthetic
gcccatggaucccccaauag

SEQ ID NO: 15764 - DNA, 25 bp, Artificial Sequence
  Synthetic
agguatctcuacaaaacccaccaga

SEQ ID NO: 15765 - DNA, 29 bp, Artificial Sequence
  Synthetic
gggucccaaaaattatauaagcacagaag

SEQ ID NO: 15766 - DNA, 24 bp, Artificial Sequence
  Synthetic
cgtaagcuacagcugaaggaagaa

SEQ ID NO: 15767 - DNA, 21 bp, Artificial Sequence
  Synthetic
gttcaccacugtctcguccag

SEQ ID NO: 15768 - DNA, 28 bp, Artificial Sequence
  Synthetic
aaaggttcactacuagtaaactgcaguc

SEQ ID NO: 15769 - DNA, 26 bp, Artificial Sequence
  Synthetic
acagacaatgtcaucacaggaggaua

SEQ ID NO: 15770 - DNA, 32 bp, Artificial Sequence
  Synthetic
tttacaagaaaaatcaaucttctgttcaggug

SEQ ID NO: 15771 - DNA, 22 bp, Artificial Sequence
  Synthetic
ggactgtaccugccaacaacut

SEQ ID NO: 15772 - DNA, 30 bp, Artificial Sequence
  Synthetic
tgagttttgaguattttcaaaagctucaga

SEQ ID NO: 15773 - DNA, 30 bp, Artificial Sequence
  Synthetic
ttcactgagtagtutgcattggatatguaa

SEQ ID NO: 15774 - DNA, 24 bp, Artificial Sequence
  Synthetic
gaugttaatgugcaccccacaaag

SEQ ID NO: 15775 - DNA, 22 bp, Artificial Sequence
  Synthetic
ccccagagaaguagctggauga

SEQ ID NO: 15776 - DNA, 22 bp, Artificial Sequence
  Synthetic
gaagtggcugccaaaaaucaga

SEQ ID NO: 15777 - DNA, 24 bp, Artificial Sequence
  Synthetic
acagaataaaggagguaggctgua

SEQ ID NO: 15778 - DNA, 21 bp, Artificial Sequence
  Synthetic
gggctgtgugaatcctcagug

SEQ ID NO: 15779 - DNA, 20 bp, Artificial Sequence
  Synthetic
tgctcccuggaccattgtug

SEQ ID NO: 15780 - DNA, 29 bp, Artificial Sequence
  Synthetic
ctatgacagcatuatttcttgttccctug

SEQ ID NO: 15781 - DNA, 28 bp, Artificial Sequence
  Synthetic
aaatgcttagtauctgcttgatcacuga

SEQ ID NO: 15782 - DNA, 23 bp, Artificial Sequence
  Synthetic
gaagtggacugtggaacacatug

SEQ ID NO: 15783 - DNA, 29 bp, Artificial Sequence
  Synthetic
acatcccacagugcataaataaccataut

SEQ ID NO: 15784 - DNA, 23 bp, Artificial Sequence
  Synthetic
gtctggctcutctcctctttcuc

SEQ ID NO: 15785 - DNA, 21 bp, Artificial Sequence
  Synthetic
actuaccaacacacggccauc

SEQ ID NO: 15786 - DNA, 23 bp, Artificial Sequence
  Synthetic
gactgtggtuctcattgcatucc

SEQ ID NO: 15787 - DNA, 27 bp, Artificial Sequence
  Synthetic
gttcagtttuaaataggtgttguccgt

SEQ ID NO: 15788 - DNA, 30 bp, Artificial Sequence
  Synthetic
cataggtttauattttcagagcugaccgaa

SEQ ID NO: 15789 - DNA, 22 bp, Artificial Sequence
  Synthetic
cagguagggcctucaaaccaat

SEQ ID NO: 15790 - DNA, 25 bp, Artificial Sequence
  Synthetic
tgtggcttttuaacccatagctgut

SEQ ID NO: 15791 - DNA, 29 bp, Artificial Sequence
  Synthetic
agttgccatatcacuctcacactaatuac

SEQ ID NO: 15792 - DNA, 21 bp, Artificial Sequence
  Synthetic
cgggcuccatcaacaucacag

SEQ ID NO: 15793 - DNA, 21 bp, Artificial Sequence
  Synthetic
cactagcccacuccagcuaaa

SEQ ID NO: 15794 - DNA, 22 bp, Artificial Sequence
  Synthetic
cagtgagcaugtgacuggagag

SEQ ID NO: 15795 - DNA, 22 bp, Artificial Sequence
  Synthetic
cttgggtgcugagtatgagcut

SEQ ID NO: 15796 - DNA, 24 bp, Artificial Sequence
  Synthetic
cccatctgtuggtgctttttctut

SEQ ID NO: 15797 - DNA, 20 bp, Artificial Sequence
  Synthetic
ggtcccguctgtgtccctua

SEQ ID NO: 15798 - DNA, 23 bp, Artificial Sequence
  Synthetic
acaggaaauggaggtctgctaut

SEQ ID NO: 15799 - DNA, 23 bp, Artificial Sequence
  Synthetic
ccaccagaugagagtcgatuagg

SEQ ID NO: 15800 - DNA, 30 bp, Artificial Sequence
  Synthetic
ttgttgtggattugtctttgttcttaatuc

SEQ ID NO: 15801 - DNA, 27 bp, Artificial Sequence
  Synthetic
cgactttcttctutagcaagagcacua

SEQ ID NO: 15802 - DNA, 21 bp, Artificial Sequence
  Synthetic
gttttcacugttgcgtugcct

SEQ ID NO: 15803 - DNA, 21 bp, Artificial Sequence
  Synthetic
gacctgcaaucaccagacuca

SEQ ID NO: 15804 - DNA, 19 bp, Artificial Sequence
  Synthetic
tcgugccggattucgaagt

SEQ ID NO: 15805 - DNA, 17 bp, Artificial Sequence
  Synthetic
gcuctccucgccccaga

SEQ ID NO: 15806 - DNA, 24 bp, Artificial Sequence
  Synthetic
ggtgcaauttaggauacccccaaa

SEQ ID NO: 15807 - DNA, 24 bp, Artificial Sequence
  Synthetic
caagatgcgugatgtcatacugga

SEQ ID NO: 15808 - DNA, 27 bp, Artificial Sequence
  Synthetic
tutagcaaataaacaugccaaccaagt

SEQ ID NO: 15809 - DNA, 26 bp, Artificial Sequence
  Synthetic
gagaggagaggagauaugaatuacct

SEQ ID NO: 15810 - DNA, 28 bp, Artificial Sequence
  Synthetic
cgatgacatcautagcctagaaucaagt

SEQ ID NO: 15811 - DNA, 24 bp, Artificial Sequence
  Synthetic
agaaaagaacccuggaaacaccuc

SEQ ID NO: 15812 - DNA, 24 bp, Artificial Sequence
  Synthetic
ttttucccacagagtcugaagcaa

SEQ ID NO: 15813 - DNA, 23 bp, Artificial Sequence
  Synthetic
gctgtaggaaucaactctccuct

SEQ ID NO: 15814 - DNA, 30 bp, Artificial Sequence
  Synthetic
gctctgcctattucagtgttttatcttuac

SEQ ID NO: 15815 - DNA, 23 bp, Artificial Sequence
  Synthetic
agaacgggutcttgcttgaugat

SEQ ID NO: 15816 - DNA, 23 bp, Artificial Sequence
  Synthetic
gagcaguatgagcauggaagaga

SEQ ID NO: 15817 - DNA, 30 bp, Artificial Sequence
  Synthetic
ggaaaattaucaagaaaaucccttcaggua

SEQ ID NO: 15818 - DNA, 21 bp, Artificial Sequence
  Synthetic
aaagaccugttggguggacaa

SEQ ID NO: 15819 - DNA, 23 bp, Artificial Sequence
  Synthetic
ctatacacuaccgcttccauggg

SEQ ID NO: 15820 - DNA, 22 bp, Artificial Sequence
  Synthetic
tgtccatacugccccttuaacg

SEQ ID NO: 15821 - DNA, 26 bp, Artificial Sequence
  Synthetic
ttacaaatguggactgttaggcugaa

SEQ ID NO: 15822 - DNA, 30 bp, Artificial Sequence
  Synthetic
aagatgcatatgtaaauggtggtctaacut

SEQ ID NO: 15823 - DNA, 22 bp, Artificial Sequence
  Synthetic
cacctttugcctcacguagagt

SEQ ID NO: 15824 - DNA, 21 bp, Artificial Sequence
  Synthetic
gcggcttugggttctguagac

SEQ ID NO: 15825 - DNA, 29 bp, Artificial Sequence
  Synthetic
tggtgccatagcguaatttgtaatatgua

SEQ ID NO: 15826 - DNA, 21 bp, Artificial Sequence
  Synthetic
ggccactugcatacaccaugt

SEQ ID NO: 15827 - DNA, 24 bp, Artificial Sequence
  Synthetic
ttttatcctcguctggtggaaugg

SEQ ID NO: 15828 - DNA, 25 bp, Artificial Sequence
  Synthetic
gtaactgctgcauctgtaaaagcug

SEQ ID NO: 15829 - DNA, 26 bp, Artificial Sequence
  Synthetic
ttctcagcattugatgatgatgguga

SEQ ID NO: 15830 - DNA, 26 bp, Artificial Sequence
  Synthetic
tcttacatgauttgcaatgcucaaca

SEQ ID NO: 15831 - DNA, 30 bp, Artificial Sequence
  Synthetic
gtuagtggattaaaatcucccaagaggaat

SEQ ID NO: 15832 - DNA, 21 bp, Artificial Sequence
  Synthetic
ccaagacuccaaagcccagua

SEQ ID NO: 15833 - DNA, 21 bp, Artificial Sequence
  Synthetic
gttcagccauccagaaugggt

SEQ ID NO: 15834 - DNA, 19 bp, Artificial Sequence
  Synthetic
caggatgugtccggagugg

SEQ ID NO: 15835 - DNA, 25 bp, Artificial Sequence
  Synthetic
agaugtccaacaaguccaagaagag

SEQ ID NO: 15836 - DNA, 22 bp, Artificial Sequence
  Synthetic
ctgtaatuaaccgccagcucct

SEQ ID NO: 15837 - DNA, 19 bp, Artificial Sequence
  Synthetic
ggccacuacctgtgcaaug

SEQ ID NO: 15838 - DNA, 20 bp, Artificial Sequence
  Synthetic
catgctcuccgtcagugaca

SEQ ID NO: 15839 - DNA, 19 bp, Artificial Sequence
  Synthetic
tctggcucccacctttucg

SEQ ID NO: 15840 - DNA, 18 bp, Artificial Sequence
  Synthetic
gggctgugcaacaagugt

SEQ ID NO: 15841 - DNA, 20 bp, Artificial Sequence
  Synthetic
tggttcugggagtcgtgauc

SEQ ID NO: 15842 - DNA, 18 bp, Artificial Sequence
  Synthetic
cccagagggugtgagguc

SEQ ID NO: 15843 - DNA, 17 bp, Artificial Sequence
  Synthetic
tgcatucgcgccucgat

SEQ ID NO: 15844 - DNA, 20 bp, Artificial Sequence
  Synthetic
gaagccagacugcagguact

SEQ ID NO: 15845 - DNA, 19 bp, Artificial Sequence
  Synthetic
cgcaugaagaggccctucc

SEQ ID NO: 15846 - DNA, 17 bp, Artificial Sequence
  Synthetic
ctcucgcggaucgccat

SEQ ID NO: 15847 - DNA, 18 bp, Artificial Sequence
  Synthetic
ccggucgcacagucaagg

SEQ ID NO: 15848 - DNA, 18 bp, Artificial Sequence
  Synthetic
ccgctuacggccaaguct

SEQ ID NO: 15849 - DNA, 18 bp, Artificial Sequence
  Synthetic
ggagccccuctctgtugg

SEQ ID NO: 15850 - DNA, 20 bp, Artificial Sequence
  Synthetic
ggcctccutctcaaccucag

SEQ ID NO: 15851 - DNA, 18 bp, Artificial Sequence
  Synthetic
ccacgcugacctuggagt

SEQ ID NO: 15852 - DNA, 23 bp, Artificial Sequence
  Synthetic
gtgttgttuccctcagtgguaca

SEQ ID NO: 15853 - DNA, 22 bp, Artificial Sequence
  Synthetic
gggagcaucttcagcauacaca

SEQ ID NO: 15854 - DNA, 28 bp, Artificial Sequence
  Synthetic
gttattgcttgagucttttcagcaugaa

SEQ ID NO: 15855 - DNA, 26 bp, Artificial Sequence
  Synthetic
cttutccattttctguaaggccaact

SEQ ID NO: 15856 - DNA, 26 bp, Artificial Sequence
  Synthetic
cttugaaccaagaauaagtcatugct

SEQ ID NO: 15857 - DNA, 27 bp, Artificial Sequence
  Synthetic
ttctgaggtucttcaataccttugacc

SEQ ID NO: 15858 - DNA, 26 bp, Artificial Sequence
  Synthetic
ctcttacaaggcugttttactccugt

SEQ ID NO: 15859 - DNA, 26 bp, Artificial Sequence
  Synthetic
agggatgcacuttcaattagaucagg

SEQ ID NO: 15860 - DNA, 23 bp, Artificial Sequence
  Synthetic
atttugggcagagaactuggact

SEQ ID NO: 15861 - DNA, 28 bp, Artificial Sequence
  Synthetic
attccctgagaugacagattattucaga

SEQ ID NO: 15862 - DNA, 28 bp, Artificial Sequence
  Synthetic
agctttgtcaagutaaactggtgtauct

SEQ ID NO: 15863 - DNA, 25 bp, Artificial Sequence
  Synthetic
cgagguataagccuagccagaaaaa

SEQ ID NO: 15864 - DNA, 28 bp, Artificial Sequence
  Synthetic
tgaactgagtuagagtgcttttctaugg

SEQ ID NO: 15865 - DNA, 22 bp, Artificial Sequence
  Synthetic
ccacagauctctggcaugaagg

SEQ ID NO: 15866 - DNA, 29 bp, Artificial Sequence
  Synthetic
cctgcctacutactatttaaacuccaaca

SEQ ID NO: 15867 - DNA, 25 bp, Artificial Sequence
  Synthetic
ctctccctcuaccatcagagauact

SEQ ID NO: 15868 - DNA, 28 bp, Artificial Sequence
  Synthetic
tggacattcatttugttcttcctcagut

SEQ ID NO: 15869 - DNA, 29 bp, Artificial Sequence
  Synthetic
gatctagacagtcuatcatcccctaacut

SEQ ID NO: 15870 - DNA, 24 bp, Artificial Sequence
  Synthetic
aggtgatgcucatgcttttgauga

SEQ ID NO: 15871 - DNA, 24 bp, Artificial Sequence
  Synthetic
cutcttttaagttcucgggagcca

SEQ ID NO: 15872 - DNA, 24 bp, Artificial Sequence
  Synthetic
ccactctggucaaccttgauaacg

SEQ ID NO: 15873 - DNA, 22 bp, Artificial Sequence
  Synthetic
cccaggcauatgctatgaugct

SEQ ID NO: 15874 - DNA, 22 bp, Artificial Sequence
  Synthetic
cacaggaggaautgcaaccgua

SEQ ID NO: 15875 - DNA, 29 bp, Artificial Sequence
  Synthetic
aaccagugacaagtaatttacaugaagga

SEQ ID NO: 15876 - DNA, 27 bp, Artificial Sequence
  Synthetic
tgaagtaagcaucttctttgtcaucca

SEQ ID NO: 15877 - DNA, 27 bp, Artificial Sequence
  Synthetic
agcactgatcaaautcataaggaguga

SEQ ID NO: 15878 - DNA, 28 bp, Artificial Sequence
  Synthetic
agcaaatatcatugtcagacctguaagg

SEQ ID NO: 15879 - DNA, 27 bp, Artificial Sequence
  Synthetic
tggcatgagugaaatatagtcaacugt

SEQ ID NO: 15880 - DNA, 28 bp, Artificial Sequence
  Synthetic
gttaaaaagccaucactttacaguggaa

SEQ ID NO: 15881 - DNA, 22 bp, Artificial Sequence
  Synthetic
gacctgctucagatggttccut

SEQ ID NO: 15882 - DNA, 24 bp, Artificial Sequence
  Synthetic
gggttccautttcaaagguaacga

SEQ ID NO: 15883 - DNA, 23 bp, Artificial Sequence
  Synthetic
actttggtucaacaggactggug

SEQ ID NO: 15884 - DNA, 27 bp, Artificial Sequence
  Synthetic
tgtactgacaucatcaaggtcacuact

SEQ ID NO: 15885 - DNA, 28 bp, Artificial Sequence
  Synthetic
gctacacaggauattttgaaggcacuat

SEQ ID NO: 15886 - DNA, 25 bp, Artificial Sequence
  Synthetic
accatggacgutttatccatagcug

SEQ ID NO: 15887 - DNA, 25 bp, Artificial Sequence
  Synthetic
agaacccaaaucaagugcaaagact

SEQ ID NO: 15888 - DNA, 27 bp, Artificial Sequence
  Synthetic
tcgtagcaagugatggatuaagagaga

SEQ ID NO: 15889 - DNA, 28 bp, Artificial Sequence
  Synthetic
caaggcatttaacuggaagtccaattua

SEQ ID NO: 15890 - DNA, 26 bp, Artificial Sequence
  Synthetic
gtgatctgctagutcagccttagaut

SEQ ID NO: 15891 - DNA, 28 bp, Artificial Sequence
  Synthetic
cttgtaaaattuggtaagattggcuggt

SEQ ID NO: 15892 - DNA, 25 bp, Artificial Sequence
  Synthetic
cucttgagtacugagaccaaaagca

SEQ ID NO: 15893 - DNA, 24 bp, Artificial Sequence
  Synthetic
ccttcaauttcctcauggccaaag

SEQ ID NO: 15894 - DNA, 22 bp, Artificial Sequence
  Synthetic
ctactccauctgcatcuggcat

SEQ ID NO: 15895 - DNA, 28 bp, Artificial Sequence
  Synthetic
cttcaaagaacaacauaataagguggct

SEQ ID NO: 15896 - DNA, 30 bp, Artificial Sequence
  Synthetic
agtaaaatgccagcaaauatatcacgagua

SEQ ID NO: 15897 - DNA, 27 bp, Artificial Sequence
  Synthetic
ggaggaggaaaguttccagagauagat

SEQ ID NO: 15898 - DNA, 27 bp, Artificial Sequence
  Synthetic
agtttcgttggcaguaatttttgctut

SEQ ID NO: 15899 - DNA, 23 bp, Artificial Sequence
  Synthetic
cgggatgaccautctcttgtguc

SEQ ID NO: 15900 - DNA, 24 bp, Artificial Sequence
  Synthetic
ctataacacucagccagttccugt

SEQ ID NO: 15901 - DNA, 20 bp, Artificial Sequence
  Synthetic
ctggcccugctgcataguag

SEQ ID NO: 15902 - DNA, 23 bp, Artificial Sequence
  Synthetic
cutgagcaccugaccaaaaagat

SEQ ID NO: 15903 - DNA, 25 bp, Artificial Sequence
  Synthetic
ctcaaatacttuaccagtggagcug

SEQ ID NO: 15904 - DNA, 20 bp, Artificial Sequence
  Synthetic
caccgggaaggccuatcauc

SEQ ID NO: 15905 - DNA, 22 bp, Artificial Sequence
  Synthetic
ggtggugacgagagagtaggut

SEQ ID NO: 15906 - DNA, 21 bp, Artificial Sequence
  Synthetic
gttctaggautgcggtgguct

SEQ ID NO: 15907 - DNA, 21 bp, Artificial Sequence
  Synthetic
cggcugaacaggtgacugaat

SEQ ID NO: 15908 - DNA, 17 bp, Artificial Sequence
  Synthetic
gggcaggutgggcatug

SEQ ID NO: 15909 - DNA, 18 bp, Artificial Sequence
  Synthetic
tgaacccuggacccugct

SEQ ID NO: 15910 - DNA, 17 bp, Artificial Sequence
  Synthetic
gccccugagcgtcauct

SEQ ID NO: 15911 - DNA, 21 bp, Artificial Sequence
  Synthetic
ctgtgcgucactgtacaccut

SEQ ID NO: 15912 - DNA, 18 bp, Artificial Sequence
  Synthetic
cctggccaaugtgucgga

SEQ ID NO: 15913 - DNA, 19 bp, Artificial Sequence
  Synthetic
ggcaugggacagagtcgut

SEQ ID NO: 15914 - DNA, 23 bp, Artificial Sequence
  Synthetic
gcttcttccugttcatcctggug

SEQ ID NO: 15915 - DNA, 23 bp, Artificial Sequence
  Synthetic
ggcagcucagaacctggtatcua

SEQ ID NO: 15916 - DNA, 17 bp, Artificial Sequence
  Synthetic
tccacugccaggcugac

SEQ ID NO: 15917 - DNA, 18 bp, Artificial Sequence
  Synthetic
gcccccucctcaccttuc

SEQ ID NO: 15918 - DNA, 20 bp, Artificial Sequence
  Synthetic
agcagcucacctucaaggac

SEQ ID NO: 15919 - DNA, 17 bp, Artificial Sequence
  Synthetic
ggcagggcugaagccuc

SEQ ID NO: 15920 - DNA, 20 bp, Artificial Sequence
  Synthetic
tgtctgtccugggagtcuca

SEQ ID NO: 15921 - DNA, 21 bp, Artificial Sequence
  Synthetic
cctcctucagcagctugaaga

SEQ ID NO: 15922 - DNA, 18 bp, Artificial Sequence
  Synthetic
gagguggctgugcgaaga

SEQ ID NO: 15923 - DNA, 18 bp, Artificial Sequence
  Synthetic
gtccccugaggagcugga

SEQ ID NO: 15924 - DNA, 21 bp, Artificial Sequence
  Synthetic
ttgatcgccgcguttaagtug

SEQ ID NO: 15925 - DNA, 25 bp, Artificial Sequence
  Synthetic
agagacagagauaggaaguttcgua

SEQ ID NO: 15926 - DNA, 30 bp, Artificial Sequence
  Synthetic
tgtttgtttgtttutaggagttatgguaca

SEQ ID NO: 15927 - DNA, 32 bp, Artificial Sequence
  Synthetic
cctatttaagatatgugccttatttccctaut

SEQ ID NO: 15928 - DNA, 27 bp, Artificial Sequence
  Synthetic
gaagataccuggaaagcttactgugaa

SEQ ID NO: 15929 - DNA, 20 bp, Artificial Sequence
  Synthetic
gggaguaaaagugggacggt

SEQ ID NO: 15930 - DNA, 25 bp, Artificial Sequence
  Synthetic
gaaagaaacugcccttccatcuaca

SEQ ID NO: 15931 - DNA, 32 bp, Artificial Sequence
  Synthetic
caaatacaatgtaaagauaccaatgtcguaca

SEQ ID NO: 15932 - DNA, 28 bp, Artificial Sequence
  Synthetic
agactataactaucagccgaguagaagg

SEQ ID NO: 15933 - DNA, 24 bp, Artificial Sequence
  Synthetic
aaaacacagcauagcactaugact

SEQ ID NO: 15934 - DNA, 27 bp, Artificial Sequence
  Synthetic
gattgaatgttucaggttttcctccuc

SEQ ID NO: 15935 - DNA, 28 bp, Artificial Sequence
  Synthetic
aagtatatggutcttctgucaaaaggct

SEQ ID NO: 15936 - DNA, 19 bp, Artificial Sequence
  Synthetic
cctggtuctgctcctucgt

SEQ ID NO: 15937 - DNA, 23 bp, Artificial Sequence
  Synthetic
ctctctctggugcgttctcttuc

SEQ ID NO: 15938 - DNA, 24 bp, Artificial Sequence
  Synthetic
cagaaagaggutatgagcgucaca

SEQ ID NO: 15939 - DNA, 29 bp, Artificial Sequence
  Synthetic
cgacaatgtaguaagtcaaaatctcucac

SEQ ID NO: 15940 - DNA, 19 bp, Artificial Sequence
  Synthetic
cagcuaccgcgaugagagg

SEQ ID NO: 15941 - DNA, 18 bp, Artificial Sequence
  Synthetic
cacaggctucgccgagua

SEQ ID NO: 15942 - DNA, 24 bp, Artificial Sequence
  Synthetic
aagtgtttucagtgtctgugacca

SEQ ID NO: 15943 - DNA, 22 bp, Artificial Sequence
  Synthetic
ggtcacttcugggtctgugaga

SEQ ID NO: 15944 - DNA, 26 bp, Artificial Sequence
  Synthetic
tgtgtccaaagcaagcuatcttctua

SEQ ID NO: 15945 - DNA, 27 bp, Artificial Sequence
  Synthetic
gaaaacutatcatcucccacagagaca

SEQ ID NO: 15946 - DNA, 30 bp, Artificial Sequence
  Synthetic
cttccccatgauaaacactacagtattugt

SEQ ID NO: 15947 - DNA, 32 bp, Artificial Sequence
  Synthetic
tgatattactttcatuctcagacttgggauaa

SEQ ID NO: 15948 - DNA, 23 bp, Artificial Sequence
  Synthetic
agggatuagagagggagugaagt

SEQ ID NO: 15949 - DNA, 22 bp, Artificial Sequence
  Synthetic
cacacatuggagcatgccatuc

SEQ ID NO: 15950 - DNA, 27 bp, Artificial Sequence
  Synthetic
agtttgtgatuccacatttctctucca

SEQ ID NO: 15951 - DNA, 30 bp, Artificial Sequence
  Synthetic
actutggagagagaacaaauaaatggtuac

SEQ ID NO: 15952 - DNA, 27 bp, Artificial Sequence
  Synthetic
gttgtgcttttugctaaaatgcatgut

SEQ ID NO: 15953 - DNA, 20 bp, Artificial Sequence
  Synthetic
cagctuggacacggcttuac

SEQ ID NO: 15954 - DNA, 24 bp, Artificial Sequence
  Synthetic
cattgccacugtcttttccttucc

SEQ ID NO: 15955 - DNA, 22 bp, Artificial Sequence
  Synthetic
tgccaccuggtaagaaaagcuc

SEQ ID NO: 15956 - DNA, 29 bp, Artificial Sequence
  Synthetic
tttcagcaauagcagcauctataagaaua

SEQ ID NO: 15957 - DNA, 22 bp, Artificial Sequence
  Synthetic
accagacgucacttucaaacgt

SEQ ID NO: 15958 - DNA, 28 bp, Artificial Sequence
  Synthetic
ctggaattattacugaagttgctggaug

SEQ ID NO: 15959 - DNA, 29 bp, Artificial Sequence
  Synthetic
tcaattagcugaacaatttgcttgaaugt

SEQ ID NO: 15960 - DNA, 20 bp, Artificial Sequence
  Synthetic
cttgugcacgacgatgtcug

SEQ ID NO: 15961 - DNA, 22 bp, Artificial Sequence
  Synthetic
ggccacuaaagtgtgcucagaa

SEQ ID NO: 15962 - DNA, 21 bp, Artificial Sequence
  Synthetic
gtgatauccggactgguagcc

SEQ ID NO: 15963 - DNA, 26 bp, Artificial Sequence
  Synthetic
aaagaattgucttctctcugccaact

SEQ ID NO: 15964 - DNA, 21 bp, Artificial Sequence
  Synthetic
cgagauggccttgaagucacc

SEQ ID NO: 15965 - DNA, 24 bp, Artificial Sequence
  Synthetic
gcctaccucacctgtttcctguat

SEQ ID NO: 15966 - DNA, 27 bp, Artificial Sequence
  Synthetic
tctggauggaaggacaaaaagaaauga

SEQ ID NO: 15967 - DNA, 26 bp, Artificial Sequence
  Synthetic
tgaatccttgtcutctacccctguag

SEQ ID NO: 15968 - DNA, 23 bp, Artificial Sequence
  Synthetic
atcacccugtctgctcugacaag

SEQ ID NO: 15969 - DNA, 22 bp, Artificial Sequence
  Synthetic
gatcugaaacggcgctuggaca

SEQ ID NO: 15970 - DNA, 27 bp, Artificial Sequence
  Synthetic
ggtgaccaataugaatgaggatctuga

SEQ ID NO: 15971 - DNA, 23 bp, Artificial Sequence
  Synthetic
ccggaggguaagttgtatagugg

SEQ ID NO: 15972 - DNA, 23 bp, Artificial Sequence
  Synthetic
tgcaugggcagaagggaaatuat

SEQ ID NO: 15973 - DNA, 30 bp, Artificial Sequence
  Synthetic
tgttgatactcautcaattgtgtcttucca

SEQ ID NO: 15974 - DNA, 22 bp, Artificial Sequence
  Synthetic
catgagacutcgatgcttuccc

SEQ ID NO: 15975 - DNA, 30 bp, Artificial Sequence
  Synthetic
accagaaccatutcaaaagttataatucca

SEQ ID NO: 15976 - DNA, 24 bp, Artificial Sequence
  Synthetic
caagcttguaccatgtgaggtuct

SEQ ID NO: 15977 - DNA, 25 bp, Artificial Sequence
  Synthetic
tgagctguaccaagttaaaucacca

SEQ ID NO: 15978 - DNA, 23 bp, Artificial Sequence
  Synthetic
gctgtaagaaaugcaagauggca

SEQ ID NO: 15979 - DNA, 21 bp, Artificial Sequence
  Synthetic
ggattccuaccaguacggcac

SEQ ID NO: 15980 - DNA, 24 bp, Artificial Sequence
  Synthetic
tcaaaggauttgctcucacacgaa

SEQ ID NO: 15981 - DNA, 22 bp, Artificial Sequence
  Synthetic
ggcatggaauctctgguggaag

SEQ ID NO: 15982 - DNA, 22 bp, Artificial Sequence
  Synthetic
ccaaagaggccccuatctcuca

SEQ ID NO: 15983 - DNA, 30 bp, Artificial Sequence
  Synthetic
gagaaaagctugtcttaaattguacagcaa

SEQ ID NO: 15984 - DNA, 32 bp, Artificial Sequence
  Synthetic
ttataaaaactuaagagacgatuggaggagat

SEQ ID NO: 15985 - DNA, 22 bp, Artificial Sequence
  Synthetic
gtgaccaacauggagtcgtgua

SEQ ID NO: 15986 - DNA, 30 bp, Artificial Sequence
  Synthetic
tccactcaauaaacaatcagttactuaaca

SEQ ID NO: 15987 - DNA, 21 bp, Artificial Sequence
  Synthetic
gcccaggcucagcauacaaaa

SEQ ID NO: 15988 - DNA, 27 bp, Artificial Sequence
  Synthetic
acaatagguagcaaaccatacatucaa

SEQ ID NO: 15989 - DNA, 29 bp, Artificial Sequence
  Synthetic
gattaccttttgucaaagcatcatcucaa

SEQ ID NO: 15990 - DNA, 27 bp, Artificial Sequence
  Synthetic
ctgggtcttaagugaaagtttttgcut

SEQ ID NO: 15991 - DNA, 28 bp, Artificial Sequence
  Synthetic
gattctgacctcuatgtaaactgagcug

SEQ ID NO: 15992 - DNA, 22 bp, Artificial Sequence
  Synthetic
tuttcaatctgtugccccaagc

SEQ ID NO: 15993 - DNA, 25 bp, Artificial Sequence
  Synthetic
ggactttgatguggacatgaaguga

SEQ ID NO: 15994 - DNA, 30 bp, Artificial Sequence
  Synthetic
ctcatttttaaugaacaaaacgaaagguga

SEQ ID NO: 15995 - DNA, 29 bp, Artificial Sequence
  Synthetic
acaagtggaauggaactcaaagacaauat

SEQ ID NO: 15996 - DNA, 23 bp, Artificial Sequence
  Synthetic
gtctctggaucccacaccttuac

SEQ ID NO: 15997 - DNA, 25 bp, Artificial Sequence
  Synthetic
gccactctuagggtttgggatatug

SEQ ID NO: 15998 - DNA, 32 bp, Artificial Sequence
  Synthetic
gctacttgcaaugatatacacaaaattaugac

SEQ ID NO: 15999 - DNA, 28 bp, Artificial Sequence
  Synthetic
gatcacatgctuacagttttgtgguaac

SEQ ID NO: 16000 - DNA, 28 bp, Artificial Sequence
  Synthetic
tttcagaatcacuctgcttttcaaagua

SEQ ID NO: 16001 - DNA, 25 bp, Artificial Sequence
  Synthetic
agacatgtcgcuactggagaattut

SEQ ID NO: 16002 - DNA, 27 bp, Artificial Sequence
  Synthetic
aatcccttatttugcagcaattaagug

SEQ ID NO: 16003 - DNA, 20 bp, Artificial Sequence
  Synthetic
ggaccucagagcagccaaug

SEQ ID NO: 16004 - DNA, 26 bp, Artificial Sequence
  Synthetic
gtcacagattcuaatgtggacaugct

SEQ ID NO: 16005 - DNA, 25 bp, Artificial Sequence
  Synthetic
caagctgcatguatgtatgtgtguc

SEQ ID NO: 16006 - DNA, 23 bp, Artificial Sequence
  Synthetic
agtaggtttucccggtttugaca

SEQ ID NO: 16007 - DNA, 17 bp, Artificial Sequence
  Synthetic
cagcaggccutgggtuc

SEQ ID NO: 16008 - DNA, 32 bp, Artificial Sequence
  Synthetic
aatctattattgttttcutccaactgtcctug

SEQ ID NO: 16009 - DNA, 23 bp, Artificial Sequence
  Synthetic
tgaaucgtgtgguagaggaggaa

SEQ ID NO: 16010 - DNA, 28 bp, Artificial Sequence
  Synthetic
gttttatctaagtccucttctgcagcua

SEQ ID NO: 16011 - DNA, 29 bp, Artificial Sequence
  Synthetic
gcacaggttattuacattgatgttcaguc

SEQ ID NO: 16012 - DNA, 28 bp, Artificial Sequence
  Synthetic
tgccttuaagaagaaaauagcaagagua

SEQ ID NO: 16013 - DNA, 29 bp, Artificial Sequence
  Synthetic
gattaattattgccautctcatcccagug

SEQ ID NO: 16014 - DNA, 27 bp, Artificial Sequence
  Synthetic
aaactacugagcaggautttcctttut

SEQ ID NO: 16015 - DNA, 28 bp, Artificial Sequence
  Synthetic
cttuggaaaaggagaaagagauacauct

SEQ ID NO: 16016 - DNA, 21 bp, Artificial Sequence
  Synthetic
cccagtctuacgtgttgccut

SEQ ID NO: 16017 - DNA, 20 bp, Artificial Sequence
  Synthetic
gtggtguaactcgtcucggt

SEQ ID NO: 16018 - DNA, 22 bp, Artificial Sequence
  Synthetic
gtgctgaggaucagggattuca

SEQ ID NO: 16019 - DNA, 25 bp, Artificial Sequence
  Synthetic
aattaccttgccuagtcacagucac

SEQ ID NO: 16020 - DNA, 29 bp, Artificial Sequence
  Synthetic
acttagttaacttacuggcttctgttgut

SEQ ID NO: 16021 - DNA, 28 bp, Artificial Sequence
  Synthetic
ctctggacaagutaaatccatacacuct

SEQ ID NO: 16022 - DNA, 28 bp, Artificial Sequence
  Synthetic
actaaaattgutgattgtgaucgaccca

SEQ ID NO: 16023 - DNA, 27 bp, Artificial Sequence
  Synthetic
gttagacutaaaagagcugaagcacct

SEQ ID NO: 16024 - DNA, 27 bp, Artificial Sequence
  Synthetic
actacatttgutccactactugcagaa

SEQ ID NO: 16025 - DNA, 29 bp, Artificial Sequence
  Synthetic
gacataacatttugttgtgtgagucaaga

SEQ ID NO: 16026 - DNA, 22 bp, Artificial Sequence
  Synthetic
cccaacuccagtgatgaagugt

SEQ ID NO: 16027 - DNA, 28 bp, Artificial Sequence
  Synthetic
agctgatgattguatggaatctattgug

SEQ ID NO: 16028 - DNA, 18 bp, Artificial Sequence
  Synthetic
aguaccacggcctgtucc

SEQ ID NO: 16029 - DNA, 29 bp, Artificial Sequence
  Synthetic
gcagttgacttautcagcatattctgugt

SEQ ID NO: 16030 - DNA, 25 bp, Artificial Sequence
  Synthetic
gctgaagttguagcaggaactacua

SEQ ID NO: 16031 - DNA, 20 bp, Artificial Sequence
  Synthetic
gguccaggtacugagggaca

SEQ ID NO: 16032 - DNA, 24 bp, Artificial Sequence
  Synthetic
gcaaaataccaucaccgccatcua

SEQ ID NO: 16033 - DNA, 23 bp, Artificial Sequence
  Synthetic
cgagcactguccagtattcuacc

SEQ ID NO: 16034 - DNA, 27 bp, Artificial Sequence
  Synthetic
acaactcagaagcautttctctuaccc

SEQ ID NO: 16035 - DNA, 28 bp, Artificial Sequence
  Synthetic
gtgtggttttacauaggccatttttcut

SEQ ID NO: 16036 - DNA, 28 bp, Artificial Sequence
  Synthetic
accagtttcattuccaatgatggttcua

SEQ ID NO: 16037 - DNA, 23 bp, Artificial Sequence
  Synthetic
tgttcactctgutacagcaccut

SEQ ID NO: 16038 - DNA, 23 bp, Artificial Sequence
  Synthetic
ttaaataggugcgatgcacggua

SEQ ID NO: 16039 - DNA, 22 bp, Artificial Sequence
  Synthetic
tgggtggaauggactacuccaa

SEQ ID NO: 16040 - DNA, 29 bp, Artificial Sequence
  Synthetic
catcttgtgagagucacttcataauccaa

SEQ ID NO: 16041 - DNA, 28 bp, Artificial Sequence
  Synthetic
agagatttgacauaatggcatgattugt

SEQ ID NO: 16042 - DNA, 30 bp, Artificial Sequence
  Synthetic
gattagagggtugaaagaaggactattuga

SEQ ID NO: 16043 - DNA, 26 bp, Artificial Sequence
  Synthetic
cauggaccaacccaagtatuaagagt

SEQ ID NO: 16044 - DNA, 28 bp, Artificial Sequence
  Synthetic
agtagaataatcaacagugcatgaggug

SEQ ID NO: 16045 - DNA, 27 bp, Artificial Sequence
  Synthetic
tctaggtcucatcaaactcttugcaag

SEQ ID NO: 16046 - DNA, 25 bp, Artificial Sequence
  Synthetic
gtccgaaugtaagaatgtugcaagt

SEQ ID NO: 16047 - DNA, 29 bp, Artificial Sequence
  Synthetic
gcuaattacattgtcuggaaaacaaacca

SEQ ID NO: 16048 - DNA, 23 bp, Artificial Sequence
  Synthetic
tctctgaagaucaactgccucca

SEQ ID NO: 16049 - DNA, 29 bp, Artificial Sequence
  Synthetic
cttctcttttgtugggatttcttgaugag

SEQ ID NO: 16050 - DNA, 22 bp, Artificial Sequence
  Synthetic
gtcaacuatctccaugcacgct

SEQ ID NO: 16051 - DNA, 28 bp, Artificial Sequence
  Synthetic
cagtgattcaauggcaaaggagttuaat

SEQ ID NO: 16052 - DNA, 25 bp, Artificial Sequence
  Synthetic
gtctttgctuggttttgttgtcuct

SEQ ID NO: 16053 - DNA, 23 bp, Artificial Sequence
  Synthetic
ccaccagugaatctcagaacugt

SEQ ID NO: 16054 - DNA, 29 bp, Artificial Sequence
  Synthetic
aagtgagaacaauccctgtataaagcaut

SEQ ID NO: 16055 - DNA, 18 bp, Artificial Sequence
  Synthetic
gggtccaccccugctcua

SEQ ID NO: 16056 - DNA, 24 bp, Artificial Sequence
  Synthetic
catctcaccccutgtcttttucct

SEQ ID NO: 16057 - DNA, 21 bp, Artificial Sequence
  Synthetic
ggtctcugcagcaaaaagucc

SEQ ID NO: 16058 - DNA, 24 bp, Artificial Sequence
  Synthetic
cagaggtttuctctttcagucgct

SEQ ID NO: 16059 - DNA, 21 bp, Artificial Sequence
  Synthetic
gatacagggutcagtgugggt

SEQ ID NO: 16060 - DNA, 26 bp, Artificial Sequence
  Synthetic
gctgaaattgcagaaucaggacttua

SEQ ID NO: 16061 - DNA, 20 bp, Artificial Sequence
  Synthetic
gtgacucagggactgaugcc

SEQ ID NO: 16062 - DNA, 27 bp, Artificial Sequence
  Synthetic
acttttcgttcucttcattcttuccca

SEQ ID NO: 16063 - DNA, 22 bp, Artificial Sequence
  Synthetic
gctcaaccagutcctcaaaguc

SEQ ID NO: 16064 - DNA, 21 bp, Artificial Sequence
  Synthetic
agcctctccugcactccttua

SEQ ID NO: 16065 - DNA, 22 bp, Artificial Sequence
  Synthetic
cattttcacaagcugggcctug

SEQ ID NO: 16066 - DNA, 20 bp, Artificial Sequence
  Synthetic
cttggctcugtggagtcgut

SEQ ID NO: 16067 - DNA, 19 bp, Artificial Sequence
  Synthetic
gtggucagctcctucacga

SEQ ID NO: 16068 - DNA, 22 bp, Artificial Sequence
  Synthetic
atggtctcttucttgtgggcut

SEQ ID NO: 16069 - DNA, 24 bp, Artificial Sequence
  Synthetic
ggtaggagtguaactgaggacuca

SEQ ID NO: 16070 - DNA, 20 bp, Artificial Sequence
  Synthetic
cgcgacaacauccaggguat

SEQ ID NO: 16071 - DNA, 19 bp, Artificial Sequence
  Synthetic
cgtgcuccgtgtaggucac

SEQ ID NO: 16072 - DNA, 21 bp, Artificial Sequence
  Synthetic
ggaagaugagtgagucgagct

SEQ ID NO: 16073 - DNA, 23 bp, Artificial Sequence
  Synthetic
accaagugaagcaaaggttugga

SEQ ID NO: 16074 - DNA, 18 bp, Artificial Sequence
  Synthetic
cugcccaccucacaggag

SEQ ID NO: 16075 - DNA, 20 bp, Artificial Sequence
  Synthetic
caaagcugtccagucccaga

SEQ ID NO: 16076 - DNA, 21 bp, Artificial Sequence
  Synthetic
ggagcttcuccactgtcugaa

SEQ ID NO: 16077 - DNA, 21 bp, Artificial Sequence
  Synthetic
gagtcctutctgcgttuccca

SEQ ID NO: 16078 - DNA, 20 bp, Artificial Sequence
  Synthetic
ggagggacguagcagugact

SEQ ID NO: 16079 - DNA, 26 bp, Artificial Sequence
  Synthetic
gggtagaagauggaagaaaggctaug

SEQ ID NO: 16080 - DNA, 29 bp, Artificial Sequence
  Synthetic
tttcctttgtaacaugtatcatcatcuga

SEQ ID NO: 16081 - DNA, 21 bp, Artificial Sequence
  Synthetic
ggucagggcagttguaagcag

SEQ ID NO: 16082 - DNA, 22 bp, Artificial Sequence
  Synthetic
ggaggccaggcauttttcacua

SEQ ID NO: 16083 - DNA, 23 bp, Artificial Sequence
  Synthetic
gcagcacttcuttgtccactcut

SEQ ID NO: 16084 - DNA, 20 bp, Artificial Sequence
  Synthetic
gccgccutgaaacattuggg

SEQ ID NO: 16085 - DNA, 22 bp, Artificial Sequence
  Synthetic
caggcucagcctttatccucag

SEQ ID NO: 16086 - DNA, 23 bp, Artificial Sequence
  Synthetic
ctcaggaacguaccctgacttug

SEQ ID NO: 16087 - DNA, 27 bp, Artificial Sequence
  Synthetic
aagtatgaaugcctacagaacugcaat

SEQ ID NO: 16088 - DNA, 27 bp, Artificial Sequence
  Synthetic
ggtaccaaagugatcctccatctuaaa

SEQ ID NO: 16089 - DNA, 22 bp, Artificial Sequence
  Synthetic
acaggaaacaucctgcacgtua

SEQ ID NO: 16090 - DNA, 22 bp, Artificial Sequence
  Synthetic
ccaggtctgguctagctgttut

SEQ ID NO: 16091 - DNA, 29 bp, Artificial Sequence
  Synthetic
cacttcttaacaaugtttttgcgaaugac

SEQ ID NO: 16092 - DNA, 21 bp, Artificial Sequence
  Synthetic
tcctgggaacuggcagtauga

SEQ ID NO: 16093 - DNA, 22 bp, Artificial Sequence
  Synthetic
gcacacaguactcgtcaauggg

SEQ ID NO: 16094 - DNA, 24 bp, Artificial Sequence
  Synthetic
ccaatauggagcggatcaugaaag

SEQ ID NO: 16095 - DNA, 22 bp, Artificial Sequence
  Synthetic
caccaggtccutaactgcctua

SEQ ID NO: 16096 - DNA, 17 bp, Artificial Sequence
  Synthetic
cgctcuctccgcucgaa

SEQ ID NO: 16097 - DNA, 21 bp, Artificial Sequence
  Synthetic
gtcttcatcgucctcctccuc

SEQ ID NO: 16098 - DNA, 23 bp, Artificial Sequence
  Synthetic
cuacttcaaggauaagggcgaca

SEQ ID NO: 16099 - DNA, 18 bp, Artificial Sequence
  Synthetic
agcgcacuccgacgaauc

SEQ ID NO: 16100 - DNA, 24 bp, Artificial Sequence
  Synthetic
ctgtctccauggacaauagcaaca

SEQ ID NO: 16101 - DNA, 17 bp, Artificial Sequence
  Synthetic
cugccaggccactugga

SEQ ID NO: 16102 - DNA, 19 bp, Artificial Sequence
  Synthetic
ctcaugcagcggagctcua

SEQ ID NO: 16103 - DNA, 21 bp, Artificial Sequence
  Synthetic
gatggtctgcaugggagacug

SEQ ID NO: 16104 - DNA, 22 bp, Artificial Sequence
  Synthetic
ccagccuaaccagggaagttug

SEQ ID NO: 16105 - DNA, 19 bp, Artificial Sequence
  Synthetic
caaggcugctggacucact

SEQ ID NO: 16106 - DNA, 20 bp, Artificial Sequence
  Synthetic
acccgccuttcattuaggca

SEQ ID NO: 16107 - DNA, 28 bp, Artificial Sequence
  Synthetic
tcaaaattagatgauctgcacactcugt

SEQ ID NO: 16108 - DNA, 22 bp, Artificial Sequence
  Synthetic
tttgcaacuagcaccagggtua

SEQ ID NO: 16109 - DNA, 31 bp, Artificial Sequence
  Synthetic
tttcatttcctgtttuagagaggagagatug

SEQ ID NO: 16110 - DNA, 21 bp, Artificial Sequence
  Synthetic
ctccgcatcuatcagcaggut

SEQ ID NO: 16111 - DNA, 31 bp, Artificial Sequence
  Synthetic
gattaatcgguaactgtacctuacaaagagt

SEQ ID NO: 16112 - DNA, 27 bp, Artificial Sequence
  Synthetic
ccttcatatctcgucctagcaattgua

SEQ ID NO: 16113 - DNA, 29 bp, Artificial Sequence
  Synthetic
tttgagattcaugcaaaagctacttaugt

SEQ ID NO: 16114 - DNA, 26 bp, Artificial Sequence
  Synthetic
cacttcagcgugacatatuaaagcaa

SEQ ID NO: 16115 - DNA, 27 bp, Artificial Sequence
  Synthetic
atccaacatgugggatttttccttaua

SEQ ID NO: 16116 - DNA, 22 bp, Artificial Sequence
  Synthetic
tcacuggagcgttaaauggcat

SEQ ID NO: 16117 - DNA, 22 bp, Artificial Sequence
  Synthetic
gacagaagaugaccagccugag

SEQ ID NO: 16118 - DNA, 22 bp, Artificial Sequence
  Synthetic
ctcttgttucagcccacgtcua

SEQ ID NO: 16119 - DNA, 22 bp, Artificial Sequence
  Synthetic
ccaagtgacgcuttccagacut

SEQ ID NO: 16120 - DNA, 28 bp, Artificial Sequence
  Synthetic
gtgtgtttatcugaaggtgatagagcut

SEQ ID NO: 16121 - DNA, 28 bp, Artificial Sequence
  Synthetic
ggttttcttaacutctggattcaagugg

SEQ ID NO: 16122 - DNA, 28 bp, Artificial Sequence
  Synthetic
ttctgtgcagaacugataatgctaucaa

SEQ ID NO: 16123 - DNA, 20 bp, Artificial Sequence
  Synthetic
agccugagcaaaacccauca

SEQ ID NO: 16124 - DNA, 26 bp, Artificial Sequence
  Synthetic
ccugagaaggaaaagcgaauaaagga

SEQ ID NO: 16125 - DNA, 31 bp, Artificial Sequence
  Synthetic
gtgtaatattuagaagagaagagcgctuagg

SEQ ID NO: 16126 - DNA, 21 bp, Artificial Sequence
  Synthetic
tgctttgcgutgagcatcuct

SEQ ID NO: 16127 - DNA, 25 bp, Artificial Sequence
  Synthetic
gtgtgatgutggctaggugaaaaat

SEQ ID NO: 16128 - DNA, 28 bp, Artificial Sequence
  Synthetic
gtcaggaaaacautcttgttatcuaggt

SEQ ID NO: 16129 - DNA, 27 bp, Artificial Sequence
  Synthetic
ggaagttaaagaaggcauttccaaguc

SEQ ID NO: 16130 - DNA, 27 bp, Artificial Sequence
  Synthetic
ccaagaacucctacaccatucaaacat

SEQ ID NO: 16131 - DNA, 22 bp, Artificial Sequence
  Synthetic
guctgaggcuaaacggaagagt

SEQ ID NO: 16132 - DNA, 23 bp, Artificial Sequence
  Synthetic
aaacutcttctgcucacaccact

SEQ ID NO: 16133 - DNA, 23 bp, Artificial Sequence
  Synthetic
ccctaugccacacacaggattuc

SEQ ID NO: 16134 - DNA, 22 bp, Artificial Sequence
  Synthetic
gaaccugcatcctguggaaaga

SEQ ID NO: 16135 - DNA, 29 bp, Artificial Sequence
  Synthetic
cttgaagtgttcugaaaaccataatgcut

SEQ ID NO: 16136 - DNA, 25 bp, Artificial Sequence
  Synthetic
ctcgtgtttgutgctggataaaugt

SEQ ID NO: 16137 - DNA, 28 bp, Artificial Sequence
  Synthetic
cagccatgtuaaaatctggaaactucat

SEQ ID NO: 16138 - DNA, 29 bp, Artificial Sequence
  Synthetic
tgagacatttttcaguaggtatctttgut

SEQ ID NO: 16139 - DNA, 22 bp, Artificial Sequence
  Synthetic
gcccgctugtcttcttctuacc

SEQ ID NO: 16140 - DNA, 27 bp, Artificial Sequence
  Synthetic
gaactttagauggcaaagacaaagcug

SEQ ID NO: 16141 - DNA, 26 bp, Artificial Sequence
  Synthetic
ccctaguctcatagcucaaaaaccat

SEQ ID NO: 16142 - DNA, 29 bp, Artificial Sequence
  Synthetic
ctttctttugaacaacaaagcttgaugac

SEQ ID NO: 16143 - DNA, 23 bp, Artificial Sequence
  Synthetic
ggtcagtccuctgtccttgtuaa

SEQ ID NO: 16144 - DNA, 26 bp, Artificial Sequence
  Synthetic
tgcaacaaaatguattcgggtctcua

SEQ ID NO: 16145 - DNA, 22 bp, Artificial Sequence
  Synthetic
cctctagcaaacccutcctgua

SEQ ID NO: 16146 - DNA, 28 bp, Artificial Sequence
  Synthetic
cagaactucaagagaactctcucaaaga

SEQ ID NO: 16147 - DNA, 26 bp, Artificial Sequence
  Synthetic
cauctgattuggagcacaaagaaagg

SEQ ID NO: 16148 - DNA, 30 bp, Artificial Sequence
  Synthetic
gtggaacattgagaauttatgcagatagut

SEQ ID NO: 16149 - DNA, 24 bp, Artificial Sequence
  Synthetic
gcgatgcaguaatccttagggtut

SEQ ID NO: 16150 - DNA, 28 bp, Artificial Sequence
  Synthetic
gcatcttttugagaaagtttugcacagt

SEQ ID NO: 16151 - DNA, 22 bp, Artificial Sequence
  Synthetic
ttctttgggaugtggtctggug

SEQ ID NO: 16152 - DNA, 26 bp, Artificial Sequence
  Synthetic
actttgcaaauagagctgtcttccut

SEQ ID NO: 16153 - DNA, 20 bp, Artificial Sequence
  Synthetic
gcaggaagcucagacuacgt

SEQ ID NO: 16154 - DNA, 25 bp, Artificial Sequence
  Synthetic
gagactatgccugtcattggaaugt

SEQ ID NO: 16155 - DNA, 31 bp, Artificial Sequence
  Synthetic
caagcacacttctaucaggtaatccataaut

SEQ ID NO: 16156 - DNA, 31 bp, Artificial Sequence
  Synthetic
tcttgatccatttuactccatctgatttuca

SEQ ID NO: 16157 - DNA, 28 bp, Artificial Sequence
  Synthetic
gacaacttaaaguggactgtagagcuat

SEQ ID NO: 16158 - DNA, 23 bp, Artificial Sequence
  Synthetic
ccttctggauggcaaatgcauct

SEQ ID NO: 16159 - DNA, 29 bp, Artificial Sequence
  Synthetic
ttaattatttagaguagtgccgcctucaa

SEQ ID NO: 16160 - DNA, 25 bp, Artificial Sequence
  Synthetic
tcttctctcagcucttccactucat

SEQ ID NO: 16161 - DNA, 23 bp, Artificial Sequence
  Synthetic
cttcucagcccaggcttcaauat

SEQ ID NO: 16162 - DNA, 23 bp, Artificial Sequence
  Synthetic
ccaggcagugagcatctctttut

SEQ ID NO: 16163 - DNA, 23 bp, Artificial Sequence
  Synthetic
cagatcaggaucctccuccaact

SEQ ID NO: 16164 - DNA, 28 bp, Artificial Sequence
  Synthetic
tctaaccauacagaagcacttccattuc

SEQ ID NO: 16165 - DNA, 21 bp, Artificial Sequence
  Synthetic
gcacgtgacuaattggccuac

SEQ ID NO: 16166 - DNA, 27 bp, Artificial Sequence
  Synthetic
gctgtgtaacaugattttccattgcua

SEQ ID NO: 16167 - DNA, 22 bp, Artificial Sequence
  Synthetic
ctgctttgcuacttccagtguc

SEQ ID NO: 16168 - DNA, 25 bp, Artificial Sequence
  Synthetic
agcagtatgaagaugaatgagguct

SEQ ID NO: 16169 - DNA, 25 bp, Artificial Sequence
  Synthetic
agatgttatctucgctgttgtucca

SEQ ID NO: 16170 - DNA, 26 bp, Artificial Sequence
  Synthetic
tctttttcttttugcagcgtgtuaca

SEQ ID NO: 16171 - DNA, 28 bp, Artificial Sequence
  Synthetic
aggagctctgauttatccacataucact

SEQ ID NO: 16172 - DNA, 24 bp, Artificial Sequence
  Synthetic
gagagaagaacaucagcgttggua

SEQ ID NO: 16173 - DNA, 21 bp, Artificial Sequence
  Synthetic
aaggctttucgggcttcauct

SEQ ID NO: 16174 - DNA, 19 bp, Artificial Sequence
  Synthetic
gcaagctcaugctggagug

SEQ ID NO: 16175 - DNA, 19 bp, Artificial Sequence
  Synthetic
ctcgcucttcgtucagcct

SEQ ID NO: 16176 - DNA, 22 bp, Artificial Sequence
  Synthetic
agcagtuagaagagaugcgcaa

SEQ ID NO: 16177 - DNA, 27 bp, Artificial Sequence
  Synthetic
acgttcaggcuaacttggtaaaatuct

SEQ ID NO: 16178 - DNA, 22 bp, Artificial Sequence
  Synthetic
cctcaaaacacaggucctcucc

SEQ ID NO: 16179 - DNA, 22 bp, Artificial Sequence
  Synthetic
ggaagaagguccccaugagact

SEQ ID NO: 16180 - DNA, 25 bp, Artificial Sequence
  Synthetic
ccccugaaaacttgacatucaagga

SEQ ID NO: 16181 - DNA, 27 bp, Artificial Sequence
  Synthetic
gggtaaatacaaagugttctcctcaut

SEQ ID NO: 16182 - DNA, 24 bp, Artificial Sequence
  Synthetic
ccaaatucccacataaaggtugca

SEQ ID NO: 16183 - DNA, 19 bp, Artificial Sequence
  Synthetic
tggagguagccccggtuat

SEQ ID NO: 16184 - DNA, 20 bp, Artificial Sequence
  Synthetic
tcctggucctgguccgaaat

SEQ ID NO: 16185 - DNA, 24 bp, Artificial Sequence
  Synthetic
tcagagutctaggaguggaagagg

SEQ ID NO: 16186 - DNA, 29 bp, Artificial Sequence
  Synthetic
caggatcauggtcatcaaaaguaacaaag

SEQ ID NO: 16187 - DNA, 28 bp, Artificial Sequence
  Synthetic
ctgtttgtuggcggaattaaagaagaua

SEQ ID NO: 16188 - DNA, 29 bp, Artificial Sequence
  Synthetic
gctgatagttatutcctccatgatucact

SEQ ID NO: 16189 - DNA, 26 bp, Artificial Sequence
  Synthetic
gctctttattgguggcttaagcttug

SEQ ID NO: 16190 - DNA, 24 bp, Artificial Sequence
  Synthetic
ttgattucaaacccgttaccucca

SEQ ID NO: 16191 - DNA, 17 bp, Artificial Sequence
  Synthetic
gaggugctccucgcaga

SEQ ID NO: 16192 - DNA, 24 bp, Artificial Sequence
  Synthetic
ggattugaagggaggagauactua

SEQ ID NO: 16193 - DNA, 22 bp, Artificial Sequence
  Synthetic
gcttgtggtuctcctccagtug

SEQ ID NO: 16194 - DNA, 19 bp, Artificial Sequence
  Synthetic
cgtcgccutggacuggaag

SEQ ID NO: 16195 - DNA, 22 bp, Artificial Sequence
  Synthetic
ctactacguggactcgttccug

SEQ ID NO: 16196 - DNA, 28 bp, Artificial Sequence
  Synthetic
ggcaaaatctgcauattatctcatgugt

SEQ ID NO: 16197 - DNA, 25 bp, Artificial Sequence
  Synthetic
acctcacugatcgtcaagucaaaat

SEQ ID NO: 16198 - DNA, 20 bp, Artificial Sequence
  Synthetic
ctgcccacggugctauagaa

SEQ ID NO: 16199 - DNA, 20 bp, Artificial Sequence
  Synthetic
aatctggcccacugctacuc

SEQ ID NO: 16200 - DNA, 21 bp, Artificial Sequence
  Synthetic
gggagaggaaaaugccaguct

SEQ ID NO: 16201 - DNA, 29 bp, Artificial Sequence
  Synthetic
agtcatcaacaaacugaaaaccactagut

SEQ ID NO: 16202 - DNA, 19 bp, Artificial Sequence
  Synthetic
agggcugggaataggucgt

SEQ ID NO: 16203 - DNA, 20 bp, Artificial Sequence
  Synthetic
ccacgaacccutgggtctuc

SEQ ID NO: 16204 - DNA, 18 bp, Artificial Sequence
  Synthetic
gtaguagccgcugccgaa

SEQ ID NO: 16205 - DNA, 17 bp, Artificial Sequence
  Synthetic
cgucgtccucgggaggt

SEQ ID NO: 16206 - DNA, 24 bp, Artificial Sequence
  Synthetic
ccagcatgttautgctgcatctuc

SEQ ID NO: 16207 - DNA, 23 bp, Artificial Sequence
  Synthetic
acgcuaagaatggucacagaaca

SEQ ID NO: 16208 - DNA, 24 bp, Artificial Sequence
  Synthetic
cacactttctcuttctcccctcuc

SEQ ID NO: 16209 - DNA, 21 bp, Artificial Sequence
  Synthetic
tgtcucgagggaatgtgucca

SEQ ID NO: 16210 - DNA, 19 bp, Artificial Sequence
  Synthetic
cccgggccauttaccgaug

SEQ ID NO: 16211 - DNA, 23 bp, Artificial Sequence
  Synthetic
ctctcgaugtagcaccaugacag

SEQ ID NO: 16212 - DNA, 22 bp, Artificial Sequence
  Synthetic
gggaagaatgugcggaggatut

SEQ ID NO: 16213 - DNA, 25 bp, Artificial Sequence
  Synthetic
ccgatgcaaaugatcccacagauat

SEQ ID NO: 16214 - DNA, 20 bp, Artificial Sequence
  Synthetic
cctuacacagaaggcuggca

SEQ ID NO: 16215 - DNA, 21 bp, Artificial Sequence
  Synthetic
aaggcccaugctttccaagua

SEQ ID NO: 16216 - DNA, 20 bp, Artificial Sequence
  Synthetic
actcactgucgcctgcttuc

SEQ ID NO: 16217 - DNA, 20 bp, Artificial Sequence
  Synthetic
gatggcgtugttgatggcut

SEQ ID NO: 16218 - DNA, 19 bp, Artificial Sequence
  Synthetic
acagcugccaagacuccac

SEQ ID NO: 16219 - DNA, 18 bp, Artificial Sequence
  Synthetic
gtccugcgagttcucgga

SEQ ID NO: 16220 - DNA, 20 bp, Artificial Sequence
  Synthetic
caccgctuccacatgagcua

SEQ ID NO: 16221 - DNA, 29 bp, Artificial Sequence
  Synthetic
acagttacaaauccaaacacaacattguc

SEQ ID NO: 16222 - DNA, 21 bp, Artificial Sequence
  Synthetic
ccagcaagcucgtagtgctut

SEQ ID NO: 16223 - DNA, 27 bp, Artificial Sequence
  Synthetic
ctgagagcugattaagagaaaauccca

SEQ ID NO: 16224 - DNA, 19 bp, Artificial Sequence
  Synthetic
cctuccagcgtccuaggag

SEQ ID NO: 16225 - DNA, 23 bp, Artificial Sequence
  Synthetic
tccctcttgucgttttccaucag

SEQ ID NO: 16226 - DNA, 28 bp, Artificial Sequence
  Synthetic
gtatgcaaaguatagaccaatgucagga

SEQ ID NO: 16227 - DNA, 28 bp, Artificial Sequence
  Synthetic
ggcacattuagaaaccatgcttctttut

SEQ ID NO: 16228 - DNA, 21 bp, Artificial Sequence
  Synthetic
atcttgcucaggcagttccuc

SEQ ID NO: 16229 - DNA, 28 bp, Artificial Sequence
  Synthetic
aaaaagtgtctautgccttgtatcucca

SEQ ID NO: 16230 - DNA, 24 bp, Artificial Sequence
  Synthetic
gatgagaggaggutcttcaagcug

SEQ ID NO: 16231 - DNA, 25 bp, Artificial Sequence
  Synthetic
ggttcautatggagtcuagggcaga

SEQ ID NO: 16232 - DNA, 24 bp, Artificial Sequence
  Synthetic
ttcctgctucaagctctcuagaac

SEQ ID NO: 16233 - DNA, 25 bp, Artificial Sequence
  Synthetic
gtttacagauctcttgttgaucgct

SEQ ID NO: 16234 - DNA, 20 bp, Artificial Sequence
  Synthetic
tcctgagcucgtccagtuct

SEQ ID NO: 16235 - DNA, 17 bp, Artificial Sequence
  Synthetic
gcggtuggcctcaugac

SEQ ID NO: 16236 - DNA, 21 bp, Artificial Sequence
  Synthetic
ctgagaggcauccatguccat

SEQ ID NO: 16237 - DNA, 24 bp, Artificial Sequence
  Synthetic
cactattugaggatgtgtcuccgt

SEQ ID NO: 16238 - DNA, 24 bp, Artificial Sequence
  Synthetic
tggagttugaagagaagctugaca

SEQ ID NO: 16239 - DNA, 23 bp, Artificial Sequence
  Synthetic
tctaccacctutctccctcacut

SEQ ID NO: 16240 - DNA, 26 bp, Artificial Sequence
  Synthetic
gtctattaccugaaagagcugacaaa

SEQ ID NO: 16241 - DNA, 25 bp, Artificial Sequence
  Synthetic
gcagcatcuacctgaaactgcuaag

SEQ ID NO: 16242 - DNA, 23 bp, Artificial Sequence
  Synthetic
gtttguggaacacauggcagaac

SEQ ID NO: 16243 - DNA, 22 bp, Artificial Sequence
  Synthetic
agcccatccgutgttttccaua

SEQ ID NO: 16244 - DNA, 19 bp, Artificial Sequence
  Synthetic
gttgggcaccugcttcaug

SEQ ID NO: 16245 - DNA, 17 bp, Artificial Sequence
  Synthetic
gggagccgucccgtuag

SEQ ID NO: 16246 - DNA, 23 bp, Artificial Sequence
  Synthetic
cugcagcaguaaagccaattuat

SEQ ID NO: 16247 - DNA, 27 bp, Artificial Sequence
  Synthetic
cgactgtatgucagcagtatgattgug

SEQ ID NO: 16248 - DNA, 29 bp, Artificial Sequence
  Synthetic
tccatgccttugaaagcaacaattttaut

SEQ ID NO: 16249 - DNA, 24 bp, Artificial Sequence
  Synthetic
gtgagaatacacuccagaggcaut

SEQ ID NO: 16250 - DNA, 24 bp, Artificial Sequence
  Synthetic
accagcttgtucatgtctggatuc

SEQ ID NO: 16251 - DNA, 22 bp, Artificial Sequence
  Synthetic
agaggactucgctgaatugacc

SEQ ID NO: 16252 - DNA, 24 bp, Artificial Sequence
  Synthetic
ctagataccccuctggaagctcut

SEQ ID NO: 16253 - DNA, 21 bp, Artificial Sequence
  Synthetic
cgatcgcacacauttgtcgug

SEQ ID NO: 16254 - DNA, 27 bp, Artificial Sequence
  Synthetic
acaaccuaaccagaaaattcctuggat

SEQ ID NO: 16255 - DNA, 32 bp, Artificial Sequence
  Synthetic
gtggccatttgaaauaattatggacatatuga

SEQ ID NO: 16256 - DNA, 28 bp, Artificial Sequence
  Synthetic
gtgggaattcuagacacatttcaatugg

SEQ ID NO: 16257 - DNA, 30 bp, Artificial Sequence
  Synthetic
ataaacatctugatttttcttcuccacaca

SEQ ID NO: 16258 - DNA, 31 bp, Artificial Sequence
  Synthetic
ctcaacattgtcagutttctattttgcttug

SEQ ID NO: 16259 - DNA, 23 bp, Artificial Sequence
  Synthetic
gagctctgaguagaaccatugct

SEQ ID NO: 16260 - DNA, 24 bp, Artificial Sequence
  Synthetic
tcctttgccautgttagcatucct

SEQ ID NO: 16261 - DNA, 29 bp, Artificial Sequence
  Synthetic
cataaaacggctucagaatgtaagtguat

SEQ ID NO: 16262 - DNA, 27 bp, Artificial Sequence
  Synthetic
tgtagtccauaaaacccatgagttcug

SEQ ID NO: 16263 - DNA, 25 bp, Artificial Sequence
  Synthetic
gcacttacaagccuatccaaaugag

SEQ ID NO: 16264 - DNA, 22 bp, Artificial Sequence
  Synthetic
ctctaaauccagagctggucca

SEQ ID NO: 16265 - DNA, 24 bp, Artificial Sequence
  Synthetic
agutcctaatcugcaaaggccaaa

SEQ ID NO: 16266 - DNA, 26 bp, Artificial Sequence
  Synthetic
tgcttttctaacuctctttgacugca

SEQ ID NO: 16267 - DNA, 24 bp, Artificial Sequence
  Synthetic
tttggattguggcacagagatuct

SEQ ID NO: 16268 - DNA, 28 bp, Artificial Sequence
  Synthetic
ccttatcctgacguaaacacctttgaua

SEQ ID NO: 16269 - DNA, 25 bp, Artificial Sequence
  Synthetic
aagacatgctguaagagacccttug

SEQ ID NO: 16270 - DNA, 23 bp, Artificial Sequence
  Synthetic
gcctccttcugggagacatcaua

SEQ ID NO: 16271 - DNA, 23 bp, Artificial Sequence
  Synthetic
agugcaatttuggcaagagcaaa

SEQ ID NO: 16272 - DNA, 25 bp, Artificial Sequence
  Synthetic
tgaugacccaaauaggagatacuca

SEQ ID NO: 16273 - DNA, 21 bp, Artificial Sequence
  Synthetic
cagauccagcaccugacacag

SEQ ID NO: 16274 - DNA, 28 bp, Artificial Sequence
  Synthetic
tttgtttugaaaaccttacctuggcaat

SEQ ID NO: 16275 - DNA, 29 bp, Artificial Sequence
  Synthetic
gctgaatttauaagtttgctgttgucact

SEQ ID NO: 16276 - DNA, 21 bp, Artificial Sequence
  Synthetic
ccccttucagcgcatcttuct

SEQ ID NO: 16277 - DNA, 20 bp, Artificial Sequence
  Synthetic
ctgagaaggaucggcucauc

SEQ ID NO: 16278 - DNA, 18 bp, Artificial Sequence
  Synthetic
cutagtgucgcccgagga

SEQ ID NO: 16279 - DNA, 20 bp, Artificial Sequence
  Synthetic
cgggaccuctatggctguct

SEQ ID NO: 16280 - DNA, 22 bp, Artificial Sequence
  Synthetic
gctggactcutcactgaccgua

SEQ ID NO: 16281 - DNA, 21 bp, Artificial Sequence
  Synthetic
ggttttgccuggaagccugac

SEQ ID NO: 16282 - DNA, 22 bp, Artificial Sequence
  Synthetic
cctgccccacaaaacugctuat

SEQ ID NO: 16283 - DNA, 24 bp, Artificial Sequence
  Synthetic
ggtgatggugattgttgtcaucct

SEQ ID NO: 16284 - DNA, 23 bp, Artificial Sequence
  Synthetic
ccctcctccuttgatgtggagua

SEQ ID NO: 16285 - DNA, 22 bp, Artificial Sequence
  Synthetic
gaagtgttucaagccgagaugg

SEQ ID NO: 16286 - DNA, 21 bp, Artificial Sequence
  Synthetic
gcatguccaagagggctguac

SEQ ID NO: 16287 - DNA, 25 bp, Artificial Sequence
  Synthetic
ccggtgaataucatctttgcggtua

SEQ ID NO: 16288 - DNA, 29 bp, Artificial Sequence
  Synthetic
caaataaaaacaacuatgctgagctguct

SEQ ID NO: 16289 - DNA, 27 bp, Artificial Sequence
  Synthetic
ggcaatatccgucataaatgtgctuat

SEQ ID NO: 16290 - DNA, 25 bp, Artificial Sequence
  Synthetic
tgatatcacaaacauatggcggcut

SEQ ID NO: 16291 - DNA, 18 bp, Artificial Sequence
  Synthetic
tggtccccucgacuccac

SEQ ID NO: 16292 - DNA, 23 bp, Artificial Sequence
  Synthetic
ggacagtggucaatggtgatgut

SEQ ID NO: 16293 - DNA, 29 bp, Artificial Sequence
  Synthetic
cagctttcattgaaacuacctcctatcut

SEQ ID NO: 16294 - DNA, 26 bp, Artificial Sequence
  Synthetic
ggagaaaaagacugagatgugaaggg

SEQ ID NO: 16295 - DNA, 22 bp, Artificial Sequence
  Synthetic
gcataaacccagaggugcttug

SEQ ID NO: 16296 - DNA, 25 bp, Artificial Sequence
  Synthetic
aacctgtgtggutgtaacactacuc

SEQ ID NO: 16297 - DNA, 27 bp, Artificial Sequence
  Synthetic
gtagcagacutctctgaattugaggaa

SEQ ID NO: 16298 - DNA, 24 bp, Artificial Sequence
  Synthetic
gaaacaucagttggugaagcagag

SEQ ID NO: 16299 - DNA, 25 bp, Artificial Sequence
  Synthetic
ctgtgttgagucaaagccuagaaga

SEQ ID NO: 16300 - DNA, 22 bp, Artificial Sequence
  Synthetic
aaattccugccaggagtuggaa

SEQ ID NO: 16301 - DNA, 23 bp, Artificial Sequence
  Synthetic
ctcactccaucattacccauggt

SEQ ID NO: 16302 - DNA, 23 bp, Artificial Sequence
  Synthetic
gtttctgtuaaggccacttgugc

SEQ ID NO: 16303 - DNA, 23 bp, Artificial Sequence
  Synthetic
aacgttagcugtgtgactuccaa

SEQ ID NO: 16304 - DNA, 21 bp, Artificial Sequence
  Synthetic
tgggtcacaagugcaaaggua

SEQ ID NO: 16305 - DNA, 20 bp, Artificial Sequence
  Synthetic
agcuggagcaccagtucaag

SEQ ID NO: 16306 - DNA, 20 bp, Artificial Sequence
  Synthetic
ggcgtcgaugcggaaattut

SEQ ID NO: 16307 - DNA, 26 bp, Artificial Sequence
  Synthetic
gcaaauaaccaccataacaauaccga

SEQ ID NO: 16308 - DNA, 17 bp, Artificial Sequence
  Synthetic
cggaggguggtgugcag

SEQ ID NO: 16309 - DNA, 17 bp, Artificial Sequence
  Synthetic
gtctcgccuccctucgt

SEQ ID NO: 16310 - DNA, 22 bp, Artificial Sequence
  Synthetic
accctaagaccccauctcagut

SEQ ID NO: 16311 - DNA, 26 bp, Artificial Sequence
  Synthetic
tccttgagcuaggaagagatacucac

SEQ ID NO: 16312 - DNA, 19 bp, Artificial Sequence
  Synthetic
cacctcaucccgtcccuac

SEQ ID NO: 16313 - DNA, 19 bp, Artificial Sequence
  Synthetic
ctgctcaucacccuccaca

SEQ ID NO: 16314 - DNA, 22 bp, Artificial Sequence
  Synthetic
tcaccgutctaaagucgggaga

SEQ ID NO: 16315 - DNA, 21 bp, Artificial Sequence
  Synthetic
gcactgaggugaagggauact

SEQ ID NO: 16316 - DNA, 21 bp, Artificial Sequence
  Synthetic
ggccgcuagctttucagacat

SEQ ID NO: 16317 - DNA, 23 bp, Artificial Sequence
  Synthetic
gugagagagaggctugagcaaat

SEQ ID NO: 16318 - DNA, 19 bp, Artificial Sequence
  Synthetic
ccugcacagcctuccagag

SEQ ID NO: 16319 - DNA, 20 bp, Artificial Sequence
  Synthetic
cccaccutgatguggaagga

SEQ ID NO: 16320 - DNA, 18 bp, Artificial Sequence
  Synthetic
acctcccugacacccugt

SEQ ID NO: 16321 - DNA, 18 bp, Artificial Sequence
  Synthetic
ccucctggcuccaccaag

SEQ ID NO: 16322 - DNA, 19 bp, Artificial Sequence
  Synthetic
gtgguataccccugcacgg

SEQ ID NO: 16323 - DNA, 25 bp, Artificial Sequence
  Synthetic
tgaaagtatguaccggagcauagga

SEQ ID NO: 16324 - DNA, 22 bp, Artificial Sequence
  Synthetic
tgcactacucctccctauccac

SEQ ID NO: 16325 - DNA, 22 bp, Artificial Sequence
  Synthetic
ccccaatugcaaagctggaaut

SEQ ID NO: 16326 - DNA, 18 bp, Artificial Sequence
  Synthetic
gcccccucctgagugact

SEQ ID NO: 16327 - DNA, 21 bp, Artificial Sequence
  Synthetic
caaguacaggaagtgcguggt

SEQ ID NO: 16328 - DNA, 18 bp, Artificial Sequence
  Synthetic
ccagagucaggtgugcga

SEQ ID NO: 16329 - DNA, 17 bp, Artificial Sequence
  Synthetic
cctuggcccggctctug

SEQ ID NO: 16330 - DNA, 17 bp, Artificial Sequence
  Synthetic
ggctgugggtgagggut

SEQ ID NO: 16331 - DNA, 23 bp, Artificial Sequence
  Synthetic
gggaggatuccgtcttctcucat

SEQ ID NO: 16332 - DNA, 21 bp, Artificial Sequence
  Synthetic
gcagttacugggcttguccat

SEQ ID NO: 16333 - DNA, 21 bp, Artificial Sequence
  Synthetic
ggagaagcuctaacacccugt

SEQ ID NO: 16334 - DNA, 20 bp, Artificial Sequence
  Synthetic
ctgttcccacccuggcatua

SEQ ID NO: 16335 - DNA, 22 bp, Artificial Sequence
  Synthetic
ggctggaauactgcuacaaccc

SEQ ID NO: 16336 - DNA, 24 bp, Artificial Sequence
  Synthetic
ttgcaaggauagaagcaucactua

SEQ ID NO: 16337 - DNA, 22 bp, Artificial Sequence
  Synthetic
cacuctctgttucccccgaaag

SEQ ID NO: 16338 - DNA, 26 bp, Artificial Sequence
  Synthetic
tcactcttctuggtaccactctucat

SEQ ID NO: 16339 - DNA, 20 bp, Artificial Sequence
  Synthetic
gcctgcuaacaccctgtucg

SEQ ID NO: 16340 - DNA, 21 bp, Artificial Sequence
  Synthetic
ccagtgacgutgctcucaaag

SEQ ID NO: 16341 - DNA, 22 bp, Artificial Sequence
  Synthetic
gggatcatucctcacgctucag

SEQ ID NO: 16342 - DNA, 21 bp, Artificial Sequence
  Synthetic
cctggcucttcccacuaaact

SEQ ID NO: 16343 - DNA, 22 bp, Artificial Sequence
  Synthetic
cctcugacaagggcaacuacac

SEQ ID NO: 16344 - DNA, 23 bp, Artificial Sequence
  Synthetic
cctcutaaacccaaugcccagac

SEQ ID NO: 16345 - DNA, 22 bp, Artificial Sequence
  Synthetic
agtgcccctucttcttcccaua

SEQ ID NO: 16346 - DNA, 18 bp, Artificial Sequence
  Synthetic
ccagcccaucctgtuccc

SEQ ID NO: 16347 - DNA, 23 bp, Artificial Sequence
  Synthetic
acctctaacugcagaacugggat

SEQ ID NO: 16348 - DNA, 25 bp, Artificial Sequence
  Synthetic
catcattcccauctgcatctgcaua

SEQ ID NO: 16349 - DNA, 25 bp, Artificial Sequence
  Synthetic
ctcccgccuataatgtcaatuccat

SEQ ID NO: 16350 - DNA, 21 bp, Artificial Sequence
  Synthetic
tgcttgaggagucccagcuaa

SEQ ID NO: 16351 - DNA, 22 bp, Artificial Sequence
  Synthetic
agcagcugaccaacaccatuat

SEQ ID NO: 16352 - DNA, 19 bp, Artificial Sequence
  Synthetic
tggccauctgctgagugac

SEQ ID NO: 16353 - DNA, 25 bp, Artificial Sequence
  Synthetic
gcaccacugaaaactaugagaaccc

SEQ ID NO: 16354 - DNA, 23 bp, Artificial Sequence
  Synthetic
tctgacgcaugacagtctucaac

SEQ ID NO: 16355 - DNA, 21 bp, Artificial Sequence
  Synthetic
tgtacaggcagugcagtctut

SEQ ID NO: 16356 - DNA, 21 bp, Artificial Sequence
  Synthetic
atcctcatcaucagcgtcgug

SEQ ID NO: 16357 - DNA, 20 bp, Artificial Sequence
  Synthetic
aaaccaaggagccugaggug

SEQ ID NO: 16358 - DNA, 22 bp, Artificial Sequence
  Synthetic
cttcactcucctggatctuggg

SEQ ID NO: 16359 - DNA, 23 bp, Artificial Sequence
  Synthetic
ctggaagaaaagaccuggucgaa

SEQ ID NO: 16360 - DNA, 22 bp, Artificial Sequence
  Synthetic
ctgaguacatccugcgaagaca

SEQ ID NO: 16361 - DNA, 26 bp, Artificial Sequence
  Synthetic
gaccactgaagugttagatgaaccut

SEQ ID NO: 16362 - DNA, 26 bp, Artificial Sequence
  Synthetic
gcctctcactuccttctgttaatcug

SEQ ID NO: 16363 - DNA, 23 bp, Artificial Sequence
  Synthetic
actgaaagugaagaacagcuggt

SEQ ID NO: 16364 - DNA, 24 bp, Artificial Sequence
  Synthetic
ttgctcaaacgugtagaacugact

SEQ ID NO: 16365 - DNA, 29 bp, Artificial Sequence
  Synthetic
caaacaagacugaaaaattaaccagcaut

SEQ ID NO: 16366 - DNA, 27 bp, Artificial Sequence
  Synthetic
catcaataatcugactggctgauccaa

SEQ ID NO: 16367 - DNA, 27 bp, Artificial Sequence
  Synthetic
gaagttaagcaagutgactggaatcug

SEQ ID NO: 16368 - DNA, 20 bp, Artificial Sequence
  Synthetic
ttgtguccccgagugagaac

SEQ ID NO: 16369 - DNA, 29 bp, Artificial Sequence
  Synthetic
tctattacgatguggagccatttctttut

SEQ ID NO: 16370 - DNA, 29 bp, Artificial Sequence
  Synthetic
gctgctgcagaauagttctacttttcaua

SEQ ID NO: 16371 - DNA, 24 bp, Artificial Sequence
  Synthetic
accugggtagtaaugagaggcaaa

SEQ ID NO: 16372 - DNA, 28 bp, Artificial Sequence
  Synthetic
agtgcttgttctuggatatcacgaaaua

SEQ ID NO: 16373 - DNA, 23 bp, Artificial Sequence
  Synthetic
gggacagtuaacatgtgagcuct

SEQ ID NO: 16374 - DNA, 28 bp, Artificial Sequence
  Synthetic
gugaatcctacactauagagaagaccct

SEQ ID NO: 16375 - DNA, 26 bp, Artificial Sequence
  Synthetic
ttcuacaaaagaagguagcacagaua

SEQ ID NO: 16376 - DNA, 28 bp, Artificial Sequence
  Synthetic
ccaagtgtcugaaaaataaccagtcaua

SEQ ID NO: 16377 - DNA, 24 bp, Artificial Sequence
  Synthetic
gcagtgcaucgagtgtaaaacaug

SEQ ID NO: 16378 - DNA, 29 bp, Artificial Sequence
  Synthetic
cctatatcaucagctctauaaaccccgaa

SEQ ID NO: 16379 - DNA, 23 bp, Artificial Sequence
  Synthetic
gatggaccuctttatcggcucaa

SEQ ID NO: 16380 - DNA, 30 bp, Artificial Sequence
  Synthetic
cccaggattaucaggatctttataggaaut

SEQ ID NO: 16381 - DNA, 23 bp, Artificial Sequence
  Synthetic
cagaaacagcgucctucagaaga

SEQ ID NO: 16382 - DNA, 17 bp, Artificial Sequence
  Synthetic
gtcuggccaggcgguag

SEQ ID NO: 16383 - DNA, 17 bp, Artificial Sequence
  Synthetic
cgtggagggucccggua

SEQ ID NO: 16384 - DNA, 28 bp, Artificial Sequence
  Synthetic
gcagagatccugcatattttgaugaaaa

SEQ ID NO: 16385 - DNA, 22 bp, Artificial Sequence
  Synthetic
gctcacuggacacaucagacaa

SEQ ID NO: 16386 - DNA, 23 bp, Artificial Sequence
  Synthetic
gcttcagctcaucttaggctgug

SEQ ID NO: 16387 - DNA, 24 bp, Artificial Sequence
  Synthetic
cagatgttacugttggtactggug

SEQ ID NO: 16388 - DNA, 28 bp, Artificial Sequence
  Synthetic
tgtttctaaccagcugaagaaaacuaca

SEQ ID NO: 16389 - DNA, 22 bp, Artificial Sequence
  Synthetic
gttucaaagaggtggugcacag

SEQ ID NO: 16390 - DNA, 24 bp, Artificial Sequence
  Synthetic
auctctgaactucggcaacagaat

SEQ ID NO: 16391 - DNA, 27 bp, Artificial Sequence
  Synthetic
ttaagttugctagatccucagaaaccc

SEQ ID NO: 16392 - DNA, 27 bp, Artificial Sequence
  Synthetic
tggtgggagagautttggttttctuaa

SEQ ID NO: 16393 - DNA, 27 bp, Artificial Sequence
  Synthetic
atctgctttcttugattcttcggauaa

SEQ ID NO: 16394 - DNA, 30 bp, Artificial Sequence
  Synthetic
gtgttgtatattaaugcaccaaatgacugt

SEQ ID NO: 16395 - DNA, 26 bp, Artificial Sequence
  Synthetic
tctagaaggcuctgcaataaggcuat

SEQ ID NO: 16396 - DNA, 20 bp, Artificial Sequence
  Synthetic
ctgugtctcatcugcagcct

SEQ ID NO: 16397 - DNA, 28 bp, Artificial Sequence
  Synthetic
ggtagagtgagaugcctacaaaatucat

SEQ ID NO: 16398 - DNA, 19 bp, Artificial Sequence
  Synthetic
agucatttcuggcgaggca

SEQ ID NO: 16399 - DNA, 23 bp, Artificial Sequence
  Synthetic
gctggctgaguttcctgaaaugt

SEQ ID NO: 16400 - DNA, 25 bp, Artificial Sequence
  Synthetic
gcgaggatauctggaagaaatucga

SEQ ID NO: 16401 - DNA, 17 bp, Artificial Sequence
  Synthetic
ggucggccguggagaag

SEQ ID NO: 16402 - DNA, 17 bp, Artificial Sequence
  Synthetic
gaccccucggtggtcut

SEQ ID NO: 16403 - DNA, 18 bp, Artificial Sequence
  Synthetic
gcggtguctcctcaugga

SEQ ID NO: 16404 - DNA, 21 bp, Artificial Sequence
  Synthetic
ccctccacucggaaggacuat

SEQ ID NO: 16405 - DNA, 23 bp, Artificial Sequence
  Synthetic
ctcttgacatuctcctcggtguc

SEQ ID NO: 16406 - DNA, 21 bp, Artificial Sequence
  Synthetic
gctacggaacucttgtgcgua

SEQ ID NO: 16407 - DNA, 27 bp, Artificial Sequence
  Synthetic
ggctaaatcttucagtctcaagacuca

SEQ ID NO: 16408 - DNA, 30 bp, Artificial Sequence
  Synthetic
tgctatgtaaaaauattctgttgtguacct

SEQ ID NO: 16409 - DNA, 26 bp, Artificial Sequence
  Synthetic
tgcctggtugactcatctatauggaa

SEQ ID NO: 16410 - DNA, 30 bp, Artificial Sequence
  Synthetic
aatgaaacttacgaugagatatttcctuca

SEQ ID NO: 16411 - DNA, 26 bp, Artificial Sequence
  Synthetic
catatcuaacactgccaucccaagac

SEQ ID NO: 16412 - DNA, 31 bp, Artificial Sequence
  Synthetic
gtatcttataaatcuggaaactctgcaguct

SEQ ID NO: 16413 - DNA, 28 bp, Artificial Sequence
  Synthetic
actgaattccaccguttccagttatuat

SEQ ID NO: 16414 - DNA, 28 bp, Artificial Sequence
  Synthetic
catggagttgacuttctaaaaggtgcua

SEQ ID NO: 16415 - DNA, 27 bp, Artificial Sequence
  Synthetic
gaggtgctacutctttacagagguaat

SEQ ID NO: 16416 - DNA, 30 bp, Artificial Sequence
  Synthetic
ttattctgttgcutgttcttgtgataucat

SEQ ID NO: 16417 - DNA, 28 bp, Artificial Sequence
  Synthetic
cactgaggttguactcttcattctcaut

SEQ ID NO: 16418 - DNA, 31 bp, Artificial Sequence
  Synthetic
tcttcctcattgaaugtattttcttgtucct

SEQ ID NO: 16419 - DNA, 23 bp, Artificial Sequence
  Synthetic
tgtttcatgcagutgaccguagt

SEQ ID NO: 16420 - DNA, 29 bp, Artificial Sequence
  Synthetic
tctggttcaggaguttgtaaaattuggat

SEQ ID NO: 16421 - DNA, 30 bp, Artificial Sequence
  Synthetic
aggttgtactacutactagaaaatgcaugg

SEQ ID NO: 16422 - DNA, 25 bp, Artificial Sequence
  Synthetic
gcaacagacaaauggagttttggua

SEQ ID NO: 16423 - DNA, 32 bp, Artificial Sequence
  Synthetic
gtgaaagaaataugaaagttcagagauagagt

SEQ ID NO: 16424 - DNA, 32 bp, Artificial Sequence
  Synthetic
aaaatgacatgtuaccaaatatgaggauaggt

SEQ ID NO: 16425 - DNA, 30 bp, Artificial Sequence
  Synthetic
aaaaattctgacaatutaccttgccaagut

SEQ ID NO: 16426 - DNA, 28 bp, Artificial Sequence
  Synthetic
tggcagagtaaaacautatttccaccut

SEQ ID NO: 16427 - DNA, 32 bp, Artificial Sequence
  Synthetic
gaagttttatgtgauctatccgttctttaugt

SEQ ID NO: 16428 - DNA, 23 bp, Artificial Sequence
  Synthetic
ggtuaaccaaagtctugccacaa

SEQ ID NO: 16429 - DNA, 30 bp, Artificial Sequence
  Synthetic
acaataaagttugaagtctgtgctcuaaaa

SEQ ID NO: 16430 - DNA, 29 bp, Artificial Sequence
  Synthetic
catgtgccctguattgaaaattaatguct

SEQ ID NO: 16431 - DNA, 25 bp, Artificial Sequence
  Synthetic
ccactcgaagagcuagatcccuaaa

SEQ ID NO: 16432 - DNA, 28 bp, Artificial Sequence
  Synthetic
tgttatatccucaggatgttccagaugt

SEQ ID NO: 16433 - DNA, 26 bp, Artificial Sequence
  Synthetic
ccaaactttctcutcttcactccuct

SEQ ID NO: 16434 - DNA, 25 bp, Artificial Sequence
  Synthetic
gttggtttttaguaagggtggugga

SEQ ID NO: 16435 - DNA, 26 bp, Artificial Sequence
  Synthetic
ccacgcctatutctatgggtattuca

SEQ ID NO: 16436 - DNA, 27 bp, Artificial Sequence
  Synthetic
ggaaaggaagaaagucaguaagaacua

SEQ ID NO: 16437 - DNA, 28 bp, Artificial Sequence
  Synthetic
ggtcaaaatugaaagtgagacaucagag

SEQ ID NO: 16438 - DNA, 24 bp, Artificial Sequence
  Synthetic
ggctctttugacatgggttuaggt

SEQ ID NO: 16439 - DNA, 23 bp, Artificial Sequence
  Synthetic
agtgcctucaaagaacctuccag

SEQ ID NO: 16440 - DNA, 25 bp, Artificial Sequence
  Synthetic
gcttttcacaagagagugccactua

SEQ ID NO: 16441 - DNA, 31 bp, Artificial Sequence
  Synthetic
gctttgattatgacutattcctgcatctuga

SEQ ID NO: 16442 - DNA, 22 bp, Artificial Sequence
  Synthetic
gggccaagcgautgttucaaag

SEQ ID NO: 16443 - DNA, 21 bp, Artificial Sequence
  Synthetic
cacgactggauggtgttcgua

SEQ ID NO: 16444 - DNA, 23 bp, Artificial Sequence
  Synthetic
aaattucacaggccuaccaccaa

SEQ ID NO: 16445 - DNA, 23 bp, Artificial Sequence
  Synthetic
tgccaaagtcutgtgacctguag

SEQ ID NO: 16446 - DNA, 25 bp, Artificial Sequence
  Synthetic
cactcttacacutacgcccaaguat

SEQ ID NO: 16447 - DNA, 21 bp, Artificial Sequence
  Synthetic
agtcgtggacuggaatgggua

SEQ ID NO: 16448 - DNA, 20 bp, Artificial Sequence
  Synthetic
ccgggcucacctgctaaaut

SEQ ID NO: 16449 - DNA, 23 bp, Artificial Sequence
  Synthetic
catctctgcuacccaagatgucc

SEQ ID NO: 16450 - DNA, 23 bp, Artificial Sequence
  Synthetic
ggcaucagaagugggaagagaag

SEQ ID NO: 16451 - DNA, 24 bp, Artificial Sequence
  Synthetic
ccgcagttuctcattgagguagaa

SEQ ID NO: 16452 - DNA, 24 bp, Artificial Sequence
  Synthetic
cataatgcutgtggttuccccaat

SEQ ID NO: 16453 - DNA, 21 bp, Artificial Sequence
  Synthetic
aggcacuaagcagccttcaug

SEQ ID NO: 16454 - DNA, 23 bp, Artificial Sequence
  Synthetic
tcagcttcaggucactttcccua

SEQ ID NO: 16455 - DNA, 20 bp, Artificial Sequence
  Synthetic
actctgtccutcgtgctucc

SEQ ID NO: 16456 - DNA, 25 bp, Artificial Sequence
  Synthetic
ctcaggataaugaagttgcagguga

SEQ ID NO: 16457 - DNA, 22 bp, Artificial Sequence
  Synthetic
tgtagctgttutggttggagug

SEQ ID NO: 16458 - DNA, 22 bp, Artificial Sequence
  Synthetic
gaacgagccggucattctttuc

SEQ ID NO: 16459 - DNA, 18 bp, Artificial Sequence
  Synthetic
aggccagcutcaccctuc

SEQ ID NO: 16460 - DNA, 27 bp, Artificial Sequence
  Synthetic
tttggagacaaaaccuattcacagcua

SEQ ID NO: 16461 - DNA, 29 bp, Artificial Sequence
  Synthetic
ctcctcggutattctgttctuaaacaaga

SEQ ID NO: 16462 - DNA, 26 bp, Artificial Sequence
  Synthetic
ttgttttgaagccuacacatgatucc

SEQ ID NO: 16463 - DNA, 28 bp, Artificial Sequence
  Synthetic
atcatcgaauacccctttgactuacaaa

SEQ ID NO: 16464 - DNA, 22 bp, Artificial Sequence
  Synthetic
gcagacaccutctccacaucaa

SEQ ID NO: 16465 - DNA, 25 bp, Artificial Sequence
  Synthetic
tgaaggaaggugttacctgaatugt

SEQ ID NO: 16466 - DNA, 22 bp, Artificial Sequence
  Synthetic
gtcccaagaugtgtacagcuca

SEQ ID NO: 16467 - DNA, 26 bp, Artificial Sequence
  Synthetic
cttaaagagcugcgaactcaagtcua

SEQ ID NO: 16468 - DNA, 21 bp, Artificial Sequence
  Synthetic
tgatcagcugttgugcaggag

SEQ ID NO: 16469 - DNA, 23 bp, Artificial Sequence
  Synthetic
tcctaaccuctcccctgugaaat

SEQ ID NO: 16470 - DNA, 24 bp, Artificial Sequence
  Synthetic
ttgacaaugctctucccaggaaat

SEQ ID NO: 16471 - DNA, 22 bp, Artificial Sequence
  Synthetic
ttggatttuccatcctguggca

SEQ ID NO: 16472 - DNA, 27 bp, Artificial Sequence
  Synthetic
aagaaatgatuccaagcatctcctuca

SEQ ID NO: 16473 - DNA, 28 bp, Artificial Sequence
  Synthetic
tgctgcatctttutgaaaagctaatcuc

SEQ ID NO: 16474 - DNA, 23 bp, Artificial Sequence
  Synthetic
gaggatttccugaggttcacguc

SEQ ID NO: 16475 - DNA, 26 bp, Artificial Sequence
  Synthetic
tgcatggctcutagatttgagtgaut

SEQ ID NO: 16476 - DNA, 23 bp, Artificial Sequence
  Synthetic
agccatttugagaggacacgtut

SEQ ID NO: 16477 - DNA, 31 bp, Artificial Sequence
  Synthetic
gttgcataatgccuttactgaccaaaattua

SEQ ID NO: 16478 - DNA, 17 bp, Artificial Sequence
  Synthetic
ggugggctguccacagg

SEQ ID NO: 16479 - DNA, 18 bp, Artificial Sequence
  Synthetic
ccgcgccutcctctcuaa

SEQ ID NO: 16480 - DNA, 22 bp, Artificial Sequence
  Synthetic
gggaauccagcagacaugaaat

SEQ ID NO: 16481 - DNA, 23 bp, Artificial Sequence
  Synthetic
agtcaggagagugagaugaaggt

SEQ ID NO: 16482 - DNA, 26 bp, Artificial Sequence
  Synthetic
gggtctctacucgcagtttctctaua

SEQ ID NO: 16483 - DNA, 28 bp, Artificial Sequence
  Synthetic
aacctttacagcautctactcgttctut

SEQ ID NO: 16484 - DNA, 22 bp, Artificial Sequence
  Synthetic
caggatuccggagcagaactua

SEQ ID NO: 16485 - DNA, 19 bp, Artificial Sequence
  Synthetic
ccuctgctgtucccaacgg

SEQ ID NO: 16486 - DNA, 28 bp, Artificial Sequence
  Synthetic
gggagaaataauggatctgcaaatagut

SEQ ID NO: 16487 - DNA, 25 bp, Artificial Sequence
  Synthetic
gtccatgaagacauatgcagaggut

SEQ ID NO: 16488 - DNA, 20 bp, Artificial Sequence
  Synthetic
ggcccacacutgagcttuca

SEQ ID NO: 16489 - DNA, 24 bp, Artificial Sequence
  Synthetic
gtaaaaggcgauttgaacgcgaut

SEQ ID NO: 16490 - DNA, 25 bp, Artificial Sequence
  Synthetic
acaatgatctgugatgccatgtuct

SEQ ID NO: 16491 - DNA, 29 bp, Artificial Sequence
  Synthetic
ggtgtaaagcagaauatgaatgaatgugg

SEQ ID NO: 16492 - DNA, 18 bp, Artificial Sequence
  Synthetic
ctccagggcuggugcaat

SEQ ID NO: 16493 - DNA, 21 bp, Artificial Sequence
  Synthetic
cggcugcaggaaagttuacac

SEQ ID NO: 16494 - DNA, 21 bp, Artificial Sequence
  Synthetic
gagaaagtucctcggagcugt

SEQ ID NO: 16495 - DNA, 23 bp, Artificial Sequence
  Synthetic
aaaatcautctggcucgggagaa

SEQ ID NO: 16496 - DNA, 17 bp, Artificial Sequence
  Synthetic
cgaggccauggagguga

SEQ ID NO: 16497 - DNA, 24 bp, Artificial Sequence
  Synthetic
tgttaaaaagcacauccaccucct

SEQ ID NO: 16498 - DNA, 20 bp, Artificial Sequence
  Synthetic
tcucagccccttcuccaaga

SEQ ID NO: 16499 - DNA, 17 bp, Artificial Sequence
  Synthetic
gguggacagcgaugggt

SEQ ID NO: 16500 - DNA, 24 bp, Artificial Sequence
  Synthetic
ggcttatcugtgcttttgttucca

SEQ ID NO: 16501 - DNA, 21 bp, Artificial Sequence
  Synthetic
ccttcgcutgggcttaaugag

SEQ ID NO: 16502 - DNA, 28 bp, Artificial Sequence
  Synthetic
tgtctagcaaauccaaaaagugcaaaaa

SEQ ID NO: 16503 - DNA, 18 bp, Artificial Sequence
  Synthetic
ggtcagcaugtggcugga

SEQ ID NO: 16504 - DNA, 23 bp, Artificial Sequence
  Synthetic
gaggacgagguctcccataguat

SEQ ID NO: 16505 - DNA, 18 bp, Artificial Sequence
  Synthetic
gggcggutgggtgttuac

SEQ ID NO: 16506 - DNA, 29 bp, Artificial Sequence
  Synthetic
acggtgttaattugctttcgataaaacug

SEQ ID NO: 16507 - DNA, 28 bp, Artificial Sequence
  Synthetic
cctuattataacgatcaugcggaacaga

SEQ ID NO: 16508 - DNA, 20 bp, Artificial Sequence
  Synthetic
gccagaaccaucaccugcat

SEQ ID NO: 16509 - DNA, 29 bp, Artificial Sequence
  Synthetic
agggaatgaaaacaguttttagaggugaa

SEQ ID NO: 16510 - DNA, 27 bp, Artificial Sequence
  Synthetic
tgattatatcatguctgctgcttaugg

SEQ ID NO: 16511 - DNA, 24 bp, Artificial Sequence
  Synthetic
ctgcactgaacutccagaagauga

SEQ ID NO: 16512 - DNA, 31 bp, Artificial Sequence
  Synthetic
ggcauagaagaagaaactguaaaggaaaaga

SEQ ID NO: 16513 - DNA, 24 bp, Artificial Sequence
  Synthetic
gctgatgcuacagatgatgtuggt

SEQ ID NO: 16514 - DNA, 30 bp, Artificial Sequence
  Synthetic
tcagtgtatggcuatgtatttcttttgugt

SEQ ID NO: 16515 - DNA, 27 bp, Artificial Sequence
  Synthetic
acctttgtgauaaacgaaccacuagag

SEQ ID NO: 16516 - DNA, 27 bp, Artificial Sequence
  Synthetic
ctctatctggaucttctctcagucagg

SEQ ID NO: 16517 - DNA, 29 bp, Artificial Sequence
  Synthetic
aaagtaggtgagaguagggttttagagut

SEQ ID NO: 16518 - DNA, 26 bp, Artificial Sequence
  Synthetic
acttatttctaaggutaccggcacug

SEQ ID NO: 16519 - DNA, 28 bp, Artificial Sequence
  Synthetic
ttcctctaatctucggttttcaactuga

SEQ ID NO: 16520 - DNA, 21 bp, Artificial Sequence
  Synthetic
cgcugggacttaatguccagt

SEQ ID NO: 16521 - DNA, 21 bp, Artificial Sequence
  Synthetic
ccattgaccugctgaacucca

SEQ ID NO: 16522 - DNA, 26 bp, Artificial Sequence
  Synthetic
tgtaatcatttutcagtgccucagga

SEQ ID NO: 16523 - DNA, 28 bp, Artificial Sequence
  Synthetic
cagcttagaacacaugctcctaauaaga

SEQ ID NO: 16524 - DNA, 27 bp, Artificial Sequence
  Synthetic
tgaagaagtcattugtcaaccatggua

SEQ ID NO: 16525 - DNA, 22 bp, Artificial Sequence
  Synthetic
ccaacccaugggaagtacugac

SEQ ID NO: 16526 - DNA, 28 bp, Artificial Sequence
  Synthetic
cctccctgaagaacauagagaagtauct

SEQ ID NO: 16527 - DNA, 24 bp, Artificial Sequence
  Synthetic
gctcccataatugaccctgtacug

SEQ ID NO: 16528 - DNA, 20 bp, Artificial Sequence
  Synthetic
gcaccautcccaucaagcaa

SEQ ID NO: 16529 - DNA, 24 bp, Artificial Sequence
  Synthetic
catttctgccutggactcuacagg

SEQ ID NO: 16530 - DNA, 22 bp, Artificial Sequence
  Synthetic
caggcatccutgagcagctuat

SEQ ID NO: 16531 - DNA, 29 bp, Artificial Sequence
  Synthetic
gctttctcatgaaguagttttcttcccut

SEQ ID NO: 16532 - DNA, 30 bp, Artificial Sequence
  Synthetic
actattctctaaattuctgcctaggtcugt

SEQ ID NO: 16533 - DNA, 22 bp, Artificial Sequence
  Synthetic
ccaatctgcugcttgagtccut

SEQ ID NO: 16534 - DNA, 22 bp, Artificial Sequence
  Synthetic
gttggcuacagguaccacacaa

SEQ ID NO: 16535 - DNA, 21 bp, Artificial Sequence
  Synthetic
cactggcuggaagaactcugg

SEQ ID NO: 16536 - DNA, 24 bp, Artificial Sequence
  Synthetic
tcactucaagcgaacaacttucct

SEQ ID NO: 16537 - DNA, 23 bp, Artificial Sequence
  Synthetic
gtttggtuggagctttgacctut

SEQ ID NO: 16538 - DNA, 23 bp, Artificial Sequence
  Synthetic
ccggtacccutctgtgatugaat

SEQ ID NO: 16539 - DNA, 29 bp, Artificial Sequence
  Synthetic
catccctaatucctgctttagaaucaaga

SEQ ID NO: 16540 - DNA, 29 bp, Artificial Sequence
  Synthetic
tgtattatgatgucgagccattcctttut

SEQ ID NO: 16541 - DNA, 24 bp, Artificial Sequence
  Synthetic
tgttcaaagaautgggctcuacca

SEQ ID NO: 16542 - DNA, 21 bp, Artificial Sequence
  Synthetic
acatgacatugccaccacuct

SEQ ID NO: 16543 - DNA, 25 bp, Artificial Sequence
  Synthetic
ggaacctcaguctttaactggaaug

SEQ ID NO: 16544 - DNA, 26 bp, Artificial Sequence
  Synthetic
caactagagcuaacagtaggcaauca

SEQ ID NO: 16545 - DNA, 27 bp, Artificial Sequence
  Synthetic
cttcttcttcacugctctcttuagaca

SEQ ID NO: 16546 - DNA, 26 bp, Artificial Sequence
  Synthetic
agaccattucagagacgacagaagua

SEQ ID NO: 16547 - DNA, 23 bp, Artificial Sequence
  Synthetic
tguttgtcttttctucccaggct

SEQ ID NO: 16548 - DNA, 20 bp, Artificial Sequence
  Synthetic
ccugacgagcagguaacagt

SEQ ID NO: 16549 - DNA, 24 bp, Artificial Sequence
  Synthetic
ttcugttttcctctugaggcaaca

SEQ ID NO: 16550 - DNA, 26 bp, Artificial Sequence
  Synthetic
auggtgcuaaaagccaagaaaaagag

SEQ ID NO: 16551 - DNA, 21 bp, Artificial Sequence
  Synthetic
cagactccaugtggctgucat

SEQ ID NO: 16552 - DNA, 26 bp, Artificial Sequence
  Synthetic
gucgatacagagtucaaagagggaaa

SEQ ID NO: 16553 - DNA, 21 bp, Artificial Sequence
  Synthetic
acgggtguagttctguaggct

SEQ ID NO: 16554 - DNA, 24 bp, Artificial Sequence
  Synthetic
gagagcacaacugagaacuacgaa

SEQ ID NO: 16555 - DNA, 21 bp, Artificial Sequence
  Synthetic
ctctgtgucagactgcuggag

SEQ ID NO: 16556 - DNA, 23 bp, Artificial Sequence
  Synthetic
gccaaacugcagcagttaacuaa

SEQ ID NO: 16557 - DNA, 22 bp, Artificial Sequence
  Synthetic
ggagtguggagacugagaaagt

SEQ ID NO: 16558 - DNA, 22 bp, Artificial Sequence
  Synthetic
gccagccuacaatgtcaacuct

SEQ ID NO: 16559 - DNA, 22 bp, Artificial Sequence
  Synthetic
gggcgtutgattcatauagcca

SEQ ID NO: 16560 - DNA, 17 bp, Artificial Sequence
  Synthetic
gcggagcugcctctuct

SEQ ID NO: 16561 - DNA, 20 bp, Artificial Sequence
  Synthetic
gagagggcucaccagaggua

SEQ ID NO: 16562 - DNA, 21 bp, Artificial Sequence
  Synthetic
cccgugtcctgtucaaacact

SEQ ID NO: 16563 - DNA, 27 bp, Artificial Sequence
  Synthetic
acacaatctacaucttctgcattugga

SEQ ID NO: 16564 - DNA, 25 bp, Artificial Sequence
  Synthetic
gccaggctttugaatttctcctgua

SEQ ID NO: 16565 - DNA, 26 bp, Artificial Sequence
  Synthetic
ggtttttctucacatctttccauggg

SEQ ID NO: 16566 - DNA, 23 bp, Artificial Sequence
  Synthetic
ccactattgcuggagtcaugaca

SEQ ID NO: 16567 - DNA, 23 bp, Artificial Sequence
  Synthetic
gcagttgaacuttctgttcugct

SEQ ID NO: 16568 - DNA, 28 bp, Artificial Sequence
  Synthetic
tcagaaatgaaauccaaagcttggtcua

SEQ ID NO: 16569 - DNA, 20 bp, Artificial Sequence
  Synthetic
tgttggctcutcagcgcuaa

SEQ ID NO: 16570 - DNA, 22 bp, Artificial Sequence
  Synthetic
aaguggagacaacaagctcugg

SEQ ID NO: 16571 - DNA, 25 bp, Artificial Sequence
  Synthetic
gccttcctcaguatccacacauaaa

SEQ ID NO: 16572 - DNA, 27 bp, Artificial Sequence
  Synthetic
aattcgatccaagucttctaccaacug

SEQ ID NO: 16573 - DNA, 26 bp, Artificial Sequence
  Synthetic
acgtccccauattgcctatuaaaact

SEQ ID NO: 16574 - DNA, 27 bp, Artificial Sequence
  Synthetic
agagttactcacacaucactctgauga

SEQ ID NO: 16575 - DNA, 25 bp, Artificial Sequence
  Synthetic
tcttaaacagggcauagccctatug

SEQ ID NO: 16576 - DNA, 22 bp, Artificial Sequence
  Synthetic
tccttgaaggucatctgcucct

SEQ ID NO: 16577 - DNA, 27 bp, Artificial Sequence
  Synthetic
attctctcttuagggagcttctctuct

SEQ ID NO: 16578 - DNA, 24 bp, Artificial Sequence
  Synthetic
tccccatttauagctgagtcucca

SEQ ID NO: 16579 - DNA, 21 bp, Artificial Sequence
  Synthetic
cgctggugaggauaacaacac

SEQ ID NO: 16580 - DNA, 30 bp, Artificial Sequence
  Synthetic
acagaagctgtgutaattttatagcaguca

SEQ ID NO: 16581 - DNA, 22 bp, Artificial Sequence
  Synthetic
aatatacgtgcutggcggguaa

SEQ ID NO: 16582 - DNA, 27 bp, Artificial Sequence
  Synthetic
cagttgtggguacctttagatucagaa

SEQ ID NO: 16583 - DNA, 23 bp, Artificial Sequence
  Synthetic
ggaggagacguagagtttgtcug

SEQ ID NO: 16584 - DNA, 30 bp, Artificial Sequence
  Synthetic
atgtaagaaatgtgaugttctgaaagctua

SEQ ID NO: 16585 - DNA, 21 bp, Artificial Sequence
  Synthetic
cggccaacacugtcaagttuc

SEQ ID NO: 16586 - DNA, 26 bp, Artificial Sequence
  Synthetic
accaagtttcacugtctacagtccua

SEQ ID NO: 16587 - DNA, 19 bp, Artificial Sequence
  Synthetic
tgaaagaugccgccgugat

SEQ ID NO: 16588 - DNA, 20 bp, Artificial Sequence
  Synthetic
gaugaaacgaccccagcuga

SEQ ID NO: 16589 - DNA, 18 bp, Artificial Sequence
  Synthetic
cgcaggcugaaggcatug

SEQ ID NO: 16590 - DNA, 20 bp, Artificial Sequence
  Synthetic
ggagagggucagtgagugct

SEQ ID NO: 16591 - DNA, 19 bp, Artificial Sequence
  Synthetic
cacgcacugtggaatcucg

SEQ ID NO: 16592 - DNA, 17 bp, Artificial Sequence
  Synthetic
cgccaggcucacctcua

SEQ ID NO: 16593 - DNA, 25 bp, Artificial Sequence
  Synthetic
ctgaggagcgaugacggaatauaag

SEQ ID NO: 16594 - DNA, 26 bp, Artificial Sequence
  Synthetic
gttactgaactugggattcaaaggug

SEQ ID NO: 16595 - DNA, 25 bp, Artificial Sequence
  Synthetic
cttctctctcucgcttggatttuct

SEQ ID NO: 16596 - DNA, 18 bp, Artificial Sequence
  Synthetic
gccaccuaccgtccucct

SEQ ID NO: 16597 - DNA, 22 bp, Artificial Sequence
  Synthetic
ggtaatuagagcccgctagcug

SEQ ID NO: 16598 - DNA, 23 bp, Artificial Sequence
  Synthetic
aaatctccaucctgcgcttuaca

SEQ ID NO: 16599 - DNA, 25 bp, Artificial Sequence
  Synthetic
acgtttgcacuatgacctucagaaa

SEQ ID NO: 16600 - DNA, 23 bp, Artificial Sequence
  Synthetic
tcaggaagutgttcugaggcaag

SEQ ID NO: 16601 - DNA, 25 bp, Artificial Sequence
  Synthetic
cutcaatggctauagagagaaccca

SEQ ID NO: 16602 - DNA, 18 bp, Artificial Sequence
  Synthetic
cuccagagccgugcgaat

SEQ ID NO: 16603 - DNA, 21 bp, Artificial Sequence
  Synthetic
gatcgctttuccgagcttcug

SEQ ID NO: 16604 - DNA, 28 bp, Artificial Sequence
  Synthetic
ctatgtcagagtugatgaggaggtauct

SEQ ID NO: 16605 - DNA, 23 bp, Artificial Sequence
  Synthetic
cggattcgugcctatgagaugac

SEQ ID NO: 16606 - DNA, 22 bp, Artificial Sequence
  Synthetic
aacctaggguttggguagaggt

SEQ ID NO: 16607 - DNA, 26 bp, Artificial Sequence
  Synthetic
gtgactacacuctgtctttccucaag

SEQ ID NO: 16608 - DNA, 18 bp, Artificial Sequence
  Synthetic
ccaggcccutgtccagug

SEQ ID NO: 16609 - DNA, 20 bp, Artificial Sequence
  Synthetic
gcagaaggugcgcataguga

SEQ ID NO: 16610 - DNA, 18 bp, Artificial Sequence
  Synthetic
tguggaagggagcccugt

SEQ ID NO: 16611 - DNA, 27 bp, Artificial Sequence
  Synthetic
agttctttgaaguagccaatgatguca

SEQ ID NO: 16612 - DNA, 21 bp, Artificial Sequence
  Synthetic
cctcagccacugttaggguct

SEQ ID NO: 16613 - DNA, 26 bp, Artificial Sequence
  Synthetic
gcagcctgaatuatgatcctttccua

SEQ ID NO: 16614 - DNA, 24 bp, Artificial Sequence
  Synthetic
aaccauggagggtttugaagaagt

SEQ ID NO: 16615 - DNA, 21 bp, Artificial Sequence
  Synthetic
gtgagctggugaagaagguct

SEQ ID NO: 16616 - DNA, 30 bp, Artificial Sequence
  Synthetic
agcttgtaacattutcatttttcctgtauc

SEQ ID NO: 16617 - DNA, 29 bp, Artificial Sequence
  Synthetic
cagggaacaaucactaatacaacattugt

SEQ ID NO: 16618 - DNA, 29 bp, Artificial Sequence
  Synthetic
aatagacatatutctagatgcugacacag

SEQ ID NO: 16619 - DNA, 29 bp, Artificial Sequence
  Synthetic
gtatgaaataaaccutagctgctgauagg

SEQ ID NO: 16620 - DNA, 32 bp, Artificial Sequence
  Synthetic
atagacctagacacucaaattagttactuacc

SEQ ID NO: 16621 - DNA, 26 bp, Artificial Sequence
  Synthetic
ggtgaagcaguacaagaatttgugga

SEQ ID NO: 16622 - DNA, 30 bp, Artificial Sequence
  Synthetic
aagattcctucacaaatcctauaagaacat

SEQ ID NO: 16623 - DNA, 25 bp, Artificial Sequence
  Synthetic
gtgttcttcgcuttagccagaaaut

SEQ ID NO: 16624 - DNA, 32 bp, Artificial Sequence
  Synthetic
aggtgaataattctucaactaaagtagatcuc

SEQ ID NO: 16625 - DNA, 21 bp, Artificial Sequence
  Synthetic
cggcaguttttcauggaggat

SEQ ID NO: 16626 - DNA, 30 bp, Artificial Sequence
  Synthetic
gttcatttttggutggagctatttuacact

SEQ ID NO: 16627 - DNA, 31 bp, Artificial Sequence
  Synthetic
tcaaaatcttgauacaggagtaaacauggaa

SEQ ID NO: 16628 - DNA, 24 bp, Artificial Sequence
  Synthetic
tgaagcaaaaccggacuaatguct

SEQ ID NO: 16629 - DNA, 30 bp, Artificial Sequence
  Synthetic
attcatgcagauacctacttttacauacac

SEQ ID NO: 16630 - DNA, 30 bp, Artificial Sequence
  Synthetic
ggccgatcacccauacaatattttctuaat

SEQ ID NO: 16631 - DNA, 32 bp, Artificial Sequence
  Synthetic
ctaattttaacaccuttttctgttgaucaggt

SEQ ID NO: 16632 - DNA, 28 bp, Artificial Sequence
  Synthetic
atgttatcttcaugtagtccaccugaac

SEQ ID NO: 16633 - DNA, 28 bp, Artificial Sequence
  Synthetic
atgactggaugaaagacatcaatctuga

SEQ ID NO: 16634 - DNA, 21 bp, Artificial Sequence
  Synthetic
ccgtccucgactgatucaacc

SEQ ID NO: 16635 - DNA, 22 bp, Artificial Sequence
  Synthetic
gtgcaaaugagacccaugaacc

SEQ ID NO: 16636 - DNA, 24 bp, Artificial Sequence
  Synthetic
agctccaaaaguggctacattgut

SEQ ID NO: 16637 - DNA, 27 bp, Artificial Sequence
  Synthetic
aatctgcctugtaatcaaccuaacaca

SEQ ID NO: 16638 - DNA, 22 bp, Artificial Sequence
  Synthetic
tgggucaacaggtttgtucagt

SEQ ID NO: 16639 - DNA, 24 bp, Artificial Sequence
  Synthetic
ggttacatgaacucccagcaauca

SEQ ID NO: 16640 - DNA, 21 bp, Artificial Sequence
  Synthetic
tgttgctgtugggtgtagugt

SEQ ID NO: 16641 - DNA, 17 bp, Artificial Sequence
  Synthetic
ccauggagccccgucag

SEQ ID NO: 16642 - DNA, 23 bp, Artificial Sequence
  Synthetic
ggattttcucctgcccaaaugga

SEQ ID NO: 16643 - DNA, 22 bp, Artificial Sequence
  Synthetic
gcccagcagcucaaacagauag

SEQ ID NO: 16644 - DNA, 27 bp, Artificial Sequence
  Synthetic
caagtcaatgtuaaatgggtcatccug

SEQ ID NO: 16645 - DNA, 23 bp, Artificial Sequence
  Synthetic
cuaatagguacggagacgaccct

SEQ ID NO: 16646 - DNA, 27 bp, Artificial Sequence
  Synthetic
tctccccaacacgaautcttttgauat

SEQ ID NO: 16647 - DNA, 28 bp, Artificial Sequence
  Synthetic
ctttttattccctuctgtctttcagcuc

SEQ ID NO: 16648 - DNA, 17 bp, Artificial Sequence
  Synthetic
ggaggcgcuccacgaua

SEQ ID NO: 16649 - DNA, 23 bp, Artificial Sequence
  Synthetic
atcattgtguccggtaagauggg

SEQ ID NO: 16650 - DNA, 25 bp, Artificial Sequence
  Synthetic
gggatgtgttugtatgcacgtttut

SEQ ID NO: 16651 - DNA, 22 bp, Artificial Sequence
  Synthetic
accatgcacutaattggccgua

SEQ ID NO: 16652 - DNA, 28 bp, Artificial Sequence
  Synthetic
ccaccttcccuggagtaaaaaucaaaat

SEQ ID NO: 16653 - DNA, 26 bp, Artificial Sequence
  Synthetic
agaggagagaguttacctgctctuaa

SEQ ID NO: 16654 - DNA, 26 bp, Artificial Sequence
  Synthetic
cttcaaaaaggacagaugcaaccaut

SEQ ID NO: 16655 - DNA, 22 bp, Artificial Sequence
  Synthetic
atagcacugacaacaggcauga

SEQ ID NO: 16656 - DNA, 22 bp, Artificial Sequence
  Synthetic
ccaguccccagaaaaugagagt

SEQ ID NO: 16657 - DNA, 19 bp, Artificial Sequence
  Synthetic
gagacgaggagguctgcug

SEQ ID NO: 16658 - DNA, 22 bp, Artificial Sequence
  Synthetic
tgataattuccgacccccucca

SEQ ID NO: 16659 - DNA, 22 bp, Artificial Sequence
  Synthetic
ctcagaagagggcucctttugt

SEQ ID NO: 16660 - DNA, 22 bp, Artificial Sequence
  Synthetic
cctcttgccacuagtgcctuaa

SEQ ID NO: 16661 - DNA, 28 bp, Artificial Sequence
  Synthetic
gaggagtaggacuacttgatgaaaaugg

SEQ ID NO: 16662 - DNA, 22 bp, Artificial Sequence
  Synthetic
gccactucatcttcugccaaaa

SEQ ID NO: 16663 - DNA, 19 bp, Artificial Sequence
  Synthetic
gccgagguccaagttggut

SEQ ID NO: 16664 - DNA, 28 bp, Artificial Sequence
  Synthetic
ggttgttattgtutttggattgccucat

SEQ ID NO: 16665 - DNA, 19 bp, Artificial Sequence
  Synthetic
cagcucgtttucggccaag

SEQ ID NO: 16666 - DNA, 26 bp, Artificial Sequence
  Synthetic
gactgtggtguttgtactaattgcut

SEQ ID NO: 16667 - DNA, 27 bp, Artificial Sequence
  Synthetic
attcagtttccugatgtatctcugcaa

SEQ ID NO: 16668 - DNA, 25 bp, Artificial Sequence
  Synthetic
gtggtggactcuagtcagaaaccua

SEQ ID NO: 16669 - DNA, 21 bp, Artificial Sequence
  Synthetic
tggtggccugtttggatucag

SEQ ID NO: 16670 - DNA, 23 bp, Artificial Sequence
  Synthetic
gcaaatgugaaggcaaauagggt

SEQ ID NO: 16671 - DNA, 23 bp, Artificial Sequence
  Synthetic
tggactccauctgctggaattut

SEQ ID NO: 16672 - DNA, 21 bp, Artificial Sequence
  Synthetic
tgtgagcccutccacaagtut

SEQ ID NO: 16673 - DNA, 28 bp, Artificial Sequence
  Synthetic
ccagctgtagtuctattaccaagtttug

SEQ ID NO: 16674 - DNA, 21 bp, Artificial Sequence
  Synthetic
aaaacacggguatgugagcca

SEQ ID NO: 16675 - DNA, 28 bp, Artificial Sequence
  Synthetic
ctgaaagattcucacatttggaauggac

SEQ ID NO: 16676 - DNA, 27 bp, Artificial Sequence
  Synthetic
catggacaccutggttttagtgtuaga

SEQ ID NO: 16677 - DNA, 23 bp, Artificial Sequence
  Synthetic
ctgatcaucctgtttgcugacct

SEQ ID NO: 16678 - DNA, 25 bp, Artificial Sequence
  Synthetic
tcctcgtatuaacagagaagcuggt

SEQ ID NO: 16679 - DNA, 25 bp, Artificial Sequence
  Synthetic
gacttttugacactgaaccauggaa

SEQ ID NO: 16680 - DNA, 24 bp, Artificial Sequence
  Synthetic
ctgagcagccucctttaaugaaga

SEQ ID NO: 16681 - DNA, 26 bp, Artificial Sequence
  Synthetic
agtcaatcauctgcatcuagagggaa

SEQ ID NO: 16682 - DNA, 24 bp, Artificial Sequence
  Synthetic
ggaugagtctauagaggagacggt

SEQ ID NO: 16683 - DNA, 25 bp, Artificial Sequence
  Synthetic
ctcgggaacacaugaagtgatagut

SEQ ID NO: 16684 - DNA, 28 bp, Artificial Sequence
  Synthetic
aatgacgctcauaatcttctctaaucgg

SEQ ID NO: 16685 - DNA, 28 bp, Artificial Sequence
  Synthetic
ctgctctcttcuctttatagtgctacut

SEQ ID NO: 16686 - DNA, 26 bp, Artificial Sequence
  Synthetic
tcaaaagagagucaaaacacagcuga

SEQ ID NO: 16687 - DNA, 24 bp, Artificial Sequence
  Synthetic
ctgtgttggagaauaactgggugt

SEQ ID NO: 16688 - DNA, 22 bp, Artificial Sequence
  Synthetic
cggtccaaacuccggataaugt

SEQ ID NO: 16689 - DNA, 27 bp, Artificial Sequence
  Synthetic
actagtacttgaautcagtggcccuaa

SEQ ID NO: 16690 - DNA, 24 bp, Artificial Sequence
  Synthetic
agtaaaatcggcucctttgcugaa

SEQ ID NO: 16691 - DNA, 24 bp, Artificial Sequence
  Synthetic
atctggagaggaguttgctgatug

SEQ ID NO: 16692 - DNA, 21 bp, Artificial Sequence
  Synthetic
ggcctttctaugccaggaguc

SEQ ID NO: 16693 - DNA, 24 bp, Artificial Sequence
  Synthetic
gggaagcaggacuactttcttuca

SEQ ID NO: 16694 - DNA, 24 bp, Artificial Sequence
  Synthetic
ccgtgcacgutctaacatgtttut

SEQ ID NO: 16695 - DNA, 21 bp, Artificial Sequence
  Synthetic
gcttaagtcaucggccccauc

SEQ ID NO: 16696 - DNA, 31 bp, Artificial Sequence
  Synthetic
gaaatggtaaagaaaauggaacagagaacut

SEQ ID NO: 16697 - DNA, 27 bp, Artificial Sequence
  Synthetic
aaggaatcttguccctgtgtttuaact

SEQ ID NO: 16698 - DNA, 26 bp, Artificial Sequence
  Synthetic
agtaatcgugaaaaagacatggguct

SEQ ID NO: 16699 - DNA, 24 bp, Artificial Sequence
  Synthetic
gtggucaagacagacagaucagat

SEQ ID NO: 16700 - DNA, 23 bp, Artificial Sequence
  Synthetic
ggtacctgttuccccaactgtuc

SEQ ID NO: 16701 - DNA, 22 bp, Artificial Sequence
  Synthetic
agtggctgcaugttctggtuaa

SEQ ID NO: 16702 - DNA, 23 bp, Artificial Sequence
  Synthetic
gttucccaccaaacaucagcaat

SEQ ID NO: 16703 - DNA, 24 bp, Artificial Sequence
  Synthetic
ggtcutttcttgaguccagaggat

SEQ ID NO: 16704 - DNA, 27 bp, Artificial Sequence
  Synthetic
gcacatcaacaauaagccaggatacua

SEQ ID NO: 16705 - DNA, 20 bp, Artificial Sequence
  Synthetic
caagcaaccutgggttggut

SEQ ID NO: 16706 - DNA, 22 bp, Artificial Sequence
  Synthetic
cccagguatccaacttuaccca

SEQ ID NO: 16707 - DNA, 19 bp, Artificial Sequence
  Synthetic
actgaagggcutgcugacc

SEQ ID NO: 16708 - DNA, 29 bp, Artificial Sequence
  Synthetic
cacagctgtauagaaaattctgggtttut

SEQ ID NO: 16709 - DNA, 22 bp, Artificial Sequence
  Synthetic
cctttuacccacccacauacct

SEQ ID NO: 16710 - DNA, 23 bp, Artificial Sequence
  Synthetic
cttccctggugcttctgattcut

SEQ ID NO: 16711 - DNA, 22 bp, Artificial Sequence
  Synthetic
ggcttguggaaacggaattugt

SEQ ID NO: 16712 - DNA, 29 bp, Artificial Sequence
  Synthetic
tgtactaattgtcuctaggaacctucgat

SEQ ID NO: 16713 - DNA, 26 bp, Artificial Sequence
  Synthetic
ccaactgccuccttagaagtctttut

SEQ ID NO: 16714 - DNA, 28 bp, Artificial Sequence
  Synthetic
gaaatgacaagtucttctcccttctuct

SEQ ID NO: 16715 - DNA, 22 bp, Artificial Sequence
  Synthetic
ccgagaauagcagttaggcuca

SEQ ID NO: 16716 - DNA, 23 bp, Artificial Sequence
  Synthetic
agctcaaagcaagagugtcacut

SEQ ID NO: 16717 - DNA, 18 bp, Artificial Sequence
  Synthetic
gcagtcaugtcggcctug

SEQ ID NO: 16718 - DNA, 21 bp, Artificial Sequence
  Synthetic
cagcgutagcaaaugcagcaa

SEQ ID NO: 16719 - DNA, 21 bp, Artificial Sequence
  Synthetic
ggcagccuggttctcgaatua

SEQ ID NO: 16720 - DNA, 22 bp, Artificial Sequence
  Synthetic
acutttcugagaagcaggcgat

SEQ ID NO: 16721 - DNA, 27 bp, Artificial Sequence
  Synthetic
agaaacatgcttucctccaaagaacua

SEQ ID NO: 16722 - DNA, 19 bp, Artificial Sequence
  Synthetic
ccagcugtatcaccuggga

SEQ ID NO: 16723 - DNA, 21 bp, Artificial Sequence
  Synthetic
gccgtgcacuttggtcauaat

SEQ ID NO: 16724 - DNA, 26 bp, Artificial Sequence
  Synthetic
ccttcacactuaggcagctactacua

SEQ ID NO: 16725 - DNA, 28 bp, Artificial Sequence
  Synthetic
ggttctauccaacaagaaagaacaucca

SEQ ID NO: 16726 - DNA, 26 bp, Artificial Sequence
  Synthetic
gaagaguacaacaatgugaaggcaat

SEQ ID NO: 16727 - DNA, 30 bp, Artificial Sequence
  Synthetic
agutgtatttguaauggaagaagagaagaa

SEQ ID NO: 16728 - DNA, 25 bp, Artificial Sequence
  Synthetic
tcttttgctagtutcttggccagut

SEQ ID NO: 16729 - DNA, 28 bp, Artificial Sequence
  Synthetic
gctagaaaagguagagcaacttttugga

SEQ ID NO: 16730 - DNA, 21 bp, Artificial Sequence
  Synthetic
agcactggaggutccaaacut

SEQ ID NO: 16731 - DNA, 25 bp, Artificial Sequence
  Synthetic
gggctagtcucaatatttgcttuga

SEQ ID NO: 16732 - DNA, 23 bp, Artificial Sequence
  Synthetic
tttcaggccucaaacatcacugt

SEQ ID NO: 16733 - DNA, 31 bp, Artificial Sequence
  Synthetic
aaacaatggacuatgatgaugaagaaacaga

SEQ ID NO: 16734 - DNA, 19 bp, Artificial Sequence
  Synthetic
aaccguacgggcaactuct

SEQ ID NO: 16735 - DNA, 28 bp, Artificial Sequence
  Synthetic
gttcctctucctaaatcaagtucccaaa

SEQ ID NO: 16736 - DNA, 26 bp, Artificial Sequence
  Synthetic
ctccaggtccagauccttttctttut

SEQ ID NO: 16737 - DNA, 28 bp, Artificial Sequence
  Synthetic
aatggtggttttauttttgtaggtgcug

SEQ ID NO: 16738 - DNA, 25 bp, Artificial Sequence
  Synthetic
guaaggcttcttucaaggacaacac

SEQ ID NO: 16739 - DNA, 29 bp, Artificial Sequence
  Synthetic
aaatgttgatttcucatgcatcctacuct

SEQ ID NO: 16740 - DNA, 22 bp, Artificial Sequence
  Synthetic
gctcttgctucagtcgtgguaa

SEQ ID NO: 16741 - DNA, 30 bp, Artificial Sequence
  Synthetic
ttcttttgacctuttcagaatctgcuagat

SEQ ID NO: 16742 - DNA, 27 bp, Artificial Sequence
  Synthetic
cttcttaggttuacctgtgtttcugct

SEQ ID NO: 16743 - DNA, 28 bp, Artificial Sequence
  Synthetic
agatttgattgaatugcgagtaatgcug

SEQ ID NO: 16744 - DNA, 25 bp, Artificial Sequence
  Synthetic
acctaagacauttcttctgcauggg

SEQ ID NO: 16745 - DNA, 28 bp, Artificial Sequence
  Synthetic
agaagtgtttgaacutgttcctgaugat

SEQ ID NO: 16746 - DNA, 23 bp, Artificial Sequence
  Synthetic
cctgagcccagcuaagcaaauat

SEQ ID NO: 16747 - DNA, 24 bp, Artificial Sequence
  Synthetic
actttgcugaagctgtgaactuct

SEQ ID NO: 16748 - DNA, 28 bp, Artificial Sequence
  Synthetic
ctagactttaguagagttcatgcaugct

SEQ ID NO: 16749 - DNA, 22 bp, Artificial Sequence
  Synthetic
ggctctatgugggaatgtgcut

SEQ ID NO: 16750 - DNA, 26 bp, Artificial Sequence
  Synthetic
ctcttcttcuggcagaatctttcucc

SEQ ID NO: 16751 - DNA, 23 bp, Artificial Sequence
  Synthetic
tgugtagatggtucccacagaac

SEQ ID NO: 16752 - DNA, 25 bp, Artificial Sequence
  Synthetic
aaggatccauagaggttagacgugt

SEQ ID NO: 16753 - DNA, 26 bp, Artificial Sequence
  Synthetic
cttttgtgtgauggatgtgaugacag

SEQ ID NO: 16754 - DNA, 29 bp, Artificial Sequence
  Synthetic
cagactgcaatucaagtatcatttgagut

SEQ ID NO: 16755 - DNA, 17 bp, Artificial Sequence
  Synthetic
gcugggcccaaggtugt

SEQ ID NO: 16756 - DNA, 26 bp, Artificial Sequence
  Synthetic
tgtacttgggcaaacuggatttauca

SEQ ID NO: 16757 - DNA, 21 bp, Artificial Sequence
  Synthetic
gcutgggatatcugccaggaa

SEQ ID NO: 16758 - DNA, 28 bp, Artificial Sequence
  Synthetic
atgaaucaggaagcagaaatagugacaa

SEQ ID NO: 16759 - DNA, 28 bp, Artificial Sequence
  Synthetic
cattccttgttuacataccactgtgtut

SEQ ID NO: 16760 - DNA, 25 bp, Artificial Sequence
  Synthetic
ggtaaaagcuaacagtctgcaugga

SEQ ID NO: 16761 - DNA, 30 bp, Artificial Sequence
  Synthetic
agaagtcaaagacaaagugtgtaattaugt

SEQ ID NO: 16762 - DNA, 27 bp, Artificial Sequence
  Synthetic
caggagtctttucttctttgctgatut

SEQ ID NO: 16763 - DNA, 23 bp, Artificial Sequence
  Synthetic
tctcaaactucttgcacauggct

SEQ ID NO: 16764 - DNA, 23 bp, Artificial Sequence
  Synthetic
gcatggcautagcaaagacucaa

SEQ ID NO: 16765 - DNA, 22 bp, Artificial Sequence
  Synthetic
agggaccaguacatgaggacug

SEQ ID NO: 16766 - DNA, 23 bp, Artificial Sequence
  Synthetic
gctgtatcgucaaggcactctug

SEQ ID NO: 16767 - DNA, 30 bp, Artificial Sequence
  Synthetic
ctggtggaguatttgatagtgtatuaacct

SEQ ID NO: 16768 - DNA, 17 bp, Artificial Sequence
  Synthetic
cucagggcgccgtcuat

SEQ ID NO: 16769 - DNA, 19 bp, Artificial Sequence
  Synthetic
aggtucacgttgugcgaca

SEQ ID NO: 16770 - DNA, 22 bp, Artificial Sequence
  Synthetic
cttcttcccgcutgccttauct

SEQ ID NO: 16771 - DNA, 24 bp, Artificial Sequence
  Synthetic
cgcttctcttuggtgatgaactug

SEQ ID NO: 16772 - DNA, 27 bp, Artificial Sequence
  Synthetic
gacaatatctacuttggatcacgugct

SEQ ID NO: 16773 - DNA, 20 bp, Artificial Sequence
  Synthetic
cagaagtugcccaggtugac

SEQ ID NO: 16774 - DNA, 18 bp, Artificial Sequence
  Synthetic
gccgacgagcutaugcac

SEQ ID NO: 16775 - DNA, 22 bp, Artificial Sequence
  Synthetic
ggacgctgutcttgttgacuga

SEQ ID NO: 16776 - DNA, 20 bp, Artificial Sequence
  Synthetic
cgggtcucacgtgtctcuct

SEQ ID NO: 16777 - DNA, 20 bp, Artificial Sequence
  Synthetic
gcagccgcutctctttgtug

SEQ ID NO: 16778 - DNA, 20 bp, Artificial Sequence
  Synthetic
tcatcucccgaaaggtgcug

SEQ ID NO: 16779 - DNA, 19 bp, Artificial Sequence
  Synthetic
cgcgtccuctcttcugagg

SEQ ID NO: 16780 - DNA, 23 bp, Artificial Sequence
  Synthetic
cagcccacacaguataacgatug

SEQ ID NO: 16781 - DNA, 24 bp, Artificial Sequence
  Synthetic
gctgagguagaaatcgaacgtugg

SEQ ID NO: 16782 - DNA, 26 bp, Artificial Sequence
  Synthetic
tccacagaugtttcatgattuccagt

SEQ ID NO: 16783 - DNA, 23 bp, Artificial Sequence
  Synthetic
ctcttgtuccgaagctggaauct

SEQ ID NO: 16784 - DNA, 32 bp, Artificial Sequence
  Synthetic
tgacuaaacgattatatgaugagaagcaacaa

SEQ ID NO: 16785 - DNA, 26 bp, Artificial Sequence
  Synthetic
ggtagaggugaactgaaatgtuagcc

SEQ ID NO: 16786 - DNA, 29 bp, Artificial Sequence
  Synthetic
attggaaaggtuatttacaacaagtuagc

SEQ ID NO: 16787 - DNA, 28 bp, Artificial Sequence
  Synthetic
tctagaaaccaaaugtgaagaugaaggt

SEQ ID NO: 16788 - DNA, 28 bp, Artificial Sequence
  Synthetic
tgagttaggaaacagauacagaggucaa

SEQ ID NO: 16789 - DNA, 30 bp, Artificial Sequence
  Synthetic
agtcgagagatucaacttcaaattcuacac

SEQ ID NO: 16790 - DNA, 26 bp, Artificial Sequence
  Synthetic
gcacttcaugcaatgaaatgaauccc

SEQ ID NO: 16791 - DNA, 21 bp, Artificial Sequence
  Synthetic
gccctctucagcttgtgtuga

SEQ ID NO: 16792 - DNA, 26 bp, Artificial Sequence
  Synthetic
ccattgaaccutgtgtgatttgucaa

SEQ ID NO: 16793 - DNA, 29 bp, Artificial Sequence
  Synthetic
gttagcacaatcauttgaattggttguct

SEQ ID NO: 16794 - DNA, 20 bp, Artificial Sequence
  Synthetic
gagucagggcugagcaaaga

SEQ ID NO: 16795 - DNA, 17 bp, Artificial Sequence
  Synthetic
atugggcagcucagcca

SEQ ID NO: 16796 - DNA, 19 bp, Artificial Sequence
  Synthetic
ctgagcagaucccgtccut

SEQ ID NO: 16797 - DNA, 20 bp, Artificial Sequence
  Synthetic
gagtgcccutgttgaggugt

SEQ ID NO: 16798 - DNA, 22 bp, Artificial Sequence
  Synthetic
atcctgtuccaggcctaugaga

SEQ ID NO: 16799 - DNA, 24 bp, Artificial Sequence
  Synthetic
acagcctttuacaggaccuagagt

SEQ ID NO: 16800 - DNA, 19 bp, Artificial Sequence
  Synthetic
ctgaggcaggacacugcut

SEQ ID NO: 16801 - DNA, 20 bp, Artificial Sequence
  Synthetic
ctgtacucagcaggctgugg

SEQ ID NO: 16802 - DNA, 20 bp, Artificial Sequence
  Synthetic
gctgatuccctcccctucca

SEQ ID NO: 16803 - DNA, 19 bp, Artificial Sequence
  Synthetic
cacauggctcugcacaggt

SEQ ID NO: 16804 - DNA, 17 bp, Artificial Sequence
  Synthetic
ctucacacgccggcauc

SEQ ID NO: 16805 - DNA, 19 bp, Artificial Sequence
  Synthetic
gggugggaccaacauggaa

SEQ ID NO: 16806 - DNA, 26 bp, Artificial Sequence
  Synthetic
gcaatgagaaugacaacttgguacct

SEQ ID NO: 16807 - DNA, 25 bp, Artificial Sequence
  Synthetic
gccatcctuccctaatttgactucg

SEQ ID NO: 16808 - DNA, 27 bp, Artificial Sequence
  Synthetic
ccatgauaacgacacaacacaaaauag

SEQ ID NO: 16809 - DNA, 23 bp, Artificial Sequence
  Synthetic
ccacgggaaaguggtgaagauat

SEQ ID NO: 16810 - DNA, 32 bp, Artificial Sequence
  Synthetic
gcattcatttccatuttaaagtgctactacut

SEQ ID NO: 16811 - DNA, 27 bp, Artificial Sequence
  Synthetic
ttttaatagcaugcctggtucaagaga

SEQ ID NO: 16812 - DNA, 26 bp, Artificial Sequence
  Synthetic
gagttcacacugtgacugagaaaaga

SEQ ID NO: 16813 - DNA, 24 bp, Artificial Sequence
  Synthetic
cacgagaatatugtgaacctgcug

SEQ ID NO: 16814 - DNA, 32 bp, Artificial Sequence
  Synthetic
gaaactcccattugagatcatattcatatuct

SEQ ID NO: 16815 - DNA, 22 bp, Artificial Sequence
  Synthetic
tcctctatcugcagaacugcct

SEQ ID NO: 16816 - DNA, 25 bp, Artificial Sequence
  Synthetic
ggaaccctttuatggcttcacucat

SEQ ID NO: 16817 - DNA, 23 bp, Artificial Sequence
  Synthetic
caatctgaugacagctcaccugt

SEQ ID NO: 16818 - DNA, 25 bp, Artificial Sequence
  Synthetic
ggcatcaucattttctgcauggaat

SEQ ID NO: 16819 - DNA, 24 bp, Artificial Sequence
  Synthetic
ggagcattucaaggaagacaccuc

SEQ ID NO: 16820 - DNA, 22 bp, Artificial Sequence
  Synthetic
tgtcgtttcutgccactgauga

SEQ ID NO: 16821 - DNA, 32 bp, Artificial Sequence
  Synthetic
attctgaaaaugcaggaacaattaactaauag

SEQ ID NO: 16822 - DNA, 25 bp, Artificial Sequence
  Synthetic
tccgucccaaataattcaugaagca

SEQ ID NO: 16823 - DNA, 25 bp, Artificial Sequence
  Synthetic
ttgaccctuaaaactggctcuagaa

SEQ ID NO: 16824 - DNA, 32 bp, Artificial Sequence
  Synthetic
tattgtgtaattgguagcttcactctgaauaa

SEQ ID NO: 16825 - DNA, 30 bp, Artificial Sequence
  Synthetic
tcacacatttuccaaaataactagttcuct

SEQ ID NO: 16826 - DNA, 28 bp, Artificial Sequence
  Synthetic
ttccccactgaugaatcattgttctuat

SEQ ID NO: 16827 - DNA, 31 bp, Artificial Sequence
  Synthetic
gataaatgcatgtuttctttttaaggtgugc

SEQ ID NO: 16828 - DNA, 21 bp, Artificial Sequence
  Synthetic
ccacagcuggaauggcagaaa

SEQ ID NO: 16829 - DNA, 26 bp, Artificial Sequence
  Synthetic
caaatgacccacucagaaagaguaga

SEQ ID NO: 16830 - DNA, 25 bp, Artificial Sequence
  Synthetic
caggagutgagtatguaaacccact

SEQ ID NO: 16831 - DNA, 30 bp, Artificial Sequence
  Synthetic
caagattgtgcaaaugacatagtcaaagut

SEQ ID NO: 16832 - DNA, 25 bp, Artificial Sequence
  Synthetic
gctgtttgauttcttccttcuccca

SEQ ID NO: 16833 - DNA, 19 bp, Artificial Sequence
  Synthetic
gccccctugccctcttcua

SEQ ID NO: 16834 - DNA, 26 bp, Artificial Sequence
  Synthetic
ttgtaaaaatatcucagcgcguagga

SEQ ID NO: 16835 - DNA, 22 bp, Artificial Sequence
  Synthetic
gacuagatagcgucaccagcag

SEQ ID NO: 16836 - DNA, 22 bp, Artificial Sequence
  Synthetic
tgggucagtugaaagccaaact

SEQ ID NO: 16837 - DNA, 28 bp, Artificial Sequence
  Synthetic
aacaaaccagtgucttctcttcatuaca

SEQ ID NO: 16838 - DNA, 25 bp, Artificial Sequence
  Synthetic
ggttaauaggagucagaagagaguc

SEQ ID NO: 16839 - DNA, 25 bp, Artificial Sequence
  Synthetic
tgggaatttcttugttgcaccacua

SEQ ID NO: 16840 - DNA, 22 bp, Artificial Sequence
  Synthetic
gggacaccautagcaugacagt

SEQ ID NO: 16841 - DNA, 31 bp, Artificial Sequence
  Synthetic
catagacaauacaagaataaagtugacgagt

SEQ ID NO: 16842 - DNA, 23 bp, Artificial Sequence
  Synthetic
tgcagggaaacautcatgauggt

SEQ ID NO: 16843 - DNA, 26 bp, Artificial Sequence
  Synthetic
ctgaaactgucttgcacagtuaacaa

SEQ ID NO: 16844 - DNA, 22 bp, Artificial Sequence
  Synthetic
tgggagcugagagtgtattugt

SEQ ID NO: 16845 - DNA, 25 bp, Artificial Sequence
  Synthetic
tgaagagtccuttatcctggaugct

SEQ ID NO: 16846 - DNA, 25 bp, Artificial Sequence
  Synthetic
acuaatttgttgccuaccagaacca

SEQ ID NO: 16847 - DNA, 26 bp, Artificial Sequence
  Synthetic
tggctacucgttaattaucaaggacg

SEQ ID NO: 16848 - DNA, 23 bp, Artificial Sequence
  Synthetic
gaaagcauagcatgagtuggcaa

SEQ ID NO: 16849 - DNA, 32 bp, Artificial Sequence
  Synthetic
catgccaacatatuctacagtgttcttacuat

SEQ ID NO: 16850 - DNA, 27 bp, Artificial Sequence
  Synthetic
cacagataaaaauacagagcactucgg

SEQ ID NO: 16851 - DNA, 27 bp, Artificial Sequence
  Synthetic
agaaagggctucatcatatcaaaugca

SEQ ID NO: 16852 - DNA, 28 bp, Artificial Sequence
  Synthetic
gcaaaagcaaacagaaugtagaaaaugg

SEQ ID NO: 16853 - DNA, 27 bp, Artificial Sequence
  Synthetic
agtactttaaccutgaacacagcucaa

SEQ ID NO: 16854 - DNA, 18 bp, Artificial Sequence
  Synthetic
tgtcuggcctgctugcat

SEQ ID NO: 16855 - DNA, 32 bp, Artificial Sequence
  Synthetic
aaatgaaaaactcaccutcatggaaagauaac

SEQ ID NO: 16856 - DNA, 23 bp, Artificial Sequence
  Synthetic
aactcaagcucagcaagtcacut

SEQ ID NO: 16857 - DNA, 22 bp, Artificial Sequence
  Synthetic
gaggatcugcaccatagugacc

SEQ ID NO: 16858 - DNA, 19 bp, Artificial Sequence
  Synthetic
caagucaggctggaugcca

SEQ ID NO: 16859 - DNA, 25 bp, Artificial Sequence
  Synthetic
gaaagttgaugcccagtaagacuga

SEQ ID NO: 16860 - DNA, 19 bp, Artificial Sequence
  Synthetic
agctgcucacggaggagua

SEQ ID NO: 16861 - DNA, 22 bp, Artificial Sequence
  Synthetic
gctcagcagacauctgcagtua

SEQ ID NO: 16862 - DNA, 30 bp, Artificial Sequence
  Synthetic
catgctggatuggccatatgtatattttug

SEQ ID NO: 16863 - DNA, 28 bp, Artificial Sequence
  Synthetic
ccttctctcaucaccaacatcatuaact

SEQ ID NO: 16864 - DNA, 28 bp, Artificial Sequence
  Synthetic
agttatcaaagucatcattgctgugaga

SEQ ID NO: 16865 - DNA, 24 bp, Artificial Sequence
  Synthetic
guaaatttgcuaagagccgaagcc

SEQ ID NO: 16866 - DNA, 22 bp, Artificial Sequence
  Synthetic
gagctgttgcugtcaccctuat

SEQ ID NO: 16867 - DNA, 17 bp, Artificial Sequence
  Synthetic
cugtccuacgccgacct

SEQ ID NO: 16868 - DNA, 20 bp, Artificial Sequence
  Synthetic
gtcgatcuccaccaccugag

SEQ ID NO: 16869 - DNA, 17 bp, Artificial Sequence
  Synthetic
cggcutcgtucccccaa

SEQ ID NO: 16870 - DNA, 26 bp, Artificial Sequence
  Synthetic
gcatgagcautagacttuacaaccat

SEQ ID NO: 16871 - DNA, 21 bp, Artificial Sequence
  Synthetic
tcaucgatgccauccaaccag

SEQ ID NO: 16872 - DNA, 30 bp, Artificial Sequence
  Synthetic
ttcaagaaaaagccacutccataagctaua

SEQ ID NO: 16873 - DNA, 27 bp, Artificial Sequence
  Synthetic
cttgagaattguaactacgcgguagaa

SEQ ID NO: 16874 - DNA, 24 bp, Artificial Sequence
  Synthetic
tcctatggcucttttgaggtcuct

SEQ ID NO: 16875 - DNA, 29 bp, Artificial Sequence
  Synthetic
cccaaaagauaacccatcttcattcauct

SEQ ID NO: 16876 - DNA, 25 bp, Artificial Sequence
  Synthetic
gacaugtcaauaacaacagcaggaa

SEQ ID NO: 16877 - DNA, 26 bp, Artificial Sequence
  Synthetic
ttgcttttgggaaaucattgttaugc

SEQ ID NO: 16878 - DNA, 22 bp, Artificial Sequence
  Synthetic
acccaatcutgatgactugcca

SEQ ID NO: 16879 - DNA, 28 bp, Artificial Sequence
  Synthetic
aaaaacttgcauacattttctcccucag

SEQ ID NO: 16880 - DNA, 27 bp, Artificial Sequence
  Synthetic
ctgtgtttgcutctgtctttgttuaca

SEQ ID NO: 16881 - DNA, 22 bp, Artificial Sequence
  Synthetic
gggatttgugcaatcggtggua

SEQ ID NO: 16882 - DNA, 28 bp, Artificial Sequence
  Synthetic
ctactcagugaagaagagaatgaugcaa

SEQ ID NO: 16883 - DNA, 29 bp, Artificial Sequence
  Synthetic
gttatcccttaugttcttcttctcuccag

SEQ ID NO: 16884 - DNA, 31 bp, Artificial Sequence
  Synthetic
tccuaccaaaacagauaaaaagaaagcagaa

SEQ ID NO: 16885 - DNA, 23 bp, Artificial Sequence
  Synthetic
cattcaauggaacaggugcaact

SEQ ID NO: 16886 - DNA, 28 bp, Artificial Sequence
  Synthetic
catcttttccgutatgttcattgttugc

SEQ ID NO: 16887 - DNA, 26 bp, Artificial Sequence
  Synthetic
gctttcttctuccctgatccacttuc

SEQ ID NO: 16888 - DNA, 24 bp, Artificial Sequence
  Synthetic
agggatccagaaauctgggacuaa

SEQ ID NO: 16889 - DNA, 30 bp, Artificial Sequence
  Synthetic
agaaaatgaaauctatgactccaucagaac

SEQ ID NO: 16890 - DNA, 29 bp, Artificial Sequence
  Synthetic
gagaattgactacgcutatacatcagcut

SEQ ID NO: 16891 - DNA, 26 bp, Artificial Sequence
  Synthetic
cttttgtugcttctgattugggaagt

SEQ ID NO: 16892 - DNA, 27 bp, Artificial Sequence
  Synthetic
tttgtaauaacggaaggctcctaaucc

SEQ ID NO: 16893 - DNA, 26 bp, Artificial Sequence
  Synthetic
attcttctttuggacttcctctugct

SEQ ID NO: 16894 - DNA, 25 bp, Artificial Sequence
  Synthetic
acuagguaaagaaagagacctcugt

SEQ ID NO: 16895 - DNA, 28 bp, Artificial Sequence
  Synthetic
gctctgattccautaactgcattaguct

SEQ ID NO: 16896 - DNA, 28 bp, Artificial Sequence
  Synthetic
gaactactgaaguaaggatgatgcttut

SEQ ID NO: 16897 - DNA, 27 bp, Artificial Sequence
  Synthetic
gatcacgttcacutgctaaagaatcut

SEQ ID NO: 16898 - DNA, 31 bp, Artificial Sequence
  Synthetic
ttcctgtgaagugatatcattttcttcucat

SEQ ID NO: 16899 - DNA, 28 bp, Artificial Sequence
  Synthetic
gttataagcagcaauattttcugcaaca

SEQ ID NO: 16900 - DNA, 28 bp, Artificial Sequence
  Synthetic
ccagautctaaaugaccaaaacaaagca

SEQ ID NO: 16901 - DNA, 31 bp, Artificial Sequence
  Synthetic
gtaauttggtacctaaauaagaagaaccaga

SEQ ID NO: 16902 - DNA, 25 bp, Artificial Sequence
  Synthetic
tggtgggtctuggtgatttctaauc

SEQ ID NO: 16903 - DNA, 26 bp, Artificial Sequence
  Synthetic
aaacacagttcuctgtctcccaauac

SEQ ID NO: 16904 - DNA, 28 bp, Artificial Sequence
  Synthetic
agcacctacaacauaacatttaatgcua

SEQ ID NO: 16905 - DNA, 30 bp, Artificial Sequence
  Synthetic
tctcttcaaaatguggtcttaaagcauact

SEQ ID NO: 16906 - DNA, 30 bp, Artificial Sequence
  Synthetic
agaaaagcttcaaugtttttaagtctccug

SEQ ID NO: 16907 - DNA, 32 bp, Artificial Sequence
  Synthetic
ataaactgtgacucaaacttattactuacact

SEQ ID NO: 16908 - DNA, 24 bp, Artificial Sequence
  Synthetic
ggaagcatuggcatcaacugaaaa

SEQ ID NO: 16909 - DNA, 28 bp, Artificial Sequence
  Synthetic
ttagtctgattutaagacaagcugcaga

SEQ ID NO: 16910 - DNA, 27 bp, Artificial Sequence
  Synthetic
cattaccttctuccttcatggccuaaa

SEQ ID NO: 16911 - DNA, 27 bp, Artificial Sequence
  Synthetic
tgtgattcaucgaccttaacttuccat

SEQ ID NO: 16912 - DNA, 27 bp, Artificial Sequence
  Synthetic
agtagcauacaaaacatgggctaucat

SEQ ID NO: 16913 - DNA, 23 bp, Artificial Sequence
  Synthetic
ccaguggaggacaagcttctuac

SEQ ID NO: 16914 - DNA, 23 bp, Artificial Sequence
  Synthetic
caacagtcacuggagcttaucca

SEQ ID NO: 16915 - DNA, 29 bp, Artificial Sequence
  Synthetic
acatttttgttcuttacacaggucacaag

SEQ ID NO: 16916 - DNA, 28 bp, Artificial Sequence
  Synthetic
gccttctgtugctttgttttaaagugaa

SEQ ID NO: 16917 - DNA, 28 bp, Artificial Sequence
  Synthetic
gttcagtgtutctgacaaaguagaaagg

SEQ ID NO: 16918 - DNA, 23 bp, Artificial Sequence
  Synthetic
aagaccgcagugggataaatcuc

SEQ ID NO: 16919 - DNA, 30 bp, Artificial Sequence
  Synthetic
ttcacauaaaactctttugagaaaaggaac

SEQ ID NO: 16920 - DNA, 27 bp, Artificial Sequence
  Synthetic
ttttggcttattucactcagtctgcua

SEQ ID NO: 16921 - DNA, 25 bp, Artificial Sequence
  Synthetic
gactttcttaccuagagagcaugcc

SEQ ID NO: 16922 - DNA, 23 bp, Artificial Sequence
  Synthetic
tcatacugccagctctaccucat

SEQ ID NO: 16923 - DNA, 26 bp, Artificial Sequence
  Synthetic
ctcacattgaacucctttgtcttcug

SEQ ID NO: 16924 - DNA, 25 bp, Artificial Sequence
  Synthetic
aaaccatagttgutccccttgtuca

SEQ ID NO: 16925 - DNA, 21 bp, Artificial Sequence
  Synthetic
cutttggtgtugggcaggaag

SEQ ID NO: 16926 - DNA, 26 bp, Artificial Sequence
  Synthetic
ctctgacatctauggacaaagcctut

SEQ ID NO: 16927 - DNA, 29 bp, Artificial Sequence
  Synthetic
caggaaaactgugcattaatgttacauga

SEQ ID NO: 16928 - DNA, 23 bp, Artificial Sequence
  Synthetic
ttgcagcagcaaaguacaucaac

SEQ ID NO: 16929 - DNA, 25 bp, Artificial Sequence
  Synthetic
tccctgataagutcggtatctucca

SEQ ID NO: 16930 - DNA, 23 bp, Artificial Sequence
  Synthetic
gagattggtcutctggcaacugt

SEQ ID NO: 16931 - DNA, 30 bp, Artificial Sequence
  Synthetic
acaacacagaacauatgtcagaaataccut

SEQ ID NO: 16932 - DNA, 25 bp, Artificial Sequence
  Synthetic
gtatcagtcgugctgatgtcaucat

SEQ ID NO: 16933 - DNA, 26 bp, Artificial Sequence
  Synthetic
gagcctcgtuatgaatatcagaugcc

SEQ ID NO: 16934 - DNA, 24 bp, Artificial Sequence
  Synthetic
gactttcagggaaucctgtaucgg

SEQ ID NO: 16935 - DNA, 22 bp, Artificial Sequence
  Synthetic
cctaactgtuaccaggctucca

SEQ ID NO: 16936 - DNA, 24 bp, Artificial Sequence
  Synthetic
agtgccaatggautgttgatgcua

SEQ ID NO: 16937 - DNA, 24 bp, Artificial Sequence
  Synthetic
gacatgcaucaaagctttctccug

SEQ ID NO: 16938 - DNA, 21 bp, Artificial Sequence
  Synthetic
gcagcacuggtatcaucagca

SEQ ID NO: 16939 - DNA, 26 bp, Artificial Sequence
  Synthetic
tcctguaatactgtctugaaagcaga

SEQ ID NO: 16940 - DNA, 24 bp, Artificial Sequence
  Synthetic
gtctcttagggcutgagcttucat

SEQ ID NO: 16941 - DNA, 28 bp, Artificial Sequence
  Synthetic
agtcatcacttttugattacaggtggut

SEQ ID NO: 16942 - DNA, 29 bp, Artificial Sequence
  Synthetic
gctcaatcatauagatcacttcuaagcca

SEQ ID NO: 16943 - DNA, 28 bp, Artificial Sequence
  Synthetic
aagaaaagucagagctagaugaaaccat

SEQ ID NO: 16944 - DNA, 22 bp, Artificial Sequence
  Synthetic
gttgcaacauctcacgggauat

SEQ ID NO: 16945 - DNA, 25 bp, Artificial Sequence
  Synthetic
acgtcccatcaucttcaggttauct

SEQ ID NO: 16946 - DNA, 22 bp, Artificial Sequence
  Synthetic
gtcgggattuctggtccagaug

SEQ ID NO: 16947 - DNA, 24 bp, Artificial Sequence
  Synthetic
agaaagagucggaagacaaaccug

SEQ ID NO: 16948 - DNA, 22 bp, Artificial Sequence
  Synthetic
ccagtgaatgutcaggtgccua

SEQ ID NO: 16949 - DNA, 20 bp, Artificial Sequence
  Synthetic
atgattggccagutcggugt

SEQ ID NO: 16950 - DNA, 26 bp, Artificial Sequence
  Synthetic
tgaaaccaaaauccgattctgggtua

SEQ ID NO: 16951 - DNA, 21 bp, Artificial Sequence
  Synthetic
gttgagacgutcgccttucag

SEQ ID NO: 16952 - DNA, 24 bp, Artificial Sequence
  Synthetic
cagagacagaguagagtgguggat

SEQ ID NO: 16953 - DNA, 21 bp, Artificial Sequence
  Synthetic
tctgccgcccuatctctgtua

SEQ ID NO: 16954 - DNA, 21 bp, Artificial Sequence
  Synthetic
tctgcatgagugcaactcucc

SEQ ID NO: 16955 - DNA, 22 bp, Artificial Sequence
  Synthetic
gtcaccucccagaccaaagaut

SEQ ID NO: 16956 - DNA, 27 bp, Artificial Sequence
  Synthetic
aggttaggtgautatcactgtctguct

SEQ ID NO: 16957 - DNA, 21 bp, Artificial Sequence
  Synthetic
caaacatcagcuccagcucct

SEQ ID NO: 16958 - DNA, 27 bp, Artificial Sequence
  Synthetic
gcaaacatgutatttgagcuagaacca

SEQ ID NO: 16959 - DNA, 31 bp, Artificial Sequence
  Synthetic
agagaagaacaaaugaataaacaggtacugt

SEQ ID NO: 16960 - DNA, 17 bp, Artificial Sequence
  Synthetic
ccacugcagccaugggt

SEQ ID NO: 16961 - DNA, 18 bp, Artificial Sequence
  Synthetic
gagccaccccugatguga

SEQ ID NO: 16962 - DNA, 28 bp, Artificial Sequence
  Synthetic
cactagagttttcuaccaaaagggtcug

SEQ ID NO: 16963 - DNA, 21 bp, Artificial Sequence
  Synthetic
ctcaagtctucgggtggctut

SEQ ID NO: 16964 - DNA, 17 bp, Artificial Sequence
  Synthetic
cctcaccucgtcggugt

SEQ ID NO: 16965 - DNA, 22 bp, Artificial Sequence
  Synthetic
caguacaaggccacagacttug

SEQ ID NO: 16966 - DNA, 19 bp, Artificial Sequence
  Synthetic
ggugggagaagcctgugac

SEQ ID NO: 16967 - DNA, 21 bp, Artificial Sequence
  Synthetic
ccaaaccgugaccagacugat

SEQ ID NO: 16968 - DNA, 17 bp, Artificial Sequence
  Synthetic
gctgctcutgcgaggug

SEQ ID NO: 16969 - DNA, 17 bp, Artificial Sequence
  Synthetic
ccctgcucgttcgcuct

SEQ ID NO: 16970 - DNA, 21 bp, Artificial Sequence
  Synthetic
tgcttttcuctggccugagag

SEQ ID NO: 16971 - DNA, 18 bp, Artificial Sequence
  Synthetic
ggagucccagcgcaucaa

SEQ ID NO: 16972 - DNA, 21 bp, Artificial Sequence
  Synthetic
ctctgctucagagccctctuc

SEQ ID NO: 16973 - DNA, 20 bp, Artificial Sequence
  Synthetic
ccuttcccuggcagacaaca

SEQ ID NO: 16974 - DNA, 22 bp, Artificial Sequence
  Synthetic
gaagctccagguctttcagguc

SEQ ID NO: 16975 - DNA, 21 bp, Artificial Sequence
  Synthetic
gggcagcacacauctctatuc

SEQ ID NO: 16976 - DNA, 20 bp, Artificial Sequence
  Synthetic
cagggccutggtttcctuct

SEQ ID NO: 16977 - DNA, 23 bp, Artificial Sequence
  Synthetic
gcttcccccgguatttacaatuc

SEQ ID NO: 16978 - DNA, 22 bp, Artificial Sequence
  Synthetic
gatcucagcgcagagaagtuga

SEQ ID NO: 16979 - DNA, 19 bp, Artificial Sequence
  Synthetic
ccugcaagaccagcuggac

SEQ ID NO: 16980 - DNA, 27 bp, Artificial Sequence
  Synthetic
gatgtcacucttatgtgtcaucaccaa

SEQ ID NO: 16981 - DNA, 22 bp, Artificial Sequence
  Synthetic
ctgaagaaggcccuggaugaag

SEQ ID NO: 16982 - DNA, 21 bp, Artificial Sequence
  Synthetic
cauggacacacagcaaaugcc

SEQ ID NO: 16983 - DNA, 20 bp, Artificial Sequence
  Synthetic
aagcugaaacggaagcugga

SEQ ID NO: 16984 - DNA, 20 bp, Artificial Sequence
  Synthetic
ccggccccuactcactttug

SEQ ID NO: 16985 - DNA, 21 bp, Artificial Sequence
  Synthetic
ggacctugaagaacagcugga

SEQ ID NO: 16986 - DNA, 17 bp, Artificial Sequence
  Synthetic
ccgcauctccucagcct

SEQ ID NO: 16987 - DNA, 22 bp, Artificial Sequence
  Synthetic
aggtacctguatggatgcaugg

SEQ ID NO: 16988 - DNA, 20 bp, Artificial Sequence
  Synthetic
cagttccgcagcutgaggua

SEQ ID NO: 16989 - DNA, 20 bp, Artificial Sequence
  Synthetic
ctctgtugacagcagggugt

SEQ ID NO: 16990 - DNA, 19 bp, Artificial Sequence
  Synthetic
ggccagaccutgggactua

SEQ ID NO: 16991 - DNA, 21 bp, Artificial Sequence
  Synthetic
cactgcccuctttgaccttug

SEQ ID NO: 16992 - DNA, 23 bp, Artificial Sequence
  Synthetic
cagggaagucacgttgtcatuca

SEQ ID NO: 16993 - DNA, 25 bp, Artificial Sequence
  Synthetic
ctcagaagatcuggaaggacaaugg

SEQ ID NO: 16994 - DNA, 24 bp, Artificial Sequence
  Synthetic
gatgaacauggtgtggtugaagag

SEQ ID NO: 16995 - DNA, 26 bp, Artificial Sequence
  Synthetic
ctccttgtcutctgacttcauaccaa

SEQ ID NO: 16996 - DNA, 23 bp, Artificial Sequence
  Synthetic
ggtcaucaggaaaaaguggcaag

SEQ ID NO: 16997 - DNA, 23 bp, Artificial Sequence
  Synthetic
cttggcatugacctttgtgtcug

SEQ ID NO: 16998 - DNA, 21 bp, Artificial Sequence
  Synthetic
cccaggcucagggaaaggaua

SEQ ID NO: 16999 - DNA, 20 bp, Artificial Sequence
  Synthetic
gggtuaacggctgaagtugg

SEQ ID NO: 17000 - DNA, 19 bp, Artificial Sequence
  Synthetic
gtgcagcccugagtucact

SEQ ID NO: 17001 - DNA, 21 bp, Artificial Sequence
  Synthetic
cctgcccauctacucggagaa

SEQ ID NO: 17002 - DNA, 20 bp, Artificial Sequence
  Synthetic
ctccacaaccaccucauccc

SEQ ID NO: 17003 - DNA, 22 bp, Artificial Sequence
  Synthetic
gccaacucagtgacgaugagaa

SEQ ID NO: 17004 - DNA, 19 bp, Artificial Sequence
  Synthetic
catgaccggcugctttguc

SEQ ID NO: 17005 - DNA, 21 bp, Artificial Sequence
  Synthetic
gaaaatgtcgucggccaugaa

SEQ ID NO: 17006 - DNA, 20 bp, Artificial Sequence
  Synthetic
tggcctgguttaacccugac

SEQ ID NO: 17007 - DNA, 20 bp, Artificial Sequence
  Synthetic
gcaccugcagctcatagcuc

SEQ ID NO: 17008 - DNA, 20 bp, Artificial Sequence
  Synthetic
ccctcuggtgatgucagggt

SEQ ID NO: 17009 - DNA, 20 bp, Artificial Sequence
  Synthetic
ctccgaggagcucaucacag

SEQ ID NO: 17010 - DNA, 20 bp, Artificial Sequence
  Synthetic
catacggccuggtgtccaut

SEQ ID NO: 17011 - DNA, 19 bp, Artificial Sequence
  Synthetic
gactgtgguccctgcaucc

SEQ ID NO: 17012 - DNA, 21 bp, Artificial Sequence
  Synthetic
ctgtggagugtgactucacca

SEQ ID NO: 17013 - DNA, 23 bp, Artificial Sequence
  Synthetic
ggacatccagucagcctcatuag

SEQ ID NO: 17014 - DNA, 23 bp, Artificial Sequence
  Synthetic
cttccagaguttguagagggcaa

SEQ ID NO: 17015 - DNA, 21 bp, Artificial Sequence
  Synthetic
cgtggacuggctauaaccact

SEQ ID NO: 17016 - DNA, 20 bp, Artificial Sequence
  Synthetic
gggctatgcugggattguga

SEQ ID NO: 17017 - DNA, 26 bp, Artificial Sequence
  Synthetic
ggattatagcttugctgctgtccaua

SEQ ID NO: 17018 - DNA, 25 bp, Artificial Sequence
  Synthetic
tttctcacagguaactauggccaag

SEQ ID NO: 17019 - DNA, 17 bp, Artificial Sequence
  Synthetic
cctccacggucctgcug

SEQ ID NO: 17020 - DNA, 23 bp, Artificial Sequence
  Synthetic
ttttcctgtugactaacggcuca

SEQ ID NO: 17021 - DNA, 21 bp, Artificial Sequence
  Synthetic
tcttttcaugccaccacgugt

SEQ ID NO: 17022 - DNA, 28 bp, Artificial Sequence
  Synthetic
gtgtcttgcatutaaagtctgttgauga

SEQ ID NO: 17023 - DNA, 21 bp, Artificial Sequence
  Synthetic
cactagcagguagctccucac

SEQ ID NO: 17024 - DNA, 28 bp, Artificial Sequence
  Synthetic
gggaatgggaauatgatagatcttgtut

SEQ ID NO: 17025 - DNA, 17 bp, Artificial Sequence
  Synthetic
cccucggaagccuccac

SEQ ID NO: 17026 - DNA, 18 bp, Artificial Sequence
  Synthetic
cctgccuggcaccuagga

SEQ ID NO: 17027 - DNA, 18 bp, Artificial Sequence
  Synthetic
cutgagguggcccacact

SEQ ID NO: 17028 - DNA, 25 bp, Artificial Sequence
  Synthetic
ttgcttgattucagacagttgcauc

SEQ ID NO: 17029 - DNA, 24 bp, Artificial Sequence
  Synthetic
gaagaaaggtuccgaagaactucc

SEQ ID NO: 17030 - DNA, 23 bp, Artificial Sequence
  Synthetic
cggtgcttuggtctcaacaguat

SEQ ID NO: 17031 - DNA, 24 bp, Artificial Sequence
  Synthetic
gctggaaacuggttgtgaauaggg

SEQ ID NO: 17032 - DNA, 24 bp, Artificial Sequence
  Synthetic
ctgtgacaucagctaagauggact

SEQ ID NO: 17033 - DNA, 20 bp, Artificial Sequence
  Synthetic
cttcgugggaggctccauac

SEQ ID NO: 17034 - DNA, 20 bp, Artificial Sequence
  Synthetic
gggtagguggttctccauga

SEQ ID NO: 17035 - DNA, 22 bp, Artificial Sequence
  Synthetic
gggauacgccacatttuggaag

SEQ ID NO: 17036 - DNA, 19 bp, Artificial Sequence
  Synthetic
gctgcucgagccgtttuct

SEQ ID NO: 17037 - DNA, 21 bp, Artificial Sequence
  Synthetic
ccuggagucggagaagaacca

SEQ ID NO: 17038 - DNA, 18 bp, Artificial Sequence
  Synthetic
gttcagcugctgcgggua

SEQ ID NO: 17039 - DNA, 18 bp, Artificial Sequence
  Synthetic
cuccacccccaugagcac

SEQ ID NO: 17040 - DNA, 17 bp, Artificial Sequence
  Synthetic
ggcutcaggcucgggaa

SEQ ID NO: 17041 - DNA, 21 bp, Artificial Sequence
  Synthetic
gcgagcccutccttaugcaaa

SEQ ID NO: 17042 - DNA, 23 bp, Artificial Sequence
  Synthetic
gggagtuaacacttcatgctuct

SEQ ID NO: 17043 - DNA, 19 bp, Artificial Sequence
  Synthetic
ccctcccuctcctccaguc

SEQ ID NO: 17044 - DNA, 25 bp, Artificial Sequence
  Synthetic
attgattccuttccccacuaaagca

SEQ ID NO: 17045 - DNA, 18 bp, Artificial Sequence
  Synthetic
cctgacgcugacctgucc

SEQ ID NO: 17046 - DNA, 23 bp, Artificial Sequence
  Synthetic
aggtgaaacugtgcttgtauccc

SEQ ID NO: 17047 - DNA, 22 bp, Artificial Sequence
  Synthetic
agcagtctguagccatttguca

SEQ ID NO: 17048 - DNA, 26 bp, Artificial Sequence
  Synthetic
gttcaucagacaaguccagagaaaua

SEQ ID NO: 17049 - DNA, 22 bp, Artificial Sequence
  Synthetic
gcactgcacuttgcgatucaac

SEQ ID NO: 17050 - DNA, 25 bp, Artificial Sequence
  Synthetic
ccagagcagaggucaaaatuaaggg

SEQ ID NO: 17051 - DNA, 24 bp, Artificial Sequence
  Synthetic
cactctactagutgtgggtccuca

SEQ ID NO: 17052 - DNA, 22 bp, Artificial Sequence
  Synthetic
gcccagguggtagtaggtgtua

SEQ ID NO: 17053 - DNA, 20 bp, Artificial Sequence
  Synthetic
cttcccaggagcacutccuc

SEQ ID NO: 17054 - DNA, 22 bp, Artificial Sequence
  Synthetic
cagggagaaagugctcauggat

SEQ ID NO: 17055 - DNA, 23 bp, Artificial Sequence
  Synthetic
ctagtgctgugtgtcccttacua

SEQ ID NO: 17056 - DNA, 21 bp, Artificial Sequence
  Synthetic
cctccucagaaagaggctguc

SEQ ID NO: 17057 - DNA, 21 bp, Artificial Sequence
  Synthetic
ggtctguttccaccugagcat

SEQ ID NO: 17058 - DNA, 19 bp, Artificial Sequence
  Synthetic
gugcaggaggauccacauc

SEQ ID NO: 17059 - DNA, 21 bp, Artificial Sequence
  Synthetic
tgccctggaaaautccagcut

SEQ ID NO: 17060 - DNA, 25 bp, Artificial Sequence
  Synthetic
aaacagaaatugagagaaggcucca

SEQ ID NO: 17061 - DNA, 24 bp, Artificial Sequence
  Synthetic
gatgacagcagcgutgagatauca

SEQ ID NO: 17062 - DNA, 26 bp, Artificial Sequence
  Synthetic
gaagatccacaautcttcgcattguc

SEQ ID NO: 17063 - DNA, 24 bp, Artificial Sequence
  Synthetic
aggactttccutgtcagtctcuca

SEQ ID NO: 17064 - DNA, 20 bp, Artificial Sequence
  Synthetic
gcaguttctgcugggacagg

SEQ ID NO: 17065 - DNA, 22 bp, Artificial Sequence
  Synthetic
tgcgctcugctatctatccuca

SEQ ID NO: 17066 - DNA, 21 bp, Artificial Sequence
  Synthetic
cccuacacacactctugacca

SEQ ID NO: 17067 - DNA, 22 bp, Artificial Sequence
  Synthetic
ttggutggccattugcaagaag

SEQ ID NO: 17068 - DNA, 19 bp, Artificial Sequence
  Synthetic
ccgaccucatccucacagg

SEQ ID NO: 17069 - DNA, 29 bp, Artificial Sequence
  Synthetic
tgtctgccaaatuaaagagccaagataut

SEQ ID NO: 17070 - DNA, 22 bp, Artificial Sequence
  Synthetic
agaacccgcaucttgtcaugaa

SEQ ID NO: 17071 - DNA, 21 bp, Artificial Sequence
  Synthetic
cttacgtcugcctctgtgugt

SEQ ID NO: 17072 - DNA, 24 bp, Artificial Sequence
  Synthetic
gaaagacgggagaacauactgugt

SEQ ID NO: 17073 - DNA, 22 bp, Artificial Sequence
  Synthetic
acctgcccgutgttactttuaa

SEQ ID NO: 17074 - DNA, 21 bp, Artificial Sequence
  Synthetic
acggacaccagcutcctctua

SEQ ID NO: 17075 - DNA, 21 bp, Artificial Sequence
  Synthetic
cgaaccgacutctctccguag

SEQ ID NO: 17076 - DNA, 22 bp, Artificial Sequence
  Synthetic
tggaaacucacgctttggtuga

SEQ ID NO: 17077 - DNA, 22 bp, Artificial Sequence
  Synthetic
gctcagagtuctctggccttug

SEQ ID NO: 17078 - DNA, 19 bp, Artificial Sequence
  Synthetic
cccagucccccttctucca

SEQ ID NO: 17079 - DNA, 26 bp, Artificial Sequence
  Synthetic
tgaacttccgugagaactucaagaaa

SEQ ID NO: 17080 - DNA, 22 bp, Artificial Sequence
  Synthetic
gtgtgcaguactgagtcctgug

SEQ ID NO: 17081 - DNA, 27 bp, Artificial Sequence
  Synthetic
caaacaaaugcagaaggaaatgucaga

SEQ ID NO: 17082 - DNA, 26 bp, Artificial Sequence
  Synthetic
aacatcgtcaaagcugttctccauat

SEQ ID NO: 17083 - DNA, 17 bp, Artificial Sequence
  Synthetic
cutgcccuggcccagaa

SEQ ID NO: 17084 - DNA, 22 bp, Artificial Sequence
  Synthetic
tttcagagcugcctcttuacca

SEQ ID NO: 17085 - DNA, 23 bp, Artificial Sequence
  Synthetic
aagactcucctctgagguagcag

SEQ ID NO: 17086 - DNA, 18 bp, Artificial Sequence
  Synthetic
gccgagcutgctgcatug

SEQ ID NO: 17087 - DNA, 17 bp, Artificial Sequence
  Synthetic
ctgcaugctgcugacgg

SEQ ID NO: 17088 - DNA, 26 bp, Artificial Sequence
  Synthetic
aaaatguggaaaaattgctucccaat

SEQ ID NO: 17089 - DNA, 24 bp, Artificial Sequence
  Synthetic
tcgtccaattuctccaaggtctut

SEQ ID NO: 17090 - DNA, 30 bp, Artificial Sequence
  Synthetic
aagtaaaggcaaggugatatttaagatgua

SEQ ID NO: 17091 - DNA, 32 bp, Artificial Sequence
  Synthetic
ttgcctaaaatttctuctggaataacatcauc

SEQ ID NO: 17092 - DNA, 20 bp, Artificial Sequence
  Synthetic
gactucggcatcaguggaca

SEQ ID NO: 17093 - DNA, 27 bp, Artificial Sequence
  Synthetic
tcatggtaaaaccguatgactaauggc

SEQ ID NO: 17094 - DNA, 23 bp, Artificial Sequence
  Synthetic
aaatgttcaguttgggctgucat

SEQ ID NO: 17095 - DNA, 23 bp, Artificial Sequence
  Synthetic
gctggcattugatccaggattut

SEQ ID NO: 17096 - DNA, 22 bp, Artificial Sequence
  Synthetic
tctttaggcaggugtgtgugac

SEQ ID NO: 17097 - DNA, 21 bp, Artificial Sequence
  Synthetic
guccgaggaggacaatgucaa

SEQ ID NO: 17098 - DNA, 25 bp, Artificial Sequence
  Synthetic
ggcaucttcucacaaaaaggacact

SEQ ID NO: 17099 - DNA, 17 bp, Artificial Sequence
  Synthetic
tccacccuccacccugt

SEQ ID NO: 17100 - DNA, 24 bp, Artificial Sequence
  Synthetic
ccgcacaccuaaggaaaagatgut

SEQ ID NO: 17101 - DNA, 25 bp, Artificial Sequence
  Synthetic
gaaagcacugcactctcttgttuag

SEQ ID NO: 17102 - DNA, 23 bp, Artificial Sequence
  Synthetic
agattcttucacatggcggucaa

SEQ ID NO: 17103 - DNA, 20 bp, Artificial Sequence
  Synthetic
ggtaccagcugtctgctcuc

SEQ ID NO: 17104 - DNA, 21 bp, Artificial Sequence
  Synthetic
ccggcaccucatctctgaaut

SEQ ID NO: 17105 - DNA, 23 bp, Artificial Sequence
  Synthetic
gctggtacagcaucatcaccauc

SEQ ID NO: 17106 - DNA, 27 bp, Artificial Sequence
  Synthetic
gctgacgtattuaatggaggtctctut

SEQ ID NO: 17107 - DNA, 22 bp, Artificial Sequence
  Synthetic
agcttgagtuttccgagcucag

SEQ ID NO: 17108 - DNA, 20 bp, Artificial Sequence
  Synthetic
ggagggagcucatgggagua

SEQ ID NO: 17109 - DNA, 19 bp, Artificial Sequence
  Synthetic
ccguaccttgguggacgac

SEQ ID NO: 17110 - DNA, 20 bp, Artificial Sequence
  Synthetic
cccctgugcactcttgcaut

SEQ ID NO: 17111 - DNA, 22 bp, Artificial Sequence
  Synthetic
aactcagtccautcctgcctuc

SEQ ID NO: 17112 - DNA, 20 bp, Artificial Sequence
  Synthetic
gacctguaaccgccauggat

SEQ ID NO: 17113 - DNA, 21 bp, Artificial Sequence
  Synthetic
ccaucaaagggacagcagcua

SEQ ID NO: 17114 - DNA, 25 bp, Artificial Sequence
  Synthetic
cccagcacaauatctagtcaccuct

SEQ ID NO: 17115 - DNA, 20 bp, Artificial Sequence
  Synthetic
acaccauccctccugaaggt

SEQ ID NO: 17116 - DNA, 19 bp, Artificial Sequence
  Synthetic
catuccccaagcuggagca

SEQ ID NO: 17117 - DNA, 19 bp, Artificial Sequence
  Synthetic
gtggagaagcgcaugaugg

SEQ ID NO: 17118 - DNA, 17 bp, Artificial Sequence
  Synthetic
ccagcugccccatccut

SEQ ID NO: 17119 - DNA, 17 bp, Artificial Sequence
  Synthetic
cugggcaagcucccaga

SEQ ID NO: 17120 - DNA, 22 bp, Artificial Sequence
  Synthetic
gggattctaccuccctccctua

SEQ ID NO: 17121 - DNA, 20 bp, Artificial Sequence
  Synthetic
acatacctgugtggctgcuc

SEQ ID NO: 17122 - DNA, 22 bp, Artificial Sequence
  Synthetic
acgactaacauggagcagctuc

SEQ ID NO: 17123 - DNA, 21 bp, Artificial Sequence
  Synthetic
ggccuaagggcggaacctuaa

SEQ ID NO: 17124 - DNA, 20 bp, Artificial Sequence
  Synthetic
ctgtgagaaugctggugggt

SEQ ID NO: 17125 - DNA, 18 bp, Artificial Sequence
  Synthetic
cgugctguggaaggacag

SEQ ID NO: 17126 - DNA, 22 bp, Artificial Sequence
  Synthetic
gcagcagagacauctcctucag

SEQ ID NO: 17127 - DNA, 22 bp, Artificial Sequence
  Synthetic
tgatcctcugagatgtgcccut

SEQ ID NO: 17128 - DNA, 24 bp, Artificial Sequence
  Synthetic
cttggcaauaacacaaguctcaug

SEQ ID NO: 17129 - DNA, 21 bp, Artificial Sequence
  Synthetic
ccttacucacccctccttugg

SEQ ID NO: 17130 - DNA, 18 bp, Artificial Sequence
  Synthetic
gtcgctgcugcctgtgua

SEQ ID NO: 17131 - DNA, 22 bp, Artificial Sequence
  Synthetic
agttcaccttcuccgtgggaua

SEQ ID NO: 17132 - DNA, 23 bp, Artificial Sequence
  Synthetic
gcauaggacgaagtucccaggag

SEQ ID NO: 17133 - DNA, 20 bp, Artificial Sequence
  Synthetic
tgttgctugaggcgaaggut

SEQ ID NO: 17134 - DNA, 20 bp, Artificial Sequence
  Synthetic
gaucttgagggucacgggaa

SEQ ID NO: 17135 - DNA, 19 bp, Artificial Sequence
  Synthetic
ctgtgaaucccgacgcuct

SEQ ID NO: 17136 - DNA, 20 bp, Artificial Sequence
  Synthetic
aggacgagguctcctuccag

SEQ ID NO: 17137 - DNA, 23 bp, Artificial Sequence
  Synthetic
ggaatgtgcugaagacagauggg

SEQ ID NO: 17138 - DNA, 17 bp, Artificial Sequence
  Synthetic
gcuccccctgaauccca

SEQ ID NO: 17139 - DNA, 17 bp, Artificial Sequence
  Synthetic
cggagcgucgtccctuc

SEQ ID NO: 17140 - DNA, 19 bp, Artificial Sequence
  Synthetic
gcaugaccacagcccucac

SEQ ID NO: 17141 - DNA, 23 bp, Artificial Sequence
  Synthetic
agggagaatcutcagggcactua

SEQ ID NO: 17142 - DNA, 19 bp, Artificial Sequence
  Synthetic
ctgcacaauccuggagcct

SEQ ID NO: 17143 - DNA, 22 bp, Artificial Sequence
  Synthetic
atgttgttcttuctgcgcctug

SEQ ID NO: 17144 - DNA, 19 bp, Artificial Sequence
  Synthetic
gcucgcagagagatucgga

SEQ ID NO: 17145 - DNA, 18 bp, Artificial Sequence
  Synthetic
ggctcccauttgccucca

SEQ ID NO: 17146 - DNA, 23 bp, Artificial Sequence
  Synthetic
tctcactccuggttgcttucaat

SEQ ID NO: 17147 - DNA, 26 bp, Artificial Sequence
  Synthetic
caacctaccgucttggaatctaacuc

SEQ ID NO: 17148 - DNA, 28 bp, Artificial Sequence
  Synthetic
ccgacatgcauataatgttttgtguact

SEQ ID NO: 17149 - DNA, 21 bp, Artificial Sequence
  Synthetic
gggugaacgcaaccctctuac

SEQ ID NO: 17150 - DNA, 22 bp, Artificial Sequence
  Synthetic
cctctctttuccccactcugga

SEQ ID NO: 17151 - DNA, 24 bp, Artificial Sequence
  Synthetic
cccactttgcuatgcctctctuaa

SEQ ID NO: 17152 - DNA, 17 bp, Artificial Sequence
  Synthetic
ccugccagccaggacuc

SEQ ID NO: 17153 - DNA, 18 bp, Artificial Sequence
  Synthetic
ttgggcuttccuggcaca

SEQ ID NO: 17154 - DNA, 17 bp, Artificial Sequence
  Synthetic
gccatgucgctgtuggg

SEQ ID NO: 17155 - DNA, 19 bp, Artificial Sequence
  Synthetic
tgatccaggagcucgcuga

SEQ ID NO: 17156 - DNA, 25 bp, Artificial Sequence
  Synthetic
aggtgtgtttutgatgagtcaucca

SEQ ID NO: 17157 - DNA, 28 bp, Artificial Sequence
  Synthetic
ctggctgaatucaaaggtgaaattgtua

SEQ ID NO: 17158 - DNA, 22 bp, Artificial Sequence
  Synthetic
gttgctgtuggaagccctatuc

SEQ ID NO: 17159 - DNA, 28 bp, Artificial Sequence
  Synthetic
gutttacatgttaacucccccaaaagac

SEQ ID NO: 17160 - DNA, 27 bp, Artificial Sequence
  Synthetic
tcactggcucaaaactacttggatuag

SEQ ID NO: 17161 - DNA, 26 bp, Artificial Sequence
  Synthetic
tgtattacucaccaggaugaccaaga

SEQ ID NO: 17162 - DNA, 24 bp, Artificial Sequence
  Synthetic
gcagtctguatgttcagagugcat

SEQ ID NO: 17163 - DNA, 26 bp, Artificial Sequence
  Synthetic
cctatatggauttggagcaucaacgg

SEQ ID NO: 17164 - DNA, 29 bp, Artificial Sequence
  Synthetic
ctggattggcaaauggaatctttaugaaa

SEQ ID NO: 17165 - DNA, 22 bp, Artificial Sequence
  Synthetic
agggaacccugaataggtgugt

SEQ ID NO: 17166 - DNA, 28 bp, Artificial Sequence
  Synthetic
agattcaattaggauttgcagctgagut

SEQ ID NO: 17167 - DNA, 28 bp, Artificial Sequence
  Synthetic
aaagaagagacucacaagtggaaaauca

SEQ ID NO: 17168 - DNA, 27 bp, Artificial Sequence
  Synthetic
actcaggatuggaagatactguagagg

SEQ ID NO: 17169 - DNA, 28 bp, Artificial Sequence
  Synthetic
tctgguaaggaccattagacauaagaca

SEQ ID NO: 17170 - DNA, 28 bp, Artificial Sequence
  Synthetic
ctgacaggcucagaatttctgaaaaaug

SEQ ID NO: 17171 - DNA, 28 bp, Artificial Sequence
  Synthetic
tcctgaagttugctatgaaacagtuact

SEQ ID NO: 17172 - DNA, 20 bp, Artificial Sequence
  Synthetic
tgctagccuaggcagagcut

SEQ ID NO: 17173 - DNA, 30 bp, Artificial Sequence
  Synthetic
gattccctctttcucttctttttcttcuct

SEQ ID NO: 17174 - DNA, 24 bp, Artificial Sequence
  Synthetic
guatattgcugagcggagaggaat

SEQ ID NO: 17175 - DNA, 21 bp, Artificial Sequence
  Synthetic
gatcgtguttgtgtccuccca

SEQ ID NO: 17176 - DNA, 20 bp, Artificial Sequence
  Synthetic
cctctguccgcagattcgug

SEQ ID NO: 17177 - DNA, 17 bp, Artificial Sequence
  Synthetic
cactcgucgcgguaggt

SEQ ID NO: 17178 - DNA, 23 bp, Artificial Sequence
  Synthetic
cctcaatgcucttatcgacccut

SEQ ID NO: 17179 - DNA, 26 bp, Artificial Sequence
  Synthetic
gactctgcugtggcaataaauaacag

SEQ ID NO: 17180 - DNA, 17 bp, Artificial Sequence
  Synthetic
ccatcagccuccggugt

SEQ ID NO: 17181 - DNA, 19 bp, Artificial Sequence
  Synthetic
gatggacugggtcaugggt

SEQ ID NO: 17182 - DNA, 18 bp, Artificial Sequence
  Synthetic
cugcagccccacaaucac

SEQ ID NO: 17183 - DNA, 18 bp, Artificial Sequence
  Synthetic
ggaccugcaguccgagga

SEQ ID NO: 17184 - DNA, 19 bp, Artificial Sequence
  Synthetic
ttggacucctccaccucca

SEQ ID NO: 17185 - DNA, 17 bp, Artificial Sequence
  Synthetic
ccgcaccucctccucct

SEQ ID NO: 17186 - DNA, 21 bp, Artificial Sequence
  Synthetic
aggtgtccutggagctttugg

SEQ ID NO: 17187 - DNA, 18 bp, Artificial Sequence
  Synthetic
cttgcccuccctgctcut

SEQ ID NO: 17188 - DNA, 20 bp, Artificial Sequence
  Synthetic
ttgaaggugagcttcucgca

SEQ ID NO: 17189 - DNA, 23 bp, Artificial Sequence
  Synthetic
ccctctgaugcagactttctugt

SEQ ID NO: 17190 - DNA, 17 bp, Artificial Sequence
  Synthetic
cgagaccutgccccuga

SEQ ID NO: 17191 - DNA, 19 bp, Artificial Sequence
  Synthetic
cgcttugagcccagaggug

SEQ ID NO: 17192 - DNA, 21 bp, Artificial Sequence
  Synthetic
ccacaagugcacauacaggca

SEQ ID NO: 17193 - DNA, 19 bp, Artificial Sequence
  Synthetic
agugacccacgacccctua

SEQ ID NO: 17194 - DNA, 19 bp, Artificial Sequence
  Synthetic
gcacacaccauctcugcct

SEQ ID NO: 17195 - DNA, 18 bp, Artificial Sequence
  Synthetic
gggcaccuagtcctccuc

SEQ ID NO: 17196 - DNA, 19 bp, Artificial Sequence
  Synthetic
ggaaacugaggcuagccct

SEQ ID NO: 17197 - DNA, 17 bp, Artificial Sequence
  Synthetic
ccaccacaugcgcucct

SEQ ID NO: 17198 - DNA, 17 bp, Artificial Sequence
  Synthetic
ggccgugccagcugaat

SEQ ID NO: 17199 - DNA, 17 bp, Artificial Sequence
  Synthetic
gctgctugcgcgactuc

SEQ ID NO: 17200 - DNA, 20 bp, Artificial Sequence
  Synthetic
gatagcgggacugatgucca

SEQ ID NO: 17201 - DNA, 20 bp, Artificial Sequence
  Synthetic
gtgatgggcugtggaauggt

SEQ ID NO: 17202 - DNA, 22 bp, Artificial Sequence
  Synthetic
cagtcugcccttctgucaaagt

SEQ ID NO: 17203 - DNA, 24 bp, Artificial Sequence
  Synthetic
acttagctuggaagctgacaagug

SEQ ID NO: 17204 - DNA, 21 bp, Artificial Sequence
  Synthetic
agaaagcctuccctgggaaug

SEQ ID NO: 17205 - DNA, 26 bp, Artificial Sequence
  Synthetic
catagacatgtauctgcgaaaacgug

SEQ ID NO: 17206 - DNA, 21 bp, Artificial Sequence
  Synthetic
cttggcauccatgacctucag

SEQ ID NO: 17207 - DNA, 20 bp, Artificial Sequence
  Synthetic
gctgtccccucaccatucag

SEQ ID NO: 17208 - DNA, 20 bp, Artificial Sequence
  Synthetic
gagctcucgaagactgcugt

SEQ ID NO: 17209 - DNA, 23 bp, Artificial Sequence
  Synthetic
aaggacugagaaggagagtguct

SEQ ID NO: 17210 - DNA, 19 bp, Artificial Sequence
  Synthetic
ccagugaaacccgagggug

SEQ ID NO: 17211 - DNA, 28 bp, Artificial Sequence
  Synthetic
tccagaaatcguagacattagcaucaag

SEQ ID NO: 17212 - DNA, 18 bp, Artificial Sequence
  Synthetic
gaatacgccuccgcguca

SEQ ID NO: 17213 - DNA, 21 bp, Artificial Sequence
  Synthetic
ggctaaagccugggtttgugt

SEQ ID NO: 17214 - DNA, 22 bp, Artificial Sequence
  Synthetic
ggatagcacuggccaaatccut

SEQ ID NO: 17215 - DNA, 20 bp, Artificial Sequence
  Synthetic
ctccgcagaauctgtcccuc

SEQ ID NO: 17216 - DNA, 24 bp, Artificial Sequence
  Synthetic
agtgguccccaaaggagaaagaua

SEQ ID NO: 17217 - DNA, 21 bp, Artificial Sequence
  Synthetic
catggcaccuccaagugaaga

SEQ ID NO: 17218 - DNA, 23 bp, Artificial Sequence
  Synthetic
gctccctccccuatccaattcut

SEQ ID NO: 17219 - DNA, 22 bp, Artificial Sequence
  Synthetic
cccatccaugactguacacagc

SEQ ID NO: 17220 - DNA, 20 bp, Artificial Sequence
  Synthetic
ctgucagagccugccaagat

SEQ ID NO: 17221 - DNA, 20 bp, Artificial Sequence
  Synthetic
gctcccagcuacaccatcug

SEQ ID NO: 17222 - DNA, 21 bp, Artificial Sequence
  Synthetic
gcctgaaaagccugctgtgua

SEQ ID NO: 17223 - DNA, 29 bp, Artificial Sequence
  Synthetic
gaacgtgagguggacttaaatttacuaga

SEQ ID NO: 17224 - DNA, 21 bp, Artificial Sequence
  Synthetic
cattctccagguggtgctuct

SEQ ID NO: 17225 - DNA, 18 bp, Artificial Sequence
  Synthetic
gctcgugtccatguccgt

SEQ ID NO: 17226 - DNA, 18 bp, Artificial Sequence
  Synthetic
ggtgatggugcgggugag

SEQ ID NO: 17227 - DNA, 18 bp, Artificial Sequence
  Synthetic
cgcugcaaagctucgaca

SEQ ID NO: 17228 - DNA, 18 bp, Artificial Sequence
  Synthetic
cugagcggtguggaggac

SEQ ID NO: 17229 - DNA, 20 bp, Artificial Sequence
  Synthetic
gctggccauggagtatguca

SEQ ID NO: 17230 - DNA, 18 bp, Artificial Sequence
  Synthetic
ggctctccugctccaucg

SEQ ID NO: 17231 - DNA, 18 bp, Artificial Sequence
  Synthetic
ctcgtgcucgtggucaga

SEQ ID NO: 17232 - DNA, 17 bp, Artificial Sequence
  Synthetic
cgacgccuccccaaguc

SEQ ID NO: 17233 - DNA, 17 bp, Artificial Sequence
  Synthetic
ggcgggugggcttctut

SEQ ID NO: 17234 - DNA, 28 bp, Artificial Sequence
  Synthetic
gcaataatatgucaggacaacgcgauat

SEQ ID NO: 17235 - DNA, 18 bp, Artificial Sequence
  Synthetic
gctcgttgugaggcggut

SEQ ID NO: 17236 - DNA, 18 bp, Artificial Sequence
  Synthetic
ccggagccutcagtggug

SEQ ID NO: 17237 - DNA, 19 bp, Artificial Sequence
  Synthetic
cctccuggagcaaggtcug

SEQ ID NO: 17238 - DNA, 18 bp, Artificial Sequence
  Synthetic
cccaucccaagaggcugt

SEQ ID NO: 17239 - DNA, 17 bp, Artificial Sequence
  Synthetic
ccgucaagcgcgatugg

SEQ ID NO: 17240 - DNA, 21 bp, Artificial Sequence
  Synthetic
gccagacgcaagauccatcuc

SEQ ID NO: 17241 - DNA, 18 bp, Artificial Sequence
  Synthetic
ggagtcaucgtcgcugct

SEQ ID NO: 17242 - DNA, 23 bp, Artificial Sequence
  Synthetic
ctctcaaggucaagaagguaccc

SEQ ID NO: 17243 - DNA, 23 bp, Artificial Sequence
  Synthetic
catgtagcccaucttttcgucct

SEQ ID NO: 17244 - DNA, 21 bp, Artificial Sequence
  Synthetic
cgactgccgugacatcatuca

SEQ ID NO: 17245 - DNA, 31 bp, Artificial Sequence
  Synthetic
gattaactgcttguacaattacgtttcacut

SEQ ID NO: 17246 - DNA, 24 bp, Artificial Sequence
  Synthetic
gtgagaggaaaacgagugtgcaua

SEQ ID NO: 17247 - DNA, 21 bp, Artificial Sequence
  Synthetic
attgaccuggactcgctgaug

SEQ ID NO: 17248 - DNA, 18 bp, Artificial Sequence
  Synthetic
gcgccugaaggatcucca

SEQ ID NO: 17249 - DNA, 17 bp, Artificial Sequence
  Synthetic
ctcggccugggcaucat

SEQ ID NO: 17250 - DNA, 17 bp, Artificial Sequence
  Synthetic
cccaggauggcgacgug

SEQ ID NO: 17251 - DNA, 21 bp, Artificial Sequence
  Synthetic
cccuggcaccttcttugacaa

SEQ ID NO: 17252 - DNA, 21 bp, Artificial Sequence
  Synthetic
ggattccagggugtagtuggg

SEQ ID NO: 17253 - DNA, 18 bp, Artificial Sequence
  Synthetic
cccgggcucggattacut

SEQ ID NO: 17254 - DNA, 19 bp, Artificial Sequence
  Synthetic
ggctgggcuggaaaucagg

SEQ ID NO: 17255 - DNA, 17 bp, Artificial Sequence
  Synthetic
ccgggcuttccgttugg

SEQ ID NO: 17256 - DNA, 17 bp, Artificial Sequence
  Synthetic
agutcggcugggccaag

SEQ ID NO: 17257 - DNA, 20 bp, Artificial Sequence
  Synthetic
aaacgcggcccucatgatua

SEQ ID NO: 17258 - DNA, 18 bp, Artificial Sequence
  Synthetic
gttcuccagccgguggat

SEQ ID NO: 17259 - DNA, 18 bp, Artificial Sequence
  Synthetic
ccacccgggcutctaguc

SEQ ID NO: 17260 - DNA, 18 bp, Artificial Sequence
  Synthetic
ggctgggcgugcatttug

SEQ ID NO: 17261 - DNA, 18 bp, Artificial Sequence
  Synthetic
cgcccuctgacuccgaag

SEQ ID NO: 17262 - DNA, 17 bp, Artificial Sequence
  Synthetic
gctcuccgccatgugct

SEQ ID NO: 17263 - DNA, 18 bp, Artificial Sequence
  Synthetic
auccccaccagcaucacc

SEQ ID NO: 17264 - DNA, 19 bp, Artificial Sequence
  Synthetic
cgttcctgcugttgaccug

SEQ ID NO: 17265 - DNA, 19 bp, Artificial Sequence
  Synthetic
caatccugggcuggaacga

SEQ ID NO: 17266 - DNA, 20 bp, Artificial Sequence
  Synthetic
gggcuctggtugaggaacaa

SEQ ID NO: 17267 - DNA, 17 bp, Artificial Sequence
  Synthetic
ccucccgccggaaacug

SEQ ID NO: 17268 - DNA, 21 bp, Artificial Sequence
  Synthetic
gcacgtacutggtctcgtugt

SEQ ID NO: 17269 - DNA, 23 bp, Artificial Sequence
  Synthetic
acaaggagctuaaggtcaagcug

SEQ ID NO: 17270 - DNA, 18 bp, Artificial Sequence
  Synthetic
ccaactcugcccccucac

SEQ ID NO: 17271 - DNA, 21 bp, Artificial Sequence
  Synthetic
gctgccttuaggtcacacuct

SEQ ID NO: 17272 - DNA, 20 bp, Artificial Sequence
  Synthetic
gcttcgucccggttcttgut

SEQ ID NO: 17273 - DNA, 24 bp, Artificial Sequence
  Synthetic
cttcccaagtugttgatgttccut

SEQ ID NO: 17274 - DNA, 18 bp, Artificial Sequence
  Synthetic
ccauctccgugcggaact

SEQ ID NO: 17275 - DNA, 25 bp, Artificial Sequence
  Synthetic
gagaagaccauctctgccaagtaug

SEQ ID NO: 17276 - DNA, 22 bp, Artificial Sequence
  Synthetic
tccttcuggagcttcctctuca

SEQ ID NO: 17277 - DNA, 18 bp, Artificial Sequence
  Synthetic
acctgagcaggugccauc

SEQ ID NO: 17278 - DNA, 21 bp, Artificial Sequence
  Synthetic
gaagtcctuggtgagctugct

SEQ ID NO: 17279 - DNA, 23 bp, Artificial Sequence
  Synthetic
ttgtgactcagguccagcttuac

SEQ ID NO: 17280 - DNA, 22 bp, Artificial Sequence
  Synthetic
aggactgguttggattctgugg

SEQ ID NO: 17281 - DNA, 21 bp, Artificial Sequence
  Synthetic
ccagauccaggagaugaggca

SEQ ID NO: 17282 - DNA, 22 bp, Artificial Sequence
  Synthetic
ctcactagugccgagaacuagg

SEQ ID NO: 17283 - DNA, 19 bp, Artificial Sequence
  Synthetic
cagaucgcggagcucaaga

SEQ ID NO: 17284 - DNA, 19 bp, Artificial Sequence
  Synthetic
gcaagggugaccacacuct

SEQ ID NO: 17285 - DNA, 22 bp, Artificial Sequence
  Synthetic
cgaagcugaaaaagcuggagga

SEQ ID NO: 17286 - DNA, 28 bp, Artificial Sequence
  Synthetic
cagatctcttcuaattcctgcttctugg

SEQ ID NO: 17287 - DNA, 23 bp, Artificial Sequence
  Synthetic
aggagcttgugttttccactugt

SEQ ID NO: 17288 - DNA, 20 bp, Artificial Sequence
  Synthetic
gaggacctucatggcgguaa

SEQ ID NO: 17289 - DNA, 22 bp, Artificial Sequence
  Synthetic
gguagacccucagaaaagctug

SEQ ID NO: 17290 - DNA, 19 bp, Artificial Sequence
  Synthetic
cccaccuctgggacucact

SEQ ID NO: 17291 - DNA, 20 bp, Artificial Sequence
  Synthetic
tctcgagggcauccgtauct

SEQ ID NO: 17292 - DNA, 21 bp, Artificial Sequence
  Synthetic
acatgtguaccccttgttugg

SEQ ID NO: 17293 - DNA, 20 bp, Artificial Sequence
  Synthetic
ctccaccagucctcugacaa

SEQ ID NO: 17294 - DNA, 21 bp, Artificial Sequence
  Synthetic
gaggucaaagcaagcctggua

SEQ ID NO: 17295 - DNA, 21 bp, Artificial Sequence
  Synthetic
caccatgutcatccuggagca

SEQ ID NO: 17296 - DNA, 19 bp, Artificial Sequence
  Synthetic
tgcugcagggacatucacc

SEQ ID NO: 17297 - DNA, 23 bp, Artificial Sequence
  Synthetic
gtgtcccauctcttgggtaucaa

SEQ ID NO: 17298 - DNA, 20 bp, Artificial Sequence
  Synthetic
gggatggugacgtgtccaut

SEQ ID NO: 17299 - DNA, 22 bp, Artificial Sequence
  Synthetic
gtcccagtcuctccaaccttug

SEQ ID NO: 17300 - DNA, 22 bp, Artificial Sequence
  Synthetic
gggaccacuaagtgctctucct

SEQ ID NO: 17301 - DNA, 22 bp, Artificial Sequence
  Synthetic
catccagtatcuggcgtacgug

SEQ ID NO: 17302 - DNA, 23 bp, Artificial Sequence
  Synthetic
tcttcagaguagatgggcaggut

SEQ ID NO: 17303 - DNA, 23 bp, Artificial Sequence
  Synthetic
gtccttugaagccgcagatatut

SEQ ID NO: 17304 - DNA, 21 bp, Artificial Sequence
  Synthetic
tcaaagccacucttgucggaa

SEQ ID NO: 17305 - DNA, 20 bp, Artificial Sequence
  Synthetic
tccttctccuccccgctuag

SEQ ID NO: 17306 - DNA, 19 bp, Artificial Sequence
  Synthetic
ctgtccagguggccaucag

SEQ ID NO: 17307 - DNA, 20 bp, Artificial Sequence
  Synthetic
tccctcatugacgaccucca

SEQ ID NO: 17308 - DNA, 22 bp, Artificial Sequence
  Synthetic
ctaugaacagagaaggccguca

SEQ ID NO: 17309 - DNA, 19 bp, Artificial Sequence
  Synthetic
cugggagcccccatucaag

SEQ ID NO: 17310 - DNA, 23 bp, Artificial Sequence
  Synthetic
ccagggctguctgcattcttaut

SEQ ID NO: 17311 - DNA, 18 bp, Artificial Sequence
  Synthetic
ggaagccutgcagccuga

SEQ ID NO: 17312 - DNA, 17 bp, Artificial Sequence
  Synthetic
ctugagccgcuccacca

SEQ ID NO: 17313 - DNA, 17 bp, Artificial Sequence
  Synthetic
cgggtccugttgccuga

SEQ ID NO: 17314 - DNA, 19 bp, Artificial Sequence
  Synthetic
ccgtgcugccaaactucac

SEQ ID NO: 17315 - DNA, 20 bp, Artificial Sequence
  Synthetic
gccaccuctatccugcacaa

SEQ ID NO: 17316 - DNA, 21 bp, Artificial Sequence
  Synthetic
tcagtgaggugctgttcugac

SEQ ID NO: 17317 - DNA, 24 bp, Artificial Sequence
  Synthetic
gggctaattuctgccttttctucc

SEQ ID NO: 17318 - DNA, 22 bp, Artificial Sequence
  Synthetic
gaggguacaatcacuggcagaa

SEQ ID NO: 17319 - DNA, 23 bp, Artificial Sequence
  Synthetic
agagaaaugcttttccuggcaga

SEQ ID NO: 17320 - DNA, 20 bp, Artificial Sequence
  Synthetic
gcatctcagcugcctcucac

SEQ ID NO: 17321 - DNA, 20 bp, Artificial Sequence
  Synthetic
gccagacuagccgaugacct

SEQ ID NO: 17322 - DNA, 22 bp, Artificial Sequence
  Synthetic
cauactcggugaacacagccat

SEQ ID NO: 17323 - DNA, 23 bp, Artificial Sequence
  Synthetic
tcatctctccuctctctctgcug

SEQ ID NO: 17324 - DNA, 17 bp, Artificial Sequence
  Synthetic
cuccacagccgcctcut

SEQ ID NO: 17325 - DNA, 18 bp, Artificial Sequence
  Synthetic
guggccacaaugagcaca

SEQ ID NO: 17326 - DNA, 25 bp, Artificial Sequence
  Synthetic
ccttccttuacagaatgctgcctut

SEQ ID NO: 17327 - DNA, 27 bp, Artificial Sequence
  Synthetic
caaaacaaguaaacaagccauttacug

SEQ ID NO: 17328 - DNA, 23 bp, Artificial Sequence
  Synthetic
tgccccaaautctgctgtatugt

SEQ ID NO: 17329 - DNA, 30 bp, Artificial Sequence
  Synthetic
gcatgataggaguaatgatttttgttugct

SEQ ID NO: 17330 - DNA, 30 bp, Artificial Sequence
  Synthetic
cctttcagccgautaatttgtttcagtaut

SEQ ID NO: 17331 - DNA, 22 bp, Artificial Sequence
  Synthetic
acaccatguatctgcactugct

SEQ ID NO: 17332 - DNA, 25 bp, Artificial Sequence
  Synthetic
cttgctcttacucaagtaggctugt

SEQ ID NO: 17333 - DNA, 20 bp, Artificial Sequence
  Synthetic
cctgccuggaggtaagcuct

SEQ ID NO: 17334 - DNA, 26 bp, Artificial Sequence
  Synthetic
tcttcttctagcauttggaacagcuc

SEQ ID NO: 17335 - DNA, 28 bp, Artificial Sequence
  Synthetic
agggaaaaataugctatacacactuggt

SEQ ID NO: 17336 - DNA, 19 bp, Artificial Sequence
  Synthetic
ccutaccugcagcgaaacg

SEQ ID NO: 17337 - DNA, 24 bp, Artificial Sequence
  Synthetic
tgugaaaagccaauaaggaagcua

SEQ ID NO: 17338 - DNA, 21 bp, Artificial Sequence
  Synthetic
gatgacggcagaugctgttug

SEQ ID NO: 17339 - DNA, 22 bp, Artificial Sequence
  Synthetic
acaggttccaguacccacatug

SEQ ID NO: 17340 - DNA, 28 bp, Artificial Sequence
  Synthetic
ttttccaggaauctaggtaaaaauggct

SEQ ID NO: 17341 - DNA, 28 bp, Artificial Sequence
  Synthetic
acgtaaatactaggugtaggtggatuca

SEQ ID NO: 17342 - DNA, 27 bp, Artificial Sequence
  Synthetic
gtattcatgaagaccugggactttuct

SEQ ID NO: 17343 - DNA, 29 bp, Artificial Sequence
  Synthetic
actttcacaaugccagattttctttgtuc

SEQ ID NO: 17344 - DNA, 29 bp, Artificial Sequence
  Synthetic
aaaggcatgtttcuaatactgtgtctcut

SEQ ID NO: 17345 - DNA, 26 bp, Artificial Sequence
  Synthetic
acaggataacuctttgcatcagtuca

SEQ ID NO: 17346 - DNA, 25 bp, Artificial Sequence
  Synthetic
gtttgttgttccugaaggttacugg

SEQ ID NO: 17347 - DNA, 27 bp, Artificial Sequence
  Synthetic
caatgtatccatuaggagatccagcut

SEQ ID NO: 17348 - DNA, 28 bp, Artificial Sequence
  Synthetic
aattgatgtugaagatatcaccugagca

SEQ ID NO: 17349 - DNA, 28 bp, Artificial Sequence
  Synthetic
gggtactatugacttcacacttugcaat

SEQ ID NO: 17350 - DNA, 29 bp, Artificial Sequence
  Synthetic
tgtccacaattucattcaagtagaatucc

SEQ ID NO: 17351 - DNA, 28 bp, Artificial Sequence
  Synthetic
gcaatgtactaugtaggtctttcgugaa

SEQ ID NO: 17352 - DNA, 23 bp, Artificial Sequence
  Synthetic
ccattaccauccgcctcatctug

SEQ ID NO: 17353 - DNA, 19 bp, Artificial Sequence
  Synthetic
actccgcacutggaaggut

SEQ ID NO: 17354 - DNA, 19 bp, Artificial Sequence
  Synthetic
gtgcgcugaccctagacug

SEQ ID NO: 17355 - DNA, 21 bp, Artificial Sequence
  Synthetic
acacagtugaggcaggguaga

SEQ ID NO: 17356 - DNA, 22 bp, Artificial Sequence
  Synthetic
gcccaaaguaaagctgagcuga

SEQ ID NO: 17357 - DNA, 24 bp, Artificial Sequence
  Synthetic
tgcccatucatcttgtgauagagg

SEQ ID NO: 17358 - DNA, 19 bp, Artificial Sequence
  Synthetic
gagggtguccctggtugac

SEQ ID NO: 17359 - DNA, 19 bp, Artificial Sequence
  Synthetic
agatgccutgcggttucga

SEQ ID NO: 17360 - DNA, 17 bp, Artificial Sequence
  Synthetic
ggctccgcucagcucat

SEQ ID NO: 17361 - DNA, 24 bp, Artificial Sequence
  Synthetic
acaaaagcuttgaaggtucaagcc

SEQ ID NO: 17362 - DNA, 20 bp, Artificial Sequence
  Synthetic
gggtctcugtcagggtcugt

SEQ ID NO: 17363 - DNA, 22 bp, Artificial Sequence
  Synthetic
agaaccagaauggctuggaacc

SEQ ID NO: 17364 - DNA, 19 bp, Artificial Sequence
  Synthetic
cccaugacccctctccuca

SEQ ID NO: 17365 - DNA, 20 bp, Artificial Sequence
  Synthetic
ccctuggaggagctcaugat

SEQ ID NO: 17366 - DNA, 22 bp, Artificial Sequence
  Synthetic
gtagtuaggaggctccucaggt

SEQ ID NO: 17367 - DNA, 20 bp, Artificial Sequence
  Synthetic
ccucacagagagggccauca

SEQ ID NO: 17368 - DNA, 22 bp, Artificial Sequence
  Synthetic
cugcccacacacacagauagag

SEQ ID NO: 17369 - DNA, 21 bp, Artificial Sequence
  Synthetic
ctttgctccugtcctggguat

SEQ ID NO: 17370 - DNA, 20 bp, Artificial Sequence
  Synthetic
gtgcgctgucagtacctgua

SEQ ID NO: 17371 - DNA, 24 bp, Artificial Sequence
  Synthetic
gcatcaatagcautggcaagtuga

SEQ ID NO: 17372 - DNA, 20 bp, Artificial Sequence
  Synthetic
agcaatggucagcagtucct

SEQ ID NO: 17373 - DNA, 21 bp, Artificial Sequence
  Synthetic
gatgaggugaaacgcacacug

SEQ ID NO: 17374 - DNA, 22 bp, Artificial Sequence
  Synthetic
gcaccttaugtgtgcccuaact

SEQ ID NO: 17375 - DNA, 25 bp, Artificial Sequence
  Synthetic
gaggtttcctaauagtgagctgcug

SEQ ID NO: 17376 - DNA, 19 bp, Artificial Sequence
  Synthetic
cuccagaaaggcccaugct

SEQ ID NO: 17377 - DNA, 21 bp, Artificial Sequence
  Synthetic
tgagcgccagugtatcaagug

SEQ ID NO: 17378 - DNA, 23 bp, Artificial Sequence
  Synthetic
ccatcccaccacautctagacuc

SEQ ID NO: 17379 - DNA, 22 bp, Artificial Sequence
  Synthetic
gccatggccutttgtgttctuc

SEQ ID NO: 17380 - DNA, 21 bp, Artificial Sequence
  Synthetic
gaagaccaugcccacguagag

SEQ ID NO: 17381 - DNA, 23 bp, Artificial Sequence
  Synthetic
cttagcataacccucatgcccut

SEQ ID NO: 17382 - DNA, 21 bp, Artificial Sequence
  Synthetic
gaagccctaugaggcagaugt

SEQ ID NO: 17383 - DNA, 20 bp, Artificial Sequence
  Synthetic
ggatgacaagcucctgcugt

SEQ ID NO: 17384 - DNA, 21 bp, Artificial Sequence
  Synthetic
ctaggacacutagggcccuga

SEQ ID NO: 17385 - DNA, 26 bp, Artificial Sequence
  Synthetic
acattgagaagaauccagagcugaaa

SEQ ID NO: 17386 - DNA, 22 bp, Artificial Sequence
  Synthetic
gcaagtguggaaatctgtgcug

SEQ ID NO: 17387 - DNA, 23 bp, Artificial Sequence
  Synthetic
ccucaactauccaccaggcaaaa

SEQ ID NO: 17388 - DNA, 21 bp, Artificial Sequence
  Synthetic
accaccagcucctagtctuct

SEQ ID NO: 17389 - DNA, 25 bp, Artificial Sequence
  Synthetic
gctgagataacucaagtcccttucc

SEQ ID NO: 17390 - DNA, 21 bp, Artificial Sequence
  Synthetic
cgctagugagggacccaauct

SEQ ID NO: 17391 - DNA, 18 bp, Artificial Sequence
  Synthetic
ccggcacucaccgtttug

SEQ ID NO: 17392 - DNA, 24 bp, Artificial Sequence
  Synthetic
gagggaagttuggttctttgguct

SEQ ID NO: 17393 - DNA, 22 bp, Artificial Sequence
  Synthetic
tccaggauttgccaacuagcac

SEQ ID NO: 17394 - DNA, 26 bp, Artificial Sequence
  Synthetic
aactactcaucacccattgtcttucc

SEQ ID NO: 17395 - DNA, 24 bp, Artificial Sequence
  Synthetic
tctcautcaccctguaagggaagt

SEQ ID NO: 17396 - DNA, 27 bp, Artificial Sequence
  Synthetic
cagtgctttuggatttagctttucaga

SEQ ID NO: 17397 - DNA, 25 bp, Artificial Sequence
  Synthetic
gcatgtauagttcatggtuccccat

SEQ ID NO: 17398 - DNA, 27 bp, Artificial Sequence
  Synthetic
cgaagctattgugtcgtctttatcuct

SEQ ID NO: 17399 - DNA, 20 bp, Artificial Sequence
  Synthetic
agcttctugacgctcctugg

SEQ ID NO: 17400 - DNA, 22 bp, Artificial Sequence
  Synthetic
ctgctgagaaugagcaggauga

SEQ ID NO: 17401 - DNA, 20 bp, Artificial Sequence
  Synthetic
cccctuggccctacttguat

SEQ ID NO: 17402 - DNA, 19 bp, Artificial Sequence
  Synthetic
gggaagtucgcgacttuct

SEQ ID NO: 17403 - DNA, 24 bp, Artificial Sequence
  Synthetic
cctctgtggcugaattctcatucc

SEQ ID NO: 17404 - DNA, 20 bp, Artificial Sequence
  Synthetic
gctcagagccgaucctgtug

SEQ ID NO: 17405 - DNA, 21 bp, Artificial Sequence
  Synthetic
gctttcaauggcctggcugat

SEQ ID NO: 17406 - DNA, 21 bp, Artificial Sequence
  Synthetic
caaaagctcutggtggaugct

SEQ ID NO: 17407 - DNA, 18 bp, Artificial Sequence
  Synthetic
ttggaguggcacctucgg

SEQ ID NO: 17408 - DNA, 21 bp, Artificial Sequence
  Synthetic
ggagtggtcuctctggctuct

SEQ ID NO: 17409 - DNA, 20 bp, Artificial Sequence
  Synthetic
gtggcguatcagaggugagc

SEQ ID NO: 17410 - DNA, 24 bp, Artificial Sequence
  Synthetic
caagacagaaugcctcaggatcua

SEQ ID NO: 17411 - DNA, 24 bp, Artificial Sequence
  Synthetic
gtggtaataggcuatgaggtgcug

SEQ ID NO: 17412 - DNA, 21 bp, Artificial Sequence
  Synthetic
gaagaccacagggugctguag

SEQ ID NO: 17413 - DNA, 24 bp, Artificial Sequence
  Synthetic
ggacaacgagauaagcaccttuca

SEQ ID NO: 17414 - DNA, 23 bp, Artificial Sequence
  Synthetic
cctcctcctcuctctcggttaut

SEQ ID NO: 17415 - DNA, 27 bp, Artificial Sequence
  Synthetic
gcaaggaatggaaugaaaaaccagtuc

SEQ ID NO: 17416 - DNA, 24 bp, Artificial Sequence
  Synthetic
aaagaaaccuctcaccttctucgg

SEQ ID NO: 17417 - DNA, 27 bp, Artificial Sequence
  Synthetic
cccattcucaacaacgccaatauagat

SEQ ID NO: 17418 - DNA, 22 bp, Artificial Sequence
  Synthetic
gaccaagcaguacgttcuccat

SEQ ID NO: 17419 - DNA, 25 bp, Artificial Sequence
  Synthetic
ggactgatgauggttaaaccctgug

SEQ ID NO: 17420 - DNA, 29 bp, Artificial Sequence
  Synthetic
caaacaattcatugaccatgtcatcuaca

SEQ ID NO: 17421 - DNA, 22 bp, Artificial Sequence
  Synthetic
tgaaattgtugttcgccaugcc

SEQ ID NO: 17422 - DNA, 17 bp, Artificial Sequence
  Synthetic
ctagcgcgcucagggua

SEQ ID NO: 17423 - DNA, 19 bp, Artificial Sequence
  Synthetic
gtcaccaaguccgctccut

SEQ ID NO: 17424 - DNA, 24 bp, Artificial Sequence
  Synthetic
gtactctgutacgagagucccagt

SEQ ID NO: 17425 - DNA, 22 bp, Artificial Sequence
  Synthetic
tcaccttctuacctcccagcua

SEQ ID NO: 17426 - DNA, 19 bp, Artificial Sequence
  Synthetic
gggttcugaggcacagcut

SEQ ID NO: 17427 - DNA, 19 bp, Artificial Sequence
  Synthetic
agtcuccaggaggcuccat

SEQ ID NO: 17428 - DNA, 21 bp, Artificial Sequence
  Synthetic
ggcaggutatcgtgugaagga

SEQ ID NO: 17429 - DNA, 19 bp, Artificial Sequence
  Synthetic
ggctgtgcuggcctctuac

SEQ ID NO: 17430 - DNA, 17 bp, Artificial Sequence
  Synthetic
cctgccuctcccacguc

SEQ ID NO: 17431 - DNA, 19 bp, Artificial Sequence
  Synthetic
aggccaacuguggagcaaa

SEQ ID NO: 17432 - DNA, 21 bp, Artificial Sequence
  Synthetic
gggtgtcagautgagtgcuct

SEQ ID NO: 17433 - DNA, 18 bp, Artificial Sequence
  Synthetic
cctcgccutggaucgcat

SEQ ID NO: 17434 - DNA, 23 bp, Artificial Sequence
  Synthetic
attcctgaagacautccgauccc

SEQ ID NO: 17435 - DNA, 22 bp, Artificial Sequence
  Synthetic
ccatccgaaguctgtctcctut

SEQ ID NO: 17436 - DNA, 20 bp, Artificial Sequence
  Synthetic
gctggcucaagtacauccgt

SEQ ID NO: 17437 - DNA, 21 bp, Artificial Sequence
  Synthetic
caccaatctuggtgccacauc

SEQ ID NO: 17438 - DNA, 18 bp, Artificial Sequence
  Synthetic
acacgtguggctcagugg

SEQ ID NO: 17439 - DNA, 17 bp, Artificial Sequence
  Synthetic
ggcguggcacctguact

SEQ ID NO: 17440 - DNA, 18 bp, Artificial Sequence
  Synthetic
acctucagcggcacaucc

SEQ ID NO: 17441 - DNA, 17 bp, Artificial Sequence
  Synthetic
gcugggcgaccacucac

SEQ ID NO: 17442 - DNA, 19 bp, Artificial Sequence
  Synthetic
ctcccccagccucaaucac

SEQ ID NO: 17443 - DNA, 21 bp, Artificial Sequence
  Synthetic
caaggauggagggaagaugcc

SEQ ID NO: 17444 - DNA, 21 bp, Artificial Sequence
  Synthetic
tgtguggagaagcugaagacc

SEQ ID NO: 17445 - DNA, 20 bp, Artificial Sequence
  Synthetic
ccttgcccutgtccttguca

SEQ ID NO: 17446 - DNA, 21 bp, Artificial Sequence
  Synthetic
cttccagtucctgcccaacut

SEQ ID NO: 17447 - DNA, 22 bp, Artificial Sequence
  Synthetic
gcttgguggtgagaucaaaggg

SEQ ID NO: 17448 - DNA, 17 bp, Artificial Sequence
  Synthetic
ccgcuccacuacgccaa

SEQ ID NO: 17449 - DNA, 20 bp, Artificial Sequence
  Synthetic
agacaccaccaugcacugag

SEQ ID NO: 17450 - DNA, 19 bp, Artificial Sequence
  Synthetic
tctccgaccccauccucag

SEQ ID NO: 17451 - DNA, 23 bp, Artificial Sequence
  Synthetic
agtttttccuggaagcacaggut

SEQ ID NO: 17452 - DNA, 17 bp, Artificial Sequence
  Synthetic
gtgcaaccgcugctucg

SEQ ID NO: 17453 - DNA, 17 bp, Artificial Sequence
  Synthetic
cccacucccctgctgut

SEQ ID NO: 17454 - DNA, 18 bp, Artificial Sequence
  Synthetic
tguccaggccuagccagt

SEQ ID NO: 17455 - DNA, 18 bp, Artificial Sequence
  Synthetic
ggctggcucctcatccuc

SEQ ID NO: 17456 - DNA, 21 bp, Artificial Sequence
  Synthetic
cctgtccugtgtgtgtgucat

SEQ ID NO: 17457 - DNA, 20 bp, Artificial Sequence
  Synthetic
gtggcuccagtgacctucaa

SEQ ID NO: 17458 - DNA, 25 bp, Artificial Sequence
  Synthetic
ccaccattttggutcccaagtttua

SEQ ID NO: 17459 - DNA, 19 bp, Artificial Sequence
  Synthetic
gactggtugcgcgtagtug

SEQ ID NO: 17460 - DNA, 27 bp, Artificial Sequence
  Synthetic
ttctcaacaguatctcaaaatgtucgt

SEQ ID NO: 17461 - DNA, 27 bp, Artificial Sequence
  Synthetic
gcaagttctgaagutcactcttgatug

SEQ ID NO: 17462 - DNA, 29 bp, Artificial Sequence
  Synthetic
tggaaaaccaagauctttaaaggaacuca

SEQ ID NO: 17463 - DNA, 22 bp, Artificial Sequence
  Synthetic
ggtctgaauccagggaaagcua

SEQ ID NO: 17464 - DNA, 25 bp, Artificial Sequence
  Synthetic
cctggcaaucatctttgcaauaaat

SEQ ID NO: 17465 - DNA, 26 bp, Artificial Sequence
  Synthetic
gcacagtacaaauccattgagcctua

SEQ ID NO: 17466 - DNA, 21 bp, Artificial Sequence
  Synthetic
cuggagcccaacaggaaugaa

SEQ ID NO: 17467 - DNA, 28 bp, Artificial Sequence
  Synthetic
ggttgaacgtuacataaataccacugga

SEQ ID NO: 17468 - DNA, 22 bp, Artificial Sequence
  Synthetic
ggaagcgatutttgccgactut

SEQ ID NO: 17469 - DNA, 19 bp, Artificial Sequence
  Synthetic
ccagccugggcgttctuac

SEQ ID NO: 17470 - DNA, 19 bp, Artificial Sequence
  Synthetic
ctcccaccuccacctcuga

SEQ ID NO: 17471 - DNA, 19 bp, Artificial Sequence
  Synthetic
ggctcagcugccttcucac

SEQ ID NO: 17472 - DNA, 20 bp, Artificial Sequence
  Synthetic
gagcuggagaaggccttuga

SEQ ID NO: 17473 - DNA, 20 bp, Artificial Sequence
  Synthetic
accttggccaucccaaacut

SEQ ID NO: 17474 - DNA, 18 bp, Artificial Sequence
  Synthetic
accagcuctgccuacgga

SEQ ID NO: 17475 - DNA, 19 bp, Artificial Sequence
  Synthetic
gctgggcugagaccaccua

SEQ ID NO: 17476 - DNA, 25 bp, Artificial Sequence
  Synthetic
ggatgggtguagatagagtgaaugg

SEQ ID NO: 17477 - DNA, 17 bp, Artificial Sequence
  Synthetic
ttcaugcgacgcugggt

SEQ ID NO: 17478 - DNA, 20 bp, Artificial Sequence
  Synthetic
aggccccautcctcuaggac

SEQ ID NO: 17479 - DNA, 27 bp, Artificial Sequence
  Synthetic
tttacttaacacacauggacaucaact

SEQ ID NO: 17480 - DNA, 26 bp, Artificial Sequence
  Synthetic
tctaggtaccugcaagttctauagac

SEQ ID NO: 17481 - DNA, 26 bp, Artificial Sequence
  Synthetic
tcaacgtgagauggaagaacaaauga

SEQ ID NO: 17482 - DNA, 26 bp, Artificial Sequence
  Synthetic
ttgatacatuggattcttcugggcaa

SEQ ID NO: 17483 - DNA, 27 bp, Artificial Sequence
  Synthetic
gtggcaataaaacuggaacaaagcuaa

SEQ ID NO: 17484 - DNA, 21 bp, Artificial Sequence
  Synthetic
cgaacucgaagctgtcuacct

SEQ ID NO: 17485 - DNA, 28 bp, Artificial Sequence
  Synthetic
gagtagacatcauccaattttgagguca

SEQ ID NO: 17486 - DNA, 19 bp, Artificial Sequence
  Synthetic
ggtgatgcugctggtggua

SEQ ID NO: 17487 - DNA, 17 bp, Artificial Sequence
  Synthetic
gtccggguggucccaaa

SEQ ID NO: 17488 - DNA, 19 bp, Artificial Sequence
  Synthetic
gggccgcgautctgatuga

SEQ ID NO: 17489 - DNA, 17 bp, Artificial Sequence
  Synthetic
gggaucggtuccggagt

SEQ ID NO: 17490 - DNA, 25 bp, Artificial Sequence
  Synthetic
cgaggucacaacagaggctauagaa

SEQ ID NO: 17491 - DNA, 22 bp, Artificial Sequence
  Synthetic
ggactgtaugcttgccgguaat

SEQ ID NO: 17492 - DNA, 24 bp, Artificial Sequence
  Synthetic
ggaggcaccuctcaagauacaaaa

SEQ ID NO: 17493 - DNA, 20 bp, Artificial Sequence
  Synthetic
cucaccaccacagacuggag

SEQ ID NO: 17494 - DNA, 23 bp, Artificial Sequence
  Synthetic
gcatgctgtuaagaagcctctug

SEQ ID NO: 17495 - DNA, 21 bp, Artificial Sequence
  Synthetic
cccaagccugtgucagagaag

SEQ ID NO: 17496 - DNA, 25 bp, Artificial Sequence
  Synthetic
tcauaggugcaaacaaaaaccagga

SEQ ID NO: 17497 - DNA, 19 bp, Artificial Sequence
  Synthetic
gcttctctugccccgauct

SEQ ID NO: 17498 - DNA, 29 bp, Artificial Sequence
  Synthetic
gttcttcctgtguattgtgttctaatugg

SEQ ID NO: 17499 - DNA, 21 bp, Artificial Sequence
  Synthetic
acgctgagacugagctgatug

SEQ ID NO: 17500 - DNA, 24 bp, Artificial Sequence
  Synthetic
aggagaauagacattucccccagt

SEQ ID NO: 17501 - DNA, 21 bp, Artificial Sequence
  Synthetic
gcccaacgcacucattttgut

SEQ ID NO: 17502 - DNA, 22 bp, Artificial Sequence
  Synthetic
gattgatcacccuggctctuct

SEQ ID NO: 17503 - DNA, 21 bp, Artificial Sequence
  Synthetic
gatttgucaaagcccgtggug

SEQ ID NO: 17504 - DNA, 22 bp, Artificial Sequence
  Synthetic
ctctggcacugatggcaattut

SEQ ID NO: 17505 - DNA, 20 bp, Artificial Sequence
  Synthetic
gaacutgtcaugggcccact

SEQ ID NO: 17506 - DNA, 25 bp, Artificial Sequence
  Synthetic
cctgtatuaaaagggcagggagtua

SEQ ID NO: 17507 - DNA, 28 bp, Artificial Sequence
  Synthetic
aatttttcctgaaaguttgcaacctuct

SEQ ID NO: 17508 - DNA, 26 bp, Artificial Sequence
  Synthetic
ggtcattctuagaaggctctttcuga

SEQ ID NO: 17509 - DNA, 26 bp, Artificial Sequence
  Synthetic
agatatggacucctacaaagcaguga

SEQ ID NO: 17510 - DNA, 29 bp, Artificial Sequence
  Synthetic
aacaaaattttaaaagutacctggcguga

SEQ ID NO: 17511 - DNA, 26 bp, Artificial Sequence
  Synthetic
cattcaagacuggtggacaaagatug

SEQ ID NO: 17512 - DNA, 26 bp, Artificial Sequence
  Synthetic
tggttatcugatggttgaugaagcaa

SEQ ID NO: 17513 - DNA, 26 bp, Artificial Sequence
  Synthetic
tggcagaaagugtaagcatgtgttua

SEQ ID NO: 17514 - DNA, 28 bp, Artificial Sequence
  Synthetic
ctacctggaagacutgtgacttcatuat

SEQ ID NO: 17515 - DNA, 19 bp, Artificial Sequence
  Synthetic
cctccaggugctagctugt

SEQ ID NO: 17516 - DNA, 23 bp, Artificial Sequence
  Synthetic
tgcatctggagauagtcccauca

SEQ ID NO: 17517 - DNA, 23 bp, Artificial Sequence
  Synthetic
gggagataugggcagttgttcuc

SEQ ID NO: 17518 - DNA, 27 bp, Artificial Sequence
  Synthetic
agttccattggucttcctgaattaugg

SEQ ID NO: 17519 - DNA, 28 bp, Artificial Sequence
  Synthetic
tgctggaaatguacaaaacgaagaguat

SEQ ID NO: 17520 - DNA, 27 bp, Artificial Sequence
  Synthetic
agtgttccaaguggttaaucaaaggag

SEQ ID NO: 17521 - DNA, 26 bp, Artificial Sequence
  Synthetic
ctaagatccaaccaucagttccugaa

SEQ ID NO: 17522 - DNA, 30 bp, Artificial Sequence
  Synthetic
tggacattcugaaaatatactaaugcaact

SEQ ID NO: 17523 - DNA, 22 bp, Artificial Sequence
  Synthetic
gcccauccccattatuccaaca

SEQ ID NO: 17524 - DNA, 28 bp, Artificial Sequence
  Synthetic
tcttgagtatgaacuttgcatggaauca

SEQ ID NO: 17525 - DNA, 29 bp, Artificial Sequence
  Synthetic
ctacagaugaagaaggtgtaacatugaca

SEQ ID NO: 17526 - DNA, 22 bp, Artificial Sequence
  Synthetic
gggtugggaacccaauaacagt

SEQ ID NO: 17527 - DNA, 18 bp, Artificial Sequence
  Synthetic
cgccgccaucttggacuc

SEQ ID NO: 17528 - DNA, 17 bp, Artificial Sequence
  Synthetic
tgguggcagcaauggga

SEQ ID NO: 17529 - DNA, 24 bp, Artificial Sequence
  Synthetic
gagctataactaugcaagcggcua

SEQ ID NO: 17530 - DNA, 21 bp, Artificial Sequence
  Synthetic
ggtagccuttgtgaactuccg

SEQ ID NO: 17531 - DNA, 23 bp, Artificial Sequence
  Synthetic
cacactggcugatggaggauaag

SEQ ID NO: 17532 - DNA, 23 bp, Artificial Sequence
  Synthetic
tggaugagattucacccgaggat

SEQ ID NO: 17533 - DNA, 19 bp, Artificial Sequence
  Synthetic
cuagtcuggccgcgagaag

SEQ ID NO: 17534 - DNA, 22 bp, Artificial Sequence
  Synthetic
ccagtaugaaagcctggaugca

SEQ ID NO: 17535 - DNA, 25 bp, Artificial Sequence
  Synthetic
tgtcaccagcucataatgagucaag

SEQ ID NO: 17536 - DNA, 22 bp, Artificial Sequence
  Synthetic
ggaggacgucatctggauaggt

SEQ ID NO: 17537 - DNA, 25 bp, Artificial Sequence
  Synthetic
cttuccaagagaagaugggaagauc

SEQ ID NO: 17538 - DNA, 23 bp, Artificial Sequence
  Synthetic
gggcaugcttctacugaagaaca

SEQ ID NO: 17539 - DNA, 20 bp, Artificial Sequence
  Synthetic
tcatccaacutgggctgguc

SEQ ID NO: 17540 - DNA, 26 bp, Artificial Sequence
  Synthetic
gcactggccaaauctgaagaagatua

SEQ ID NO: 17541 - DNA, 28 bp, Artificial Sequence
  Synthetic
aaaaagaaaattgcauctgatgctguat

SEQ ID NO: 17542 - DNA, 22 bp, Artificial Sequence
  Synthetic
gagtcccaucatcactgctgut

SEQ ID NO: 17543 - DNA, 32 bp, Artificial Sequence
  Synthetic
gagatacaaaugcaagagagcttataattugg

SEQ ID NO: 17544 - DNA, 22 bp, Artificial Sequence
  Synthetic
tggtctctcauggcactguact

SEQ ID NO: 17545 - DNA, 31 bp, Artificial Sequence
  Synthetic
tgcattccctguggtttttaataaaaatuga

SEQ ID NO: 17546 - DNA, 22 bp, Artificial Sequence
  Synthetic
ctacactggagguggactcuct

SEQ ID NO: 17547 - DNA, 22 bp, Artificial Sequence
  Synthetic
tcaagttcaucaccccactcug

SEQ ID NO: 17548 - DNA, 25 bp, Artificial Sequence
  Synthetic
ccatttctggaauctggtacauggt

SEQ ID NO: 17549 - DNA, 20 bp, Artificial Sequence
  Synthetic
aagcacauaaccaccccucg

SEQ ID NO: 17550 - DNA, 28 bp, Artificial Sequence
  Synthetic
gaaggttagaaaaagauagtgcatgcug

SEQ ID NO: 17551 - DNA, 25 bp, Artificial Sequence
  Synthetic
atcccctgtugattccctagaauct

SEQ ID NO: 17552 - DNA, 22 bp, Artificial Sequence
  Synthetic
gggaagacgauccatatgguct

SEQ ID NO: 17553 - DNA, 24 bp, Artificial Sequence
  Synthetic
gttctgtgaugggccttttctgua

SEQ ID NO: 17554 - DNA, 21 bp, Artificial Sequence
  Synthetic
cactgcatucacatccgctug

SEQ ID NO: 17555 - DNA, 29 bp, Artificial Sequence
  Synthetic
actctcttttctguactttctcctctuct

SEQ ID NO: 17556 - DNA, 22 bp, Artificial Sequence
  Synthetic
gacaacaaugtggaaccauggg

SEQ ID NO: 17557 - DNA, 20 bp, Artificial Sequence
  Synthetic
gcaccutgaagcugcagaca

SEQ ID NO: 17558 - DNA, 31 bp, Artificial Sequence
  Synthetic
atcatgattcaacaagauatgcttttcuagt

SEQ ID NO: 17559 - DNA, 21 bp, Artificial Sequence
  Synthetic
gguttcactctucgccgagat

SEQ ID NO: 17560 - DNA, 21 bp, Artificial Sequence
  Synthetic
gcatccgugttctugaagcag

SEQ ID NO: 17561 - DNA, 25 bp, Artificial Sequence
  Synthetic
ctcctgtcacccuttatgacatgut

SEQ ID NO: 17562 - DNA, 22 bp, Artificial Sequence
  Synthetic
cctggtcacaguggttgtctut

SEQ ID NO: 17563 - DNA, 26 bp, Artificial Sequence
  Synthetic
aaaatggguaggaaaatccacaguag

SEQ ID NO: 17564 - DNA, 18 bp, Artificial Sequence
  Synthetic
cggcuacccgagaauggt

SEQ ID NO: 17565 - DNA, 17 bp, Artificial Sequence
  Synthetic
tgcttcugccccagucc

SEQ ID NO: 17566 - DNA, 21 bp, Artificial Sequence
  Synthetic
cacagggcccaauttgtucac

SEQ ID NO: 17567 - DNA, 20 bp, Artificial Sequence
  Synthetic
tcaacgagugcctcuccaac

SEQ ID NO: 17568 - DNA, 22 bp, Artificial Sequence
  Synthetic
ctgattcuggcactcauccact

SEQ ID NO: 17569 - DNA, 22 bp, Artificial Sequence
  Synthetic
gtgggagacagucacagaaaug

SEQ ID NO: 17570 - DNA, 22 bp, Artificial Sequence
  Synthetic
agacatugggcacgtcacaaua

SEQ ID NO: 17571 - DNA, 22 bp, Artificial Sequence
  Synthetic
tgatgtatguacaccccugcct

SEQ ID NO: 17572 - DNA, 25 bp, Artificial Sequence
  Synthetic
tgcaagtgtaacugttgacgtaguc

SEQ ID NO: 17573 - DNA, 22 bp, Artificial Sequence
  Synthetic
gatcctugccagaatggaggut

SEQ ID NO: 17574 - DNA, 27 bp, Artificial Sequence
  Synthetic
aacctgaccacuttgtttaaagucaga

SEQ ID NO: 17575 - DNA, 21 bp, Artificial Sequence
  Synthetic
cagtattggcuccctgtuccc

SEQ ID NO: 17576 - DNA, 24 bp, Artificial Sequence
  Synthetic
gucaagcagtaugcaacaacaaga

SEQ ID NO: 17577 - DNA, 25 bp, Artificial Sequence
  Synthetic
gtgaaguggacaaaaatgaaugcct

SEQ ID NO: 17578 - DNA, 23 bp, Artificial Sequence
  Synthetic
cacaccgutgatacatgtugcac

SEQ ID NO: 17579 - DNA, 27 bp, Artificial Sequence
  Synthetic
agatgaaggatgucaacataacgtguc

SEQ ID NO: 17580 - DNA, 22 bp, Artificial Sequence
  Synthetic
gcagatgcaggugtaggaauca

SEQ ID NO: 17581 - DNA, 23 bp, Artificial Sequence
  Synthetic
gttctggugtggaatatcugcct

SEQ ID NO: 17582 - DNA, 24 bp, Artificial Sequence
  Synthetic
cgattgacttuatccacacacugc

SEQ ID NO: 17583 - DNA, 25 bp, Artificial Sequence
  Synthetic
attgcaaatttgugcttccttguct

SEQ ID NO: 17584 - DNA, 19 bp, Artificial Sequence
  Synthetic
agtcagccccuttguagcc

SEQ ID NO: 17585 - DNA, 27 bp, Artificial Sequence
  Synthetic
gacattttctcutagttgtccttugcc

SEQ ID NO: 17586 - DNA, 22 bp, Artificial Sequence
  Synthetic
cagtcugcctctggtuaccaat

SEQ ID NO: 17587 - DNA, 26 bp, Artificial Sequence
  Synthetic
cctgtgagaggaauattgatgacugc

SEQ ID NO: 17588 - DNA, 21 bp, Artificial Sequence
  Synthetic
guaggaaccaggcaggtugag

SEQ ID NO: 17589 - DNA, 25 bp, Artificial Sequence
  Synthetic
caaatggaaguacctgtaccacugt

SEQ ID NO: 17590 - DNA, 21 bp, Artificial Sequence
  Synthetic
gagtacuggcagtcctcucct

SEQ ID NO: 17591 - DNA, 23 bp, Artificial Sequence
  Synthetic
ccatacagatguccagaaggcut

SEQ ID NO: 17592 - DNA, 17 bp, Artificial Sequence
  Synthetic
gccccucagcccgauac

SEQ ID NO: 17593 - DNA, 19 bp, Artificial Sequence
  Synthetic
ccccuccccatgtggauct

SEQ ID NO: 17594 - DNA, 18 bp, Artificial Sequence
  Synthetic
caggctuggtgcctcuga

SEQ ID NO: 17595 - DNA, 29 bp, Artificial Sequence
  Synthetic
ttctcatgcuaagcaagtagggttaatut

SEQ ID NO: 17596 - DNA, 18 bp, Artificial Sequence
  Synthetic
agggatgugggtgctugg

SEQ ID NO: 17597 - DNA, 18 bp, Artificial Sequence
  Synthetic
tctctccgcucctguggt

SEQ ID NO: 17598 - DNA, 20 bp, Artificial Sequence
  Synthetic
cttcugccgcagaactucct

SEQ ID NO: 17599 - DNA, 21 bp, Artificial Sequence
  Synthetic
ctcagccccucctccatuaac

SEQ ID NO: 17600 - DNA, 27 bp, Artificial Sequence
  Synthetic
gccataaagtgccucgtagatttguag

SEQ ID NO: 17601 - DNA, 19 bp, Artificial Sequence
  Synthetic
gctctggugtggctgagua

SEQ ID NO: 17602 - DNA, 25 bp, Artificial Sequence
  Synthetic
tttgcttcuccagttggtgatuagt

SEQ ID NO: 17603 - DNA, 23 bp, Artificial Sequence
  Synthetic
ccataccucagctctgcaaugag

SEQ ID NO: 17604 - DNA, 25 bp, Artificial Sequence
  Synthetic
ctggguaggaaaagagtagacucca

SEQ ID NO: 17605 - DNA, 21 bp, Artificial Sequence
  Synthetic
tggcaagugggatgtgaugag

SEQ ID NO: 17606 - DNA, 21 bp, Artificial Sequence
  Synthetic
cugaaaggcaggaagcuggat

SEQ ID NO: 17607 - DNA, 30 bp, Artificial Sequence
  Synthetic
cccattcttttcuctcattttctcttgaug

SEQ ID NO: 17608 - DNA, 25 bp, Artificial Sequence
  Synthetic
tctcttcatagugtgtgtacucgct

SEQ ID NO: 17609 - DNA, 20 bp, Artificial Sequence
  Synthetic
autgaagtccugcaggccaa

SEQ ID NO: 17610 - DNA, 18 bp, Artificial Sequence
  Synthetic
gcttcccugggcgagtug

SEQ ID NO: 17611 - DNA, 24 bp, Artificial Sequence
  Synthetic
ggaacugtcttaccuacggcaaaa

SEQ ID NO: 17612 - DNA, 19 bp, Artificial Sequence
  Synthetic
aaggugccaacagctcuca

SEQ ID NO: 17613 - DNA, 26 bp, Artificial Sequence
  Synthetic
agaaaacaucttggtccuacgaaagg

SEQ ID NO: 17614 - DNA, 27 bp, Artificial Sequence
  Synthetic
ccacgttatgucggtatagaacauaca

SEQ ID NO: 17615 - DNA, 22 bp, Artificial Sequence
  Synthetic
agaagccacugtctttgcucag

SEQ ID NO: 17616 - DNA, 22 bp, Artificial Sequence
  Synthetic
acagtcacatucccctcctcut

SEQ ID NO: 17617 - DNA, 26 bp, Artificial Sequence
  Synthetic
atcaacctccucaaagaacaactugt

SEQ ID NO: 17618 - DNA, 25 bp, Artificial Sequence
  Synthetic
aaatattaatgcauggagccuggga

SEQ ID NO: 17619 - DNA, 25 bp, Artificial Sequence
  Synthetic
ggagcuaaaggctcaaatugaggaa

SEQ ID NO: 17620 - DNA, 26 bp, Artificial Sequence
  Synthetic
tgtccatcgtcutgcaagtaaaaaug

SEQ ID NO: 17621 - DNA, 23 bp, Artificial Sequence
  Synthetic
tttctctccaauccacccttugg

SEQ ID NO: 17622 - DNA, 29 bp, Artificial Sequence
  Synthetic
aagcatctgcacutaatgaagaauaaaag

SEQ ID NO: 17623 - DNA, 25 bp, Artificial Sequence
  Synthetic
agctctatagcaguctggtgaagut

SEQ ID NO: 17624 - DNA, 21 bp, Artificial Sequence
  Synthetic
caagggautcgatgtgugcaa

SEQ ID NO: 17625 - DNA, 22 bp, Artificial Sequence
  Synthetic
aggctgcugatatggagtcuct

SEQ ID NO: 17626 - DNA, 24 bp, Artificial Sequence
  Synthetic
ctaatgtggauctgggtatgcuga

SEQ ID NO: 17627 - DNA, 28 bp, Artificial Sequence
  Synthetic
cagtactgtcautgtgatcatagtucct

SEQ ID NO: 17628 - DNA, 26 bp, Artificial Sequence
  Synthetic
catgttccagcacutgtttattucga

SEQ ID NO: 17629 - DNA, 24 bp, Artificial Sequence
  Synthetic
ccagaagctuacagtgtccttuct

SEQ ID NO: 17630 - DNA, 24 bp, Artificial Sequence
  Synthetic
ggcgcagtuctttttctttctcut

SEQ ID NO: 17631 - DNA, 25 bp, Artificial Sequence
  Synthetic
tgggatttggutttctattcugcca

SEQ ID NO: 17632 - DNA, 27 bp, Artificial Sequence
  Synthetic
aatctcattguatttttcagccuccca

SEQ ID NO: 17633 - DNA, 27 bp, Artificial Sequence
  Synthetic
ggcctctgtauctaataaccatgugac

SEQ ID NO: 17634 - DNA, 22 bp, Artificial Sequence
  Synthetic
ctttggugcagcatttcucgaa

SEQ ID NO: 17635 - DNA, 28 bp, Artificial Sequence
  Synthetic
gtcctgttacuaaaatgtgtacagguga

SEQ ID NO: 17636 - DNA, 25 bp, Artificial Sequence
  Synthetic
agactgctgagutatagtggtcuca

SEQ ID NO: 17637 - DNA, 28 bp, Artificial Sequence
  Synthetic
aagaugcaacagacattttugaagacaa

SEQ ID NO: 17638 - DNA, 24 bp, Artificial Sequence
  Synthetic
caacagtcacacuttccaagtucc

SEQ ID NO: 17639 - DNA, 23 bp, Artificial Sequence
  Synthetic
actuagcaagcacaaagguaccc

SEQ ID NO: 17640 - DNA, 20 bp, Artificial Sequence
  Synthetic
tgcagaguatctcgcaucgg

SEQ ID NO: 17641 - DNA, 21 bp, Artificial Sequence
  Synthetic
actggagaaggaucgccucaa

SEQ ID NO: 17642 - DNA, 24 bp, Artificial Sequence
  Synthetic
cacagatccugcaaatctcctuca

SEQ ID NO: 17643 - DNA, 17 bp, Artificial Sequence
  Synthetic
ccacugggctgugccat

SEQ ID NO: 17644 - DNA, 28 bp, Artificial Sequence
  Synthetic
agattaguaagacagactcuggaaagga

SEQ ID NO: 17645 - DNA, 29 bp, Artificial Sequence
  Synthetic
attaatgcctgtgugtttttcagaacaut

SEQ ID NO: 17646 - DNA, 25 bp, Artificial Sequence
  Synthetic
gacagagugcgatatccatuagaca

SEQ ID NO: 17647 - DNA, 17 bp, Artificial Sequence
  Synthetic
ccguagccccagccuct

SEQ ID NO: 17648 - DNA, 20 bp, Artificial Sequence
  Synthetic
ccatgctcucacctcaucca

SEQ ID NO: 17649 - DNA, 20 bp, Artificial Sequence
  Synthetic
gctcacuacacgcctuaccg

SEQ ID NO: 17650 - DNA, 26 bp, Artificial Sequence
  Synthetic
ttctacatcucattcaggucaagcag

SEQ ID NO: 17651 - DNA, 21 bp, Artificial Sequence
  Synthetic
cugcaacaggaguaagtcuca

SEQ ID NO: 17652 - DNA, 19 bp, Artificial Sequence
  Synthetic
gctcccccaucctaaugcc

SEQ ID NO: 17653 - DNA, 28 bp, Artificial Sequence
  Synthetic
agtccttctcaccuagagtatcctuact

SEQ ID NO: 17654 - DNA, 28 bp, Artificial Sequence
  Synthetic
gattatatatggaaugcgtgtcuccagt

SEQ ID NO: 17655 - DNA, 23 bp, Artificial Sequence
  Synthetic
gtaagtgutctgagcuggaggag

SEQ ID NO: 17656 - DNA, 27 bp, Artificial Sequence
  Synthetic
atcccaguatagcttagugaagcaaag

SEQ ID NO: 17657 - DNA, 26 bp, Artificial Sequence
  Synthetic
aaaagatggaacuccaggaaauccaa

SEQ ID NO: 17658 - DNA, 18 bp, Artificial Sequence
  Synthetic
cagcucgctcctcugcat

SEQ ID NO: 17659 - DNA, 20 bp, Artificial Sequence
  Synthetic
caggcggaaguaagggugag

SEQ ID NO: 17660 - DNA, 22 bp, Artificial Sequence
  Synthetic
gagagatcaaugccagtgccua

SEQ ID NO: 17661 - DNA, 21 bp, Artificial Sequence
  Synthetic
cacaggugagccuaccaacag

SEQ ID NO: 17662 - DNA, 18 bp, Artificial Sequence
  Synthetic
gggagggacugggatugg

SEQ ID NO: 17663 - DNA, 24 bp, Artificial Sequence
  Synthetic
ccggatacucacatctcccttaug

SEQ ID NO: 17664 - DNA, 20 bp, Artificial Sequence
  Synthetic
gccttgctuccccaaccuaa

SEQ ID NO: 17665 - DNA, 26 bp, Artificial Sequence
  Synthetic
caagagaggaagucttggtctuagaa

SEQ ID NO: 17666 - DNA, 23 bp, Artificial Sequence
  Synthetic
tgaattcaagauggcagcaggut

SEQ ID NO: 17667 - DNA, 22 bp, Artificial Sequence
  Synthetic
ccaccatgutccaacatuccct

SEQ ID NO: 17668 - DNA, 25 bp, Artificial Sequence
  Synthetic
aaacttctgcuttcatcctguggat

SEQ ID NO: 17669 - DNA, 25 bp, Artificial Sequence
  Synthetic
cagatttacagagaucctgccugag

SEQ ID NO: 17670 - DNA, 17 bp, Artificial Sequence
  Synthetic
caggccgcccucatcug

SEQ ID NO: 17671 - DNA, 24 bp, Artificial Sequence
  Synthetic
atgatccaaauggctggtgagaut

SEQ ID NO: 17672 - DNA, 20 bp, Artificial Sequence
  Synthetic
cccagaguagctgagaccug

SEQ ID NO: 17673 - DNA, 18 bp, Artificial Sequence
  Synthetic
tgggugtccuccccaact

SEQ ID NO: 17674 - DNA, 17 bp, Artificial Sequence
  Synthetic
ggtgugcccacgcugaa

SEQ ID NO: 17675 - DNA, 20 bp, Artificial Sequence
  Synthetic
gccagcgaaggucttcucac

SEQ ID NO: 17676 - DNA, 19 bp, Artificial Sequence
  Synthetic
ctgcgcuggctcttcaaug

SEQ ID NO: 17677 - DNA, 21 bp, Artificial Sequence
  Synthetic
gtagttgccgutgttgacgug

SEQ ID NO: 17678 - DNA, 23 bp, Artificial Sequence
  Synthetic
cctggatcuaactacccctgucc

SEQ ID NO: 17679 - DNA, 17 bp, Artificial Sequence
  Synthetic
ccccgacucacggtuga

SEQ ID NO: 17680 - DNA, 22 bp, Artificial Sequence
  Synthetic
cctcaggugttcaccacaucaa

SEQ ID NO: 17681 - DNA, 19 bp, Artificial Sequence
  Synthetic
gcaggguctcacctugaca

SEQ ID NO: 17682 - DNA, 20 bp, Artificial Sequence
  Synthetic
cccauggacctgaugccaag

SEQ ID NO: 17683 - DNA, 19 bp, Artificial Sequence
  Synthetic
aggucccggugcacaaaat

SEQ ID NO: 17684 - DNA, 17 bp, Artificial Sequence
  Synthetic
cccatucgctggaugcc

SEQ ID NO: 17685 - DNA, 17 bp, Artificial Sequence
  Synthetic
gggctgaccuccgtgut

SEQ ID NO: 17686 - DNA, 27 bp, Artificial Sequence
  Synthetic
caaacggtcuggttttattttagugct

SEQ ID NO: 17687 - DNA, 28 bp, Artificial Sequence
  Synthetic
ccagaatcctuccttacctgtagauagt

SEQ ID NO: 17688 - DNA, 25 bp, Artificial Sequence
  Synthetic
tgtaacttaugagcagctgugacaa

SEQ ID NO: 17689 - DNA, 22 bp, Artificial Sequence
  Synthetic
cttagctgugtggatcagugct

SEQ ID NO: 17690 - DNA, 20 bp, Artificial Sequence
  Synthetic
gaggcucccagcatcatcut

SEQ ID NO: 17691 - DNA, 29 bp, Artificial Sequence
  Synthetic
cactattatggtcuaccaggtactcuact

SEQ ID NO: 17692 - DNA, 19 bp, Artificial Sequence
  Synthetic
gucccagcactugcaggat

SEQ ID NO: 17693 - DNA, 26 bp, Artificial Sequence
  Synthetic
gaaaggaaaagaaaagucuccatcuc

SEQ ID NO: 17694 - DNA, 26 bp, Artificial Sequence
  Synthetic
caactcaguggagcattcagatuaca

SEQ ID NO: 17695 - DNA, 22 bp, Artificial Sequence
  Synthetic
tgcttccuccaccctttccuaa

SEQ ID NO: 17696 - DNA, 25 bp, Artificial Sequence
  Synthetic
ctattcccatcucagcaaccctuac

SEQ ID NO: 17697 - DNA, 26 bp, Artificial Sequence
  Synthetic
tgtccaguaaagcaagacctcuaaga

SEQ ID NO: 17698 - DNA, 21 bp, Artificial Sequence
  Synthetic
ctgtgatucaggtgccucact

SEQ ID NO: 17699 - DNA, 22 bp, Artificial Sequence
  Synthetic
gacatattggcugggtcccuac

SEQ ID NO: 17700 - DNA, 25 bp, Artificial Sequence
  Synthetic
gtgttcactcugatacctccaacug

SEQ ID NO: 17701 - DNA, 27 bp, Artificial Sequence
  Synthetic
aaggagactcutattgtgtttgcugat

SEQ ID NO: 17702 - DNA, 29 bp, Artificial Sequence
  Synthetic
ggcttcttttcaucattgtgttctatucc

SEQ ID NO: 17703 - DNA, 22 bp, Artificial Sequence
  Synthetic
gtcttcucgcacaaaagcauca

SEQ ID NO: 17704 - DNA, 21 bp, Artificial Sequence
  Synthetic
ctgacatcugctgaacgcaut

SEQ ID NO: 17705 - DNA, 23 bp, Artificial Sequence
  Synthetic
ctcttcccccuctgacaagtuac

SEQ ID NO: 17706 - DNA, 23 bp, Artificial Sequence
  Synthetic
cagcagagagccacautacttug

SEQ ID NO: 17707 - DNA, 22 bp, Artificial Sequence
  Synthetic
aagagcgacutggccaaauact

SEQ ID NO: 17708 - DNA, 17 bp, Artificial Sequence
  Synthetic
cuccagcacccacgugt

SEQ ID NO: 17709 - DNA, 21 bp, Artificial Sequence
  Synthetic
acacctgtccucttcccctut

SEQ ID NO: 17710 - DNA, 17 bp, Artificial Sequence
  Synthetic
tcugctggcugccaagg

SEQ ID NO: 17711 - DNA, 21 bp, Artificial Sequence
  Synthetic
actcatgaccutcacgctgut

SEQ ID NO: 17712 - DNA, 17 bp, Artificial Sequence
  Synthetic
guggctgcuacgcaggt

SEQ ID NO: 17713 - DNA, 21 bp, Artificial Sequence
  Synthetic
gccaggccuactctgtctaug

SEQ ID NO: 17714 - DNA, 23 bp, Artificial Sequence
  Synthetic
guggcatgtatcuggaacaggaa

SEQ ID NO: 17715 - DNA, 20 bp, Artificial Sequence
  Synthetic
agctcttgcuggtcaaccug

SEQ ID NO: 17716 - DNA, 27 bp, Artificial Sequence
  Synthetic
ggtagatttctuactgttgtcctucct

SEQ ID NO: 17717 - DNA, 29 bp, Artificial Sequence
  Synthetic
ccaaaaatagacuaagaggagtgttccua

SEQ ID NO: 17718 - DNA, 28 bp, Artificial Sequence
  Synthetic
aatcaacaacugatgacgatguacagaa

SEQ ID NO: 17719 - DNA, 30 bp, Artificial Sequence
  Synthetic
ccaaactggcuacaacaaagattttaauca

SEQ ID NO: 17720 - DNA, 23 bp, Artificial Sequence
  Synthetic
ggcaacacgacgaaauagccaua

SEQ ID NO: 17721 - DNA, 23 bp, Artificial Sequence
  Synthetic
ccgtttggcuttaccttcuccat

SEQ ID NO: 17722 - DNA, 31 bp, Artificial Sequence
  Synthetic
gatgcagttgtuagttttgaaatacagauga

SEQ ID NO: 17723 - DNA, 25 bp, Artificial Sequence
  Synthetic
cttccucactaaatctucccaacca

SEQ ID NO: 17724 - DNA, 21 bp, Artificial Sequence
  Synthetic
tctutttcccccuagggagca

SEQ ID NO: 17725 - DNA, 23 bp, Artificial Sequence
  Synthetic
tggataccaugttgctgtuggat

SEQ ID NO: 17726 - DNA, 27 bp, Artificial Sequence
  Synthetic
ggcatgacaaguagtgcctgtaauaat

SEQ ID NO: 17727 - DNA, 23 bp, Artificial Sequence
  Synthetic
gaattctgugagctcatcugcct

SEQ ID NO: 17728 - DNA, 23 bp, Artificial Sequence
  Synthetic
caaagatgucctgtctugcacag

SEQ ID NO: 17729 - DNA, 21 bp, Artificial Sequence
  Synthetic
tcaggcucgacagacaaagug

SEQ ID NO: 17730 - DNA, 25 bp, Artificial Sequence
  Synthetic
tctacgttgttucaggtgaaagugt

SEQ ID NO: 17731 - DNA, 22 bp, Artificial Sequence
  Synthetic
caccatccaucctgtctgtcuc

SEQ ID NO: 17732 - DNA, 27 bp, Artificial Sequence
  Synthetic
tgctatgtcaguctgaaactttctugt

SEQ ID NO: 17733 - DNA, 25 bp, Artificial Sequence
  Synthetic
gctcagtttcauctttgccacuaag

SEQ ID NO: 17734 - DNA, 26 bp, Artificial Sequence
  Synthetic
gccttactcttcuccttctcctacug

SEQ ID NO: 17735 - DNA, 23 bp, Artificial Sequence
  Synthetic
ggaggtcugtttagagttugcct

SEQ ID NO: 17736 - DNA, 24 bp, Artificial Sequence
  Synthetic
actttatugccccaagcaaguagg

SEQ ID NO: 17737 - DNA, 20 bp, Artificial Sequence
  Synthetic
gtacagtucccgctgacgut

SEQ ID NO: 17738 - DNA, 23 bp, Artificial Sequence
  Synthetic
agatgcagcagaaugtctuccag

SEQ ID NO: 17739 - DNA, 27 bp, Artificial Sequence
  Synthetic
tccacacacuattttaatguccaagca

SEQ ID NO: 17740 - DNA, 23 bp, Artificial Sequence
  Synthetic
tggcagguggaaatacgaatgut

SEQ ID NO: 17741 - DNA, 30 bp, Artificial Sequence
  Synthetic
acctgattttccucagaattaactgtgaug

SEQ ID NO: 17742 - DNA, 26 bp, Artificial Sequence
  Synthetic
tgagtttccacutcaagtaguaccca

SEQ ID NO: 17743 - DNA, 21 bp, Artificial Sequence
  Synthetic
gaccaggcuggttcagguaag

SEQ ID NO: 17744 - DNA, 17 bp, Artificial Sequence
  Synthetic
gggagtgugccgcaaug

SEQ ID NO: 17745 - DNA, 17 bp, Artificial Sequence
  Synthetic
acugccacggccttuga

SEQ ID NO: 17746 - DNA, 20 bp, Artificial Sequence
  Synthetic
ctctttgcagugctccccut

SEQ ID NO: 17747 - DNA, 26 bp, Artificial Sequence
  Synthetic
gacgactctutgctgtattttuccag

SEQ ID NO: 17748 - DNA, 21 bp, Artificial Sequence
  Synthetic
gtctggtgagucgagaggtug

SEQ ID NO: 17749 - DNA, 19 bp, Artificial Sequence
  Synthetic
ggtcggcutgttggaucgt

SEQ ID NO: 17750 - DNA, 21 bp, Artificial Sequence
  Synthetic
gtttctguccccaucaaagcc

SEQ ID NO: 17751 - DNA, 20 bp, Artificial Sequence
  Synthetic
gagtcaccccagucggatuc

SEQ ID NO: 17752 - DNA, 22 bp, Artificial Sequence
  Synthetic
gtagggttcuggcgtttguagt

SEQ ID NO: 17753 - DNA, 21 bp, Artificial Sequence
  Synthetic
cctgtcuaaagaccccaccug

SEQ ID NO: 17754 - DNA, 27 bp, Artificial Sequence
  Synthetic
agtatgagcatutcacatcacaguagg

SEQ ID NO: 17755 - DNA, 25 bp, Artificial Sequence
  Synthetic
agcaaacaagagauggcaatgttut

SEQ ID NO: 17756 - DNA, 25 bp, Artificial Sequence
  Synthetic
agccactttatucttacccctccua

SEQ ID NO: 17757 - DNA, 27 bp, Artificial Sequence
  Synthetic
tctccataucccattccctguagaaaa

SEQ ID NO: 17758 - DNA, 25 bp, Artificial Sequence
  Synthetic
gtgtgtctccauagctggaagatuc

SEQ ID NO: 17759 - DNA, 28 bp, Artificial Sequence
  Synthetic
gcccattgatgtutctgatctatcacut

SEQ ID NO: 17760 - DNA, 21 bp, Artificial Sequence
  Synthetic
ggcutctggactuggaaccat

SEQ ID NO: 17761 - DNA, 26 bp, Artificial Sequence
  Synthetic
ataagcctgaagauaatgtggguagg

SEQ ID NO: 17762 - DNA, 30 bp, Artificial Sequence
  Synthetic
ttttaaatggagatucattgacgggactua

SEQ ID NO: 17763 - DNA, 23 bp, Artificial Sequence
  Synthetic
cgcagacautcccgtttguagat

SEQ ID NO: 17764 - DNA, 22 bp, Artificial Sequence
  Synthetic
ctcatactctutccgtcgcuga

SEQ ID NO: 17765 - DNA, 26 bp, Artificial Sequence
  Synthetic
aaaaacatgagcuctctccttcctut

SEQ ID NO: 17766 - DNA, 32 bp, Artificial Sequence
  Synthetic
ataggagaactauggatttgataaaatugagg

SEQ ID NO: 17767 - DNA, 26 bp, Artificial Sequence
  Synthetic
ccacgaaaaccguaagttgtcaaaut

SEQ ID NO: 17768 - DNA, 25 bp, Artificial Sequence
  Synthetic
gatctgtgacgutccttccaaauct

SEQ ID NO: 17769 - DNA, 26 bp, Artificial Sequence
  Synthetic
gctcatgaggagaucttggatcttut

SEQ ID NO: 17770 - DNA, 21 bp, Artificial Sequence
  Synthetic
ccagacccguggaactacaut

SEQ ID NO: 17771 - DNA, 32 bp, Artificial Sequence
  Synthetic
gtttatgaagatgaaacutctttctggtgtug

SEQ ID NO: 17772 - DNA, 30 bp, Artificial Sequence
  Synthetic
aggaatctgtttuaattgctcttgaaaauc

SEQ ID NO: 17773 - DNA, 30 bp, Artificial Sequence
  Synthetic
tccactttatuaaaaagcacatctgttuct

SEQ ID NO: 17774 - DNA, 31 bp, Artificial Sequence
  Synthetic
gaatgcattucaggacatttcaatgaguaat

SEQ ID NO: 17775 - DNA, 32 bp, Artificial Sequence
  Synthetic
actctcatctatauggtctttattgccattut

SEQ ID NO: 17776 - DNA, 31 bp, Artificial Sequence
  Synthetic
ccaatcccugaacaaatgaatcttaaugaag

SEQ ID NO: 17777 - DNA, 26 bp, Artificial Sequence
  Synthetic
gaaacugaggacgatgatctugaaca

SEQ ID NO: 17778 - DNA, 32 bp, Artificial Sequence
  Synthetic
gcacaagtuaaaaacctcattatctaaucaac

SEQ ID NO: 17779 - DNA, 32 bp, Artificial Sequence
  Synthetic
cttctcttctaagucaactttgttttgttuct

SEQ ID NO: 17780 - DNA, 24 bp, Artificial Sequence
  Synthetic
cttgtcaaagggcccuaggatuaa

SEQ ID NO: 17781 - DNA, 27 bp, Artificial Sequence
  Synthetic
ggtaagttgauccactgtatcttuggt

SEQ ID NO: 17782 - DNA, 30 bp, Artificial Sequence
  Synthetic
tcccattctauggagtagcagattuaaaag

SEQ ID NO: 17783 - DNA, 32 bp, Artificial Sequence
  Synthetic
tgggacccctguatacaataacatatatauaa

SEQ ID NO: 17784 - DNA, 27 bp, Artificial Sequence
  Synthetic
ccttctaagagaucctgaaacctcugt

SEQ ID NO: 17785 - DNA, 25 bp, Artificial Sequence
  Synthetic
ccaaaaggtauccctctttgugcaa

SEQ ID NO: 17786 - DNA, 21 bp, Artificial Sequence
  Synthetic
gtcagccagcugctgtttcua

SEQ ID NO: 17787 - DNA, 24 bp, Artificial Sequence
  Synthetic
ggcttcatatcucggtgtaggaug

SEQ ID NO: 17788 - DNA, 21 bp, Artificial Sequence
  Synthetic
gcaccccucccttctatgcua

SEQ ID NO: 17789 - DNA, 25 bp, Artificial Sequence
  Synthetic
cagagauagagggagacagattuct

SEQ ID NO: 17790 - DNA, 21 bp, Artificial Sequence
  Synthetic
ctgattcagugttgcccccua

SEQ ID NO: 17791 - DNA, 19 bp, Artificial Sequence
  Synthetic
cggccaggaggcutgatuc

SEQ ID NO: 17792 - DNA, 25 bp, Artificial Sequence
  Synthetic
ctattcaacugaaggctcctcucac

SEQ ID NO: 17793 - DNA, 23 bp, Artificial Sequence
  Synthetic
tcaatgcuccatctgugaaaaca

SEQ ID NO: 17794 - DNA, 22 bp, Artificial Sequence
  Synthetic
tcaccacauccaggctttuagt

SEQ ID NO: 17795 - DNA, 21 bp, Artificial Sequence
  Synthetic
gctcagagucatctggtuggg

SEQ ID NO: 17796 - DNA, 20 bp, Artificial Sequence
  Synthetic
gcctcaggccuttggagtua

SEQ ID NO: 17797 - DNA, 20 bp, Artificial Sequence
  Synthetic
caggagcagugcatauggct

SEQ ID NO: 17798 - DNA, 21 bp, Artificial Sequence
  Synthetic
ctgtcucagccagaggttgut

SEQ ID NO: 17799 - DNA, 27 bp, Artificial Sequence
  Synthetic
gtggagacacccuactttatgactuac

SEQ ID NO: 17800 - DNA, 22 bp, Artificial Sequence
  Synthetic
tggttuaacggacaccccatuc

SEQ ID NO: 17801 - DNA, 23 bp, Artificial Sequence
  Synthetic
catccaucccaagatccatcugt

SEQ ID NO: 17802 - DNA, 23 bp, Artificial Sequence
  Synthetic
tcccagcauggaagtatccucat

SEQ ID NO: 17803 - DNA, 21 bp, Artificial Sequence
  Synthetic
cttctttcuccctccccgtug

SEQ ID NO: 17804 - DNA, 23 bp, Artificial Sequence
  Synthetic
accagtttgugaacacagtguct

SEQ ID NO: 17805 - DNA, 25 bp, Artificial Sequence
  Synthetic
aagctcttggauaaaggacaagugg

SEQ ID NO: 17806 - DNA, 21 bp, Artificial Sequence
  Synthetic
cagctgctuggagatccucag

SEQ ID NO: 17807 - DNA, 20 bp, Artificial Sequence
  Synthetic
gcagccuccttcacattugg

SEQ ID NO: 17808 - DNA, 18 bp, Artificial Sequence
  Synthetic
gccagcccauagcatgug

SEQ ID NO: 17809 - DNA, 22 bp, Artificial Sequence
  Synthetic
ttctcagttgagutggcagcut

SEQ ID NO: 17810 - DNA, 31 bp, Artificial Sequence
  Synthetic
tttttgtttucagaguagattcttcatauct

SEQ ID NO: 17811 - DNA, 23 bp, Artificial Sequence
  Synthetic
gtgaattgucccagcatgaccua

SEQ ID NO: 17812 - DNA, 20 bp, Artificial Sequence
  Synthetic
gtgguggtaggtuccagacc

SEQ ID NO: 17813 - DNA, 22 bp, Artificial Sequence
  Synthetic
ttctttcagcugtaggcugcaa

SEQ ID NO: 17814 - DNA, 28 bp, Artificial Sequence
  Synthetic
aatcgcctggaagutactttctaatcuc

SEQ ID NO: 17815 - DNA, 21 bp, Artificial Sequence
  Synthetic
gggccaaucaactgatggcut

SEQ ID NO: 17816 - DNA, 21 bp, Artificial Sequence
  Synthetic
tgttctgctgugaaggtggut

SEQ ID NO: 17817 - DNA, 30 bp, Artificial Sequence
  Synthetic
acattttatgatgutttgttcttctgugct

SEQ ID NO: 17818 - DNA, 18 bp, Artificial Sequence
  Synthetic
ctagccgaugcccuccaa

SEQ ID NO: 17819 - DNA, 24 bp, Artificial Sequence
  Synthetic
aaatucgggaaaggugaagaggag

SEQ ID NO: 17820 - DNA, 20 bp, Artificial Sequence
  Synthetic
atuggagagucccagatguc

SEQ ID NO: 17821 - DNA, 21 bp, Artificial Sequence
  Synthetic
caagatccugtgcagguacca

SEQ ID NO: 17822 - DNA, 18 bp, Artificial Sequence
  Synthetic
caucatccugggcacagc

SEQ ID NO: 17823 - DNA, 19 bp, Artificial Sequence
  Synthetic
tctccacgcuccggauagt

SEQ ID NO: 17824 - DNA, 17 bp, Artificial Sequence
  Synthetic
ccucccagacggaccuc

SEQ ID NO: 17825 - DNA, 18 bp, Artificial Sequence
  Synthetic
acaagucgggcaccaugt

SEQ ID NO: 17826 - DNA, 20 bp, Artificial Sequence
  Synthetic
gcggaugacgatggtgugaa

SEQ ID NO: 17827 - DNA, 22 bp, Artificial Sequence
  Synthetic
acaucgagaagaccaugagcac

SEQ ID NO: 17828 - DNA, 20 bp, Artificial Sequence
  Synthetic
ttctcagggcuctcgaucct

SEQ ID NO: 17829 - DNA, 21 bp, Artificial Sequence
  Synthetic
cggtuacgatctgauggagca

SEQ ID NO: 17830 - DNA, 18 bp, Artificial Sequence
  Synthetic
cgaggcccccutctugaa

SEQ ID NO: 17831 - DNA, 19 bp, Artificial Sequence
  Synthetic
ctgagcugccactttgcug

SEQ ID NO: 17832 - DNA, 21 bp, Artificial Sequence
  Synthetic
cccatcagggaugtgcaugag

SEQ ID NO: 17833 - DNA, 23 bp, Artificial Sequence
  Synthetic
acttgccttucccagatgactug

SEQ ID NO: 17834 - DNA, 21 bp, Artificial Sequence
  Synthetic
cctggccacaagccuaagaug

SEQ ID NO: 17835 - DNA, 28 bp, Artificial Sequence
  Synthetic
ctcaaggtctcguggatttactattuct

SEQ ID NO: 17836 - DNA, 28 bp, Artificial Sequence
  Synthetic
agagtttauggctatacacugagagagg

SEQ ID NO: 17837 - DNA, 25 bp, Artificial Sequence
  Synthetic
ttcccagtugtatgtttatgtuggt

SEQ ID NO: 17838 - DNA, 22 bp, Artificial Sequence
  Synthetic
gccaggccutccaaagaaaauc

SEQ ID NO: 17839 - DNA, 21 bp, Artificial Sequence
  Synthetic
gttattccugcaggtcugcca

SEQ ID NO: 17840 - DNA, 19 bp, Artificial Sequence
  Synthetic
cccugctcagucccagact

SEQ ID NO: 17841 - DNA, 24 bp, Artificial Sequence
  Synthetic
agaacaagcugaaaugcacaaagg

SEQ ID NO: 17842 - DNA, 24 bp, Artificial Sequence
  Synthetic
ggtgaugaagacagagacccaauc

SEQ ID NO: 17843 - DNA, 25 bp, Artificial Sequence
  Synthetic
gctgacatttgutcttccacatucc

SEQ ID NO: 17844 - DNA, 22 bp, Artificial Sequence
  Synthetic
tcgagctcaauctcagcttucc

SEQ ID NO: 17845 - DNA, 21 bp, Artificial Sequence
  Synthetic
accaccaguctcatgctccua

SEQ ID NO: 17846 - DNA, 19 bp, Artificial Sequence
  Synthetic
ggtgccugctgtggaaaug

SEQ ID NO: 17847 - DNA, 23 bp, Artificial Sequence
  Synthetic
ctcaccggaaagautguccagaa

SEQ ID NO: 17848 - DNA, 19 bp, Artificial Sequence
  Synthetic
ccgugcgcaagtactucca

SEQ ID NO: 17849 - DNA, 18 bp, Artificial Sequence
  Synthetic
cuaaccccagcccagguc

SEQ ID NO: 17850 - DNA, 24 bp, Artificial Sequence
  Synthetic
agctcacutactagccuaaggaca

SEQ ID NO: 17851 - DNA, 20 bp, Artificial Sequence
  Synthetic
cctgttcutccaggauggct

SEQ ID NO: 17852 - DNA, 23 bp, Artificial Sequence
  Synthetic
ctcttagucacctctcccucaga

SEQ ID NO: 17853 - DNA, 22 bp, Artificial Sequence
  Synthetic
ggaaaccuagggaggacaccua

SEQ ID NO: 17854 - DNA, 18 bp, Artificial Sequence
  Synthetic
ccaaucccgccatgcuca

SEQ ID NO: 17855 - DNA, 20 bp, Artificial Sequence
  Synthetic
tccccaacaugagacugggt

SEQ ID NO: 17856 - DNA, 20 bp, Artificial Sequence
  Synthetic
ccaggaucaccuccgagaag

SEQ ID NO: 17857 - DNA, 19 bp, Artificial Sequence
  Synthetic
ggtcauccacgtcctuggt

SEQ ID NO: 17858 - DNA, 21 bp, Artificial Sequence
  Synthetic
caacttugggatcagcuccgt

SEQ ID NO: 17859 - DNA, 26 bp, Artificial Sequence
  Synthetic
caggtcauacttgtaatcugcaacca

SEQ ID NO: 17860 - DNA, 25 bp, Artificial Sequence
  Synthetic
gctgctuccatgtgtcauaaagact

SEQ ID NO: 17861 - DNA, 31 bp, Artificial Sequence
  Synthetic
gaaaccgacaguactgacatttatttcuact

SEQ ID NO: 17862 - DNA, 24 bp, Artificial Sequence
  Synthetic
atacataaaguccttcccgcugac

SEQ ID NO: 17863 - DNA, 21 bp, Artificial Sequence
  Synthetic
gtgtgcattugtagcgcagua

SEQ ID NO: 17864 - DNA, 29 bp, Artificial Sequence
  Synthetic
tcaaatatggaguccacgagatcattuac

SEQ ID NO: 17865 - DNA, 24 bp, Artificial Sequence
  Synthetic
caaactcaaacutgggctccauaa

SEQ ID NO: 17866 - DNA, 23 bp, Artificial Sequence
  Synthetic
ggagacagacaugagtctucacc

SEQ ID NO: 17867 - DNA, 26 bp, Artificial Sequence
  Synthetic
tcttaggtgucagattttcccucaga

SEQ ID NO: 17868 - DNA, 20 bp, Artificial Sequence
  Synthetic
tggugggcuaccaaaagcaa

SEQ ID NO: 17869 - DNA, 24 bp, Artificial Sequence
  Synthetic
tgagcaacgugttctcttttcuct

SEQ ID NO: 17870 - DNA, 26 bp, Artificial Sequence
  Synthetic
gtaagacaauggtttttggttuggga

SEQ ID NO: 17871 - DNA, 27 bp, Artificial Sequence
  Synthetic
ttcagccagautaagagagagaucact

SEQ ID NO: 17872 - DNA, 24 bp, Artificial Sequence
  Synthetic
accatagactgutggacatgtcug

SEQ ID NO: 17873 - DNA, 27 bp, Artificial Sequence
  Synthetic
ccagttuagggacagaautatagtgut

SEQ ID NO: 17874 - DNA, 22 bp, Artificial Sequence
  Synthetic
cacataggccugcatgggauaa

SEQ ID NO: 17875 - DNA, 23 bp, Artificial Sequence
  Synthetic
ggaagttgttugagcaagaggug

SEQ ID NO: 17876 - DNA, 27 bp, Artificial Sequence
  Synthetic
tgtaaagccaucaacacagagtatcuc

SEQ ID NO: 17877 - DNA, 25 bp, Artificial Sequence
  Synthetic
accattuccaccctcactaauaacc

SEQ ID NO: 17878 - DNA, 22 bp, Artificial Sequence
  Synthetic
ctgttgugggagtagctgtugt

SEQ ID NO: 17879 - DNA, 25 bp, Artificial Sequence
  Synthetic
aaatagcauggacagtgcaatcuct

SEQ ID NO: 17880 - DNA, 27 bp, Artificial Sequence
  Synthetic
gaaacaagcaagcuaaatgtgaacuga

SEQ ID NO: 17881 - DNA, 21 bp, Artificial Sequence
  Synthetic
gtctcccutcccccaugaaag

SEQ ID NO: 17882 - DNA, 29 bp, Artificial Sequence
  Synthetic
catcagaagcagcaaaautaguagaaaca

SEQ ID NO: 17883 - DNA, 21 bp, Artificial Sequence
  Synthetic
aguggactgugaacggacaac

SEQ ID NO: 17884 - DNA, 23 bp, Artificial Sequence
  Synthetic
cttacgaaggaaggucttuggca

SEQ ID NO: 17885 - DNA, 25 bp, Artificial Sequence
  Synthetic
tttcagttcutctcggtguccaaat

SEQ ID NO: 17886 - DNA, 22 bp, Artificial Sequence
  Synthetic
ccctgctcuacctccactcuaa

SEQ ID NO: 17887 - DNA, 28 bp, Artificial Sequence
  Synthetic
ggacacttuagctgtgaaugaaaagaaa

SEQ ID NO: 17888 - DNA, 22 bp, Artificial Sequence
  Synthetic
ccattgccutgccagtaaucac

SEQ ID NO: 17889 - DNA, 24 bp, Artificial Sequence
  Synthetic
agagcucagaaacttaggtuggga

SEQ ID NO: 17890 - DNA, 28 bp, Artificial Sequence
  Synthetic
aggcaggcgautatctatttgttttcua

SEQ ID NO: 17891 - DNA, 28 bp, Artificial Sequence
  Synthetic
gagtcaaggagacauttgtaugaggaaa

SEQ ID NO: 17892 - DNA, 23 bp, Artificial Sequence
  Synthetic
gcatgaccacuactgtcacacut

SEQ ID NO: 17893 - DNA, 28 bp, Artificial Sequence
  Synthetic
cugaaagaagaggaagaucagaaatcuc

SEQ ID NO: 17894 - DNA, 24 bp, Artificial Sequence
  Synthetic
caccttuattcctgguggaagact

SEQ ID NO: 17895 - DNA, 28 bp, Artificial Sequence
  Synthetic
cagatcacucaaaatttgcatgugaaga

SEQ ID NO: 17896 - DNA, 27 bp, Artificial Sequence
  Synthetic
ggcatagacaugagtttatcttggugt

SEQ ID NO: 17897 - DNA, 28 bp, Artificial Sequence
  Synthetic
gcatgctttcaucaaatggattucagaa

SEQ ID NO: 17898 - DNA, 25 bp, Artificial Sequence
  Synthetic
ggguagatttauaacgggaagcact

SEQ ID NO: 17899 - DNA, 27 bp, Artificial Sequence
  Synthetic
gagauggaaagaagagguaagtatuct

SEQ ID NO: 17900 - DNA, 24 bp, Artificial Sequence
  Synthetic
tggtagcgacgaucagagtcauaa

SEQ ID NO: 17901 - DNA, 24 bp, Artificial Sequence
  Synthetic
actcggtatguatcttcccgaugt

SEQ ID NO: 17902 - DNA, 28 bp, Artificial Sequence
  Synthetic
gccttcagattgugaggatttcttctua

SEQ ID NO: 17903 - DNA, 28 bp, Artificial Sequence
  Synthetic
gaatgagcaagcagauatttccucaaaa

SEQ ID NO: 17904 - DNA, 20 bp, Artificial Sequence
  Synthetic
caaggccacuggctctgtua

SEQ ID NO: 17905 - DNA, 21 bp, Artificial Sequence
  Synthetic
ccacagcaguagcatcuccac

SEQ ID NO: 17906 - DNA, 25 bp, Artificial Sequence
  Synthetic
tgtcgtcccugttcttccaaatuaa

SEQ ID NO: 17907 - DNA, 26 bp, Artificial Sequence
  Synthetic
tgtaggcaaagautgaaaatgugcag

SEQ ID NO: 17908 - DNA, 27 bp, Artificial Sequence
  Synthetic
cattttgtttcaguttccacacaguga

SEQ ID NO: 17909 - DNA, 21 bp, Artificial Sequence
  Synthetic
cagcugccatcttcuaccaca

SEQ ID NO: 17910 - DNA, 19 bp, Artificial Sequence
  Synthetic
gcccatccucgacgatgut

SEQ ID NO: 17911 - DNA, 22 bp, Artificial Sequence
  Synthetic
ctauccccaaggcucacagaaa

SEQ ID NO: 17912 - DNA, 23 bp, Artificial Sequence
  Synthetic
gaactcccccacuatctagguct

SEQ ID NO: 17913 - DNA, 26 bp, Artificial Sequence
  Synthetic
gatgctctcacutcctcatttctgua

SEQ ID NO: 17914 - DNA, 20 bp, Artificial Sequence
  Synthetic
cctgctccaugactggugag

SEQ ID NO: 17915 - DNA, 18 bp, Artificial Sequence
  Synthetic
ctgugcccaggaccatug

SEQ ID NO: 17916 - DNA, 22 bp, Artificial Sequence
  Synthetic
ttcccctaacccugccttctua

SEQ ID NO: 17917 - DNA, 25 bp, Artificial Sequence
  Synthetic
tccaagatccuacttccatctucca

SEQ ID NO: 17918 - DNA, 17 bp, Artificial Sequence
  Synthetic
gcacguagcccgtcuca

SEQ ID NO: 17919 - DNA, 17 bp, Artificial Sequence
  Synthetic
ctgcccggccucatgua

SEQ ID NO: 17920 - DNA, 22 bp, Artificial Sequence
  Synthetic
gtatgctuggcgaatgtugagg

SEQ ID NO: 17921 - DNA, 25 bp, Artificial Sequence
  Synthetic
guccatttgucgaaagaacaggaga

SEQ ID NO: 17922 - DNA, 26 bp, Artificial Sequence
  Synthetic
tctgcacatgutctgagaaggauaac

SEQ ID NO: 17923 - DNA, 28 bp, Artificial Sequence
  Synthetic
ctaactgtgccautgcattctgaatuat

SEQ ID NO: 17924 - DNA, 23 bp, Artificial Sequence
  Synthetic
cgaaagagtaguctgggtgtugg

SEQ ID NO: 17925 - DNA, 27 bp, Artificial Sequence
  Synthetic
tgttttgatgcaccauaagaccttuct

SEQ ID NO: 17926 - DNA, 27 bp, Artificial Sequence
  Synthetic
acactggacuacactatgttgctauca

SEQ ID NO: 17927 - DNA, 30 bp, Artificial Sequence
  Synthetic
gcagatgaagaaautcaaaggatugaagag

SEQ ID NO: 17928 - DNA, 28 bp, Artificial Sequence
  Synthetic
gcaggtttcutccagattacucagaaat

SEQ ID NO: 17929 - DNA, 27 bp, Artificial Sequence
  Synthetic
tcctccccaagaautgaaaaagtaugg

SEQ ID NO: 17930 - DNA, 26 bp, Artificial Sequence
  Synthetic
ttctgtgtggcuattatctgcauacc

SEQ ID NO: 17931 - DNA, 19 bp, Artificial Sequence
  Synthetic
gttcgcguggcctctguat

SEQ ID NO: 17932 - DNA, 31 bp, Artificial Sequence
  Synthetic
tgcctagaattttacuaactggaactttgut

SEQ ID NO: 17933 - DNA, 27 bp, Artificial Sequence
  Synthetic
aaatggttgtauggctgttggtttuac

SEQ ID NO: 17934 - DNA, 27 bp, Artificial Sequence
  Synthetic
gcaatttttccuttctctctttcucca

SEQ ID NO: 17935 - DNA, 27 bp, Artificial Sequence
  Synthetic
agatgcagtagaacutcagcagtttut

SEQ ID NO: 17936 - DNA, 24 bp, Artificial Sequence
  Synthetic
ctgtagcatcutccctcatcaucc

SEQ ID NO: 17937 - DNA, 26 bp, Artificial Sequence
  Synthetic
gatgctcttgutctacacaaagucct

SEQ ID NO: 17938 - DNA, 29 bp, Artificial Sequence
  Synthetic
gctgcattggagucatgtattttgattut

SEQ ID NO: 17939 - DNA, 26 bp, Artificial Sequence
  Synthetic
ttacaaattactuggaatcgtcccut

SEQ ID NO: 17940 - DNA, 25 bp, Artificial Sequence
  Synthetic
attccctctucaccagcatattugt

SEQ ID NO: 17941 - DNA, 21 bp, Artificial Sequence
  Synthetic
gutcttgaagcucgagagcca

SEQ ID NO: 17942 - DNA, 27 bp, Artificial Sequence
  Synthetic
caataaatcacaccugcataactugct

SEQ ID NO: 17943 - DNA, 30 bp, Artificial Sequence
  Synthetic
ctttcacagaacaaaacugaagaaucaaga

SEQ ID NO: 17944 - DNA, 29 bp, Artificial Sequence
  Synthetic
caactcctaactgugtcataaagctgaua

SEQ ID NO: 17945 - DNA, 26 bp, Artificial Sequence
  Synthetic
gttctttctucatctcattcguccct

SEQ ID NO: 17946 - DNA, 23 bp, Artificial Sequence
  Synthetic
cgcccagccuagacattttctua

SEQ ID NO: 17947 - DNA, 30 bp, Artificial Sequence
  Synthetic
ccaagtaattttaucttgacaggaugcaaa

SEQ ID NO: 17948 - DNA, 24 bp, Artificial Sequence
  Synthetic
ggaaagatcauaggccaatcugct

SEQ ID NO: 17949 - DNA, 26 bp, Artificial Sequence
  Synthetic
gtttaacttatugagcatgcctggut

SEQ ID NO: 17950 - DNA, 28 bp, Artificial Sequence
  Synthetic
ctcatttcttgtucgaaggtacaaaucc

SEQ ID NO: 17951 - DNA, 27 bp, Artificial Sequence
  Synthetic
taacaattttuggtctttgcugaaaca

SEQ ID NO: 17952 - DNA, 22 bp, Artificial Sequence
  Synthetic
ggtgcccuaatgaagagcucac

SEQ ID NO: 17953 - DNA, 28 bp, Artificial Sequence
  Synthetic
ttcttatgtctacacuggctttctgtuc

SEQ ID NO: 17954 - DNA, 25 bp, Artificial Sequence
  Synthetic
acagttggatcuaagtgggaagcua

SEQ ID NO: 17955 - DNA, 23 bp, Artificial Sequence
  Synthetic
tcctctgaaaacucgttgcauca

SEQ ID NO: 17956 - DNA, 26 bp, Artificial Sequence
  Synthetic
gcaagtatgtcugcttttgatcctut

SEQ ID NO: 17957 - DNA, 26 bp, Artificial Sequence
  Synthetic
gaaagaugaaggaaaugaagggtgua

SEQ ID NO: 17958 - DNA, 23 bp, Artificial Sequence
  Synthetic
tguaccaacaguaccagcaacag

SEQ ID NO: 17959 - DNA, 22 bp, Artificial Sequence
  Synthetic
aaaaccaugagccaactcccut

SEQ ID NO: 17960 - DNA, 24 bp, Artificial Sequence
  Synthetic
gcctaucaaccaagaccaggttut

SEQ ID NO: 17961 - DNA, 22 bp, Artificial Sequence
  Synthetic
aaccagguccaggttgggtaua

SEQ ID NO: 17962 - DNA, 26 bp, Artificial Sequence
  Synthetic
gagcttctcatuctcaatgtacgugt

SEQ ID NO: 17963 - DNA, 20 bp, Artificial Sequence
  Synthetic
gggaggacagcucacaaguc

SEQ ID NO: 17964 - DNA, 22 bp, Artificial Sequence
  Synthetic
tcagtgcucaagctggugaaat

SEQ ID NO: 17965 - DNA, 24 bp, Artificial Sequence
  Synthetic
cttctacaucctgttctucaccgt

SEQ ID NO: 17966 - DNA, 21 bp, Artificial Sequence
  Synthetic
aaccagagaaaucgggugcaa

SEQ ID NO: 17967 - DNA, 24 bp, Artificial Sequence
  Synthetic
gcttatgctugcttgatcctucag

SEQ ID NO: 17968 - DNA, 28 bp, Artificial Sequence
  Synthetic
agctagttucgaaaagcaaagaauaggt

SEQ ID NO: 17969 - DNA, 23 bp, Artificial Sequence
  Synthetic
gcuatgatuaccagagacagcca

SEQ ID NO: 17970 - DNA, 20 bp, Artificial Sequence
  Synthetic
caagctucacacgcatggut

SEQ ID NO: 17971 - DNA, 22 bp, Artificial Sequence
  Synthetic
gggccaagauttcagtcatugt

SEQ ID NO: 17972 - DNA, 17 bp, Artificial Sequence
  Synthetic
gucgcccacacucacct

SEQ ID NO: 17973 - DNA, 20 bp, Artificial Sequence
  Synthetic
gaagcgcacaguggaccuaa

SEQ ID NO: 17974 - DNA, 32 bp, Artificial Sequence
  Synthetic
agtagaatgtttacuaccaaatggaatgauag

SEQ ID NO: 17975 - DNA, 32 bp, Artificial Sequence
  Synthetic
acgaaaatguaagaagattcatctugaagaag

SEQ ID NO: 17976 - DNA, 32 bp, Artificial Sequence
  Synthetic
tgtgaatttgauatggttaaagauccagaagt

SEQ ID NO: 17977 - DNA, 22 bp, Artificial Sequence
  Synthetic
tgctttggcaautctggugaag

SEQ ID NO: 17978 - DNA, 29 bp, Artificial Sequence
  Synthetic
atcctctgaacaacuaaaactctgtgtut

SEQ ID NO: 17979 - DNA, 32 bp, Artificial Sequence
  Synthetic
attttgaaacttgtuactcaccttatacugac

SEQ ID NO: 17980 - DNA, 25 bp, Artificial Sequence
  Synthetic
agtgtgtgcauatgtgtatgtugag

SEQ ID NO: 17981 - DNA, 27 bp, Artificial Sequence
  Synthetic
ggtactctttgagugttcacattguca

SEQ ID NO: 17982 - DNA, 23 bp, Artificial Sequence
  Synthetic
ttaaggaacacugtccatuggca

SEQ ID NO: 17983 - DNA, 26 bp, Artificial Sequence
  Synthetic
gtaacaccaauagggttcagcaaauc

SEQ ID NO: 17984 - DNA, 33 bp, Artificial Sequence
  Synthetic
atgtatttgcttttuctgtaaatcatctgugaa

SEQ ID NO: 17985 - DNA, 27 bp, Artificial Sequence
  Synthetic
agaggatctcgugtagaaattgcttug

SEQ ID NO: 17986 - DNA, 27 bp, Artificial Sequence
  Synthetic
tgtaactauccccgaaattcuacccaa

SEQ ID NO: 17987 - DNA, 30 bp, Artificial Sequence
  Synthetic
tttaagtgacauaccaatttguacaacagt

SEQ ID NO: 17988 - DNA, 30 bp, Artificial Sequence
  Synthetic
tggaatcaccuaggtcctaaaataugaaca

SEQ ID NO: 17989 - DNA, 33 bp, Artificial Sequence
  Synthetic
gcaagtaatatguaccttaagaatttaauggga

SEQ ID NO: 17990 - DNA, 31 bp, Artificial Sequence
  Synthetic
gtacagatgaagtutttagttgagcaaauga

SEQ ID NO: 17991 - DNA, 25 bp, Artificial Sequence
  Synthetic
caaugaaacccccaagaaaguacct

SEQ ID NO: 17992 - DNA, 30 bp, Artificial Sequence
  Synthetic
ttccatcatttaatugtaaacgtgttacuc

SEQ ID NO: 17993 - DNA, 22 bp, Artificial Sequence
  Synthetic
gttgaactgcagugcaccttuc

SEQ ID NO: 17994 - DNA, 33 bp, Artificial Sequence
  Synthetic
tcaagacattttgtauctgcatatatcaaacua

SEQ ID NO: 17995 - DNA, 27 bp, Artificial Sequence
  Synthetic
gcacacgttcucgtttataaccaaaut

SEQ ID NO: 17996 - DNA, 29 bp, Artificial Sequence
  Synthetic
gcatgccaatcucttcataaatctttuct

SEQ ID NO: 17997 - DNA, 28 bp, Artificial Sequence
  Synthetic
ccatgatgtgcaucattcatttgttuca

SEQ ID NO: 17998 - DNA, 21 bp, Artificial Sequence
  Synthetic
catgauggagacggagcugaa

SEQ ID NO: 17999 - DNA, 18 bp, Artificial Sequence
  Synthetic
gcattcaugggccgctug

SEQ ID NO: 18000 - DNA, 17 bp, Artificial Sequence
  Synthetic
cggcggcaauagcaugg

SEQ ID NO: 18001 - DNA, 19 bp, Artificial Sequence
  Synthetic
ccagctggucctgcaucat

SEQ ID NO: 18002 - DNA, 22 bp, Artificial Sequence
  Synthetic
ccgggacaugatcagcatguat

SEQ ID NO: 18003 - DNA, 17 bp, Artificial Sequence
  Synthetic
ccggcccucacatgugt

SEQ ID NO: 18004 - DNA, 29 bp, Artificial Sequence
  Synthetic
acttttatgagagagaucctggacttcut

SEQ ID NO: 18005 - DNA, 25 bp, Artificial Sequence
  Synthetic
gctcctaccguaccactagaactut

SEQ ID NO: 18006 - DNA, 28 bp, Artificial Sequence
  Synthetic
acatggcaatcaaaaugtccattgttua

SEQ ID NO: 18007 - DNA, 26 bp, Artificial Sequence
  Synthetic
attttcttcutttcacgttugcaact

SEQ ID NO: 18008 - DNA, 27 bp, Artificial Sequence
  Synthetic
catctctguggtcttgttuaaaaaggg

SEQ ID NO: 18009 - DNA, 25 bp, Artificial Sequence
  Synthetic
caaaatggaaagutgggaucgaaca

SEQ ID NO: 18010 - DNA, 25 bp, Artificial Sequence
  Synthetic
tctcatggaagcuatgggtaucaca

SEQ ID NO: 18011 - DNA, 28 bp, Artificial Sequence
  Synthetic
cttttaaugaaacgctgtucagaaacca

SEQ ID NO: 18012 - DNA, 25 bp, Artificial Sequence
  Synthetic
agcattcccgaaauctgttgtuagt

SEQ ID NO: 18013 - DNA, 27 bp, Artificial Sequence
  Synthetic
aggcauacaaaagaatgtcctuagaaa

SEQ ID NO: 18014 - DNA, 28 bp, Artificial Sequence
  Synthetic
actcacattttgcautgttttctcaaua

SEQ ID NO: 18015 - DNA, 28 bp, Artificial Sequence
  Synthetic
cagtgtgaaaautatcggaauggagaag

SEQ ID NO: 18016 - DNA, 25 bp, Artificial Sequence
  Synthetic
gctttctgaggutaccatccuacat

SEQ ID NO: 18017 - DNA, 21 bp, Artificial Sequence
  Synthetic
caggaguaaacccugggcaag

SEQ ID NO: 18018 - DNA, 22 bp, Artificial Sequence
  Synthetic
tgcaaaggugattttcccugct

SEQ ID NO: 18019 - DNA, 24 bp, Artificial Sequence
  Synthetic
gagctgtuccgataccataaugct

SEQ ID NO: 18020 - DNA, 25 bp, Artificial Sequence
  Synthetic
cgccagacttugctgagtttaaaut

SEQ ID NO: 18021 - DNA, 28 bp, Artificial Sequence
  Synthetic
gttcatttaaaaggcautttctccucca

SEQ ID NO: 18022 - DNA, 25 bp, Artificial Sequence
  Synthetic
gtgacattggccuttgtgttatugt

SEQ ID NO: 18023 - DNA, 22 bp, Artificial Sequence
  Synthetic
tgcctgttcutcatcatgccut

SEQ ID NO: 18024 - DNA, 21 bp, Artificial Sequence
  Synthetic
cgcgattacuttaggcccuca

SEQ ID NO: 18025 - DNA, 23 bp, Artificial Sequence
  Synthetic
cgccttagugaagagcagtaugt

SEQ ID NO: 18026 - DNA, 21 bp, Artificial Sequence
  Synthetic
gaggcuccaggacttcgaaut

SEQ ID NO: 18027 - DNA, 22 bp, Artificial Sequence
  Synthetic
ccctgaagaucgaccucacaga

SEQ ID NO: 18028 - DNA, 22 bp, Artificial Sequence
  Synthetic
ggccccaaaaguggtccttauc

SEQ ID NO: 18029 - DNA, 21 bp, Artificial Sequence
  Synthetic
attcctcugcctacgagucct

SEQ ID NO: 18030 - DNA, 22 bp, Artificial Sequence
  Synthetic
gcatcctatucagagcgtgcut

SEQ ID NO: 18031 - DNA, 21 bp, Artificial Sequence
  Synthetic
tactgccagcucacttcacuc

SEQ ID NO: 18032 - DNA, 32 bp, Artificial Sequence
  Synthetic
ctttgtacctcuaggaatgacggattattuag

SEQ ID NO: 18033 - DNA, 22 bp, Artificial Sequence
  Synthetic
ggtcccatuaaagccctgtcug

SEQ ID NO: 18034 - DNA, 24 bp, Artificial Sequence
  Synthetic
cggttttctuccccttttgctgua

SEQ ID NO: 18035 - DNA, 24 bp, Artificial Sequence
  Synthetic
gtaatcuccactgtcttucaccgt

SEQ ID NO: 18036 - DNA, 31 bp, Artificial Sequence
  Synthetic
gtttaaacaattggaacutacttagctacug

SEQ ID NO: 18037 - DNA, 30 bp, Artificial Sequence
  Synthetic
attttgagcuacaatagtataauggccact

SEQ ID NO: 18038 - DNA, 25 bp, Artificial Sequence
  Synthetic
tcattgccaugactctcaggaatug

SEQ ID NO: 18039 - DNA, 21 bp, Artificial Sequence
  Synthetic
cacttuggcgaaagucacacg

SEQ ID NO: 18040 - DNA, 28 bp, Artificial Sequence
  Synthetic
tgaatatatttatguggacccgaugcag

SEQ ID NO: 18041 - DNA, 25 bp, Artificial Sequence
  Synthetic
caagctcagauctctattcugccaa

SEQ ID NO: 18042 - DNA, 28 bp, Artificial Sequence
  Synthetic
tgtctgaacugaagataatgacucacct

SEQ ID NO: 18043 - DNA, 23 bp, Artificial Sequence
  Synthetic
gggatggagaguggaggattuaa

SEQ ID NO: 18044 - DNA, 25 bp, Artificial Sequence
  Synthetic
cacagtatguccccatgcuagaaag

SEQ ID NO: 18045 - DNA, 23 bp, Artificial Sequence
  Synthetic
tcccaacacccagagugagtaua

SEQ ID NO: 18046 - DNA, 21 bp, Artificial Sequence
  Synthetic
gcaacgucctccuggcacaag

SEQ ID NO: 18047 - DNA, 28 bp, Artificial Sequence
  Synthetic
agagattaaagugaaggaggaugagcct

SEQ ID NO: 18048 - DNA, 21 bp, Artificial Sequence
  Synthetic
tgcccactcutgagttctguc

SEQ ID NO: 18049 - DNA, 22 bp, Artificial Sequence
  Synthetic
ccttuccacccacagauccaaa

SEQ ID NO: 18050 - DNA, 22 bp, Artificial Sequence
  Synthetic
agguctagttctgugcaggagt

SEQ ID NO: 18051 - DNA, 23 bp, Artificial Sequence
  Synthetic
tcaatggtcucgtcctctctcut

SEQ ID NO: 18052 - DNA, 24 bp, Artificial Sequence
  Synthetic
cagacagaaccuctggcuacaaag

SEQ ID NO: 18053 - DNA, 27 bp, Artificial Sequence
  Synthetic
ctttcttgtguaaagtcaggacucaca

SEQ ID NO: 18054 - DNA, 21 bp, Artificial Sequence
  Synthetic
cataactgcagugggccugaa

SEQ ID NO: 18055 - DNA, 22 bp, Artificial Sequence
  Synthetic
agttcaccaugtgtgtgtucca

SEQ ID NO: 18056 - DNA, 27 bp, Artificial Sequence
  Synthetic
tgataatgccaguaaactagcugcaat

SEQ ID NO: 18057 - DNA, 25 bp, Artificial Sequence
  Synthetic
tgctggaaccugaacagaattctuc

SEQ ID NO: 18058 - DNA, 21 bp, Artificial Sequence
  Synthetic
gtaaaccugaggcaccaccut

SEQ ID NO: 18059 - DNA, 27 bp, Artificial Sequence
  Synthetic
tgacattggucttgttttcucagaaca

SEQ ID NO: 18060 - DNA, 28 bp, Artificial Sequence
  Synthetic
ccaatcaaaugacctccaaacaauacac

SEQ ID NO: 18061 - DNA, 22 bp, Artificial Sequence
  Synthetic
gaactggagaugttgguccact

SEQ ID NO: 18062 - DNA, 28 bp, Artificial Sequence
  Synthetic
ccagcaauagcagcaaaaautacaaaua

SEQ ID NO: 18063 - DNA, 28 bp, Artificial Sequence
  Synthetic
cgaactcgctugattttgaatactgaut

SEQ ID NO: 18064 - DNA, 25 bp, Artificial Sequence
  Synthetic
gaaacaagacccaaaacutgcauca

SEQ ID NO: 18065 - DNA, 23 bp, Artificial Sequence
  Synthetic
cgcagcttgutgaccagacauat

SEQ ID NO: 18066 - DNA, 23 bp, Artificial Sequence
  Synthetic
gtcttgccauagtcagaugcaca

SEQ ID NO: 18067 - DNA, 24 bp, Artificial Sequence
  Synthetic
tggtctcaaugatgctctttugct

SEQ ID NO: 18068 - DNA, 27 bp, Artificial Sequence
  Synthetic
attggatacaccugtcaagactcaaua

SEQ ID NO: 18069 - DNA, 26 bp, Artificial Sequence
  Synthetic
ctttacaaatugctgccagacucaag

SEQ ID NO: 18070 - DNA, 28 bp, Artificial Sequence
  Synthetic
ccataggcagtcuaatgtacgaacttua

SEQ ID NO: 18071 - DNA, 27 bp, Artificial Sequence
  Synthetic
aauggagaaaaggaaacttuaggagca

SEQ ID NO: 18072 - DNA, 23 bp, Artificial Sequence
  Synthetic
gtttgcaacagccccutctttut

SEQ ID NO: 18073 - DNA, 28 bp, Artificial Sequence
  Synthetic
tggtttattgucaaggatacccctttut

SEQ ID NO: 18074 - DNA, 25 bp, Artificial Sequence
  Synthetic
ccaacacuacacactgtgctatuca

SEQ ID NO: 18075 - DNA, 18 bp, Artificial Sequence
  Synthetic
gtuggagcctgugccagt

SEQ ID NO: 18076 - DNA, 24 bp, Artificial Sequence
  Synthetic
tggccuggcagaaatagtgaatut

SEQ ID NO: 18077 - DNA, 25 bp, Artificial Sequence
  Synthetic
gaggctggcaaauagttagtaucca

SEQ ID NO: 18078 - DNA, 23 bp, Artificial Sequence
  Synthetic
gtttgggauggaatggtgaucca

SEQ ID NO: 18079 - DNA, 24 bp, Artificial Sequence
  Synthetic
aguagagtttgucagccagagaca

SEQ ID NO: 18080 - DNA, 25 bp, Artificial Sequence
  Synthetic
actactttcgcautcacacacacut

SEQ ID NO: 18081 - DNA, 19 bp, Artificial Sequence
  Synthetic
gtgctgccautctgcaugt

SEQ ID NO: 18082 - DNA, 26 bp, Artificial Sequence
  Synthetic
ctcccuggagaacagctcaaauaaaa

SEQ ID NO: 18083 - DNA, 28 bp, Artificial Sequence
  Synthetic
ccacacaacacauttatctacaaaugct

SEQ ID NO: 18084 - DNA, 21 bp, Artificial Sequence
  Synthetic
gaagcaccagcccuaugaact

SEQ ID NO: 18085 - DNA, 28 bp, Artificial Sequence
  Synthetic
ccattgcattgauatgatggatatuggg

SEQ ID NO: 18086 - DNA, 22 bp, Artificial Sequence
  Synthetic
gggagccaccuctagatuacca

SEQ ID NO: 18087 - DNA, 22 bp, Artificial Sequence
  Synthetic
gaagagagcugttgaacaugcc

SEQ ID NO: 18088 - DNA, 23 bp, Artificial Sequence
  Synthetic
gctttctggaucctgacatuggg

SEQ ID NO: 18089 - DNA, 27 bp, Artificial Sequence
  Synthetic
ctcattcatgcucttatgctgguaaaa

SEQ ID NO: 18090 - DNA, 29 bp, Artificial Sequence
  Synthetic
gtcacagggccutacaacagatatataug

SEQ ID NO: 18091 - DNA, 26 bp, Artificial Sequence
  Synthetic
ttcccaccacauttgtcatgaauact

SEQ ID NO: 18092 - DNA, 24 bp, Artificial Sequence
  Synthetic
cttaaaccttuggagagtggucct

SEQ ID NO: 18093 - DNA, 20 bp, Artificial Sequence
  Synthetic
tggtaccccucagcacucat

SEQ ID NO: 18094 - DNA, 32 bp, Artificial Sequence
  Synthetic
ggaacttacguagaatatatuggaaggaaaaa

SEQ ID NO: 18095 - DNA, 27 bp, Artificial Sequence
  Synthetic
gggagtcatuaagcaaccacttaucaa

SEQ ID NO: 18096 - DNA, 24 bp, Artificial Sequence
  Synthetic
ctttcaaacgcuatctccuggact

SEQ ID NO: 18097 - DNA, 22 bp, Artificial Sequence
  Synthetic
acaagcaccuctacatcuccat

SEQ ID NO: 18098 - DNA, 17 bp, Artificial Sequence
  Synthetic
ggctuggcccactuggt

SEQ ID NO: 18099 - DNA, 24 bp, Artificial Sequence
  Synthetic
gaagugcacaaatucaaggcaact

SEQ ID NO: 18100 - DNA, 30 bp, Artificial Sequence
  Synthetic
actaaaccttaagaugagcattgttttgug

SEQ ID NO: 18101 - DNA, 28 bp, Artificial Sequence
  Synthetic
cctaatttcagcuatattccctggctua

SEQ ID NO: 18102 - DNA, 30 bp, Artificial Sequence
  Synthetic
agaagataatautgaagctguagggaaaaa

SEQ ID NO: 18103 - DNA, 29 bp, Artificial Sequence
  Synthetic
ctgattttcauagaaaactcaccugggat

SEQ ID NO: 18104 - DNA, 30 bp, Artificial Sequence
  Synthetic
agaagaagatuggaagaagactugaagaag

SEQ ID NO: 18105 - DNA, 32 bp, Artificial Sequence
  Synthetic
caatcaccaattautcatgtataggatuccat

SEQ ID NO: 18106 - DNA, 25 bp, Artificial Sequence
  Synthetic
tcttggacaagcucaaaagacagut

SEQ ID NO: 18107 - DNA, 24 bp, Artificial Sequence
  Synthetic
caccagttcttucagagagctgua

SEQ ID NO: 18108 - DNA, 18 bp, Artificial Sequence
  Synthetic
aggagatgcugggtgcug

SEQ ID NO: 18109 - DNA, 20 bp, Artificial Sequence
  Synthetic
agccagagcuggaacagtug

SEQ ID NO: 18110 - DNA, 19 bp, Artificial Sequence
  Synthetic
gtggtuacctggcuaggct

SEQ ID NO: 18111 - DNA, 20 bp, Artificial Sequence
  Synthetic
gttccatggccuccgatcuc

SEQ ID NO: 18112 - DNA, 21 bp, Artificial Sequence
  Synthetic
cuggaggaggaaguaagcaua

SEQ ID NO: 18113 - DNA, 21 bp, Artificial Sequence
  Synthetic
cctgtccugacctcccuacag

SEQ ID NO: 18114 - DNA, 19 bp, Artificial Sequence
  Synthetic
gccatuggccacctgguag

SEQ ID NO: 18115 - DNA, 21 bp, Artificial Sequence
  Synthetic
cctgugggccagaaggagaua

SEQ ID NO: 18116 - DNA, 22 bp, Artificial Sequence
  Synthetic
ctgcaggaaggugtgtttgtug

SEQ ID NO: 18117 - DNA, 19 bp, Artificial Sequence
  Synthetic
cctugaagggacgccugag

SEQ ID NO: 18118 - DNA, 19 bp, Artificial Sequence
  Synthetic
aggcctcucaggacugacc

SEQ ID NO: 18119 - DNA, 22 bp, Artificial Sequence
  Synthetic
ccgatggaaggugattgaguct

SEQ ID NO: 18120 - DNA, 19 bp, Artificial Sequence
  Synthetic
gatgaccucctgcgtgucc

SEQ ID NO: 18121 - DNA, 22 bp, Artificial Sequence
  Synthetic
ctggagacuaacgtgacguact

SEQ ID NO: 18122 - DNA, 23 bp, Artificial Sequence
  Synthetic
tggcggcugcaaagaaaaauaac

SEQ ID NO: 18123 - DNA, 19 bp, Artificial Sequence
  Synthetic
agtgtucgaggccuaccca

SEQ ID NO: 18124 - DNA, 20 bp, Artificial Sequence
  Synthetic
ccagatauccacccgtucct

SEQ ID NO: 18125 - DNA, 22 bp, Artificial Sequence
  Synthetic
ggtgagaacaucaccctcaugt

SEQ ID NO: 18126 - DNA, 22 bp, Artificial Sequence
  Synthetic
cctttcttcucgtgcagtguca

SEQ ID NO: 18127 - DNA, 22 bp, Artificial Sequence
  Synthetic
ccctgattuattcacggcucca

SEQ ID NO: 18128 - DNA, 19 bp, Artificial Sequence
  Synthetic
cagctccagggutccacuc

SEQ ID NO: 18129 - DNA, 22 bp, Artificial Sequence
  Synthetic
gccctgacucctgtttaacuct

SEQ ID NO: 18130 - DNA, 17 bp, Artificial Sequence
  Synthetic
ccaccgccucugccaag

SEQ ID NO: 18131 - DNA, 20 bp, Artificial Sequence
  Synthetic
cagctcugctcacctgugaa

SEQ ID NO: 18132 - DNA, 17 bp, Artificial Sequence
  Synthetic
cugcaacacgacgccut

SEQ ID NO: 18133 - DNA, 21 bp, Artificial Sequence
  Synthetic
gcgggaaccutggaactaucc

SEQ ID NO: 18134 - DNA, 32 bp, Artificial Sequence
  Synthetic
cacttaagtttcagugttatttttctcctugt

SEQ ID NO: 18135 - DNA, 30 bp, Artificial Sequence
  Synthetic
aagataactggugctcattttcatcatuat

SEQ ID NO: 18136 - DNA, 24 bp, Artificial Sequence
  Synthetic
tggaaaaacaggutcactggttug

SEQ ID NO: 18137 - DNA, 23 bp, Artificial Sequence
  Synthetic
ccctgaaccacacutcaacctua

SEQ ID NO: 18138 - DNA, 27 bp, Artificial Sequence
  Synthetic
gcttttagtttggugatagaacagcuc

SEQ ID NO: 18139 - DNA, 30 bp, Artificial Sequence
  Synthetic
tgtcaagatuccggaagtatatuaagttuc

SEQ ID NO: 18140 - DNA, 22 bp, Artificial Sequence
  Synthetic
tggtttaatugcaggcgcatug

SEQ ID NO: 18141 - DNA, 27 bp, Artificial Sequence
  Synthetic
agaagacttcaguctggattgttgaug

SEQ ID NO: 18142 - DNA, 21 bp, Artificial Sequence
  Synthetic
catagaggccacuaggcctug

SEQ ID NO: 18143 - DNA, 22 bp, Artificial Sequence
  Synthetic
agggcagcagacaauttctuct

SEQ ID NO: 18144 - DNA, 23 bp, Artificial Sequence
  Synthetic
tgtttgcactuccttgagtccug

SEQ ID NO: 18145 - DNA, 25 bp, Artificial Sequence
  Synthetic
gcatcguccacacaagtaaaatuct

SEQ ID NO: 18146 - DNA, 23 bp, Artificial Sequence
  Synthetic
gcaaugaaaaagcagcccttcuc

SEQ ID NO: 18147 - DNA, 28 bp, Artificial Sequence
  Synthetic
gatgaagttccagguaattctagcaugt

SEQ ID NO: 18148 - DNA, 29 bp, Artificial Sequence
  Synthetic
tgatctaatgatuctggttctctuaccct

SEQ ID NO: 18149 - DNA, 24 bp, Artificial Sequence
  Synthetic
ggacagguagctcttcgaatugat

SEQ ID NO: 18150 - DNA, 23 bp, Artificial Sequence
  Synthetic
gagtcagaacaugacctgtugct

SEQ ID NO: 18151 - DNA, 27 bp, Artificial Sequence
  Synthetic
gcttcaaattgtaugtggcccttttuc

SEQ ID NO: 18152 - DNA, 23 bp, Artificial Sequence
  Synthetic
gtgtgtggutcaaaagugaagct

SEQ ID NO: 18153 - DNA, 28 bp, Artificial Sequence
  Synthetic
gcatctggaattucaaggacactgtuat

SEQ ID NO: 18154 - DNA, 26 bp, Artificial Sequence
  Synthetic
ccaaaatucaacctgtcaucaagcat

SEQ ID NO: 18155 - DNA, 22 bp, Artificial Sequence
  Synthetic
gggttctgccauaactggatut

SEQ ID NO: 18156 - DNA, 28 bp, Artificial Sequence
  Synthetic
cttctgcttcuagtcagaatcacauacc

SEQ ID NO: 18157 - DNA, 19 bp, Artificial Sequence
  Synthetic
acgaccaggacuccgguaa

SEQ ID NO: 18158 - DNA, 23 bp, Artificial Sequence
  Synthetic
aaccguaaagcctuaaagaccga

SEQ ID NO: 18159 - DNA, 25 bp, Artificial Sequence
  Synthetic
tgttaaguggcccattatcugaagg

SEQ ID NO: 18160 - DNA, 23 bp, Artificial Sequence
  Synthetic
cgggatgaguttccagagcauag

SEQ ID NO: 18161 - DNA, 23 bp, Artificial Sequence
  Synthetic
ccttttccatgucaccaatgcug

SEQ ID NO: 18162 - DNA, 22 bp, Artificial Sequence
  Synthetic
caacaatttuggcctguggact

SEQ ID NO: 18163 - DNA, 26 bp, Artificial Sequence
  Synthetic
gaaatcaaagaatuctcgtccaccug

SEQ ID NO: 18164 - DNA, 23 bp, Artificial Sequence
  Synthetic
acccuggatttaugcccaagaag

SEQ ID NO: 18165 - DNA, 33 bp, Artificial Sequence
  Synthetic
catcaatgttataacugctactcaaaatgucat

SEQ ID NO: 18166 - DNA, 27 bp, Artificial Sequence
  Synthetic
aagtgcttaauggctagacaaauagca

SEQ ID NO: 18167 - DNA, 22 bp, Artificial Sequence
  Synthetic
cttccucaacagtctcctuggg

SEQ ID NO: 18168 - DNA, 22 bp, Artificial Sequence
  Synthetic
aaaggtgccutctacccttgug

SEQ ID NO: 18169 - DNA, 22 bp, Artificial Sequence
  Synthetic
tggattagcagcaugacaggut

SEQ ID NO: 18170 - DNA, 24 bp, Artificial Sequence
  Synthetic
gcatgttaatgutagctggtgcut

SEQ ID NO: 18171 - DNA, 31 bp, Artificial Sequence
  Synthetic
tccagtggcaataugatgaaaagtattttug

SEQ ID NO: 18172 - DNA, 21 bp, Artificial Sequence
  Synthetic
gggagagtucccagtcctcut

SEQ ID NO: 18173 - DNA, 29 bp, Artificial Sequence
  Synthetic
gccugagaaauaaaaaggataaagtuacc

SEQ ID NO: 18174 - DNA, 27 bp, Artificial Sequence
  Synthetic
gcaactguaaagctactgaugagaacc

SEQ ID NO: 18175 - DNA, 26 bp, Artificial Sequence
  Synthetic
ctgtaatgugcggaaaattucaacct

SEQ ID NO: 18176 - DNA, 21 bp, Artificial Sequence
  Synthetic
cagcagagguctcaggaaguc

SEQ ID NO: 18177 - DNA, 23 bp, Artificial Sequence
  Synthetic
ctacacggguatctccatucaca

SEQ ID NO: 18178 - DNA, 24 bp, Artificial Sequence
  Synthetic
gtgttcacagaaugctgactgtuc

SEQ ID NO: 18179 - DNA, 22 bp, Artificial Sequence
  Synthetic
ccagcauccccacaacuaaaac

SEQ ID NO: 18180 - DNA, 21 bp, Artificial Sequence
  Synthetic
tgtactgagcaugaccccugt

SEQ ID NO: 18181 - DNA, 25 bp, Artificial Sequence
  Synthetic
tttatctgacatuttgggtgccuga

SEQ ID NO: 18182 - DNA, 21 bp, Artificial Sequence
  Synthetic
caaacccuctccagugaccag

SEQ ID NO: 18183 - DNA, 23 bp, Artificial Sequence
  Synthetic
ggaactgaggutttctccaguga

SEQ ID NO: 18184 - DNA, 21 bp, Artificial Sequence
  Synthetic
gcagcttcaccucatcagguc

SEQ ID NO: 18185 - DNA, 22 bp, Artificial Sequence
  Synthetic
gaggatcugacacacagcctut

SEQ ID NO: 18186 - DNA, 25 bp, Artificial Sequence
  Synthetic
caatcutttaggtctcucgggaagg

SEQ ID NO: 18187 - DNA, 22 bp, Artificial Sequence
  Synthetic
cagtgtctguccagccactaug

SEQ ID NO: 18188 - DNA, 23 bp, Artificial Sequence
  Synthetic
acttaaucccaaaaacccuggca

SEQ ID NO: 18189 - DNA, 20 bp, Artificial Sequence
  Synthetic
cctgtcuccgtcaccacuct

SEQ ID NO: 18190 - DNA, 20 bp, Artificial Sequence
  Synthetic
gcagagagacauggcacuca

SEQ ID NO: 18191 - DNA, 23 bp, Artificial Sequence
  Synthetic
agtaucgagaaccgagugagagg

SEQ ID NO: 18192 - DNA, 21 bp, Artificial Sequence
  Synthetic
gagatgcggucagaatcugca

SEQ ID NO: 18193 - DNA, 26 bp, Artificial Sequence
  Synthetic
ccutttaaaatccagucccaggacat

SEQ ID NO: 18194 - DNA, 17 bp, Artificial Sequence
  Synthetic
gccccaucggagtugct

SEQ ID NO: 18195 - DNA, 19 bp, Artificial Sequence
  Synthetic
cccgccguatgagttcugt

SEQ ID NO: 18196 - DNA, 27 bp, Artificial Sequence
  Synthetic
tcattacagaaaugcatcgtgatucct

SEQ ID NO: 18197 - DNA, 23 bp, Artificial Sequence
  Synthetic
gtttcuagcaacccacacactuc

SEQ ID NO: 18198 - DNA, 25 bp, Artificial Sequence
  Synthetic
atgcctcacgccauaaatactaaut

SEQ ID NO: 18199 - DNA, 23 bp, Artificial Sequence
  Synthetic
tgccattuctaagaacguagcca

SEQ ID NO: 18200 - DNA, 18 bp, Artificial Sequence
  Synthetic
cactgaguccccgtgcut

SEQ ID NO: 18201 - DNA, 19 bp, Artificial Sequence
  Synthetic
cacucaccggcaagttguc

SEQ ID NO: 18202 - DNA, 20 bp, Artificial Sequence
  Synthetic
gaaggtgagcucgggttuct

SEQ ID NO: 18203 - DNA, 20 bp, Artificial Sequence
  Synthetic
gctccccuttccgtgaugaa

SEQ ID NO: 18204 - DNA, 29 bp, Artificial Sequence
  Synthetic
ctgtatgatatggugtgtggagatatucc

SEQ ID NO: 18205 - DNA, 27 bp, Artificial Sequence
  Synthetic
aatttcaaagacugtcccaugaagact

SEQ ID NO: 18206 - DNA, 17 bp, Artificial Sequence
  Synthetic
gcagggcagguggcuac

SEQ ID NO: 18207 - DNA, 19 bp, Artificial Sequence
  Synthetic
ggagcagcutcagcaugga

SEQ ID NO: 18208 - DNA, 19 bp, Artificial Sequence
  Synthetic
gtggcugaagtccagguga

SEQ ID NO: 18209 - DNA, 18 bp, Artificial Sequence
  Synthetic
ccagcagguggugaagca

SEQ ID NO: 18210 - DNA, 20 bp, Artificial Sequence
  Synthetic
atcacccucccccucagaaa

SEQ ID NO: 18211 - DNA, 27 bp, Artificial Sequence
  Synthetic
gctccttctggaauctgttaccttuag

SEQ ID NO: 18212 - DNA, 18 bp, Artificial Sequence
  Synthetic
gcacgagcucugcaagca

SEQ ID NO: 18213 - DNA, 18 bp, Artificial Sequence
  Synthetic
gacacgugctgtccucct

SEQ ID NO: 18214 - DNA, 18 bp, Artificial Sequence
  Synthetic
gtggcgacuggaagugga

SEQ ID NO: 18215 - DNA, 18 bp, Artificial Sequence
  Synthetic
gttgcgcaugcagcucat

SEQ ID NO: 18216 - DNA, 25 bp, Artificial Sequence
  Synthetic
ggcagtaagccacutgtttttctug

SEQ ID NO: 18217 - DNA, 23 bp, Artificial Sequence
  Synthetic
ggccaaggugaagaaaagtcuga

SEQ ID NO: 18218 - DNA, 29 bp, Artificial Sequence
  Synthetic
ttctgaataactgaagutggtcctgaaut

SEQ ID NO: 18219 - DNA, 27 bp, Artificial Sequence
  Synthetic
tctaaaatgacccuacctgggttauca

SEQ ID NO: 18220 - DNA, 24 bp, Artificial Sequence
  Synthetic
ggccttccccuctctttctauagt

SEQ ID NO: 18221 - DNA, 22 bp, Artificial Sequence
  Synthetic
ggatcuggcagctagaaatugc

SEQ ID NO: 18222 - DNA, 22 bp, Artificial Sequence
  Synthetic
aaggttttaccacugcagccua

SEQ ID NO: 18223 - DNA, 24 bp, Artificial Sequence
  Synthetic
attatccuggaactgauggaggga

SEQ ID NO: 18224 - DNA, 23 bp, Artificial Sequence
  Synthetic
ctcctaagatguccactgctgut

SEQ ID NO: 18225 - DNA, 28 bp, Artificial Sequence
  Synthetic
gggagacaaaaaugttgctatttuacag

SEQ ID NO: 18226 - DNA, 26 bp, Artificial Sequence
  Synthetic
ctagtgtguagacagacatgguaaca

SEQ ID NO: 18227 - DNA, 30 bp, Artificial Sequence
  Synthetic
ggaagtccaaaaaccugaaaggaatattuc

SEQ ID NO: 18228 - DNA, 25 bp, Artificial Sequence
  Synthetic
cttcagctttcucccactgtatuga

SEQ ID NO: 18229 - DNA, 30 bp, Artificial Sequence
  Synthetic
ttctgtagaaagatutcagtgcagaagaut

SEQ ID NO: 18230 - DNA, 26 bp, Artificial Sequence
  Synthetic
acatgagcatgutctagatgcaugaa

SEQ ID NO: 18231 - DNA, 27 bp, Artificial Sequence
  Synthetic
gctccattgaaugttaacctcaucaga

SEQ ID NO: 18232 - DNA, 24 bp, Artificial Sequence
  Synthetic
ccaccagacaguctaguaacaagg

SEQ ID NO: 18233 - DNA, 26 bp, Artificial Sequence
  Synthetic
accagccucattatatctuggagaga

SEQ ID NO: 18234 - DNA, 28 bp, Artificial Sequence
  Synthetic
agaacaucttgugaaaagacaaagacca

SEQ ID NO: 18235 - DNA, 21 bp, Artificial Sequence
  Synthetic
ctcuggccaagacaaaccuca

SEQ ID NO: 18236 - DNA, 28 bp, Artificial Sequence
  Synthetic
tgtatatttgaguatacgcggaaugcaa

SEQ ID NO: 18237 - DNA, 22 bp, Artificial Sequence
  Synthetic
caatggatcuggaaggctguca

SEQ ID NO: 18238 - DNA, 33 bp, Artificial Sequence
  Synthetic
aaatacttgcauttacatacctuaaaagaggat

SEQ ID NO: 18239 - DNA, 28 bp, Artificial Sequence
  Synthetic
tgcactgaaagaaucacaaaatggaaug

SEQ ID NO: 18240 - DNA, 31 bp, Artificial Sequence
  Synthetic
tccacacaacttgautttgatccatatcuaa

SEQ ID NO: 18241 - DNA, 27 bp, Artificial Sequence
  Synthetic
tgccagatatuaaatcgagacttugct

SEQ ID NO: 18242 - DNA, 28 bp, Artificial Sequence
  Synthetic
attttgttaacaccccautttcatgcut

SEQ ID NO: 18243 - DNA, 22 bp, Artificial Sequence
  Synthetic
cttttctgcuctacctgugcct

SEQ ID NO: 18244 - DNA, 25 bp, Artificial Sequence
  Synthetic
gtagaaaacuacaccccagtcuacc

SEQ ID NO: 18245 - DNA, 27 bp, Artificial Sequence
  Synthetic
gtttcatcctguagggaacttttccut

SEQ ID NO: 18246 - DNA, 26 bp, Artificial Sequence
  Synthetic
cagctgtguacaggtgaatacatuga

SEQ ID NO: 18247 - DNA, 28 bp, Artificial Sequence
  Synthetic
ctatagcttaagugtgacctgtucacaa

SEQ ID NO: 18248 - DNA, 23 bp, Artificial Sequence
  Synthetic
agcatccagaaugccatgcttua

SEQ ID NO: 18249 - DNA, 21 bp, Artificial Sequence
  Synthetic
gaaaggcgacguttttgtgug

SEQ ID NO: 18250 - DNA, 21 bp, Artificial Sequence
  Synthetic
gggcacucagctagtcctcut

SEQ ID NO: 18251 - DNA, 25 bp, Artificial Sequence
  Synthetic
tgagctgcagagugctatgaaauac

SEQ ID NO: 18252 - DNA, 23 bp, Artificial Sequence
  Synthetic
catugaacaagagcctggugaga

SEQ ID NO: 18253 - DNA, 22 bp, Artificial Sequence
  Synthetic
tgaattcaucgtgggatgugac

SEQ ID NO: 18254 - DNA, 28 bp, Artificial Sequence
  Synthetic
tggtacuacaatgtttcatuagcaagca

SEQ ID NO: 18255 - DNA, 27 bp, Artificial Sequence
  Synthetic
agaactgctcaaacaucgaggaaatua

SEQ ID NO: 18256 - DNA, 24 bp, Artificial Sequence
  Synthetic
gguatatagcauccaaccgaaggc

SEQ ID NO: 18257 - DNA, 25 bp, Artificial Sequence
  Synthetic
tctacctgtcugcaaattgtgtugt

SEQ ID NO: 18258 - DNA, 30 bp, Artificial Sequence
  Synthetic
aaagctttggaauaatgtcctttcauaaga

SEQ ID NO: 18259 - DNA, 24 bp, Artificial Sequence
  Synthetic
gcacccctucactgagtacattut

SEQ ID NO: 18260 - DNA, 22 bp, Artificial Sequence
  Synthetic
tcactagaguggtgcagccuat

SEQ ID NO: 18261 - DNA, 26 bp, Artificial Sequence
  Synthetic
cttaucagcaaaaccagtaucaaggc

SEQ ID NO: 18262 - DNA, 28 bp, Artificial Sequence
  Synthetic
acacgacttuaggcagctattuaaaact

SEQ ID NO: 18263 - DNA, 28 bp, Artificial Sequence
  Synthetic
catctaaaaatcugccattggtgaagug

SEQ ID NO: 18264 - DNA, 24 bp, Artificial Sequence
  Synthetic
acttgccagtuttgtcctcagtut

SEQ ID NO: 18265 - DNA, 28 bp, Artificial Sequence
  Synthetic
gcaaaagaaauacaacagaacaagucut

SEQ ID NO: 18266 - DNA, 26 bp, Artificial Sequence
  Synthetic
gacttcaguacaactcacuggaagaa

SEQ ID NO: 18267 - DNA, 21 bp, Artificial Sequence
  Synthetic
caaggcauaaggcugaaagca

SEQ ID NO: 18268 - DNA, 28 bp, Artificial Sequence
  Synthetic
gagaugaaggagaagctctuaaaagagt

SEQ ID NO: 18269 - DNA, 25 bp, Artificial Sequence
  Synthetic
ggctgaggutaaagacagtuacaga

SEQ ID NO: 18270 - DNA, 24 bp, Artificial Sequence
  Synthetic
ctttatgccaugagtgcucagaga

SEQ ID NO: 18271 - DNA, 20 bp, Artificial Sequence
  Synthetic
ccagtggacucctcagggut

SEQ ID NO: 18272 - DNA, 22 bp, Artificial Sequence
  Synthetic
gggatcugcagtacttgctuca

SEQ ID NO: 18273 - DNA, 22 bp, Artificial Sequence
  Synthetic
tttccagcuctguggcaagaat

SEQ ID NO: 18274 - DNA, 21 bp, Artificial Sequence
  Synthetic
ggtuccagaacaccatuccgt

SEQ ID NO: 18275 - DNA, 21 bp, Artificial Sequence
  Synthetic
ggaaagcucctccaagtguct

SEQ ID NO: 18276 - DNA, 26 bp, Artificial Sequence
  Synthetic
tttcagttcaagcagaugtatggcua

SEQ ID NO: 18277 - DNA, 25 bp, Artificial Sequence
  Synthetic
gcttatcttucctctcctgcucaga

SEQ ID NO: 18278 - DNA, 22 bp, Artificial Sequence
  Synthetic
gguactctctgtugaccaccca

SEQ ID NO: 18279 - DNA, 22 bp, Artificial Sequence
  Synthetic
tctcugacccagcacaaaugat

SEQ ID NO: 18280 - DNA, 21 bp, Artificial Sequence
  Synthetic
cagagcctguctttgcggaua

SEQ ID NO: 18281 - DNA, 20 bp, Artificial Sequence
  Synthetic
cccagaauccatccgaguct

SEQ ID NO: 18282 - DNA, 26 bp, Artificial Sequence
  Synthetic
tugtgtcagtugaagaaacagaagga

SEQ ID NO: 18283 - DNA, 22 bp, Artificial Sequence
  Synthetic
ccatgtgcugtgtttgtuccag

SEQ ID NO: 18284 - DNA, 23 bp, Artificial Sequence
  Synthetic
ctttgtgcagaucttgctgugag

SEQ ID NO: 18285 - DNA, 21 bp, Artificial Sequence
  Synthetic
ccagcttucgtggcatcugaa

SEQ ID NO: 18286 - DNA, 23 bp, Artificial Sequence
  Synthetic
cagcagcucttgataucagaagg

SEQ ID NO: 18287 - DNA, 23 bp, Artificial Sequence
  Synthetic
tgaactcactgugctctgtgtug

SEQ ID NO: 18288 - DNA, 24 bp, Artificial Sequence
  Synthetic
ccaggaaaauacatggagctgaug

SEQ ID NO: 18289 - DNA, 24 bp, Artificial Sequence
  Synthetic
gatgtcaagtuctacctggcugag

SEQ ID NO: 18290 - DNA, 25 bp, Artificial Sequence
  Synthetic
taacggaguagaaattgcagtuacc

SEQ ID NO: 18291 - DNA, 26 bp, Artificial Sequence
  Synthetic
tctgatgttccgutttctcttgcuaa

SEQ ID NO: 18292 - DNA, 21 bp, Artificial Sequence
  Synthetic
gctgcagagutcggattctug

SEQ ID NO: 18293 - DNA, 29 bp, Artificial Sequence
  Synthetic
cuactatcaatacucgaccagcagaaaag

SEQ ID NO: 18294 - DNA, 29 bp, Artificial Sequence
  Synthetic
ttctcaagatcacutttaaatgggtguga

SEQ ID NO: 18295 - DNA, 23 bp, Artificial Sequence
  Synthetic
cctgggugtcatttcucagaact

SEQ ID NO: 18296 - DNA, 19 bp, Artificial Sequence
  Synthetic
ggctgucgctcagcaugaa

SEQ ID NO: 18297 - DNA, 23 bp, Artificial Sequence
  Synthetic
gctttcaagugaaacgtgttugt

SEQ ID NO: 18298 - DNA, 32 bp, Artificial Sequence
  Synthetic
ttaccttatctctuttcttagttcatctucgg

SEQ ID NO: 18299 - DNA, 30 bp, Artificial Sequence
  Synthetic
ttagctaaacgaauaaagcagttacaucat

SEQ ID NO: 18300 - DNA, 24 bp, Artificial Sequence
  Synthetic
gagautagttggcugaggcaaaac

SEQ ID NO: 18301 - DNA, 20 bp, Artificial Sequence
  Synthetic
cucgcaggaacatguggact

SEQ ID NO: 18302 - DNA, 22 bp, Artificial Sequence
  Synthetic
ctagagggcuccttcttggtuc

SEQ ID NO: 18303 - DNA, 27 bp, Artificial Sequence
  Synthetic
cccutcattaaggacuggagaagaaaa

SEQ ID NO: 18304 - DNA, 26 bp, Artificial Sequence
  Synthetic
actagttgtacugaaatgccaaugga

SEQ ID NO: 18305 - DNA, 27 bp, Artificial Sequence
  Synthetic
ggctgggaacauttgtcatttattcut

SEQ ID NO: 18306 - DNA, 23 bp, Artificial Sequence
  Synthetic
cagcucaaaccgtactctucaca

SEQ ID NO: 18307 - DNA, 27 bp, Artificial Sequence
  Synthetic
gcgcttgtaatgucaatagcttgacua

SEQ ID NO: 18308 - DNA, 25 bp, Artificial Sequence
  Synthetic
gtagtguggaaaataactgcugcac

SEQ ID NO: 18309 - DNA, 22 bp, Artificial Sequence
  Synthetic
ccatgccuggtattctcucaca

SEQ ID NO: 18310 - DNA, 25 bp, Artificial Sequence
  Synthetic
tttcttgtggcutaaaactcuccca

SEQ ID NO: 18311 - DNA, 23 bp, Artificial Sequence
  Synthetic
cctgcuaaggccatcaaaccuat

SEQ ID NO: 18312 - DNA, 29 bp, Artificial Sequence
  Synthetic
tttcagattgaguacttccaaagaaccut

SEQ ID NO: 18313 - DNA, 27 bp, Artificial Sequence
  Synthetic
gagtttattctgugtcttgctcaucct

SEQ ID NO: 18314 - DNA, 27 bp, Artificial Sequence
  Synthetic
gatgtccttcauggctctctcaauaag

SEQ ID NO: 18315 - DNA, 27 bp, Artificial Sequence
  Synthetic
cagauaaagaaagauacacacaacugg

SEQ ID NO: 18316 - DNA, 24 bp, Artificial Sequence
  Synthetic
ccttgtttttguagcaggcgatut

SEQ ID NO: 18317 - DNA, 17 bp, Artificial Sequence
  Synthetic
cgggucagccctggtuc

SEQ ID NO: 18318 - DNA, 19 bp, Artificial Sequence
  Synthetic
gtgagaaugaccgggugga

SEQ ID NO: 18319 - DNA, 21 bp, Artificial Sequence
  Synthetic
ccttgtcucacagagcacuca

SEQ ID NO: 18320 - DNA, 20 bp, Artificial Sequence
  Synthetic
ggaacucgaatcgcuaccct

SEQ ID NO: 18321 - DNA, 19 bp, Artificial Sequence
  Synthetic
ggguccccaagacaccuac

SEQ ID NO: 18322 - DNA, 23 bp, Artificial Sequence
  Synthetic
gctacaagaacuaccgauaccgt

SEQ ID NO: 18323 - DNA, 25 bp, Artificial Sequence
  Synthetic
cagcaagugcccagtatattttgut

SEQ ID NO: 18324 - DNA, 22 bp, Artificial Sequence
  Synthetic
tgtttgccaugtttggaacugg

SEQ ID NO: 18325 - DNA, 24 bp, Artificial Sequence
  Synthetic
aggacccgauaaaaccuaaagaug

SEQ ID NO: 18326 - DNA, 21 bp, Artificial Sequence
  Synthetic
ccctcagcugatgtctccuct

SEQ ID NO: 18327 - DNA, 21 bp, Artificial Sequence
  Synthetic
caccttccuccagaagctuga

SEQ ID NO: 18328 - DNA, 21 bp, Artificial Sequence
  Synthetic
cctggtcuccaacccattcug

SEQ ID NO: 18329 - DNA, 23 bp, Artificial Sequence
  Synthetic
gcatccaugagttctgtguccat

SEQ ID NO: 18330 - DNA, 25 bp, Artificial Sequence
  Synthetic
tcagtgctucaaagattgtatugct

SEQ ID NO: 18331 - DNA, 22 bp, Artificial Sequence
  Synthetic
ccatctucaaagggacctccuc

SEQ ID NO: 18332 - DNA, 24 bp, Artificial Sequence
  Synthetic
ggcgaagaacaaagacuccacaua

SEQ ID NO: 18333 - DNA, 30 bp, Artificial Sequence
  Synthetic
attcacaaaccugatctaaatcacugaagt

SEQ ID NO: 18334 - DNA, 23 bp, Artificial Sequence
  Synthetic
atttccccugcagattguaagca

SEQ ID NO: 18335 - DNA, 29 bp, Artificial Sequence
  Synthetic
ctattagatgaguaaggcgctcaacatua

SEQ ID NO: 18336 - DNA, 29 bp, Artificial Sequence
  Synthetic
ggagcctauggaagagatagaaaattuga

SEQ ID NO: 18337 - DNA, 22 bp, Artificial Sequence
  Synthetic
actgcaatagcutgctctgcut

SEQ ID NO: 18338 - DNA, 31 bp, Artificial Sequence
  Synthetic
aaaatgagaatgcauttaattgcgttaguct

SEQ ID NO: 18339 - DNA, 23 bp, Artificial Sequence
  Synthetic
cgttctgaagcugatggttucct

SEQ ID NO: 18340 - DNA, 23 bp, Artificial Sequence
  Synthetic
tttgttgttgugccttctucagc

SEQ ID NO: 18341 - DNA, 27 bp, Artificial Sequence
  Synthetic
gaacagatgatgugaggctattggaut

SEQ ID NO: 18342 - DNA, 28 bp, Artificial Sequence
  Synthetic
ggaaagaugaagaaactgaagagucaga

SEQ ID NO: 18343 - DNA, 28 bp, Artificial Sequence
  Synthetic
actacaacgaaguatttttgtucccaca

SEQ ID NO: 18344 - DNA, 25 bp, Artificial Sequence
  Synthetic
catgttgcacaaggugaagatgaug

SEQ ID NO: 18345 - DNA, 22 bp, Artificial Sequence
  Synthetic
gttttgcagccauaagtcggut

SEQ ID NO: 18346 - DNA, 31 bp, Artificial Sequence
  Synthetic
acacagaaagauactggagtaaaugaaaagg

SEQ ID NO: 18347 - DNA, 24 bp, Artificial Sequence
  Synthetic
aagcatuaggcacaacauaacaca

SEQ ID NO: 18348 - DNA, 22 bp, Artificial Sequence
  Synthetic
tggguaactgucccaccaaaaa

SEQ ID NO: 18349 - DNA, 29 bp, Artificial Sequence
  Synthetic
caaaagactaacucaggaacaagagagua

SEQ ID NO: 18350 - DNA, 25 bp, Artificial Sequence
  Synthetic
aattgutcggacagaugaagaggag

SEQ ID NO: 18351 - DNA, 26 bp, Artificial Sequence
  Synthetic
acctgagccucttaaatuaagcacaa

SEQ ID NO: 18352 - DNA, 31 bp, Artificial Sequence
  Synthetic
tctttcaatagacuctatcttgtctgcuaca

SEQ ID NO: 18353 - DNA, 26 bp, Artificial Sequence
  Synthetic
gttagctgaguatagcactggtucaa

SEQ ID NO: 18354 - DNA, 30 bp, Artificial Sequence
  Synthetic
ttctcttacccautgcttttactgatuagg

SEQ ID NO: 18355 - DNA, 25 bp, Artificial Sequence
  Synthetic
tttcctgaagaautctgggcuaagg

SEQ ID NO: 18356 - DNA, 28 bp, Artificial Sequence
  Synthetic
caagactggatuttcagtgtctguagaa

SEQ ID NO: 18357 - DNA, 30 bp, Artificial Sequence
  Synthetic
ttgtcttgaatgttutagtcactgttgtug

SEQ ID NO: 18358 - DNA, 26 bp, Artificial Sequence
  Synthetic
ttttactcaaggguatgaaagugcca

SEQ ID NO: 18359 - DNA, 24 bp, Artificial Sequence
  Synthetic
cagttgctcaugattctttcugct

SEQ ID NO: 18360 - DNA, 30 bp, Artificial Sequence
  Synthetic
ccacattttcttautgaactcttccaugag

SEQ ID NO: 18361 - DNA, 26 bp, Artificial Sequence
  Synthetic
tcagtcuaagacaguaaccagagaua

SEQ ID NO: 18362 - DNA, 25 bp, Artificial Sequence
  Synthetic
ttgttccaaaugtagguaacaccgt

SEQ ID NO: 18363 - DNA, 26 bp, Artificial Sequence
  Synthetic
caccatctccaucctcaataatccug

SEQ ID NO: 18364 - DNA, 20 bp, Artificial Sequence
  Synthetic
gctccucgcagcttcuaact

SEQ ID NO: 18365 - DNA, 29 bp, Artificial Sequence
  Synthetic
aaaaacctuaccacacagtacatatuggt

SEQ ID NO: 18366 - DNA, 31 bp, Artificial Sequence
  Synthetic
ctcaaatatttttgtguctaggacaaggaug

SEQ ID NO: 18367 - DNA, 28 bp, Artificial Sequence
  Synthetic
ccttcactttcutcatcttcctctugat

SEQ ID NO: 18368 - DNA, 25 bp, Artificial Sequence
  Synthetic
tgaccatatattucaggccctgcua

SEQ ID NO: 18369 - DNA, 30 bp, Artificial Sequence
  Synthetic
gatttcttactttuactagtggcttcucgt

SEQ ID NO: 18370 - DNA, 22 bp, Artificial Sequence
  Synthetic
tctctggcuggaagtcctgaua

SEQ ID NO: 18371 - DNA, 26 bp, Artificial Sequence
  Synthetic
aaacacaaaauggtttacatguggag

SEQ ID NO: 18372 - DNA, 26 bp, Artificial Sequence
  Synthetic
gcagaccgaagaautagctggaaaut

SEQ ID NO: 18373 - DNA, 23 bp, Artificial Sequence
  Synthetic
ctcccaggucagtagtagcauat

SEQ ID NO: 18374 - DNA, 28 bp, Artificial Sequence
  Synthetic
cagaatcctacugaaaagcttgauggaa

SEQ ID NO: 18375 - DNA, 23 bp, Artificial Sequence
  Synthetic
cacattcttcugtttcccagcuc

SEQ ID NO: 18376 - DNA, 30 bp, Artificial Sequence
  Synthetic
ttgtaactccaucaggtaactctcaattuc

SEQ ID NO: 18377 - DNA, 26 bp, Artificial Sequence
  Synthetic
tcacaacttuacctttgggaaugaca

SEQ ID NO: 18378 - DNA, 28 bp, Artificial Sequence
  Synthetic
caatactgauagaggaagucctttctuc

SEQ ID NO: 18379 - DNA, 23 bp, Artificial Sequence
  Synthetic
gagtgcttcuggagcacctuaaa

SEQ ID NO: 18380 - DNA, 24 bp, Artificial Sequence
  Synthetic
ggctucaaacagccaacauaagag

SEQ ID NO: 18381 - DNA, 23 bp, Artificial Sequence
  Synthetic
cucctactcucacacaggagaga

SEQ ID NO: 18382 - DNA, 21 bp, Artificial Sequence
  Synthetic
acacagcuctccagacuggaa

SEQ ID NO: 18383 - DNA, 25 bp, Artificial Sequence
  Synthetic
gtttttgtggugggctttatgaugt

SEQ ID NO: 18384 - DNA, 22 bp, Artificial Sequence
  Synthetic
tcatctggtucatgctgcucat

SEQ ID NO: 18385 - DNA, 29 bp, Artificial Sequence
  Synthetic
agcaagctgtaacautcattcaatcttuc

SEQ ID NO: 18386 - DNA, 21 bp, Artificial Sequence
  Synthetic
cgagggtugctcatagtugct

SEQ ID NO: 18387 - DNA, 23 bp, Artificial Sequence
  Synthetic
gggaaatccugaaccagcatcut

SEQ ID NO: 18388 - DNA, 21 bp, Artificial Sequence
  Synthetic
ccaggugccaucgaagaacag

SEQ ID NO: 18389 - DNA, 23 bp, Artificial Sequence
  Synthetic
caaactutcacaccaugggacag

SEQ ID NO: 18390 - DNA, 22 bp, Artificial Sequence
  Synthetic
caatctccuccaggccaucaaa

SEQ ID NO: 18391 - DNA, 21 bp, Artificial Sequence
  Synthetic
cttttccatuggcccaaggug

SEQ ID NO: 18392 - DNA, 23 bp, Artificial Sequence
  Synthetic
cgaatcataccuccttggacugg

SEQ ID NO: 18393 - DNA, 24 bp, Artificial Sequence
  Synthetic
tgcatctcucagttttcttuggct

SEQ ID NO: 18394 - DNA, 25 bp, Artificial Sequence
  Synthetic
gaaauttcttggcauaaccagccat

SEQ ID NO: 18395 - DNA, 20 bp, Artificial Sequence
  Synthetic
cccctgcuggatcagtugac

SEQ ID NO: 18396 - DNA, 21 bp, Artificial Sequence
  Synthetic
ggctcaccggcucttgttuaa

SEQ ID NO: 18397 - DNA, 28 bp, Artificial Sequence
  Synthetic
tcaaggagaagcauaaaatttugcacag

SEQ ID NO: 18398 - DNA, 24 bp, Artificial Sequence
  Synthetic
ggcuccccatataguccaaaacag

SEQ ID NO: 18399 - DNA, 23 bp, Artificial Sequence
  Synthetic
ctcattagggucatcgttggcut

SEQ ID NO: 18400 - DNA, 23 bp, Artificial Sequence
  Synthetic
gggctgttcautttgagtgcaua

SEQ ID NO: 18401 - DNA, 31 bp, Artificial Sequence
  Synthetic
acatgaccctcaguagcaatataaatttucc

SEQ ID NO: 18402 - DNA, 23 bp, Artificial Sequence
  Synthetic
gtctgagaacggaugagttugct

SEQ ID NO: 18403 - DNA, 24 bp, Artificial Sequence
  Synthetic
ttctaaacgugccttctgttucct

SEQ ID NO: 18404 - DNA, 28 bp, Artificial Sequence
  Synthetic
cgagtaguaaaactttctgaugagggaa

SEQ ID NO: 18405 - DNA, 25 bp, Artificial Sequence
  Synthetic
ctgtgctgucataaatacactuggg

SEQ ID NO: 18406 - DNA, 24 bp, Artificial Sequence
  Synthetic
ggtttttgacaaautccgtguggt

SEQ ID NO: 18407 - DNA, 22 bp, Artificial Sequence
  Synthetic
ggcccttgaugggttcttctut

SEQ ID NO: 18408 - DNA, 25 bp, Artificial Sequence
  Synthetic
gattaaagggacuctgaagggacut

SEQ ID NO: 18409 - DNA, 31 bp, Artificial Sequence
  Synthetic
aatcttaaaagaaacugtgaagcaaatucgt

SEQ ID NO: 18410 - DNA, 22 bp, Artificial Sequence
  Synthetic
ctttcttguctctgcccuggag

SEQ ID NO: 18411 - DNA, 25 bp, Artificial Sequence
  Synthetic
cagacacttcaucatcagctctcut

SEQ ID NO: 18412 - DNA, 32 bp, Artificial Sequence
  Synthetic
actggtatctcuaaaaacatttcaaacacuga

SEQ ID NO: 18413 - DNA, 30 bp, Artificial Sequence
  Synthetic
attgactgaattuagatcactggtgatuaa

SEQ ID NO: 18414 - DNA, 24 bp, Artificial Sequence
  Synthetic
gccacatcauccatttccctttut

SEQ ID NO: 18415 - DNA, 25 bp, Artificial Sequence
  Synthetic
aggagcagcauctatctgagaauga

SEQ ID NO: 18416 - DNA, 25 bp, Artificial Sequence
  Synthetic
ctgctgagaagcccuatctttacut

SEQ ID NO: 18417 - DNA, 22 bp, Artificial Sequence
  Synthetic
ctttcacaagaugcacccacug

SEQ ID NO: 18418 - DNA, 22 bp, Artificial Sequence
  Synthetic
aatatggucaccccuagcaagt

SEQ ID NO: 18419 - DNA, 26 bp, Artificial Sequence
  Synthetic
gaaattggatuggcggtgatttucat

SEQ ID NO: 18420 - DNA, 30 bp, Artificial Sequence
  Synthetic
agcttataacataatuacctgtttggcaut

SEQ ID NO: 18421 - DNA, 25 bp, Artificial Sequence
  Synthetic
cccacctctugatgaaccatctaut

SEQ ID NO: 18422 - DNA, 30 bp, Artificial Sequence
  Synthetic
ttaacataagaacaagacautcaaccuact

SEQ ID NO: 18423 - DNA, 26 bp, Artificial Sequence
  Synthetic
tttagatgtctcugggaaaactgcut

SEQ ID NO: 18424 - DNA, 28 bp, Artificial Sequence
  Synthetic
agaatattttgtgauttcaaccccctua

SEQ ID NO: 18425 - DNA, 29 bp, Artificial Sequence
  Synthetic
aaaactgtgccautctgattgaaaaugat

SEQ ID NO: 18426 - DNA, 22 bp, Artificial Sequence
  Synthetic
cctccgacagutctgagtucac

SEQ ID NO: 18427 - DNA, 20 bp, Artificial Sequence
  Synthetic
gcagtcagcucctctgucac

SEQ ID NO: 18428 - DNA, 21 bp, Artificial Sequence
  Synthetic
tgatcatgucgtgggcttucc

SEQ ID NO: 18429 - DNA, 22 bp, Artificial Sequence
  Synthetic
tgactucggctaacugagaggt

SEQ ID NO: 18430 - DNA, 25 bp, Artificial Sequence
  Synthetic
ccagtaattcaautcttcccgguct

SEQ ID NO: 18431 - DNA, 23 bp, Artificial Sequence
  Synthetic
tgctcttcccuattctcccctut

SEQ ID NO: 18432 - DNA, 21 bp, Artificial Sequence
  Synthetic
ggtgggcaauggccataucat

SEQ ID NO: 18433 - DNA, 23 bp, Artificial Sequence
  Synthetic
cctttgcacucagaacauccaag

SEQ ID NO: 18434 - DNA, 22 bp, Artificial Sequence
  Synthetic
tcccacccacacuatccctuac

SEQ ID NO: 18435 - DNA, 24 bp, Artificial Sequence
  Synthetic
gctgaaaaggutccttacuaccct

SEQ ID NO: 18436 - DNA, 21 bp, Artificial Sequence
  Synthetic
gtggcattgutggaggaguca

SEQ ID NO: 18437 - DNA, 28 bp, Artificial Sequence
  Synthetic
tgaaaaactgaggugcttaaggaguaaa

SEQ ID NO: 18438 - DNA, 28 bp, Artificial Sequence
  Synthetic
ctattactaaacucagtgctcuccaagt

SEQ ID NO: 18439 - DNA, 24 bp, Artificial Sequence
  Synthetic
gaaaagattgauctctgggcuggt

SEQ ID NO: 18440 - DNA, 29 bp, Artificial Sequence
  Synthetic
actattgttgtguttctttttcccucagt

SEQ ID NO: 18441 - DNA, 22 bp, Artificial Sequence
  Synthetic
cctctcaacagucctgguacct

SEQ ID NO: 18442 - DNA, 20 bp, Artificial Sequence
  Synthetic
gggtuaggcccuacagacaa

SEQ ID NO: 18443 - DNA, 23 bp, Artificial Sequence
  Synthetic
gaagccugaaaagccattgtuca

SEQ ID NO: 18444 - DNA, 28 bp, Artificial Sequence
  Synthetic
tgtgtgtaucacttgagaataugagcag

SEQ ID NO: 18445 - DNA, 24 bp, Artificial Sequence
  Synthetic
ggagtcaacutcccaatuggagaa

SEQ ID NO: 18446 - DNA, 26 bp, Artificial Sequence
  Synthetic
ctccaacaatgucagattgcaaaugt

SEQ ID NO: 18447 - DNA, 28 bp, Artificial Sequence
  Synthetic
gagtcctttgaggautgtgaaattctut

SEQ ID NO: 18448 - DNA, 21 bp, Artificial Sequence
  Synthetic
cctctcgauactccuggcgaa

SEQ ID NO: 18449 - DNA, 24 bp, Artificial Sequence
  Synthetic
aggcucgaaaacgcaagtacttua

SEQ ID NO: 18450 - DNA, 31 bp, Artificial Sequence
  Synthetic
atgaaaaccatuacaaacttctcaagtgtuc

SEQ ID NO: 18451 - DNA, 28 bp, Artificial Sequence
  Synthetic
ggagaaaatccuaattccagttguacct

SEQ ID NO: 18452 - DNA, 30 bp, Artificial Sequence
  Synthetic
acaacattgtagacutttccatgatuacct

SEQ ID NO: 18453 - DNA, 28 bp, Artificial Sequence
  Synthetic
aagtcatgtggautctttgaattttguc

SEQ ID NO: 18454 - DNA, 22 bp, Artificial Sequence
  Synthetic
gaaatttccgaugctgcugaag

SEQ ID NO: 18455 - DNA, 21 bp, Artificial Sequence
  Synthetic
aaggaugggcacggaaaauga

SEQ ID NO: 18456 - DNA, 24 bp, Artificial Sequence
  Synthetic
ccatcctccucctcatcatcauac

SEQ ID NO: 18457 - DNA, 25 bp, Artificial Sequence
  Synthetic
gtctcgagaugcctctgtattucaa

SEQ ID NO: 18458 - DNA, 24 bp, Artificial Sequence
  Synthetic
cttgtgctuggagatgttctuacg

SEQ ID NO: 18459 - DNA, 28 bp, Artificial Sequence
  Synthetic
ggcattttctttcautctggacaacaut

SEQ ID NO: 18460 - DNA, 22 bp, Artificial Sequence
  Synthetic
tgcattgacuggagtguggaaa

SEQ ID NO: 18461 - DNA, 21 bp, Artificial Sequence
  Synthetic
gcgagtuggaaccactgtuca

SEQ ID NO: 18462 - DNA, 24 bp, Artificial Sequence
  Synthetic
catgccccacauttcagtttuagg

SEQ ID NO: 18463 - DNA, 28 bp, Artificial Sequence
  Synthetic
cttuttgatgaaaaacaucgggaagaga

SEQ ID NO: 18464 - DNA, 23 bp, Artificial Sequence
  Synthetic
gtgattgtttccugatgctgcug

SEQ ID NO: 18465 - DNA, 28 bp, Artificial Sequence
  Synthetic
catctcagcugaagatagtgacttugaa

SEQ ID NO: 18466 - DNA, 23 bp, Artificial Sequence
  Synthetic
gcutggcattttucagggaaagg

SEQ ID NO: 18467 - DNA, 23 bp, Artificial Sequence
  Synthetic
gggtgtggugaaggattctccua

SEQ ID NO: 18468 - DNA, 27 bp, Artificial Sequence
  Synthetic
ctcttcttccgutggtaaacgaaaauc

SEQ ID NO: 18469 - DNA, 30 bp, Artificial Sequence
  Synthetic
cacggaggauacgaatggaagatauaaaaa

SEQ ID NO: 18470 - DNA, 24 bp, Artificial Sequence
  Synthetic
gaaaaaggtugttctcaagugcct

SEQ ID NO: 18471 - DNA, 23 bp, Artificial Sequence
  Synthetic
gttggcauggcaaccaagauaaa

SEQ ID NO: 18472 - DNA, 25 bp, Artificial Sequence
  Synthetic
aaagaagggcugccataattccaua

SEQ ID NO: 18473 - DNA, 21 bp, Artificial Sequence
  Synthetic
cagcagaacaugtcucagcca

SEQ ID NO: 18474 - DNA, 22 bp, Artificial Sequence
  Synthetic
cgtccauacaccagatccucat

SEQ ID NO: 18475 - DNA, 29 bp, Artificial Sequence
  Synthetic
tggcttccttcuattaagactaggaaugt

SEQ ID NO: 18476 - DNA, 24 bp, Artificial Sequence
  Synthetic
cacccagcauatcataccacaguc

SEQ ID NO: 18477 - DNA, 26 bp, Artificial Sequence
  Synthetic
ctgatgatgaaaucacgatgatggut

SEQ ID NO: 18478 - DNA, 21 bp, Artificial Sequence
  Synthetic
caacagctuggtggcatcaug

SEQ ID NO: 18479 - DNA, 28 bp, Artificial Sequence
  Synthetic
cctcagagaaaguggatttcagtagtua

SEQ ID NO: 18480 - DNA, 26 bp, Artificial Sequence
  Synthetic
atcttctgtacucctaatccacccut

SEQ ID NO: 18481 - DNA, 22 bp, Artificial Sequence
  Synthetic
gggaaagcgucttggatgauga

SEQ ID NO: 18482 - DNA, 21 bp, Artificial Sequence
  Synthetic
tcatgggcuctctggctauct

SEQ ID NO: 18483 - DNA, 23 bp, Artificial Sequence
  Synthetic
aggctcccccuactattauagcg

SEQ ID NO: 18484 - DNA, 22 bp, Artificial Sequence
  Synthetic
tctucccaccauacactccuat

SEQ ID NO: 18485 - DNA, 21 bp, Artificial Sequence
  Synthetic
gacgacaugaaggccaatcug

SEQ ID NO: 18486 - DNA, 17 bp, Artificial Sequence
  Synthetic
gcgcgggccuctctuac

SEQ ID NO: 18487 - DNA, 17 bp, Artificial Sequence
  Synthetic
accgcccguctttcucc

SEQ ID NO: 18488 - DNA, 22 bp, Artificial Sequence
  Synthetic
cctgatcucccaggcaaacaug

SEQ ID NO: 18489 - DNA, 24 bp, Artificial Sequence
  Synthetic
cctcatggcuaagcttctttcuct

SEQ ID NO: 18490 - DNA, 29 bp, Artificial Sequence
  Synthetic
ccgaggagucggataatttttctcuaaat

SEQ ID NO: 18491 - DNA, 24 bp, Artificial Sequence
  Synthetic
ggcttgaattautccgacctguga

SEQ ID NO: 18492 - DNA, 30 bp, Artificial Sequence
  Synthetic
gtataugagggaaguagaagaagatgtaug

SEQ ID NO: 18493 - DNA, 28 bp, Artificial Sequence
  Synthetic
gagatgaatctuacagtgatgtgtccut

SEQ ID NO: 18494 - DNA, 25 bp, Artificial Sequence
  Synthetic
gcaaaccaggaggcautgattcuaa

SEQ ID NO: 18495 - DNA, 24 bp, Artificial Sequence
  Synthetic
agacaaatgcuatggatgggcuag

SEQ ID NO: 18496 - DNA, 27 bp, Artificial Sequence
  Synthetic
attgaactgaagguagagttgcugaat

SEQ ID NO: 18497 - DNA, 27 bp, Artificial Sequence
  Synthetic
agactacggagutccttttcatcagua

SEQ ID NO: 18498 - DNA, 20 bp, Artificial Sequence
  Synthetic
cacctcagtuggagctgcut

SEQ ID NO: 18499 - DNA, 18 bp, Artificial Sequence
  Synthetic
gactcugcccaggcuacc

SEQ ID NO: 18500 - DNA, 19 bp, Artificial Sequence
  Synthetic
gtggccacaagccutcuct

SEQ ID NO: 18501 - DNA, 20 bp, Artificial Sequence
  Synthetic
acccttcuaacccacccuca

SEQ ID NO: 18502 - DNA, 20 bp, Artificial Sequence
  Synthetic
ggacauccccgtgtcacuac

SEQ ID NO: 18503 - DNA, 23 bp, Artificial Sequence
  Synthetic
tgttcccgttucctcttgatcuc

SEQ ID NO: 18504 - DNA, 21 bp, Artificial Sequence
  Synthetic
cagaagcgaucaggaugacca

SEQ ID NO: 18505 - DNA, 18 bp, Artificial Sequence
  Synthetic
gcccacugaccactgugt

SEQ ID NO: 18506 - DNA, 23 bp, Artificial Sequence
  Synthetic
gacctcccgauaaaacgctacut

SEQ ID NO: 18507 - DNA, 22 bp, Artificial Sequence
  Synthetic
ctacatctaccugacggctugg

SEQ ID NO: 18508 - DNA, 22 bp, Artificial Sequence
  Synthetic
cugttgaagcugaacacgcaaa

SEQ ID NO: 18509 - DNA, 26 bp, Artificial Sequence
  Synthetic
acttacuttacgaccuacacaggagt

SEQ ID NO: 18510 - DNA, 24 bp, Artificial Sequence
  Synthetic
gagcauagtgcttcucagcaaaag

SEQ ID NO: 18511 - DNA, 17 bp, Artificial Sequence
  Synthetic
ctctgugcagcccguca

SEQ ID NO: 18512 - DNA, 23 bp, Artificial Sequence
  Synthetic
tgtcctcgcgucgatataaaucc

SEQ ID NO: 18513 - DNA, 27 bp, Artificial Sequence
  Synthetic
aaaagcatctttautttcgaagcaguc

SEQ ID NO: 18514 - DNA, 18 bp, Artificial Sequence
  Synthetic
ccggguggcatttgucaa

SEQ ID NO: 18515 - DNA, 19 bp, Artificial Sequence
  Synthetic
cctgctggutgcactguca

SEQ ID NO: 18516 - DNA, 26 bp, Artificial Sequence
  Synthetic
tggtgaaaaugaagaattgcauaacc

SEQ ID NO: 18517 - DNA, 22 bp, Artificial Sequence
  Synthetic
gggtacgaguatgtcucacaca

SEQ ID NO: 18518 - DNA, 22 bp, Artificial Sequence
  Synthetic
tgttttgctcuccacccttcug

SEQ ID NO: 18519 - DNA, 24 bp, Artificial Sequence
  Synthetic
gctgggaggaaaugctgaauaagg

SEQ ID NO: 18520 - DNA, 32 bp, Artificial Sequence
  Synthetic
caagaagaaaatauacctgatccatguaacct

SEQ ID NO: 18521 - DNA, 32 bp, Artificial Sequence
  Synthetic
cttattacagtgagaaauttttgtctctgcut

SEQ ID NO: 18522 - DNA, 18 bp, Artificial Sequence
  Synthetic
ggccggugcagatagucc

SEQ ID NO: 18523 - DNA, 17 bp, Artificial Sequence
  Synthetic
catggccucggctggua

SEQ ID NO: 18524 - DNA, 23 bp, Artificial Sequence
  Synthetic
ccctgcttgutaaagaaaggcut

SEQ ID NO: 18525 - DNA, 29 bp, Artificial Sequence
  Synthetic
acttcacatttccuttgacatctttcuct

SEQ ID NO: 18526 - DNA, 22 bp, Artificial Sequence
  Synthetic
tcgagcaacuacgaacucaagc

SEQ ID NO: 18527 - DNA, 20 bp, Artificial Sequence
  Synthetic
tggaggcuggaggaauggat

SEQ ID NO: 18528 - DNA, 20 bp, Artificial Sequence
  Synthetic
cttcccgcucttccactuca

SEQ ID NO: 18529 - DNA, 19 bp, Artificial Sequence
  Synthetic
cgtacggguggctcucaag

SEQ ID NO: 18530 - DNA, 17 bp, Artificial Sequence
  Synthetic
acuacggcgugcgaacc

SEQ ID NO: 18531 - DNA, 22 bp, Artificial Sequence
  Synthetic
gggaagaacaaggaugctccua

SEQ ID NO: 18532 - DNA, 25 bp, Artificial Sequence
  Synthetic
gcatcagttguccgtacagataguc

SEQ ID NO: 18533 - DNA, 24 bp, Artificial Sequence
  Synthetic
tgggtgttgaguctgttaaagcuc

SEQ ID NO: 18534 - DNA, 23 bp, Artificial Sequence
  Synthetic
guatccagaagcugggcagaaaa

SEQ ID NO: 18535 - DNA, 24 bp, Artificial Sequence
  Synthetic
aggttucaggcttctucaaaggac

SEQ ID NO: 18536 - DNA, 25 bp, Artificial Sequence
  Synthetic
ctatgcaacaagaucacaagcagut

SEQ ID NO: 18537 - DNA, 22 bp, Artificial Sequence
  Synthetic
gtggagacaccaaguctuccag

SEQ ID NO: 18538 - DNA, 21 bp, Artificial Sequence
  Synthetic
cagaatgucaacagcgcctut

SEQ ID NO: 18539 - DNA, 21 bp, Artificial Sequence
  Synthetic
cgtttgtugcaggctttgcuc

SEQ ID NO: 18540 - DNA, 23 bp, Artificial Sequence
  Synthetic
aagccaugaggaatgtcactugt

SEQ ID NO: 18541 - DNA, 31 bp, Artificial Sequence
  Synthetic
cattgagtataaacagugattttcagcctut

SEQ ID NO: 18542 - DNA, 28 bp, Artificial Sequence
  Synthetic
gaaatataacaaacuccgccaaccatut

SEQ ID NO: 18543 - DNA, 25 bp, Artificial Sequence
  Synthetic
aagcttccuccattcuaacaaacac

SEQ ID NO: 18544 - DNA, 24 bp, Artificial Sequence
  Synthetic
aggaaccagagagcutcttuacct

SEQ ID NO: 18545 - DNA, 27 bp, Artificial Sequence
  Synthetic
cattttuaaacaaccgagacaagucca

SEQ ID NO: 18546 - DNA, 21 bp, Artificial Sequence
  Synthetic
gggaggaaguttgctgucgag

SEQ ID NO: 18547 - DNA, 19 bp, Artificial Sequence
  Synthetic
ggccccggutagtctcuga

SEQ ID NO: 18548 - DNA, 24 bp, Artificial Sequence
  Synthetic
cacatcgaacuggatagaggtugt

SEQ ID NO: 18549 - DNA, 24 bp, Artificial Sequence
  Synthetic
gcagagagugtgaggttaucacag

SEQ ID NO: 18550 - DNA, 23 bp, Artificial Sequence
  Synthetic
agtattgctgucctgcaagucac

SEQ ID NO: 18551 - DNA, 28 bp, Artificial Sequence
  Synthetic
acacaaaaagctauccactttcactuct

SEQ ID NO: 18552 - DNA, 26 bp, Artificial Sequence
  Synthetic
ggctattccaaacauaagctgcttut

SEQ ID NO: 18553 - DNA, 20 bp, Artificial Sequence
  Synthetic
gcagcagcauacactauggc

SEQ ID NO: 18554 - DNA, 29 bp, Artificial Sequence
  Synthetic
ccaggttagctuagaactattgctgtaut

SEQ ID NO: 18555 - DNA, 28 bp, Artificial Sequence
  Synthetic
aagagatttaccugatcactttgucgag

SEQ ID NO: 18556 - DNA, 29 bp, Artificial Sequence
  Synthetic
cagatggtgtgcuttgtccattttataug

SEQ ID NO: 18557 - DNA, 21 bp, Artificial Sequence
  Synthetic
tcttgugcaagcccatgguat

SEQ ID NO: 18558 - DNA, 23 bp, Artificial Sequence
  Synthetic
gcccatcaaccutctcttttgut

SEQ ID NO: 18559 - DNA, 26 bp, Artificial Sequence
  Synthetic
gctatattuggagcagacacactugg

SEQ ID NO: 18560 - DNA, 29 bp, Artificial Sequence
  Synthetic
agatttggagaaaggauauttgtgauagg

SEQ ID NO: 18561 - DNA, 24 bp, Artificial Sequence
  Synthetic
gauttctgtaccatugagggcact

SEQ ID NO: 18562 - DNA, 21 bp, Artificial Sequence
  Synthetic
gtttccaagugggcacttcug

SEQ ID NO: 18563 - DNA, 25 bp, Artificial Sequence
  Synthetic
aaccccauggagtacuaggagaaaa

SEQ ID NO: 18564 - DNA, 24 bp, Artificial Sequence
  Synthetic
ttcttataggaaautcggcgccut

SEQ ID NO: 18565 - DNA, 27 bp, Artificial Sequence
  Synthetic
cagatgagagauctcattcaccttugt

SEQ ID NO: 18566 - DNA, 24 bp, Artificial Sequence
  Synthetic
tgcatcctucccagtctttuaact

SEQ ID NO: 18567 - DNA, 22 bp, Artificial Sequence
  Synthetic
ctcagttgugcctgtttcaugg

SEQ ID NO: 18568 - DNA, 20 bp, Artificial Sequence
  Synthetic
gttcgcacuccttccaucca

SEQ ID NO: 18569 - DNA, 29 bp, Artificial Sequence
  Synthetic
tccgtcattagutagaaacatcauaggga

SEQ ID NO: 18570 - DNA, 24 bp, Artificial Sequence
  Synthetic
catgcctttcuctgagtgtaugct

SEQ ID NO: 18571 - DNA, 25 bp, Artificial Sequence
  Synthetic
aaatcagtaagutacctgctuggct

SEQ ID NO: 18572 - DNA, 22 bp, Artificial Sequence
  Synthetic
agagggcaauattgtgcctugg

SEQ ID NO: 18573 - DNA, 28 bp, Artificial Sequence
  Synthetic
agtaatgctacucaacacagagtctgua

SEQ ID NO: 18574 - DNA, 23 bp, Artificial Sequence
  Synthetic
tgtttccaagutctttggcugga

SEQ ID NO: 18575 - DNA, 24 bp, Artificial Sequence
  Synthetic
tcttggttggcugggtactagtua

SEQ ID NO: 18576 - DNA, 22 bp, Artificial Sequence
  Synthetic
actcccctuccaacatcatucc

SEQ ID NO: 18577 - DNA, 22 bp, Artificial Sequence
  Synthetic
gatgcugagacctcactgucac

SEQ ID NO: 18578 - DNA, 22 bp, Artificial Sequence
  Synthetic
ccacctgctucctccttttcug

SEQ ID NO: 18579 - DNA, 20 bp, Artificial Sequence
  Synthetic
gagcaacaauggacgtggug

SEQ ID NO: 18580 - DNA, 22 bp, Artificial Sequence
  Synthetic
tttagcagcccagcutttggua

SEQ ID NO: 18581 - DNA, 20 bp, Artificial Sequence
  Synthetic
ggaacugaacccaggcugac

SEQ ID NO: 18582 - DNA, 30 bp, Artificial Sequence
  Synthetic
gttgtaaaagacucatccaatccaaatuga

SEQ ID NO: 18583 - DNA, 28 bp, Artificial Sequence
  Synthetic
gttgacgtgaaugaagacaaatgcauat

SEQ ID NO: 18584 - DNA, 21 bp, Artificial Sequence
  Synthetic
gcacuttcagctcuggaggag

SEQ ID NO: 18585 - DNA, 28 bp, Artificial Sequence
  Synthetic
actctcttaagauaaccacccuagagat

SEQ ID NO: 18586 - DNA, 23 bp, Artificial Sequence
  Synthetic
tcccaacagacutctggtttugg

SEQ ID NO: 18587 - DNA, 29 bp, Artificial Sequence
  Synthetic
aatactaaacagacuggtcagguaaaaca

SEQ ID NO: 18588 - DNA, 28 bp, Artificial Sequence
  Synthetic
aaacatgtgtttuaaaaaggctcctcug

SEQ ID NO: 18589 - DNA, 19 bp, Artificial Sequence
  Synthetic
ccagcaugcagucccagat

SEQ ID NO: 18590 - DNA, 17 bp, Artificial Sequence
  Synthetic
gaactgggcugcgguca

SEQ ID NO: 18591 - DNA, 17 bp, Artificial Sequence
  Synthetic
gccggagcutccugagt

SEQ ID NO: 18592 - DNA, 22 bp, Artificial Sequence
  Synthetic
gtagcucatcatcugggacagg

SEQ ID NO: 18593 - DNA, 21 bp, Artificial Sequence
  Synthetic
catggugccgaaccaauacaa

SEQ ID NO: 18594 - DNA, 18 bp, Artificial Sequence
  Synthetic
catcccaggcagguggut

SEQ ID NO: 18595 - DNA, 17 bp, Artificial Sequence
  Synthetic
agctccggcaugctcuc

SEQ ID NO: 18596 - DNA, 19 bp, Artificial Sequence
  Synthetic
tgcgcaccaggutgtacuc

SEQ ID NO: 18597 - DNA, 17 bp, Artificial Sequence
  Synthetic
ccaaggugctgcuggac

SEQ ID NO: 18598 - DNA, 21 bp, Artificial Sequence
  Synthetic
gttgaugaggtccuccagcat

SEQ ID NO: 18599 - DNA, 19 bp, Artificial Sequence
  Synthetic
ggaggcaucggtgtacguc

SEQ ID NO: 18600 - DNA, 19 bp, Artificial Sequence
  Synthetic
tgcggtcugtctggttgug

SEQ ID NO: 18601 - DNA, 18 bp, Artificial Sequence
  Synthetic
cacccgtcuctgcctcug

SEQ ID NO: 18602 - DNA, 21 bp, Artificial Sequence
  Synthetic
cgacucacccggaacttctug

SEQ ID NO: 18603 - DNA, 19 bp, Artificial Sequence
  Synthetic
tcctagggagcucgcucag

SEQ ID NO: 18604 - DNA, 17 bp, Artificial Sequence
  Synthetic
ctcugcacggccucgat

SEQ ID NO: 18605 - DNA, 19 bp, Artificial Sequence
  Synthetic
cuctctgattguccgccca

SEQ ID NO: 18606 - DNA, 21 bp, Artificial Sequence
  Synthetic
ggccacauccaagttcagguc

SEQ ID NO: 18607 - DNA, 20 bp, Artificial Sequence
  Synthetic
cagtctcugcagtgcuggaa

SEQ ID NO: 18608 - DNA, 19 bp, Artificial Sequence
  Synthetic
aggtccccuggttguagca

SEQ ID NO: 18609 - DNA, 17 bp, Artificial Sequence
  Synthetic
ggcggcacaugcatcuc

SEQ ID NO: 18610 - DNA, 17 bp, Artificial Sequence
  Synthetic
tcatugacgcgcugcac

SEQ ID NO: 18611 - DNA, 22 bp, Artificial Sequence
  Synthetic
gagccccaagugcttuaacaac

SEQ ID NO: 18612 - DNA, 21 bp, Artificial Sequence
  Synthetic
gccacaacccutacccuagga

SEQ ID NO: 18613 - DNA, 21 bp, Artificial Sequence
  Synthetic
ctacacaggcagcuactguga

SEQ ID NO: 18614 - DNA, 17 bp, Artificial Sequence
  Synthetic
cctucgggcacctcugt

SEQ ID NO: 18615 - DNA, 18 bp, Artificial Sequence
  Synthetic
gctucacgggcagcuact

SEQ ID NO: 18616 - DNA, 23 bp, Artificial Sequence
  Synthetic
cgttgaugtcctccucacagaaa

SEQ ID NO: 18617 - DNA, 19 bp, Artificial Sequence
  Synthetic
ctcacacucaccctuccgt

SEQ ID NO: 18618 - DNA, 17 bp, Artificial Sequence
  Synthetic
ccgccccucccacauag

SEQ ID NO: 18619 - DNA, 19 bp, Artificial Sequence
  Synthetic
gucccaacugccagaccaa

SEQ ID NO: 18620 - DNA, 22 bp, Artificial Sequence
  Synthetic
gggtttaggacugatgtguccc

SEQ ID NO: 18621 - DNA, 20 bp, Artificial Sequence
  Synthetic
ggacggcaucaatggctuca

SEQ ID NO: 18622 - DNA, 20 bp, Artificial Sequence
  Synthetic
gaagcagagguaggcgtugt

SEQ ID NO: 18623 - DNA, 19 bp, Artificial Sequence
  Synthetic
ccacuacggctccugcaag

SEQ ID NO: 18624 - DNA, 19 bp, Artificial Sequence
  Synthetic
ccagccucgactcggttuc

SEQ ID NO: 18625 - DNA, 18 bp, Artificial Sequence
  Synthetic
ccccgaugcgagaucgac

SEQ ID NO: 18626 - DNA, 17 bp, Artificial Sequence
  Synthetic
gggccucaaggcacuca

SEQ ID NO: 18627 - DNA, 18 bp, Artificial Sequence
  Synthetic
gtcaacggcuggacuggt

SEQ ID NO: 18628 - DNA, 17 bp, Artificial Sequence
  Synthetic
ggcacacucgtggguga

SEQ ID NO: 18629 - DNA, 19 bp, Artificial Sequence
  Synthetic
acaacgaggucggctccua

SEQ ID NO: 18630 - DNA, 19 bp, Artificial Sequence
  Synthetic
gtgaggcaggcautgucca

SEQ ID NO: 18631 - DNA, 17 bp, Artificial Sequence
  Synthetic
cucagcacccccugcaa

SEQ ID NO: 18632 - DNA, 28 bp, Artificial Sequence
  Synthetic
tcatccaaggtuttcatcttgacttugt

SEQ ID NO: 18633 - DNA, 28 bp, Artificial Sequence
  Synthetic
tgacatgcauggagatagtattaaugcc

SEQ ID NO: 18634 - DNA, 23 bp, Artificial Sequence
  Synthetic
ctggaatgtcutagaagccguga

SEQ ID NO: 18635 - DNA, 23 bp, Artificial Sequence
  Synthetic
aggaagauactctcuggcaacca

SEQ ID NO: 18636 - DNA, 31 bp, Artificial Sequence
  Synthetic
tttttggcagcauagcataaataacatgaut

SEQ ID NO: 18637 - DNA, 21 bp, Artificial Sequence
  Synthetic
acctgctcuggcatggagaua

SEQ ID NO: 18638 - DNA, 27 bp, Artificial Sequence
  Synthetic
caaagcagucataattgttcuggcaaa

SEQ ID NO: 18639 - DNA, 30 bp, Artificial Sequence
  Synthetic
gaatggctgtuacacttttgataactugat

SEQ ID NO: 18640 - DNA, 20 bp, Artificial Sequence
  Synthetic
acctgggcaauctgaagugc

SEQ ID NO: 18641 - DNA, 20 bp, Artificial Sequence
  Synthetic
ggctcugcacacctcctcua

SEQ ID NO: 18642 - DNA, 23 bp, Artificial Sequence
  Synthetic
tcauaaagaacagccccttgucg

SEQ ID NO: 18643 - DNA, 23 bp, Artificial Sequence
  Synthetic
cccagucagctgtgtuaaaggaa

SEQ ID NO: 18644 - DNA, 17 bp, Artificial Sequence
  Synthetic
ggcaagugaggguggga

SEQ ID NO: 18645 - DNA, 27 bp, Artificial Sequence
  Synthetic
aactactagaauccacatgggatcuga

SEQ ID NO: 18646 - DNA, 25 bp, Artificial Sequence
  Synthetic
caaaggaccaaugactctgttucct

SEQ ID NO: 18647 - DNA, 26 bp, Artificial Sequence
  Synthetic
ttgtctttcguagttggctgttttuc

SEQ ID NO: 18648 - DNA, 22 bp, Artificial Sequence
  Synthetic
cccagaguccttaaccugcaat

SEQ ID NO: 18649 - DNA, 29 bp, Artificial Sequence
  Synthetic
cacaatcatgttgcutttctaaaccctua

SEQ ID NO: 18650 - DNA, 22 bp, Artificial Sequence
  Synthetic
cgctgtggugaaggactatuct

SEQ ID NO: 18651 - DNA, 25 bp, Artificial Sequence
  Synthetic
ggtttcctugagaggtaacttuggg

SEQ ID NO: 18652 - DNA, 22 bp, Artificial Sequence
  Synthetic
catcaagaggccutcgaagcua

SEQ ID NO: 18653 - DNA, 19 bp, Artificial Sequence
  Synthetic
gccucaccatgaacugggt

SEQ ID NO: 18654 - DNA, 25 bp, Artificial Sequence
  Synthetic
gggtgctauacagattttgccttug

SEQ ID NO: 18655 - DNA, 24 bp, Artificial Sequence
  Synthetic
ctaatgggaaccccugagtgtuag

SEQ ID NO: 18656 - DNA, 26 bp, Artificial Sequence
  Synthetic
gaaugcacttacugcaagaacagaaa

SEQ ID NO: 18657 - DNA, 25 bp, Artificial Sequence
  Synthetic
tcactataccaagugtcagctguct

SEQ ID NO: 18658 - DNA, 28 bp, Artificial Sequence
  Synthetic
acaagaaacgaaccaaauctccaaaaut

SEQ ID NO: 18659 - DNA, 28 bp, Artificial Sequence
  Synthetic
tccaatgtctugccgaattcttcaauat

SEQ ID NO: 18660 - DNA, 27 bp, Artificial Sequence
  Synthetic
ggtgaucaaccaaaaactccugagaat

SEQ ID NO: 18661 - DNA, 22 bp, Artificial Sequence
  Synthetic
gagttgagucagggcctctaug

SEQ ID NO: 18662 - DNA, 28 bp, Artificial Sequence
  Synthetic
ctcacataucaactcagctacuaaccaa

SEQ ID NO: 18663 - DNA, 28 bp, Artificial Sequence
  Synthetic
gcaaatcatuggaacaattgucaagagt

SEQ ID NO: 18664 - DNA, 27 bp, Artificial Sequence
  Synthetic
cagttgacacaacutgcttcgataaut

SEQ ID NO: 18665 - DNA, 25 bp, Artificial Sequence
  Synthetic
tgtgtacactugaaggtggtttcug

SEQ ID NO: 18666 - DNA, 24 bp, Artificial Sequence
  Synthetic
gctcaaacgagguccattaugcaa

SEQ ID NO: 18667 - DNA, 29 bp, Artificial Sequence
  Synthetic
tccgttttaagaugaaataagctgaguga

SEQ ID NO: 18668 - DNA, 27 bp, Artificial Sequence
  Synthetic
gguttctaccaaaagugaagaggaagt

SEQ ID NO: 18669 - DNA, 29 bp, Artificial Sequence
  Synthetic
ggtgggcagtucagaatctttagttauag

SEQ ID NO: 18670 - DNA, 28 bp, Artificial Sequence
  Synthetic
gtcaaaaaggaaaugcaauaaggauaga

SEQ ID NO: 18671 - DNA, 26 bp, Artificial Sequence
  Synthetic
atcagctcuggaataacaagctucaa

SEQ ID NO: 18672 - DNA, 28 bp, Artificial Sequence
  Synthetic
ctctctgagguattgtaatgcttcauca

SEQ ID NO: 18673 - DNA, 25 bp, Artificial Sequence
  Synthetic
acuccaugaacagucaaaagagaat

SEQ ID NO: 18674 - DNA, 21 bp, Artificial Sequence
  Synthetic
caaggaaggucgtcccttcuc

SEQ ID NO: 18675 - DNA, 25 bp, Artificial Sequence
  Synthetic
gactgcagccuaagcatatagugat

SEQ ID NO: 18676 - DNA, 24 bp, Artificial Sequence
  Synthetic
cccgaaucaagcggaagaauaact

SEQ ID NO: 18677 - DNA, 26 bp, Artificial Sequence
  Synthetic
aagtccaaacacauctatccaucaaa

SEQ ID NO: 18678 - DNA, 20 bp, Artificial Sequence
  Synthetic
ctgtacgaugcctucgggaa

SEQ ID NO: 18679 - DNA, 20 bp, Artificial Sequence
  Synthetic
gctcagucacaccaguggaa

SEQ ID NO: 18680 - DNA, 20 bp, Artificial Sequence
  Synthetic
cacgcuaccactcctgtuga

SEQ ID NO: 18681 - DNA, 29 bp, Artificial Sequence
  Synthetic
agcttctttagccucaaacttaatctugt

SEQ ID NO: 18682 - DNA, 21 bp, Artificial Sequence
  Synthetic
ggccctauaaccattggguct

SEQ ID NO: 18683 - DNA, 28 bp, Artificial Sequence
  Synthetic
cagacttgaaaugggtgagatgaagaua

SEQ ID NO: 18684 - DNA, 21 bp, Artificial Sequence
  Synthetic
ggagcacauccccaaaaucca

SEQ ID NO: 18685 - DNA, 22 bp, Artificial Sequence
  Synthetic
gaggugaccttcauccaagcat

SEQ ID NO: 18686 - DNA, 23 bp, Artificial Sequence
  Synthetic
gagtttacccaggcugagtacug

SEQ ID NO: 18687 - DNA, 20 bp, Artificial Sequence
  Synthetic
cacaagaugacggcctccut

SEQ ID NO: 18688 - DNA, 22 bp, Artificial Sequence
  Synthetic
gtttgatuggaggactcugcct

SEQ ID NO: 18689 - DNA, 22 bp, Artificial Sequence
  Synthetic
agtacagcutcagcacugacac

SEQ ID NO: 18690 - DNA, 19 bp, Artificial Sequence
  Synthetic
ttcacagagggugcaggug

SEQ ID NO: 18691 - DNA, 18 bp, Artificial Sequence
  Synthetic
gcacgcucagagugcaag

SEQ ID NO: 18692 - DNA, 20 bp, Artificial Sequence
  Synthetic
ggucacgcagagcccatuag

SEQ ID NO: 18693 - DNA, 18 bp, Artificial Sequence
  Synthetic
cgccgccguaagtguagg

SEQ ID NO: 18694 - DNA, 21 bp, Artificial Sequence
  Synthetic
cagatcugcgagcuggagaag

SEQ ID NO: 18695 - DNA, 20 bp, Artificial Sequence
  Synthetic
cgcttgcucacctccactut

SEQ ID NO: 18696 - DNA, 18 bp, Artificial Sequence
  Synthetic
cactagcgucacgucggt

SEQ ID NO: 18697 - DNA, 18 bp, Artificial Sequence
  Synthetic
ccctccugggtgcaguct

SEQ ID NO: 18698 - DNA, 21 bp, Artificial Sequence
  Synthetic
acctccccuagtccuaaagcg

SEQ ID NO: 18699 - DNA, 22 bp, Artificial Sequence
  Synthetic
ccattccacacccuccctttug

SEQ ID NO: 18700 - DNA, 23 bp, Artificial Sequence
  Synthetic
ggtgccucaggaagaaagaacug

SEQ ID NO: 18701 - DNA, 27 bp, Artificial Sequence
  Synthetic
cgctgcctcugaagtttttgtatcaua

SEQ ID NO: 18702 - DNA, 28 bp, Artificial Sequence
  Synthetic
cttggctattgcaucatctcaactaauc

SEQ ID NO: 18703 - DNA, 20 bp, Artificial Sequence
  Synthetic
aaagtgggcuccagtcucac

SEQ ID NO: 18704 - DNA, 23 bp, Artificial Sequence
  Synthetic
tguttctgcaacugaaacgcaag

SEQ ID NO: 18705 - DNA, 26 bp, Artificial Sequence
  Synthetic
catctagctctugggaccttcttcua

SEQ ID NO: 18706 - DNA, 17 bp, Artificial Sequence
  Synthetic
gccccaugggctgcuac

SEQ ID NO: 18707 - DNA, 17 bp, Artificial Sequence
  Synthetic
gtgccccggaguccaua

SEQ ID NO: 18708 - DNA, 28 bp, Artificial Sequence
  Synthetic
tcattgagcagauagtctatgtcaucca

SEQ ID NO: 18709 - DNA, 20 bp, Artificial Sequence
  Synthetic
gagacccacutgcctuccaa

SEQ ID NO: 18710 - DNA, 21 bp, Artificial Sequence
  Synthetic
ggacgaacagccutgcatcua

SEQ ID NO: 18711 - DNA, 20 bp, Artificial Sequence
  Synthetic
gttgacaccacagcaugguc

SEQ ID NO: 18712 - DNA, 26 bp, Artificial Sequence
  Synthetic
aguatctggactuaaagacacaggct

SEQ ID NO: 18713 - DNA, 21 bp, Artificial Sequence
  Synthetic
gggatgccugatgcttcucac

SEQ ID NO: 18714 - DNA, 22 bp, Artificial Sequence
  Synthetic
ccattccugtccccattuaccc

SEQ ID NO: 18715 - DNA, 18 bp, Artificial Sequence
  Synthetic
gtcagugcaccugaggct

SEQ ID NO: 18716 - DNA, 18 bp, Artificial Sequence
  Synthetic
ggccttcgcutcgctcut

SEQ ID NO: 18717 - DNA, 20 bp, Artificial Sequence
  Synthetic
ggcgctutaacccttuccag

SEQ ID NO: 18718 - DNA, 25 bp, Artificial Sequence
  Synthetic
gccttgaacaaugaggatccttgua

SEQ ID NO: 18719 - DNA, 20 bp, Artificial Sequence
  Synthetic
catctgtgggucctctguca

SEQ ID NO: 18720 - DNA, 20 bp, Artificial Sequence
  Synthetic
caccttgggucaccagtuct

SEQ ID NO: 18721 - DNA, 20 bp, Artificial Sequence
  Synthetic
ggtcaucccaggcacactug

SEQ ID NO: 18722 - DNA, 19 bp, Artificial Sequence
  Synthetic
cggccaucattccccauga

SEQ ID NO: 18723 - DNA, 17 bp, Artificial Sequence
  Synthetic
gctgagcugggtgcugt

SEQ ID NO: 18724 - DNA, 21 bp, Artificial Sequence
  Synthetic
agaccacggugtattctgcua

SEQ ID NO: 18725 - DNA, 20 bp, Artificial Sequence
  Synthetic
gactgucgaacaccacguca

SEQ ID NO: 18726 - DNA, 20 bp, Artificial Sequence
  Synthetic
aacaaguggaggatgcugct

SEQ ID NO: 18727 - DNA, 18 bp, Artificial Sequence
  Synthetic
gctgtugggagcctguga

SEQ ID NO: 18728 - DNA, 24 bp, Artificial Sequence
  Synthetic
cagaaagagugaggaggtuagagg

SEQ ID NO: 18729 - DNA, 29 bp, Artificial Sequence
  Synthetic
gattaattggctuctctgcttctttguag

SEQ ID NO: 18730 - DNA, 21 bp, Artificial Sequence
  Synthetic
ggttccagugctcagcctuaa

SEQ ID NO: 18731 - DNA, 22 bp, Artificial Sequence
  Synthetic
gttggagaccccugaatctugg

SEQ ID NO: 18732 - DNA, 21 bp, Artificial Sequence
  Synthetic
gctcauggagcactcaaguga

SEQ ID NO: 18733 - DNA, 22 bp, Artificial Sequence
  Synthetic
cttcgtatcuggagggttcugg

SEQ ID NO: 18734 - DNA, 22 bp, Artificial Sequence
  Synthetic
cctcaaccucaaaccagctuca

SEQ ID NO: 18735 - DNA, 20 bp, Artificial Sequence
  Synthetic
tcaccaugcagttgguggac

SEQ ID NO: 18736 - DNA, 28 bp, Artificial Sequence
  Synthetic
cttcgctccagaauttgaatgtatucac

SEQ ID NO: 18737 - DNA, 28 bp, Artificial Sequence
  Synthetic
tgaagttgttguaagactttgtctcgua

SEQ ID NO: 18738 - DNA, 26 bp, Artificial Sequence
  Synthetic
ttcacctatcaugttgcctttcucaa

SEQ ID NO: 18739 - DNA, 25 bp, Artificial Sequence
  Synthetic
cccaactggacucttgctaatagug

SEQ ID NO: 18740 - DNA, 28 bp, Artificial Sequence
  Synthetic
tgggtuagaagaagaaaagugaaaagca

SEQ ID NO: 18741 - DNA, 21 bp, Artificial Sequence
  Synthetic
cctgcctuccaaagcagauac

SEQ ID NO: 18742 - DNA, 17 bp, Artificial Sequence
  Synthetic
cctcacgcccuccctug

SEQ ID NO: 18743 - DNA, 24 bp, Artificial Sequence
  Synthetic
acctccaccucagguagagaaaaa

SEQ ID NO: 18744 - DNA, 28 bp, Artificial Sequence
  Synthetic
gacuatacctuaaacacucaagaaccag

SEQ ID NO: 18745 - DNA, 23 bp, Artificial Sequence
  Synthetic
ggatggagttuggccaacagaua

SEQ ID NO: 18746 - DNA, 29 bp, Artificial Sequence
  Synthetic
atgtaggaaaaugaagattcagctaucaa

SEQ ID NO: 18747 - DNA, 25 bp, Artificial Sequence
  Synthetic
aggagagtgcautgtctctgattuc

SEQ ID NO: 18748 - DNA, 25 bp, Artificial Sequence
  Synthetic
gctgtgtttatutccagcacttuct

SEQ ID NO: 18749 - DNA, 27 bp, Artificial Sequence
  Synthetic
tcctttgcagauttagtttccuaagca

SEQ ID NO: 18750 - DNA, 23 bp, Artificial Sequence
  Synthetic
ggctgtgccugttgtttguaaag

SEQ ID NO: 18751 - DNA, 30 bp, Artificial Sequence
  Synthetic
ccttgatgctttugtttttcagagatugaa

SEQ ID NO: 18752 - DNA, 28 bp, Artificial Sequence
  Synthetic
aaaagccttctaaagugactgacactua

SEQ ID NO: 18753 - DNA, 23 bp, Artificial Sequence
  Synthetic
gacaggcauctttgttugggaac

SEQ ID NO: 18754 - DNA, 23 bp, Artificial Sequence
  Synthetic
gttgtaccaaaugaaggugcact

SEQ ID NO: 18755 - DNA, 20 bp, Artificial Sequence
  Synthetic
accccauacccaacccagua

SEQ ID NO: 18756 - DNA, 22 bp, Artificial Sequence
  Synthetic
ggtttgcugaagaggctgguag

SEQ ID NO: 18757 - DNA, 27 bp, Artificial Sequence
  Synthetic
caacaactggauaatggaaggtttugt

SEQ ID NO: 18758 - DNA, 26 bp, Artificial Sequence
  Synthetic
cactggtgcutggtacttatgtuagt

SEQ ID NO: 18759 - DNA, 25 bp, Artificial Sequence
  Synthetic
gggactagtuttagagttcaguggt

SEQ ID NO: 18760 - DNA, 22 bp, Artificial Sequence
  Synthetic
tgagaagagacuggtccctgug

SEQ ID NO: 18761 - DNA, 28 bp, Artificial Sequence
  Synthetic
gtacttaactttutccctccttcuccat

SEQ ID NO: 18762 - DNA, 28 bp, Artificial Sequence
  Synthetic
cttactctgtccaaaugttgaagttgug

SEQ ID NO: 18763 - DNA, 30 bp, Artificial Sequence
  Synthetic
attccattttgtgguctttaagagagugat

SEQ ID NO: 18764 - DNA, 27 bp, Artificial Sequence
  Synthetic
tctcttttatuagacacagccttcuca

SEQ ID NO: 18765 - DNA, 24 bp, Artificial Sequence
  Synthetic
ctcgttaaucaggcggtcauagag

SEQ ID NO: 18766 - DNA, 24 bp, Artificial Sequence
  Synthetic
agtacctcttugaaaagccacgut

SEQ ID NO: 18767 - DNA, 23 bp, Artificial Sequence
  Synthetic
ggttatguccatcactugaggca

SEQ ID NO: 18768 - DNA, 19 bp, Artificial Sequence
  Synthetic
gggttccacugcgagtgut

SEQ ID NO: 18769 - DNA, 20 bp, Artificial Sequence
  Synthetic
ggtcugacagcccttcctug

SEQ ID NO: 18770 - DNA, 17 bp, Artificial Sequence
  Synthetic
ggtggugatgccagugc

SEQ ID NO: 18771 - DNA, 20 bp, Artificial Sequence
  Synthetic
tccacugaccacctctucca

SEQ ID NO: 18772 - DNA, 22 bp, Artificial Sequence
  Synthetic
agutgccataaucgggagaacc

SEQ ID NO: 18773 - DNA, 24 bp, Artificial Sequence
  Synthetic
cactgcaacagautcactctguct

SEQ ID NO: 18774 - DNA, 22 bp, Artificial Sequence
  Synthetic
cctgauaaacagcaggcacucc

SEQ ID NO: 18775 - DNA, 23 bp, Artificial Sequence
  Synthetic
actgatgcttuaaagagccguga

SEQ ID NO: 18776 - DNA, 25 bp, Artificial Sequence
  Synthetic
tcttggcaucataatgtgtttuggc

SEQ ID NO: 18777 - DNA, 22 bp, Artificial Sequence
  Synthetic
tgagcactauaagctgcaggua

SEQ ID NO: 18778 - DNA, 21 bp, Artificial Sequence
  Synthetic
tcaugcaccaagactggucac

SEQ ID NO: 18779 - DNA, 23 bp, Artificial Sequence
  Synthetic
cttctttggccucatctcacuct

SEQ ID NO: 18780 - DNA, 19 bp, Artificial Sequence
  Synthetic
gctctgcauagctggccut

SEQ ID NO: 18781 - DNA, 17 bp, Artificial Sequence
  Synthetic
gccaccgugaggagcug

SEQ ID NO: 18782 - DNA, 20 bp, Artificial Sequence
  Synthetic
cgctgtttcucagcctccuc

SEQ ID NO: 18783 - DNA, 19 bp, Artificial Sequence
  Synthetic
agtugaagcggctggugat

SEQ ID NO: 18784 - DNA, 21 bp, Artificial Sequence
  Synthetic
cctgggccutctcctcuaact

SEQ ID NO: 18785 - DNA, 20 bp, Artificial Sequence
  Synthetic
gcuggaacagcaaugccaga

SEQ ID NO: 18786 - DNA, 19 bp, Artificial Sequence
  Synthetic
ccgcatcucaagctcugct

SEQ ID NO: 18787 - DNA, 18 bp, Artificial Sequence
  Synthetic
ggcaaugagcuggaacgg

SEQ ID NO: 18788 - DNA, 18 bp, Artificial Sequence
  Synthetic
acctctutgctgguggca

SEQ ID NO: 18789 - DNA, 21 bp, Artificial Sequence
  Synthetic
ccacagcgagcuccagauaag

SEQ ID NO: 18790 - DNA, 22 bp, Artificial Sequence
  Synthetic
aggacttcaguctcagccugat

SEQ ID NO: 18791 - DNA, 23 bp, Artificial Sequence
  Synthetic
gcgttgtauctctgagcugaagg

SEQ ID NO: 18792 - DNA, 19 bp, Artificial Sequence
  Synthetic
gctcagcuctgccttcucc

SEQ ID NO: 18793 - DNA, 18 bp, Artificial Sequence
  Synthetic
ggaugcggctcucaagca

SEQ ID NO: 18794 - DNA, 20 bp, Artificial Sequence
  Synthetic
gttgctggauggtggcatug

SEQ ID NO: 18795 - DNA, 22 bp, Artificial Sequence
  Synthetic
gtctagccugatcactgaccug

SEQ ID NO: 18796 - DNA, 23 bp, Artificial Sequence
  Synthetic
ttccagcugtgaaagtttuccct

SEQ ID NO: 18797 - DNA, 22 bp, Artificial Sequence
  Synthetic
caagatgaugggccccatgtut

SEQ ID NO: 18798 - DNA, 27 bp, Artificial Sequence
  Synthetic
cttaaaggaaagguctccattctccuc

SEQ ID NO: 18799 - DNA, 22 bp, Artificial Sequence
  Synthetic
agccaggaacccauactctcut

SEQ ID NO: 18800 - DNA, 28 bp, Artificial Sequence
  Synthetic
catccctatuacttctctcaucagcaag

SEQ ID NO: 18801 - DNA, 24 bp, Artificial Sequence
  Synthetic
attgcttcagaucttaggcgctua

SEQ ID NO: 18802 - DNA, 21 bp, Artificial Sequence
  Synthetic
caagtcaggugaggugaagca

SEQ ID NO: 18803 - DNA, 21 bp, Artificial Sequence
  Synthetic
tgcctccugtttggcttcuag

SEQ ID NO: 18804 - DNA, 25 bp, Artificial Sequence
  Synthetic
tcctctcctaacuctctcaagctuc

SEQ ID NO: 18805 - DNA, 24 bp, Artificial Sequence
  Synthetic
gcttttcttccuctcttgggtucc

SEQ ID NO: 18806 - DNA, 31 bp, Artificial Sequence
  Synthetic
ttccaaaagctguacctaggaaaatactuac

SEQ ID NO: 18807 - DNA, 25 bp, Artificial Sequence
  Synthetic
ttcctugaactcagtugacacacat

SEQ ID NO: 18808 - DNA, 22 bp, Artificial Sequence
  Synthetic
ggaaagccaaaucaacccucca

SEQ ID NO: 18809 - DNA, 27 bp, Artificial Sequence
  Synthetic
tgcgtctcgugttataaaatgctttut

SEQ ID NO: 18810 - DNA, 30 bp, Artificial Sequence
  Synthetic
cttacccccagaauctacaataacattugt

SEQ ID NO: 18811 - DNA, 28 bp, Artificial Sequence
  Synthetic
ttccattttgguttactcaggatucact

SEQ ID NO: 18812 - DNA, 30 bp, Artificial Sequence
  Synthetic
acaaataaguaaacaccacagaaugaggag

SEQ ID NO: 18813 - DNA, 22 bp, Artificial Sequence
  Synthetic
cttgattugcagcagccaacut

SEQ ID NO: 18814 - DNA, 28 bp, Artificial Sequence
  Synthetic
catttaagacuctaagtctgugcagagg

SEQ ID NO: 18815 - DNA, 27 bp, Artificial Sequence
  Synthetic
gtctatctcugaccaaagtggaugaaa

SEQ ID NO: 18816 - DNA, 25 bp, Artificial Sequence
  Synthetic
aggcaagtuaggagacagtcactua

SEQ ID NO: 18817 - DNA, 30 bp, Artificial Sequence
  Synthetic
gataugaaaaagaaccaaugcaaagaaggt

SEQ ID NO: 18818 - DNA, 26 bp, Artificial Sequence
  Synthetic
aggcagcatttautaccccatttgua

SEQ ID NO: 18819 - DNA, 33 bp, Artificial Sequence
  Synthetic
gcatgaatttacugtatcttaattugaaggaaa

SEQ ID NO: 18820 - DNA, 28 bp, Artificial Sequence
  Synthetic
catgtgggtgucattcttttgatttuct

SEQ ID NO: 18821 - DNA, 30 bp, Artificial Sequence
  Synthetic
gtgagatggcaguaccttaatatgatguaa

SEQ ID NO: 18822 - DNA, 17 bp, Artificial Sequence
  Synthetic
gcggucggcttcacuca

SEQ ID NO: 18823 - DNA, 19 bp, Artificial Sequence
  Synthetic
tgacggaccgaaucacugc

SEQ ID NO: 18824 - DNA, 20 bp, Artificial Sequence
  Synthetic
cagcttgucgatggucaacg

SEQ ID NO: 18825 - DNA, 20 bp, Artificial Sequence
  Synthetic
ctcagccccuttccacacua

SEQ ID NO: 18826 - DNA, 24 bp, Artificial Sequence
  Synthetic
acatactcggugtaaggtguccat

SEQ ID NO: 18827 - DNA, 29 bp, Artificial Sequence
  Synthetic
catctgaagttcugtaatttccttctucc

SEQ ID NO: 18828 - DNA, 22 bp, Artificial Sequence
  Synthetic
ccaatuccagaccaagctguga

SEQ ID NO: 18829 - DNA, 25 bp, Artificial Sequence
  Synthetic
gctucaaagagaaaagguaacaucc

SEQ ID NO: 18830 - DNA, 27 bp, Artificial Sequence
  Synthetic
cctgctcatauctcagcatttctucag

SEQ ID NO: 18831 - DNA, 28 bp, Artificial Sequence
  Synthetic
accattagtgaagguaaagatggcuaga

SEQ ID NO: 18832 - DNA, 26 bp, Artificial Sequence
  Synthetic
ctgggcttugctatttcaactaucac

SEQ ID NO: 18833 - DNA, 23 bp, Artificial Sequence
  Synthetic
gcutaatggcaugacaaagcaga

SEQ ID NO: 18834 - DNA, 28 bp, Artificial Sequence
  Synthetic
acattgcagucgaaagattaaacttucc

SEQ ID NO: 18835 - DNA, 27 bp, Artificial Sequence
  Synthetic
cagttctccautctttagtcuccacaa

SEQ ID NO: 18836 - DNA, 20 bp, Artificial Sequence
  Synthetic
tgtgccccaggguttgtuac

SEQ ID NO: 18837 - DNA, 19 bp, Artificial Sequence
  Synthetic
accguccgagugcacaaaa

SEQ ID NO: 18838 - DNA, 18 bp, Artificial Sequence
  Synthetic
ccttgcuccagcagguct

SEQ ID NO: 18839 - DNA, 17 bp, Artificial Sequence
  Synthetic
aggaguggacccugcca

SEQ ID NO: 18840 - DNA, 23 bp, Artificial Sequence
  Synthetic
agtagtutaggacagugccagga

SEQ ID NO: 18841 - DNA, 19 bp, Artificial Sequence
  Synthetic
gaagcugttcugccccagt

SEQ ID NO: 18842 - DNA, 23 bp, Artificial Sequence
  Synthetic
gaatcuaaggccacctgauaccc

SEQ ID NO: 18843 - DNA, 20 bp, Artificial Sequence
  Synthetic
ctctggcagcuggcatgaua

SEQ ID NO: 18844 - DNA, 25 bp, Artificial Sequence
  Synthetic
gcucacacattuagacacacacaga

SEQ ID NO: 18845 - DNA, 23 bp, Artificial Sequence
  Synthetic
aacacaacgacaacugcaacuac

SEQ ID NO: 18846 - DNA, 22 bp, Artificial Sequence
  Synthetic
gggtgcaggaaaugaagacugt

SEQ ID NO: 18847 - DNA, 20 bp, Artificial Sequence
  Synthetic
cgatgugcaggagagaucgc

SEQ ID NO: 18848 - DNA, 26 bp, Artificial Sequence
  Synthetic
ccattaaagaacuggactggaaccua

SEQ ID NO: 18849 - DNA, 18 bp, Artificial Sequence
  Synthetic
ctgggcaugaagctgugc

SEQ ID NO: 18850 - DNA, 22 bp, Artificial Sequence
  Synthetic
caugacccagggaaucaguaag

SEQ ID NO: 18851 - DNA, 25 bp, Artificial Sequence
  Synthetic
gttaccagcuctttgatctctucca

SEQ ID NO: 18852 - DNA, 23 bp, Artificial Sequence
  Synthetic
tcaccgacugaattcauccaaca

SEQ ID NO: 18853 - DNA, 29 bp, Artificial Sequence
  Synthetic
accgctaattaucttttctctgtuacagg

SEQ ID NO: 18854 - DNA, 25 bp, Artificial Sequence
  Synthetic
tcaccaauacgaacacaaugctaua

SEQ ID NO: 18855 - DNA, 24 bp, Artificial Sequence
  Synthetic
gcagctgcugagaaattcaaagut

SEQ ID NO: 18856 - DNA, 25 bp, Artificial Sequence
  Synthetic
cagttccacuctgtataaaggugct

SEQ ID NO: 18857 - DNA, 23 bp, Artificial Sequence
  Synthetic
gcagcagcugaaattgaugaaga

SEQ ID NO: 18858 - DNA, 23 bp, Artificial Sequence
  Synthetic
cgcaucacagggttagtatuggt

SEQ ID NO: 18859 - DNA, 24 bp, Artificial Sequence
  Synthetic
ctaaatctgcuggaatccctgucc

SEQ ID NO: 18860 - DNA, 22 bp, Artificial Sequence
  Synthetic
gctgcagagacagaugctgaut

SEQ ID NO: 18861 - DNA, 28 bp, Artificial Sequence
  Synthetic
cctgtucagaaagactctucaaagacag

SEQ ID NO: 18862 - DNA, 25 bp, Artificial Sequence
  Synthetic
cccattttacaugtgacagaagcug

SEQ ID NO: 18863 - DNA, 21 bp, Artificial Sequence
  Synthetic
cutctcctucccccaaagagg

SEQ ID NO: 18864 - DNA, 25 bp, Artificial Sequence
  Synthetic
ttttagagagaagagucgctgtugg

SEQ ID NO: 18865 - DNA, 22 bp, Artificial Sequence
  Synthetic
cccaaacaagutgccacttcut

SEQ ID NO: 18866 - DNA, 22 bp, Artificial Sequence
  Synthetic
gagatgggauagctggtccuct

SEQ ID NO: 18867 - DNA, 21 bp, Artificial Sequence
  Synthetic
ccagctacaacuccctccuct

SEQ ID NO: 18868 - DNA, 23 bp, Artificial Sequence
  Synthetic
ctcctttuagggagggaggagut

SEQ ID NO: 18869 - DNA, 21 bp, Artificial Sequence
  Synthetic
cccaaaaggagguctggcuac

SEQ ID NO: 18870 - DNA, 21 bp, Artificial Sequence
  Synthetic
gtagcuggacctcctttuggg

SEQ ID NO: 18871 - DNA, 19 bp, Artificial Sequence
  Synthetic
aguccagcagcuaccccat

SEQ ID NO: 18872 - DNA, 17 bp, Artificial Sequence
  Synthetic
gcucgggccttttuggg

SEQ ID NO: 18873 - DNA, 21 bp, Artificial Sequence
  Synthetic
cctcagctgugactcctcugt

SEQ ID NO: 18874 - DNA, 20 bp, Artificial Sequence
  Synthetic
gttgggcacucttugggaga

SEQ ID NO: 18875 - DNA, 21 bp, Artificial Sequence
  Synthetic
gtgctcctcuggctacctuag

SEQ ID NO: 18876 - DNA, 22 bp, Artificial Sequence
  Synthetic
ctgggccugcataagaatcugt

SEQ ID NO: 18877 - DNA, 27 bp, Artificial Sequence
  Synthetic
cctcttctccagagauacctctttcuc

SEQ ID NO: 18878 - DNA, 23 bp, Artificial Sequence
  Synthetic
tggtatccucagagtggttgcua

SEQ ID NO: 18879 - DNA, 22 bp, Artificial Sequence
  Synthetic
ctgcagcaccuactactaccut

SEQ ID NO: 18880 - DNA, 23 bp, Artificial Sequence
  Synthetic
gcaggaacuacctcatttcugga

SEQ ID NO: 18881 - DNA, 26 bp, Artificial Sequence
  Synthetic
atcagagttcutttggttctguccaa

SEQ ID NO: 18882 - DNA, 23 bp, Artificial Sequence
  Synthetic
gtcacacagugguaaggaacagt

SEQ ID NO: 18883 - DNA, 22 bp, Artificial Sequence
  Synthetic
cttcagtggcugtagctgaguc

SEQ ID NO: 18884 - DNA, 21 bp, Artificial Sequence
  Synthetic
gggucgaggcaataguagagg

SEQ ID NO: 18885 - DNA, 22 bp, Artificial Sequence
  Synthetic
ctttctccagcugtgctaccua

SEQ ID NO: 18886 - DNA, 22 bp, Artificial Sequence
  Synthetic
gacaagaggagutgauggcagt

SEQ ID NO: 18887 - DNA, 26 bp, Artificial Sequence
  Synthetic
accacttccuacctagaaaacacuct

SEQ ID NO: 18888 - DNA, 25 bp, Artificial Sequence
  Synthetic
guagttttcttguacgagagagcca

SEQ ID NO: 18889 - DNA, 23 bp, Artificial Sequence
  Synthetic
ggtaacatctugccagacccaut

SEQ ID NO: 18890 - DNA, 28 bp, Artificial Sequence
  Synthetic
agcagagtucgagaactaagcaaatuag

SEQ ID NO: 18891 - DNA, 24 bp, Artificial Sequence
  Synthetic
gtctcucaggtccaatuccaaaca

SEQ ID NO: 18892 - DNA, 30 bp, Artificial Sequence
  Synthetic
gtaactttaaggtguttgaaggattttcut

SEQ ID NO: 18893 - DNA, 23 bp, Artificial Sequence
  Synthetic
cactcgggagutttctuggaaca

SEQ ID NO: 18894 - DNA, 27 bp, Artificial Sequence
  Synthetic
tcttttctggtutttcttggctcuact

SEQ ID NO: 18895 - DNA, 18 bp, Artificial Sequence
  Synthetic
cggcccugcatccaugat

SEQ ID NO: 18896 - DNA, 26 bp, Artificial Sequence
  Synthetic
cagacagaagcacaguaccgattuat

SEQ ID NO: 18897 - DNA, 21 bp, Artificial Sequence
  Synthetic
gcgtauccaagaggccuagca

SEQ ID NO: 18898 - DNA, 18 bp, Artificial Sequence
  Synthetic
cuaaacgcggccaggtug

SEQ ID NO: 18899 - DNA, 20 bp, Artificial Sequence
  Synthetic
ctatacggucggacctggug

SEQ ID NO: 18900 - DNA, 17 bp, Artificial Sequence
  Synthetic
tggccuggcgcttcaut

SEQ ID NO: 18901 - DNA, 17 bp, Artificial Sequence
  Synthetic
cgggugctcttcucgca

SEQ ID NO: 18902 - DNA, 19 bp, Artificial Sequence
  Synthetic
cagaggcgcugttccucat

SEQ ID NO: 18903 - DNA, 18 bp, Artificial Sequence
  Synthetic
cgccgccuaccacaugac

SEQ ID NO: 18904 - DNA, 22 bp, Artificial Sequence
  Synthetic
tggaaacuccagttgtgtugct

SEQ ID NO: 18905 - DNA, 23 bp, Artificial Sequence
  Synthetic
gccattgactuctacacctccut

SEQ ID NO: 18906 - DNA, 26 bp, Artificial Sequence
  Synthetic
tggcaauaaagggatgtaaaacugga

SEQ ID NO: 18907 - DNA, 26 bp, Artificial Sequence
  Synthetic
actgtcauggaggaacgaatgauaga

SEQ ID NO: 18908 - DNA, 22 bp, Artificial Sequence
  Synthetic
gttgaagcugcagaaactgcuc

SEQ ID NO: 18909 - DNA, 21 bp, Artificial Sequence
  Synthetic
ctctgggautgaagggacuca

SEQ ID NO: 18910 - DNA, 26 bp, Artificial Sequence
  Synthetic
gattcatgguacctgatgggttuaga

SEQ ID NO: 18911 - DNA, 29 bp, Artificial Sequence
  Synthetic
aggacccaaguactgaattaaaacttucc

SEQ ID NO: 18912 - DNA, 24 bp, Artificial Sequence
  Synthetic
gtcagatttcauccgggacattug

SEQ ID NO: 18913 - DNA, 26 bp, Artificial Sequence
  Synthetic
aacagactugaaagttcttttgucct

SEQ ID NO: 18914 - DNA, 22 bp, Artificial Sequence
  Synthetic
ttgguacaaaggacaactggug

SEQ ID NO: 18915 - DNA, 23 bp, Artificial Sequence
  Synthetic
agacccauattgugcaacaggaa

SEQ ID NO: 18916 - DNA, 26 bp, Artificial Sequence
  Synthetic
cctggttttgagagutcttttggcua

SEQ ID NO: 18917 - DNA, 28 bp, Artificial Sequence
  Synthetic
tttagcacaaguagggtaacaagttuga

SEQ ID NO: 18918 - DNA, 18 bp, Artificial Sequence
  Synthetic
gcuggaccacgcttucct

SEQ ID NO: 18919 - DNA, 23 bp, Artificial Sequence
  Synthetic
gcaggaugagctgaagaaaaugg

SEQ ID NO: 18920 - DNA, 24 bp, Artificial Sequence
  Synthetic
gattcagtccuggtctcttcacug

SEQ ID NO: 18921 - DNA, 25 bp, Artificial Sequence
  Synthetic
tcctaagtgaccuggaagatgauga

SEQ ID NO: 18922 - DNA, 22 bp, Artificial Sequence
  Synthetic
tccacctccucctctcctauca

SEQ ID NO: 18923 - DNA, 23 bp, Artificial Sequence
  Synthetic
ctgugagacagcagaucgagaaa

SEQ ID NO: 18924 - DNA, 25 bp, Artificial Sequence
  Synthetic
cgaccatgcugttcaaatgttctut

SEQ ID NO: 18925 - DNA, 23 bp, Artificial Sequence
  Synthetic
cccagugggaattugagaaggac

SEQ ID NO: 18926 - DNA, 23 bp, Artificial Sequence
  Synthetic
tcaagagugtgtttcuccaccag

SEQ ID NO: 18927 - DNA, 22 bp, Artificial Sequence
  Synthetic
gctagacugacacaggcucaag

SEQ ID NO: 18928 - DNA, 22 bp, Artificial Sequence
  Synthetic
ccctacacacauaagcctguca

SEQ ID NO: 18929 - DNA, 27 bp, Artificial Sequence
  Synthetic
gcaatccatugaatatgagcatugagg

SEQ ID NO: 18930 - DNA, 25 bp, Artificial Sequence
  Synthetic
actgccgcucatattcatttcucat

SEQ ID NO: 18931 - DNA, 20 bp, Artificial Sequence
  Synthetic
gggucaaagaagggcacucg

SEQ ID NO: 18932 - DNA, 28 bp, Artificial Sequence
  Synthetic
ttctgtttttgccutttcaatttccugt

SEQ ID NO: 18933 - DNA, 21 bp, Artificial Sequence
  Synthetic
gtgatggcagcutgtccatut

SEQ ID NO: 18934 - DNA, 24 bp, Artificial Sequence
  Synthetic
ctggtgaaugctgttcttgguaac

SEQ ID NO: 18935 - DNA, 26 bp, Artificial Sequence
  Synthetic
ccttcacautttctgcttucagagga

SEQ ID NO: 18936 - DNA, 29 bp, Artificial Sequence
  Synthetic
gctgatggtguaagagattttccatttut

SEQ ID NO: 18937 - DNA, 26 bp, Artificial Sequence
  Synthetic
tgggccttgtauacttgaatggagua

SEQ ID NO: 18938 - DNA, 22 bp, Artificial Sequence
  Synthetic
gctccacacucatgauccagat

SEQ ID NO: 18939 - DNA, 20 bp, Artificial Sequence
  Synthetic
ttgcccgagutccaagaguc

SEQ ID NO: 18940 - DNA, 20 bp, Artificial Sequence
  Synthetic
tggcaaaggucggtgagtuc

SEQ ID NO: 18941 - DNA, 23 bp, Artificial Sequence
  Synthetic
cacaacctguccttgtctctguc

SEQ ID NO: 18942 - DNA, 17 bp, Artificial Sequence
  Synthetic
ctctgccutgcgcucct

SEQ ID NO: 18943 - DNA, 18 bp, Artificial Sequence
  Synthetic
gugcctccugggaacaga

SEQ ID NO: 18944 - DNA, 21 bp, Artificial Sequence
  Synthetic
gcagagctugcagtgactgut

SEQ ID NO: 18945 - DNA, 23 bp, Artificial Sequence
  Synthetic
tgcagcgutttcagaatcugaga

SEQ ID NO: 18946 - DNA, 26 bp, Artificial Sequence
  Synthetic
gaatcuaaccaaaagauccacactuc

SEQ ID NO: 18947 - DNA, 32 bp, Artificial Sequence
  Synthetic
cagtatacagtgcutacctaccaaatatttut

SEQ ID NO: 18948 - DNA, 22 bp, Artificial Sequence
  Synthetic
tgaucacttgctucccaccaag

SEQ ID NO: 18949 - DNA, 24 bp, Artificial Sequence
  Synthetic
ccaggactcauttgtgccttgtua

SEQ ID NO: 18950 - DNA, 27 bp, Artificial Sequence
  Synthetic
agacccagcutattgaattcatugagt

SEQ ID NO: 18951 - DNA, 20 bp, Artificial Sequence
  Synthetic
tcttgcagguggatgtuccc

SEQ ID NO: 18952 - DNA, 26 bp, Artificial Sequence
  Synthetic
agcattaagcaaaauacccccacaut

SEQ ID NO: 18953 - DNA, 22 bp, Artificial Sequence
  Synthetic
cctaucgacagccaaagcaugt

SEQ ID NO: 18954 - DNA, 24 bp, Artificial Sequence
  Synthetic
cagccacucttgataacauccagt

SEQ ID NO: 18955 - DNA, 18 bp, Artificial Sequence
  Synthetic
gggttgtuggcaggucaa

SEQ ID NO: 18956 - DNA, 27 bp, Artificial Sequence
  Synthetic
caaagagtacuggctagagtcaactuc

SEQ ID NO: 18957 - DNA, 32 bp, Artificial Sequence
  Synthetic
agtatagcaucatctttatauaaccaggaaca

SEQ ID NO: 18958 - DNA, 24 bp, Artificial Sequence
  Synthetic
gctgaattgguagggaagaaucca

SEQ ID NO: 18959 - DNA, 30 bp, Artificial Sequence
  Synthetic
cttaaatggagcuttttgtttctaauccaa

SEQ ID NO: 18960 - DNA, 17 bp, Artificial Sequence
  Synthetic
cguggctuccccgaagg

SEQ ID NO: 18961 - DNA, 23 bp, Artificial Sequence
  Synthetic
cgattccaucaactcggacttug

SEQ ID NO: 18962 - DNA, 24 bp, Artificial Sequence
  Synthetic
gaacgttcaccuttttgcagauca

SEQ ID NO: 18963 - DNA, 25 bp, Artificial Sequence
  Synthetic
agtagatcaggguctggaaacacut

SEQ ID NO: 18964 - DNA, 22 bp, Artificial Sequence
  Synthetic
ccaaacccaacutccgtgaugt

SEQ ID NO: 18965 - DNA, 27 bp, Artificial Sequence
  Synthetic
tcagaaattgcugattcatcacucact

SEQ ID NO: 18966 - DNA, 19 bp, Artificial Sequence
  Synthetic
ctggctguacctcgauggt

SEQ ID NO: 18967 - DNA, 22 bp, Artificial Sequence
  Synthetic
gctctggcucttgcttctuagg

SEQ ID NO: 18968 - DNA, 18 bp, Artificial Sequence
  Synthetic
cctcgguggtctcucgct

SEQ ID NO: 18969 - DNA, 23 bp, Artificial Sequence
  Synthetic
aagatgccauggaaagctcucat

SEQ ID NO: 18970 - DNA, 27 bp, Artificial Sequence
  Synthetic
gatcacttgaaugacagtcgatuagga

SEQ ID NO: 18971 - DNA, 25 bp, Artificial Sequence
  Synthetic
tgtctcugaccaaagaagcttugag

SEQ ID NO: 18972 - DNA, 25 bp, Artificial Sequence
  Synthetic
ccttttgaguagatccatgtgugaa

SEQ ID NO: 18973 - DNA, 25 bp, Artificial Sequence
  Synthetic
cagggacaggauaagcacaauacat

SEQ ID NO: 18974 - DNA, 22 bp, Artificial Sequence
  Synthetic
gcctggtttuggtggaattcug

SEQ ID NO: 18975 - DNA, 28 bp, Artificial Sequence
  Synthetic
aaaaagaaacacaagugaggacaaagug

SEQ ID NO: 18976 - DNA, 27 bp, Artificial Sequence
  Synthetic
gatttattcucctgaccauaccagcag

SEQ ID NO: 18977 - DNA, 27 bp, Artificial Sequence
  Synthetic
aaatatttccaaguagtcccaccagut

SEQ ID NO: 18978 - DNA, 28 bp, Artificial Sequence
  Synthetic
ctgctggtcacagugatatacatagtut

SEQ ID NO: 18979 - DNA, 27 bp, Artificial Sequence
  Synthetic
gagcatgatttuaccattgaagcugat

SEQ ID NO: 18980 - DNA, 30 bp, Artificial Sequence
  Synthetic
agcagtactaaugaagatgaggattugaac

SEQ ID NO: 18981 - DNA, 20 bp, Artificial Sequence
  Synthetic
ggccaagcuctttgaaugct

SEQ ID NO: 18982 - DNA, 25 bp, Artificial Sequence
  Synthetic
ccugcctuaagagaagggaagaaga

SEQ ID NO: 18983 - DNA, 21 bp, Artificial Sequence
  Synthetic
acccgtacutacctggcugat

SEQ ID NO: 18984 - DNA, 18 bp, Artificial Sequence
  Synthetic
ccgaagcugctgcctugt

SEQ ID NO: 18985 - DNA, 17 bp, Artificial Sequence
  Synthetic
ccgcugcagactcucga

SEQ ID NO: 18986 - DNA, 28 bp, Artificial Sequence
  Synthetic
cgtttuaagaggaaaaagucaggagagt

SEQ ID NO: 18987 - DNA, 19 bp, Artificial Sequence
  Synthetic
ctgtcgcugctggatcuct

SEQ ID NO: 18988 - DNA, 18 bp, Artificial Sequence
  Synthetic
gaagtgcuacgccucgga

SEQ ID NO: 18989 - DNA, 20 bp, Artificial Sequence
  Synthetic
ggtgaugcaagagcugaggt

SEQ ID NO: 18990 - DNA, 19 bp, Artificial Sequence
  Synthetic
tgccagtguacgccttcuc

SEQ ID NO: 18991 - DNA, 22 bp, Artificial Sequence
  Synthetic
ctgatctgaugaaggccuggat

SEQ ID NO: 18992 - DNA, 22 bp, Artificial Sequence
  Synthetic
caaggatucccataggugcaca

SEQ ID NO: 18993 - DNA, 20 bp, Artificial Sequence
  Synthetic
gtcctgggcugaacttcugg

SEQ ID NO: 18994 - DNA, 19 bp, Artificial Sequence
  Synthetic
cctcgccaguccagtcuct

SEQ ID NO: 18995 - DNA, 17 bp, Artificial Sequence
  Synthetic
gggcgcucctggtgauc

SEQ ID NO: 18996 - DNA, 22 bp, Artificial Sequence
  Synthetic
gctcctcccauttatcccagug

SEQ ID NO: 18997 - DNA, 21 bp, Artificial Sequence
  Synthetic
aacacctgcuccaagagtcug

SEQ ID NO: 18998 - DNA, 20 bp, Artificial Sequence
  Synthetic
guaacctugcagccaacacc

SEQ ID NO: 18999 - DNA, 17 bp, Artificial Sequence
  Synthetic
agguctcccugcccaga

SEQ ID NO: 19000 - DNA, 22 bp, Artificial Sequence
  Synthetic
gtctctagauggtgagucagca

SEQ ID NO: 19001 - DNA, 21 bp, Artificial Sequence
  Synthetic
ggaacttgcuttcccggtuca

SEQ ID NO: 19002 - DNA, 23 bp, Artificial Sequence
  Synthetic
gcagcttcaaacucaagaaccug

SEQ ID NO: 19003 - DNA, 20 bp, Artificial Sequence
  Synthetic
gcacugcaggctacugaagg

SEQ ID NO: 19004 - DNA, 18 bp, Artificial Sequence
  Synthetic
cguggctuggcagagagg

SEQ ID NO: 19005 - DNA, 26 bp, Artificial Sequence
  Synthetic
ggaactgatuctgaaccaaaugacaa

SEQ ID NO: 19006 - DNA, 21 bp, Artificial Sequence
  Synthetic
cttgatgtucaaccgctgcug

SEQ ID NO: 19007 - DNA, 21 bp, Artificial Sequence
  Synthetic
ggctgagcuttgggtguaact

SEQ ID NO: 19008 - DNA, 21 bp, Artificial Sequence
  Synthetic
atctctggacaugccgaaguc

SEQ ID NO: 19009 - DNA, 21 bp, Artificial Sequence
  Synthetic
caaatgcuccacatugccagt

SEQ ID NO: 19010 - DNA, 17 bp, Artificial Sequence
  Synthetic
ccagcccucctccuggt

SEQ ID NO: 19011 - DNA, 19 bp, Artificial Sequence
  Synthetic
cgtgcugaagcgagaacug

SEQ ID NO: 19012 - DNA, 22 bp, Artificial Sequence
  Synthetic
gggagagcautccatcccagua

SEQ ID NO: 19013 - DNA, 19 bp, Artificial Sequence
  Synthetic
aucaaccacggcaucacca

SEQ ID NO: 19014 - DNA, 22 bp, Artificial Sequence
  Synthetic
cccatcucccaagcttguagaa

SEQ ID NO: 19015 - DNA, 26 bp, Artificial Sequence
  Synthetic
acccactacaacaauggcaactauac

SEQ ID NO: 19016 - DNA, 21 bp, Artificial Sequence
  Synthetic
gccattgucctcactcgucac

SEQ ID NO: 19017 - DNA, 21 bp, Artificial Sequence
  Synthetic
ggtagcagagccauccttgua

SEQ ID NO: 19018 - DNA, 23 bp, Artificial Sequence
  Synthetic
gaugttcaugcggaagagaggaa

SEQ ID NO: 19019 - DNA, 20 bp, Artificial Sequence
  Synthetic
cccuctctcttugccgacag

SEQ ID NO: 19020 - DNA, 17 bp, Artificial Sequence
  Synthetic
gcggccgccugactuac

SEQ ID NO: 19021 - DNA, 24 bp, Artificial Sequence
  Synthetic
tctgcagcaagacugagatcaaut

SEQ ID NO: 19022 - DNA, 17 bp, Artificial Sequence
  Synthetic
ccucgccccuacaccca

SEQ ID NO: 19023 - DNA, 21 bp, Artificial Sequence
  Synthetic
gctcctuccccttccagatut

SEQ ID NO: 19024 - DNA, 22 bp, Artificial Sequence
  Synthetic
cutcacgcuaagggcgaaaaag

SEQ ID NO: 19025 - DNA, 18 bp, Artificial Sequence
  Synthetic
ccgatuaccggcgcauca

SEQ ID NO: 19026 - DNA, 21 bp, Artificial Sequence
  Synthetic
acgaagcaggcgaagutcaut

SEQ ID NO: 19027 - DNA, 19 bp, Artificial Sequence
  Synthetic
gcccagccaucugcaacat

SEQ ID NO: 19028 - DNA, 28 bp, Artificial Sequence
  Synthetic
gcagttttcgugctaatgtttttgcuaa

SEQ ID NO: 19029 - DNA, 23 bp, Artificial Sequence
  Synthetic
actgaaacucacaatagccaucc

SEQ ID NO: 19030 - DNA, 28 bp, Artificial Sequence
  Synthetic
gagtgctacggagauagagaaatcaaut

SEQ ID NO: 19031 - DNA, 25 bp, Artificial Sequence
  Synthetic
tccacagtuagaggacaaaaagcug

SEQ ID NO: 19032 - DNA, 21 bp, Artificial Sequence
  Synthetic
gatcucagcgcagagaagtug

SEQ ID NO: 19033 - DNA, 18 bp, Artificial Sequence
  Synthetic
ccugcaagaccagcugga

SEQ ID NO: 19034 - DNA, 20 bp, Artificial Sequence
  Synthetic
gtcctuggccagcttaaugg

SEQ ID NO: 19035 - DNA, 23 bp, Artificial Sequence
  Synthetic
acacctcaaguactagcccaugt

SEQ ID NO: 19036 - DNA, 23 bp, Artificial Sequence
  Synthetic
gtttgcacagugccttucagaat

SEQ ID NO: 19037 - DNA, 27 bp, Artificial Sequence
  Synthetic
ctgtgtttcagcucattgtgatuaacc

SEQ ID NO: 19038 - DNA, 22 bp, Artificial Sequence
  Synthetic
catcccutggaccucagcaaaa

SEQ ID NO: 19039 - DNA, 22 bp, Artificial Sequence
  Synthetic
gggctaccuagagactgcttua

SEQ ID NO: 19040 - DNA, 28 bp, Artificial Sequence
  Synthetic
acctgatctcuctgatttccaaattucc

SEQ ID NO: 19041 - DNA, 30 bp, Artificial Sequence
  Synthetic
tggautaaacaaaaaugaaacaaccaagca

SEQ ID NO: 19042 - DNA, 28 bp, Artificial Sequence
  Synthetic
cattcactaaggcauttcattcctucag

SEQ ID NO: 19043 - DNA, 29 bp, Artificial Sequence
  Synthetic
cacccattgagucattcactttuaaagaa

SEQ ID NO: 19044 - DNA, 24 bp, Artificial Sequence
  Synthetic
caucaggcgcaaucgtattuaaag

SEQ ID NO: 19045 - DNA, 24 bp, Artificial Sequence
  Synthetic
ctgagtccuaaacgcatggauaca

SEQ ID NO: 19046 - DNA, 24 bp, Artificial Sequence
  Synthetic
agaaaaggaagugccaggcaaaua

SEQ ID NO: 19047 - DNA, 23 bp, Artificial Sequence
  Synthetic
ccaacttcuagcctgtcgatugt

SEQ ID NO: 19048 - DNA, 22 bp, Artificial Sequence
  Synthetic
tgactctgaaugacagccucca

SEQ ID NO: 19049 - DNA, 22 bp, Artificial Sequence
  Synthetic
ctggaagcaaccuctcctctut

SEQ ID NO: 19050 - DNA, 29 bp, Artificial Sequence
  Synthetic
ggaggttatctguagagacagtcatttut

SEQ ID NO: 19051 - DNA, 25 bp, Artificial Sequence
  Synthetic
caccttgaacacautcctccuaaag

SEQ ID NO: 19052 - DNA, 27 bp, Artificial Sequence
  Synthetic
cctttagtctttucccagacaatcuga

SEQ ID NO: 19053 - DNA, 21 bp, Artificial Sequence
  Synthetic
catttuccccacagggucagt

SEQ ID NO: 19054 - DNA, 31 bp, Artificial Sequence
  Synthetic
tgaatggtctagauttacctgagtgtttuag

SEQ ID NO: 19055 - DNA, 23 bp, Artificial Sequence
  Synthetic
gctgttttugtctcctcuagcgt

SEQ ID NO: 19056 - DNA, 23 bp, Artificial Sequence
  Synthetic
acaaatcctucaaagaccugcct

SEQ ID NO: 19057 - DNA, 21 bp, Artificial Sequence
  Synthetic
gaaccucaggugcaacagaga

SEQ ID NO: 19058 - DNA, 24 bp, Artificial Sequence
  Synthetic
ggtagagtccauctttgcactucc

SEQ ID NO: 19059 - DNA, 20 bp, Artificial Sequence
  Synthetic
gacatcgguggaggttguct

SEQ ID NO: 19060 - DNA, 20 bp, Artificial Sequence
  Synthetic
cctgaucccaaguggccaac

SEQ ID NO: 19061 - DNA, 22 bp, Artificial Sequence
  Synthetic
gggaaagaccutccaugcaaga

SEQ ID NO: 19062 - DNA, 22 bp, Artificial Sequence
  Synthetic
aggtagagguggaaggtgacut

SEQ ID NO: 19063 - DNA, 24 bp, Artificial Sequence
  Synthetic
catagttcuggaaaaccccagcut

SEQ ID NO: 19064 - DNA, 18 bp, Artificial Sequence
  Synthetic
ccccctcacucaccggua

SEQ ID NO: 19065 - DNA, 20 bp, Artificial Sequence
  Synthetic
gccttcucctgcctcucaag

SEQ ID NO: 19066 - DNA, 20 bp, Artificial Sequence
  Synthetic
cucttccctcugcccagaag

SEQ ID NO: 19067 - DNA, 20 bp, Artificial Sequence
  Synthetic
gcctgaaggagcuagaccug

SEQ ID NO: 19068 - DNA, 22 bp, Artificial Sequence
  Synthetic
agcttctgccutggatctctuc

SEQ ID NO: 19069 - DNA, 22 bp, Artificial Sequence
  Synthetic
cagaaaccugaaggagcuggac

SEQ ID NO: 19070 - DNA, 23 bp, Artificial Sequence
  Synthetic
catcacttgtgucaggaacgtut

SEQ ID NO: 19071 - DNA, 25 bp, Artificial Sequence
  Synthetic
gggagagagagauggagaacatcut

SEQ ID NO: 19072 - DNA, 24 bp, Artificial Sequence
  Synthetic
gtcatctggacugaaaagggtcut

SEQ ID NO: 19073 - DNA, 25 bp, Artificial Sequence
  Synthetic
aaggaaaaacucacactgactucca

SEQ ID NO: 19074 - DNA, 25 bp, Artificial Sequence
  Synthetic
ggatgccucgggaagtatagtttuc

SEQ ID NO: 19075 - DNA, 21 bp, Artificial Sequence
  Synthetic
ctgctctucatcctcgauggt

SEQ ID NO: 19076 - DNA, 22 bp, Artificial Sequence
  Synthetic
ctccacataaucaggccagcut

SEQ ID NO: 19077 - DNA, 18 bp, Artificial Sequence
  Synthetic
ccacccaugggagcctuc

SEQ ID NO: 19078 - DNA, 18 bp, Artificial Sequence
  Synthetic
ctaggcugggctgaggug

SEQ ID NO: 19079 - DNA, 24 bp, Artificial Sequence
  Synthetic
agaaatctctgccucactcctcua

SEQ ID NO: 19080 - DNA, 21 bp, Artificial Sequence
  Synthetic
cccatacugagccaccaggua

SEQ ID NO: 19081 - DNA, 22 bp, Artificial Sequence
  Synthetic
gaaggaggagcugaaggagtuc

SEQ ID NO: 19082 - DNA, 26 bp, Artificial Sequence
  Synthetic
gaacaagaaguggagaatgtcaguct

SEQ ID NO: 19083 - DNA, 21 bp, Artificial Sequence
  Synthetic
cacagacccuctcactcaugt

SEQ ID NO: 19084 - DNA, 22 bp, Artificial Sequence
  Synthetic
cggagattcucttcctctgugc

SEQ ID NO: 19085 - DNA, 24 bp, Artificial Sequence
  Synthetic
gacctgatttccutactgcctcut

SEQ ID NO: 19086 - DNA, 22 bp, Artificial Sequence
  Synthetic
gcctcacaaccuccgtcatgug

SEQ ID NO: 19087 - DNA, 28 bp, Artificial Sequence
  Synthetic
tgtctccttccucttcctacagtacucc

SEQ ID NO: 19088 - DNA, 23 bp, Artificial Sequence
  Synthetic
cattcugggagcttcatcuggac

SEQ ID NO: 19089 - DNA, 22 bp, Artificial Sequence
  Synthetic
ctggtcctcugactgctcttut

SEQ ID NO: 19090 - DNA, 21 bp, Artificial Sequence
  Synthetic
tcatggacucctggagauggt

SEQ ID NO: 19091 - DNA, 21 bp, Artificial Sequence
  Synthetic
gccaaggcutcaagctcucag

SEQ ID NO: 19092 - DNA, 20 bp, Artificial Sequence
  Synthetic
gcuggtccucagaaaaccga

SEQ ID NO: 19093 - DNA, 21 bp, Artificial Sequence
  Synthetic
gaggaaggaugccagctucat

SEQ ID NO: 19094 - DNA, 20 bp, Artificial Sequence
  Synthetic
cutaggaagcuccgccaaga

SEQ ID NO: 19095 - DNA, 20 bp, Artificial Sequence
  Synthetic
ggttcaggcucccaugaagg

SEQ ID NO: 19096 - DNA, 19 bp, Artificial Sequence
  Synthetic
tccagcugcagcagatuga

SEQ ID NO: 19097 - DNA, 19 bp, Artificial Sequence
  Synthetic
actccagaccccugcugaa

SEQ ID NO: 19098 - DNA, 22 bp, Artificial Sequence
  Synthetic
agagaacacugggagaggguag

SEQ ID NO: 19099 - DNA, 19 bp, Artificial Sequence
  Synthetic
cugccgauccaaagccaag

SEQ ID NO: 19100 - DNA, 17 bp, Artificial Sequence
  Synthetic
agcacggccutggucag

SEQ ID NO: 19101 - DNA, 24 bp, Artificial Sequence
  Synthetic
agtggttctgaugacctttcccua

SEQ ID NO: 19102 - DNA, 22 bp, Artificial Sequence
  Synthetic
ggagguggtauaggaggaggag

SEQ ID NO: 19103 - DNA, 20 bp, Artificial Sequence
  Synthetic
ttctccaccucgggctcuaa

SEQ ID NO: 19104 - DNA, 21 bp, Artificial Sequence
  Synthetic
gggcgatuagagggtgaggua

SEQ ID NO: 19105 - DNA, 19 bp, Artificial Sequence
  Synthetic
ccacgggacuctguggagt

SEQ ID NO: 19106 - DNA, 21 bp, Artificial Sequence
  Synthetic
catggtgacauactccccgut

SEQ ID NO: 19107 - DNA, 22 bp, Artificial Sequence
  Synthetic
gccttggtcucctggatctcua

SEQ ID NO: 19108 - DNA, 21 bp, Artificial Sequence
  Synthetic
ccatcugagacccggatctug

SEQ ID NO: 19109 - DNA, 22 bp, Artificial Sequence
  Synthetic
gctgttgtcugctgtgacctua

SEQ ID NO: 19110 - DNA, 18 bp, Artificial Sequence
  Synthetic
gguaccccggaacacguc

SEQ ID NO: 19111 - DNA, 21 bp, Artificial Sequence
  Synthetic
ctactccttcucccacagcuc

SEQ ID NO: 19112 - DNA, 20 bp, Artificial Sequence
  Synthetic
gagctcucgaagtgctguca

SEQ ID NO: 19113 - DNA, 18 bp, Artificial Sequence
  Synthetic
gcagguacgtcgggugag

SEQ ID NO: 19114 - DNA, 19 bp, Artificial Sequence
  Synthetic
ccattgcugttggcaucgg

SEQ ID NO: 19115 - DNA, 19 bp, Artificial Sequence
  Synthetic
cccauggcccagacaugag

SEQ ID NO: 19116 - DNA, 30 bp, Artificial Sequence
  Synthetic
atttatggtcgtttutaaggataagctgut

SEQ ID NO: 19117 - DNA, 28 bp, Artificial Sequence
  Synthetic
gattagacattccutgttgtgctcagua

SEQ ID NO: 19118 - DNA, 21 bp, Artificial Sequence
  Synthetic
accugtcgugaaggaaaccag

SEQ ID NO: 19119 - DNA, 29 bp, Artificial Sequence
  Synthetic
tcatattacttcaguagtcccatguggat

SEQ ID NO: 19120 - DNA, 30 bp, Artificial Sequence
  Synthetic
tgccagggatttugttcctatctaataaug

SEQ ID NO: 19121 - DNA, 31 bp, Artificial Sequence
  Synthetic
ggattatttcuggacacaagauaaggagaat

SEQ ID NO: 19122 - DNA, 27 bp, Artificial Sequence
  Synthetic
cctgctttttaauccaagtaagccaut

SEQ ID NO: 19123 - DNA, 25 bp, Artificial Sequence
  Synthetic
atgctctcaccutaaagtgttggut

SEQ ID NO: 19124 - DNA, 32 bp, Artificial Sequence
  Synthetic
atagctattatccugagtcttatgtctgauac

SEQ ID NO: 19125 - DNA, 31 bp, Artificial Sequence
  Synthetic
gtttcaccauggauaagagaagatacttaua

SEQ ID NO: 19126 - DNA, 29 bp, Artificial Sequence
  Synthetic
aaatgtttgagugagtcttctctttguct

SEQ ID NO: 19127 - DNA, 32 bp, Artificial Sequence
  Synthetic
aagtacatatacctaauctcccaaaatgttuc

SEQ ID NO: 19128 - DNA, 29 bp, Artificial Sequence
  Synthetic
gtcatcaaatgctuagtagcacagaaaut

SEQ ID NO: 19129 - DNA, 31 bp, Artificial Sequence
  Synthetic
atctctcaccatuaccattccaaatattcut

SEQ ID NO: 19130 - DNA, 23 bp, Artificial Sequence
  Synthetic
gaagtggcccugtacatgttuct

SEQ ID NO: 19131 - DNA, 26 bp, Artificial Sequence
  Synthetic
agaggcaaacuccatgaatgtgtuat

SEQ ID NO: 19132 - DNA, 25 bp, Artificial Sequence
  Synthetic
aaggtttaautcatgcttugcacaa

SEQ ID NO: 19133 - DNA, 23 bp, Artificial Sequence
  Synthetic
atccattccugtagggagtcugt

SEQ ID NO: 19134 - DNA, 27 bp, Artificial Sequence
  Synthetic
ggacttcaaauacggaccaatgtuaag

SEQ ID NO: 19135 - DNA, 30 bp, Artificial Sequence
  Synthetic
agagaaaggtgaaaaauaagagaacactut

SEQ ID NO: 19136 - DNA, 30 bp, Artificial Sequence
  Synthetic
gcaattcaaauaaaaacgaaactgtgucaa

SEQ ID NO: 19137 - DNA, 32 bp, Artificial Sequence
  Synthetic
attggacatattaagauttacaagacccuaca

SEQ ID NO: 19138 - DNA, 19 bp, Artificial Sequence
  Synthetic
aaacguggcatgtcucgga

SEQ ID NO: 19139 - DNA, 26 bp, Artificial Sequence
  Synthetic
ctcttacatgccagutctctaggtut

SEQ ID NO: 19140 - DNA, 24 bp, Artificial Sequence
  Synthetic
ccaactgctcuggaacatgtttuc

SEQ ID NO: 19141 - DNA, 25 bp, Artificial Sequence
  Synthetic
cttgacataccucagcacacacaua

SEQ ID NO: 19142 - DNA, 23 bp, Artificial Sequence
  Synthetic
gtatgtagtcggugctgtgacut

SEQ ID NO: 19143 - DNA, 30 bp, Artificial Sequence
  Synthetic
agaaacagcuaataaaaagttcuccaaact

SEQ ID NO: 19144 - DNA, 25 bp, Artificial Sequence
  Synthetic
acataagtcugggtgtatctggugt

SEQ ID NO: 19145 - DNA, 28 bp, Artificial Sequence
  Synthetic
tgattgttccagaguagacgatguaaag

SEQ ID NO: 19146 - DNA, 32 bp, Artificial Sequence
  Synthetic
catactcaguagacaauataaagcctcauaat

SEQ ID NO: 19147 - DNA, 26 bp, Artificial Sequence
  Synthetic
aaaataggatucccagcttuggaagt

SEQ ID NO: 19148 - DNA, 31 bp, Artificial Sequence
  Synthetic
cagtctatatctauaactgtaactccugggt

SEQ ID NO: 19149 - DNA, 23 bp, Artificial Sequence
  Synthetic
ggcagcagguagtttctgttgut

SEQ ID NO: 19150 - DNA, 21 bp, Artificial Sequence
  Synthetic
caggagtgugaagccattguc

SEQ ID NO: 19151 - DNA, 25 bp, Artificial Sequence
  Synthetic
agtaatgcgauattgagcagtgucc

SEQ ID NO: 19152 - DNA, 21 bp, Artificial Sequence
  Synthetic
gagccacaccucacgtuagaa

SEQ ID NO: 19153 - DNA, 29 bp, Artificial Sequence
  Synthetic
gtgaaagtctucactggaaaattcugaaa

SEQ ID NO: 19154 - DNA, 26 bp, Artificial Sequence
  Synthetic
aataaaagctgaggugatggcagaua

SEQ ID NO: 19155 - DNA, 29 bp, Artificial Sequence
  Synthetic
aaacctcctgaugataaaacagataugct

SEQ ID NO: 19156 - DNA, 30 bp, Artificial Sequence
  Synthetic
tttctgtctttacutgttcctttattcuct

SEQ ID NO: 19157 - DNA, 24 bp, Artificial Sequence
  Synthetic
agcagctgacutgactttgcuaat

SEQ ID NO: 19158 - DNA, 27 bp, Artificial Sequence
  Synthetic
ttgttgtctutgggtgtatuagcaaac

SEQ ID NO: 19159 - DNA, 27 bp, Artificial Sequence
  Synthetic
agatatgcuttacaactugagaaccat

SEQ ID NO: 19160 - DNA, 21 bp, Artificial Sequence
  Synthetic
gctgcagcutgatgaggucaa

SEQ ID NO: 19161 - DNA, 26 bp, Artificial Sequence
  Synthetic
gagtaatcuaggaaccucaaggcaaa

SEQ ID NO: 19162 - DNA, 30 bp, Artificial Sequence
  Synthetic
cacuactaactctggtuaacaaacacagaa

SEQ ID NO: 19163 - DNA, 30 bp, Artificial Sequence
  Synthetic
tttgggtgatccutatatatagatguagca

SEQ ID NO: 19164 - DNA, 23 bp, Artificial Sequence
  Synthetic
ctcucccaaaggttcugaaggat

SEQ ID NO: 19165 - DNA, 32 bp, Artificial Sequence
  Synthetic
tttagataaacuaaccaaguaacttcttagug

SEQ ID NO: 19166 - DNA, 23 bp, Artificial Sequence
  Synthetic
tgctgcagaaacucagaggatut

SEQ ID NO: 19167 - DNA, 19 bp, Artificial Sequence
  Synthetic
guaagaagcagcgccugga

SEQ ID NO: 19168 - DNA, 25 bp, Artificial Sequence
  Synthetic
cctgttatcautgtgccaagaucca

SEQ ID NO: 19169 - DNA, 20 bp, Artificial Sequence
  Synthetic
gcgcgcaugttagcaagtuc

SEQ ID NO: 19170 - DNA, 26 bp, Artificial Sequence
  Synthetic
gcaatgaaautcagtccuggaaggaa

SEQ ID NO: 19171 - DNA, 21 bp, Artificial Sequence
  Synthetic
tttgcttcugcacttggctug

SEQ ID NO: 19172 - DNA, 17 bp, Artificial Sequence
  Synthetic
ctucgggcggcaaaucc

SEQ ID NO: 19173 - DNA, 20 bp, Artificial Sequence
  Synthetic
gcctggacgugctccattut

SEQ ID NO: 19174 - DNA, 25 bp, Artificial Sequence
  Synthetic
gccatatggugaagtcttactcgut

SEQ ID NO: 19175 - DNA, 26 bp, Artificial Sequence
  Synthetic
tcaatgaccatcutagtctccaguga

SEQ ID NO: 19176 - DNA, 22 bp, Artificial Sequence
  Synthetic
gcacaucaaagcccaaggacua

SEQ ID NO: 19177 - DNA, 30 bp, Artificial Sequence
  Synthetic
agaucaaaaagttggugaagagaaaagaaa

SEQ ID NO: 19178 - DNA, 24 bp, Artificial Sequence
  Synthetic
gcttttcctgutacctctctgugt

SEQ ID NO: 19179 - DNA, 30 bp, Artificial Sequence
  Synthetic
attctttcaacugtttttagaucaaaggca

SEQ ID NO: 19180 - DNA, 22 bp, Artificial Sequence
  Synthetic
gtaccttuaggcaggctcctuc

SEQ ID NO: 19181 - DNA, 24 bp, Artificial Sequence
  Synthetic
tgcatatgccuttttagcucaaca

SEQ ID NO: 19182 - DNA, 25 bp, Artificial Sequence
  Synthetic
ggtgttttgcaugaagcttcctuaa

SEQ ID NO: 19183 - DNA, 30 bp, Artificial Sequence
  Synthetic
tgtttgatttttcuagtcatcttctcauca

SEQ ID NO: 19184 - DNA, 27 bp, Artificial Sequence
  Synthetic
auccaacagaagaaattuaagggaagt

SEQ ID NO: 19185 - DNA, 25 bp, Artificial Sequence
  Synthetic
cagtgaaccucctttctttgcttut

SEQ ID NO: 19186 - DNA, 22 bp, Artificial Sequence
  Synthetic
cgcccgacugatacttgatuga

SEQ ID NO: 19187 - DNA, 25 bp, Artificial Sequence
  Synthetic
cauagggaaaatgaugagcccagag

SEQ ID NO: 19188 - DNA, 32 bp, Artificial Sequence
  Synthetic
ccatgactttatacucacttttccatttuaag

SEQ ID NO: 19189 - DNA, 20 bp, Artificial Sequence
  Synthetic
gctcccccuaccuccaaaaa

SEQ ID NO: 19190 - DNA, 21 bp, Artificial Sequence
  Synthetic
ctgacccccugaaagctguag

SEQ ID NO: 19191 - DNA, 25 bp, Artificial Sequence
  Synthetic
agucgagaugaaacagaaggaacag

SEQ ID NO: 19192 - DNA, 21 bp, Artificial Sequence
  Synthetic
tccagcucttcttccauggat

SEQ ID NO: 19193 - DNA, 27 bp, Artificial Sequence
  Synthetic
gcagtttcgaaaucaacgagatcuact

SEQ ID NO: 19194 - DNA, 24 bp, Artificial Sequence
  Synthetic
gggtgttcugaagtcagtccuaga

SEQ ID NO: 19195 - DNA, 22 bp, Artificial Sequence
  Synthetic
gcaccagugacattcaggauga

SEQ ID NO: 19196 - DNA, 26 bp, Artificial Sequence
  Synthetic
gctgtagatguctgatttcactgugg

SEQ ID NO: 19197 - DNA, 21 bp, Artificial Sequence
  Synthetic
atgagcgcugacttgtgagut

SEQ ID NO: 19198 - DNA, 20 bp, Artificial Sequence
  Synthetic
tgaugcgctcguacacaagg

SEQ ID NO: 19199 - DNA, 23 bp, Artificial Sequence
  Synthetic
tcctctcaccugccttatcugaa

SEQ ID NO: 19200 - DNA, 20 bp, Artificial Sequence
  Synthetic
gctgtcaguggcaacctcut

SEQ ID NO: 19201 - DNA, 32 bp, Artificial Sequence
  Synthetic
attattctggataugagtggttaattcugagg

SEQ ID NO: 19202 - DNA, 19 bp, Artificial Sequence
  Synthetic
ctctcaucgtggagucgca

SEQ ID NO: 19203 - DNA, 23 bp, Artificial Sequence
  Synthetic
gagcattgccauggacatcaaut

SEQ ID NO: 19204 - DNA, 27 bp, Artificial Sequence
  Synthetic
cttgtttgacauactcatgaagcugag

SEQ ID NO: 19205 - DNA, 24 bp, Artificial Sequence
  Synthetic
agttgtttcctugcatttctggut

SEQ ID NO: 19206 - DNA, 22 bp, Artificial Sequence
  Synthetic
gauttctcctccuccacccaac

SEQ ID NO: 19207 - DNA, 21 bp, Artificial Sequence
  Synthetic
caagtgggucccaaaagcauc

SEQ ID NO: 19208 - DNA, 28 bp, Artificial Sequence
  Synthetic
gggataactuctatgtgattgaucaagg

SEQ ID NO: 19209 - DNA, 27 bp, Artificial Sequence
  Synthetic
gggatgtaaugacccttcaaaaucact

SEQ ID NO: 19210 - DNA, 28 bp, Artificial Sequence
  Synthetic
acagcaccaaauaatacagagcagtuat

SEQ ID NO: 19211 - DNA, 20 bp, Artificial Sequence
  Synthetic
ggutctcccugcaccacaat

SEQ ID NO: 19212 - DNA, 25 bp, Artificial Sequence
  Synthetic
gacctagattugaacgtgttctugg

SEQ ID NO: 19213 - DNA, 22 bp, Artificial Sequence
  Synthetic
catgagugaagcatggatuggg

SEQ ID NO: 19214 - DNA, 22 bp, Artificial Sequence
  Synthetic
cttgtgtgaccuttgcccttug

SEQ ID NO: 19215 - DNA, 21 bp, Artificial Sequence
  Synthetic
cacaaacacacccaugagcug

SEQ ID NO: 19216 - DNA, 19 bp, Artificial Sequence
  Synthetic
cgcacugagctgtccatug

SEQ ID NO: 19217 - DNA, 17 bp, Artificial Sequence
  Synthetic
cggtgggcugactccug

SEQ ID NO: 19218 - DNA, 23 bp, Artificial Sequence
  Synthetic
agaccutggagaatucagagcct

SEQ ID NO: 19219 - DNA, 24 bp, Artificial Sequence
  Synthetic
cattaccacagcauccaagaccua

SEQ ID NO: 19220 - DNA, 20 bp, Artificial Sequence
  Synthetic
aagggcaccagcugtagaug

SEQ ID NO: 19221 - DNA, 22 bp, Artificial Sequence
  Synthetic
cagaatgcaaggucatccucct

SEQ ID NO: 19222 - DNA, 18 bp, Artificial Sequence
  Synthetic
cuccggagagaccccuga

SEQ ID NO: 19223 - DNA, 24 bp, Artificial Sequence
  Synthetic
atggacttgauctcgatggtctug

SEQ ID NO: 19224 - DNA, 27 bp, Artificial Sequence
  Synthetic
aagttcatcaaugaccaguacgagaaa

SEQ ID NO: 19225 - DNA, 18 bp, Artificial Sequence
  Synthetic
augaggacgccgacacug

SEQ ID NO: 19226 - DNA, 20 bp, Artificial Sequence
  Synthetic
gcagugaccacgaguaccag

SEQ ID NO: 19227 - DNA, 21 bp, Artificial Sequence
  Synthetic
tgggucagcagaagagacugt

SEQ ID NO: 19228 - DNA, 21 bp, Artificial Sequence
  Synthetic
caaggtcuacagcctgctgut

SEQ ID NO: 19229 - DNA, 20 bp, Artificial Sequence
  Synthetic
caguccccaucacagaccat

SEQ ID NO: 19230 - DNA, 20 bp, Artificial Sequence
  Synthetic
cgactgaucgacccucaggt

SEQ ID NO: 19231 - DNA, 22 bp, Artificial Sequence
  Synthetic
gggaccacguctttactgaugt

SEQ ID NO: 19232 - DNA, 22 bp, Artificial Sequence
  Synthetic
atcttcccaaaagucaccugca

SEQ ID NO: 19233 - DNA, 27 bp, Artificial Sequence
  Synthetic
aggtcttggtttugattgaatcgtcut

SEQ ID NO: 19234 - DNA, 21 bp, Artificial Sequence
  Synthetic
aagcacauggtcaccauggat

SEQ ID NO: 19235 - DNA, 20 bp, Artificial Sequence
  Synthetic
cgacacugccgttgatgtug

SEQ ID NO: 19236 - DNA, 27 bp, Artificial Sequence
  Synthetic
aggcttattaaatuccttagcgaccug

SEQ ID NO: 19237 - DNA, 22 bp, Artificial Sequence
  Synthetic
atggtguccaactgatgtuggt

SEQ ID NO: 19238 - DNA, 23 bp, Artificial Sequence
  Synthetic
gggacttuggacaactgagugac

SEQ ID NO: 19239 - DNA, 24 bp, Artificial Sequence
  Synthetic
acaaagctgcacucatcttctgut

SEQ ID NO: 19240 - DNA, 20 bp, Artificial Sequence
  Synthetic
ttttcuggacggcgtaccuc

SEQ ID NO: 19241 - DNA, 17 bp, Artificial Sequence
  Synthetic
auggcgtcugccacgat

SEQ ID NO: 19242 - DNA, 21 bp, Artificial Sequence
  Synthetic
acccaaaaugccccugaagac

SEQ ID NO: 19243 - DNA, 21 bp, Artificial Sequence
  Synthetic
gcugccacgugacacaaaaat

SEQ ID NO: 19244 - DNA, 23 bp, Artificial Sequence
  Synthetic
ggctgtcctuaggaacttcagug

SEQ ID NO: 19245 - DNA, 23 bp, Artificial Sequence
  Synthetic
cttcugagaaggcccaaagaugt

SEQ ID NO: 19246 - DNA, 22 bp, Artificial Sequence
  Synthetic
cctcuacgagagcctcuacgac

SEQ ID NO: 19247 - DNA, 23 bp, Artificial Sequence
  Synthetic
tcutcaatgacaaucaggcggaa

SEQ ID NO: 19248 - DNA, 19 bp, Artificial Sequence
  Synthetic
tcctgcugaactgcgcuac

SEQ ID NO: 19249 - DNA, 22 bp, Artificial Sequence
  Synthetic
gtgccugaaggaaatcugcaaa

SEQ ID NO: 19250 - DNA, 27 bp, Artificial Sequence
  Synthetic
ttgtagcctttaugtttcccatcacut

SEQ ID NO: 19251 - DNA, 19 bp, Artificial Sequence
  Synthetic
ggcgcuacggattccauct

SEQ ID NO: 19252 - DNA, 21 bp, Artificial Sequence
  Synthetic
cacugtgtcaguggcagaaac

SEQ ID NO: 19253 - DNA, 19 bp, Artificial Sequence
  Synthetic
catattgcgcgugcagcuc

SEQ ID NO: 19254 - DNA, 20 bp, Artificial Sequence
  Synthetic
ggcccatcuctcttctgugc

SEQ ID NO: 19255 - DNA, 21 bp, Artificial Sequence
  Synthetic
ggagtatcuggcctggucagt

SEQ ID NO: 19256 - DNA, 21 bp, Artificial Sequence
  Synthetic
cgctcctuggtttcctctcug

SEQ ID NO: 19257 - DNA, 27 bp, Artificial Sequence
  Synthetic
ccttcaaguaacactgaagaagtucct

SEQ ID NO: 19258 - DNA, 19 bp, Artificial Sequence
  Synthetic
cctgauggaagcccgtugg

SEQ ID NO: 19259 - DNA, 23 bp, Artificial Sequence
  Synthetic
gaaauctcccactuggaacacag

SEQ ID NO: 19260 - DNA, 21 bp, Artificial Sequence
  Synthetic
ccctgctaaugactcctgucc

SEQ ID NO: 19261 - DNA, 25 bp, Artificial Sequence
  Synthetic
cacagauccaaacctaaggtcucac

SEQ ID NO: 19262 - DNA, 23 bp, Artificial Sequence
  Synthetic
gagctgcctutttctttctggut

SEQ ID NO: 19263 - DNA, 27 bp, Artificial Sequence
  Synthetic
agaagcaagtcuccatgttgttctuac

SEQ ID NO: 19264 - DNA, 25 bp, Artificial Sequence
  Synthetic
ccagaaaugatgaacugaaccacct

SEQ ID NO: 19265 - DNA, 22 bp, Artificial Sequence
  Synthetic
agaggaaatcugcagctctguc

SEQ ID NO: 19266 - DNA, 22 bp, Artificial Sequence
  Synthetic
cgtucagacggttcttugcaag

SEQ ID NO: 19267 - DNA, 20 bp, Artificial Sequence
  Synthetic
gcacucgaggacagcttugg

SEQ ID NO: 19268 - DNA, 23 bp, Artificial Sequence
  Synthetic
attggcgaaugcaagatccttuc

SEQ ID NO: 19269 - DNA, 24 bp, Artificial Sequence
  Synthetic
ccatttctgucaccgttccaucaa

SEQ ID NO: 19270 - DNA, 21 bp, Artificial Sequence
  Synthetic
ggtactgcuccagaagtggut

SEQ ID NO: 19271 - DNA, 29 bp, Artificial Sequence
  Synthetic
cttaggaaatagaaucctgacccacauac

SEQ ID NO: 19272 - DNA, 25 bp, Artificial Sequence
  Synthetic
ctcatcagccaagauaagcgtauca

SEQ ID NO: 19273 - DNA, 25 bp, Artificial Sequence
  Synthetic
ttttcctgcagcuccaaatctuaga

SEQ ID NO: 19274 - DNA, 24 bp, Artificial Sequence
  Synthetic
gggttgctaucatacggttctuac

SEQ ID NO: 19275 - DNA, 21 bp, Artificial Sequence
  Synthetic
cctggaacgcutagtgguaca

SEQ ID NO: 19276 - DNA, 20 bp, Artificial Sequence
  Synthetic
ccgaggucactgaacugcat

SEQ ID NO: 19277 - DNA, 19 bp, Artificial Sequence
  Synthetic
ctgacgauctgccgcugaa

SEQ ID NO: 19278 - DNA, 23 bp, Artificial Sequence
  Synthetic
gtctgtcguagaagtcactcugg

SEQ ID NO: 19279 - DNA, 22 bp, Artificial Sequence
  Synthetic
gctgtgcugatttcctttucgg

SEQ ID NO: 19280 - DNA, 22 bp, Artificial Sequence
  Synthetic
cccggaaaaugctaagctccuc

SEQ ID NO: 19281 - DNA, 21 bp, Artificial Sequence
  Synthetic
ccccataggugtgcaaaucca

SEQ ID NO: 19282 - DNA, 24 bp, Artificial Sequence
  Synthetic
tgaugaaacagccacttauccaca

SEQ ID NO: 19283 - DNA, 26 bp, Artificial Sequence
  Synthetic
gacagtatggaaautaccagcaguga

SEQ ID NO: 19284 - DNA, 24 bp, Artificial Sequence
  Synthetic
actgtacaaagcuttaccguagcc

SEQ ID NO: 19285 - DNA, 24 bp, Artificial Sequence
  Synthetic
aggaaautcacagtauggccaaca

SEQ ID NO: 19286 - DNA, 27 bp, Artificial Sequence
  Synthetic
tttccaaatggaaucttaccctgtuga

SEQ ID NO: 19287 - DNA, 26 bp, Artificial Sequence
  Synthetic
agcctccttcucagcaatacaataug

SEQ ID NO: 19288 - DNA, 27 bp, Artificial Sequence
  Synthetic
aggcatattcauggaactgtttgucat

SEQ ID NO: 19289 - DNA, 27 bp, Artificial Sequence
  Synthetic
acttttgtauggaccatctgttuaact

SEQ ID NO: 19290 - DNA, 27 bp, Artificial Sequence
  Synthetic
tcttactgagaacacuctgaggtctut

SEQ ID NO: 19291 - DNA, 29 bp, Artificial Sequence
  Synthetic
acttgatgcacuagttttatgcuaaacct

SEQ ID NO: 19292 - DNA, 32 bp, Artificial Sequence
  Synthetic
acaaatggacaauatgtctattacgaauacac

SEQ ID NO: 19293 - DNA, 28 bp, Artificial Sequence
  Synthetic
cagcttcttuaccaaactttcaatugct

SEQ ID NO: 19294 - DNA, 30 bp, Artificial Sequence
  Synthetic
acatgttaaatattgucagtatgcgttuga

SEQ ID NO: 19295 - DNA, 32 bp, Artificial Sequence
  Synthetic
ttatgtttcttaggaugaaagcaaagtcuact

SEQ ID NO: 19296 - DNA, 24 bp, Artificial Sequence
  Synthetic
gtgaaggacugttgcagauagcat

SEQ ID NO: 19297 - DNA, 21 bp, Artificial Sequence
  Synthetic
gcccacaugggttaattugct

SEQ ID NO: 19298 - DNA, 28 bp, Artificial Sequence
  Synthetic
ccctattgttacugttgatggatacgug

SEQ ID NO: 19299 - DNA, 32 bp, Artificial Sequence
  Synthetic
taactatctgactauacaatcaatacctugct

SEQ ID NO: 19300 - DNA, 22 bp, Artificial Sequence
  Synthetic
gucatcgacagaugcagcagca

SEQ ID NO: 19301 - DNA, 31 bp, Artificial Sequence
  Synthetic
atgaaaagcatacutactgatagcuggagct

SEQ ID NO: 19302 - DNA, 25 bp, Artificial Sequence
  Synthetic
aaaatttuggagaagggaagucgga

SEQ ID NO: 19303 - DNA, 21 bp, Artificial Sequence
  Synthetic
gtccauacccaccgacaucag

SEQ ID NO: 19304 - DNA, 21 bp, Artificial Sequence
  Synthetic
gatccaggccaucatccugac

SEQ ID NO: 19305 - DNA, 22 bp, Artificial Sequence
  Synthetic
gucccaacacuggaaaggauat

SEQ ID NO: 19306 - DNA, 23 bp, Artificial Sequence
  Synthetic
gcaggtactuctgtcagctgaut

SEQ ID NO: 19307 - DNA, 18 bp, Artificial Sequence
  Synthetic
ccccuagcacgtgccuac

SEQ ID NO: 19308 - DNA, 21 bp, Artificial Sequence
  Synthetic
catgactguggtgccgtacut

SEQ ID NO: 19309 - DNA, 18 bp, Artificial Sequence
  Synthetic
ctgctcccgugggacauc

SEQ ID NO: 19310 - DNA, 22 bp, Artificial Sequence
  Synthetic
tgaggtguggatgtggaugaag

SEQ ID NO: 19311 - DNA, 20 bp, Artificial Sequence
  Synthetic
cccccagauggtgcttucag

SEQ ID NO: 19312 - DNA, 18 bp, Artificial Sequence
  Synthetic
ggtcugcgctttguccga

SEQ ID NO: 19313 - DNA, 21 bp, Artificial Sequence
  Synthetic
cugtcccuggaggagaaagac

SEQ ID NO: 19314 - DNA, 18 bp, Artificial Sequence
  Synthetic
gcucccgggcgttatugg

SEQ ID NO: 19315 - DNA, 20 bp, Artificial Sequence
  Synthetic
tcttcccccaaccucacugt

SEQ ID NO: 19316 - DNA, 17 bp, Artificial Sequence
  Synthetic
gggccggugaaaccuga

SEQ ID NO: 19317 - DNA, 17 bp, Artificial Sequence
  Synthetic
ctugggccccucaccac

SEQ ID NO: 19318 - DNA, 18 bp, Artificial Sequence
  Synthetic
ccagtguccccucggaga

SEQ ID NO: 19319 - DNA, 20 bp, Artificial Sequence
  Synthetic
tgcauggagcagaggugaac

SEQ ID NO: 19320 - DNA, 17 bp, Artificial Sequence
  Synthetic
cctgcccuaccguccct

SEQ ID NO: 19321 - DNA, 20 bp, Artificial Sequence
  Synthetic
ccagctcaggugaggacuac

SEQ ID NO: 19322 - DNA, 18 bp, Artificial Sequence
  Synthetic
gagcugccggaguaggag

SEQ ID NO: 19323 - DNA, 17 bp, Artificial Sequence
  Synthetic
cagcugggcgctttcug

SEQ ID NO: 19324 - DNA, 22 bp, Artificial Sequence
  Synthetic
acagacccutgatctccucact

SEQ ID NO: 19325 - DNA, 19 bp, Artificial Sequence
  Synthetic
ccctcccugcagatgtucc

SEQ ID NO: 19326 - DNA, 18 bp, Artificial Sequence
  Synthetic
gctccguggaaugcagga

SEQ ID NO: 19327 - DNA, 18 bp, Artificial Sequence
  Synthetic
ctgguacgagggcaugct

SEQ ID NO: 19328 - DNA, 18 bp, Artificial Sequence
  Synthetic
cauggcagcccagacuct

SEQ ID NO: 19329 - DNA, 18 bp, Artificial Sequence
  Synthetic
agcccuactguccccaca

SEQ ID NO: 19330 - DNA, 20 bp, Artificial Sequence
  Synthetic
ctuccagagagcaccacuca

SEQ ID NO: 19331 - DNA, 22 bp, Artificial Sequence
  Synthetic
ctaagcugaccatgcucaacac

SEQ ID NO: 19332 - DNA, 18 bp, Artificial Sequence
  Synthetic
ggccactguctgcagcuc

SEQ ID NO: 19333 - DNA, 17 bp, Artificial Sequence
  Synthetic
ctgggccccaucaugct

SEQ ID NO: 19334 - DNA, 20 bp, Artificial Sequence
  Synthetic
ccgcgcuacaaccagaugaa

SEQ ID NO: 19335 - DNA, 25 bp, Artificial Sequence
  Synthetic
aatgatctgaggacuctggagtaug

SEQ ID NO: 19336 - DNA, 18 bp, Artificial Sequence
  Synthetic
gggaugcagcagcagaug

SEQ ID NO: 19337 - DNA, 21 bp, Artificial Sequence
  Synthetic
cattcgctcugagacaccuga

SEQ ID NO: 19338 - DNA, 17 bp, Artificial Sequence
  Synthetic
cccatggugccacugca

SEQ ID NO: 19339 - DNA, 19 bp, Artificial Sequence
  Synthetic
ggcagugacctuggcaact

SEQ ID NO: 19340 - DNA, 23 bp, Artificial Sequence
  Synthetic
ccctcaaugctaaggccuacaag

SEQ ID NO: 19341 - DNA, 17 bp, Artificial Sequence
  Synthetic
ccggagcguacctggug

SEQ ID NO: 19342 - DNA, 20 bp, Artificial Sequence
  Synthetic
ccuacctctugcagcagaca

SEQ ID NO: 19343 - DNA, 18 bp, Artificial Sequence
  Synthetic
acgugaagacggctgcuc

SEQ ID NO: 19344 - DNA, 23 bp, Artificial Sequence
  Synthetic
ggaaagtgaautctgctggcuct

SEQ ID NO: 19345 - DNA, 24 bp, Artificial Sequence
  Synthetic
gaaagccaggaaaugcactctuac

SEQ ID NO: 19346 - DNA, 22 bp, Artificial Sequence
  Synthetic
ggatgtggcutaggcagaacuc

SEQ ID NO: 19347 - DNA, 21 bp, Artificial Sequence
  Synthetic
gatgccgtucaggttgttgut

SEQ ID NO: 19348 - DNA, 20 bp, Artificial Sequence
  Synthetic
ctcttccaccuggagcctuc

SEQ ID NO: 19349 - DNA, 22 bp, Artificial Sequence
  Synthetic
gcttgcaguggtggttctucat

SEQ ID NO: 19350 - DNA, 21 bp, Artificial Sequence
  Synthetic
gccctcgugagcattatgugt

SEQ ID NO: 19351 - DNA, 21 bp, Artificial Sequence
  Synthetic
cttgtccttcucggagccauc

SEQ ID NO: 19352 - DNA, 21 bp, Artificial Sequence
  Synthetic
tgcagggutccaggttuaaca

SEQ ID NO: 19353 - DNA, 21 bp, Artificial Sequence
  Synthetic
gcactttguggttggttgcuc

SEQ ID NO: 19354 - DNA, 23 bp, Artificial Sequence
  Synthetic
tcggcagacacugtgatcattut

SEQ ID NO: 19355 - DNA, 22 bp, Artificial Sequence
  Synthetic
gguccaagacaatguggaggag

SEQ ID NO: 19356 - DNA, 20 bp, Artificial Sequence
  Synthetic
cggcacugacagttugcaat

SEQ ID NO: 19357 - DNA, 20 bp, Artificial Sequence
  Synthetic
cagagugggatgccugaact

SEQ ID NO: 19358 - DNA, 22 bp, Artificial Sequence
  Synthetic
gtccggcagaagaaaucaucac

SEQ ID NO: 19359 - DNA, 20 bp, Artificial Sequence
  Synthetic
tggtgaggtugggtgggtua

SEQ ID NO: 19360 - DNA, 17 bp, Artificial Sequence
  Synthetic
cgggcccauccacucaa

SEQ ID NO: 19361 - DNA, 19 bp, Artificial Sequence
  Synthetic
cggatucggagccttccuc

SEQ ID NO: 19362 - DNA, 20 bp, Artificial Sequence
  Synthetic
ccaacgcacacuctctccuc

SEQ ID NO: 19363 - DNA, 21 bp, Artificial Sequence
  Synthetic
gctaaggccuatgccatcuca

SEQ ID NO: 19364 - DNA, 17 bp, Artificial Sequence
  Synthetic
ctgacccgutccucgct

SEQ ID NO: 19365 - DNA, 20 bp, Artificial Sequence
  Synthetic
gtacgucggaggccttctuc

SEQ ID NO: 19366 - DNA, 23 bp, Artificial Sequence
  Synthetic
cgtcctgaugagattgctcctug

SEQ ID NO: 19367 - DNA, 21 bp, Artificial Sequence
  Synthetic
cgtatttgcggucagcctcut

SEQ ID NO: 19368 - DNA, 18 bp, Artificial Sequence
  Synthetic
ctggcugggcctccttut

SEQ ID NO: 19369 - DNA, 17 bp, Artificial Sequence
  Synthetic
cugggugccaccacact

SEQ ID NO: 19370 - DNA, 19 bp, Artificial Sequence
  Synthetic
ccgcccutccttcttcucc

SEQ ID NO: 19371 - DNA, 20 bp, Artificial Sequence
  Synthetic
aacgtcctcautgcggagut

SEQ ID NO: 19372 - DNA, 24 bp, Artificial Sequence
  Synthetic
agagttgagaugggatagucacga

SEQ ID NO: 19373 - DNA, 20 bp, Artificial Sequence
  Synthetic
gaggactucctgcctuccac

SEQ ID NO: 19374 - DNA, 19 bp, Artificial Sequence
  Synthetic
catactgccugctgccuca

SEQ ID NO: 19375 - DNA, 21 bp, Artificial Sequence
  Synthetic
actcttgacgutgtccagcuc

SEQ ID NO: 19376 - DNA, 27 bp, Artificial Sequence
  Synthetic
ctaattctggugccttcactttgatut

SEQ ID NO: 19377 - DNA, 25 bp, Artificial Sequence
  Synthetic
cacagtcttucatcaggttcuggaa

SEQ ID NO: 19378 - DNA, 23 bp, Artificial Sequence
  Synthetic
gatgccaaccaacaugtcaaguc

SEQ ID NO: 19379 - DNA, 22 bp, Artificial Sequence
  Synthetic
ccacaaacccagagcugagauc

SEQ ID NO: 19380 - DNA, 21 bp, Artificial Sequence
  Synthetic
ggtgtaggutccatgggaugt

SEQ ID NO: 19381 - DNA, 21 bp, Artificial Sequence
  Synthetic
ctgctccugtgaaggtacuca

SEQ ID NO: 19382 - DNA, 20 bp, Artificial Sequence
  Synthetic
acatgcuacccacggttcug

SEQ ID NO: 19383 - DNA, 24 bp, Artificial Sequence
  Synthetic
ggtcaaagautaaggugcccacaa

SEQ ID NO: 19384 - DNA, 21 bp, Artificial Sequence
  Synthetic
gaacgugagcatgtgtgugat

SEQ ID NO: 19385 - DNA, 21 bp, Artificial Sequence
  Synthetic
ccagacaaacugctgcccuac

SEQ ID NO: 19386 - DNA, 19 bp, Artificial Sequence
  Synthetic
ggtgcaggaguccttcugg

SEQ ID NO: 19387 - DNA, 19 bp, Artificial Sequence
  Synthetic
aggacccacccaucaccua

SEQ ID NO: 19388 - DNA, 26 bp, Artificial Sequence
  Synthetic
tgcctggtacuttctgcgatttaaut

SEQ ID NO: 19389 - DNA, 21 bp, Artificial Sequence
  Synthetic
cccctattuggtggccacauc

SEQ ID NO: 19390 - DNA, 19 bp, Artificial Sequence
  Synthetic
gccccacugttcugacaca

SEQ ID NO: 19391 - DNA, 23 bp, Artificial Sequence
  Synthetic
tcacgtgtugttgacaatcugga

SEQ ID NO: 19392 - DNA, 18 bp, Artificial Sequence
  Synthetic
gtcagcaccauccuccgt

SEQ ID NO: 19393 - DNA, 20 bp, Artificial Sequence
  Synthetic
guatccgtuggccagcaaga

SEQ ID NO: 19394 - DNA, 18 bp, Artificial Sequence
  Synthetic
guccaagccgcagacuca

SEQ ID NO: 19395 - DNA, 17 bp, Artificial Sequence
  Synthetic
gtggaugcctcucccga

SEQ ID NO: 19396 - DNA, 18 bp, Artificial Sequence
  Synthetic
gcatggguggcaccugag

SEQ ID NO: 19397 - DNA, 20 bp, Artificial Sequence
  Synthetic
aggutctcucccaccaggat

SEQ ID NO: 19398 - DNA, 19 bp, Artificial Sequence
  Synthetic
ctucccccaccccacttuc

SEQ ID NO: 19399 - DNA, 18 bp, Artificial Sequence
  Synthetic
agggacucgggacacucc

SEQ ID NO: 19400 - DNA, 17 bp, Artificial Sequence
  Synthetic
ccucgagccuccggagt

SEQ ID NO: 19401 - DNA, 17 bp, Artificial Sequence
  Synthetic
gggccguaccugggaat

SEQ ID NO: 19402 - DNA, 28 bp, Artificial Sequence
  Synthetic
gtcctttcaagguactagttactgtugt

SEQ ID NO: 19403 - DNA, 20 bp, Artificial Sequence
  Synthetic
cuguccacucagagaaaggg

SEQ ID NO: 19404 - DNA, 22 bp, Artificial Sequence
  Synthetic
cccatgtuagacaaggcgauca

SEQ ID NO: 19405 - DNA, 23 bp, Artificial Sequence
  Synthetic
tctcuggaagaggctcatauggt

SEQ ID NO: 19406 - DNA, 28 bp, Artificial Sequence
  Synthetic
cctaagcaaatgugattttacccagaug

SEQ ID NO: 19407 - DNA, 26 bp, Artificial Sequence
  Synthetic
cacaattccagaautctccagaggut

SEQ ID NO: 19408 - DNA, 24 bp, Artificial Sequence
  Synthetic
cataaguggaaagaaguccggcat

SEQ ID NO: 19409 - DNA, 24 bp, Artificial Sequence
  Synthetic
aaaggttaucagcaccaugaacca

SEQ ID NO: 19410 - DNA, 23 bp, Artificial Sequence
  Synthetic
gcacaucaatcuacacccagagt

SEQ ID NO: 19411 - DNA, 26 bp, Artificial Sequence
  Synthetic
caacccatgcutgttgaataauggaa

SEQ ID NO: 19412 - DNA, 26 bp, Artificial Sequence
  Synthetic
ttcctctacagcucataacctuacca

SEQ ID NO: 19413 - DNA, 27 bp, Artificial Sequence
  Synthetic
cccaactttcacaauaccaggtacaua

SEQ ID NO: 19414 - DNA, 23 bp, Artificial Sequence
  Synthetic
ctttguttgcaggugcaagaagt

SEQ ID NO: 19415 - DNA, 24 bp, Artificial Sequence
  Synthetic
cactgttccucttcacagaacuct

SEQ ID NO: 19416 - DNA, 17 bp, Artificial Sequence
  Synthetic
ccgtcgucctgccucat

SEQ ID NO: 19417 - DNA, 21 bp, Artificial Sequence
  Synthetic
ggagtccutgctggguaaagg

SEQ ID NO: 19418 - DNA, 21 bp, Artificial Sequence
  Synthetic
accacctccaugagcatcuct

SEQ ID NO: 19419 - DNA, 21 bp, Artificial Sequence
  Synthetic
gttgcagaggcagaguaggua

SEQ ID NO: 19420 - DNA, 17 bp, Artificial Sequence
  Synthetic
ctgtcgccguctccgut

SEQ ID NO: 19421 - DNA, 17 bp, Artificial Sequence
  Synthetic
ctgcgtguggcgctuac

SEQ ID NO: 19422 - DNA, 23 bp, Artificial Sequence
  Synthetic
cgtctgtctucctttcactcaut

SEQ ID NO: 19423 - DNA, 21 bp, Artificial Sequence
  Synthetic
gaugaacacgcuaccacaagg

SEQ ID NO: 19424 - DNA, 22 bp, Artificial Sequence
  Synthetic
ctcctctccuggaagtttucgg

SEQ ID NO: 19425 - DNA, 17 bp, Artificial Sequence
  Synthetic
ccgctgcugccctuact

SEQ ID NO: 19426 - DNA, 22 bp, Artificial Sequence
  Synthetic
agctgcguctcaagaucaacag

SEQ ID NO: 19427 - DNA, 24 bp, Artificial Sequence
  Synthetic
ttggtgagcaugaggatgtagtug

SEQ ID NO: 19428 - DNA, 22 bp, Artificial Sequence
  Synthetic
ctactcaagtcuccgtctgcug

SEQ ID NO: 19429 - DNA, 18 bp, Artificial Sequence
  Synthetic
ccauagccgacacguggt

SEQ ID NO: 19430 - DNA, 19 bp, Artificial Sequence
  Synthetic
cctgaucgagcgctgtcug

SEQ ID NO: 19431 - DNA, 27 bp, Artificial Sequence
  Synthetic
aaguttttagaatctttucccggaggt

SEQ ID NO: 19432 - DNA, 25 bp, Artificial Sequence
  Synthetic
cgctgatggucatatccaatcucaa

SEQ ID NO: 19433 - DNA, 30 bp, Artificial Sequence
  Synthetic
ggttctactcugaatgtctataaactugct

SEQ ID NO: 19434 - DNA, 24 bp, Artificial Sequence
  Synthetic
tcaatgaugaggtaagugcgcaat

SEQ ID NO: 19435 - DNA, 26 bp, Artificial Sequence
  Synthetic
cgtggaggaguttaccatttgtgtua

SEQ ID NO: 19436 - DNA, 17 bp, Artificial Sequence
  Synthetic
ctccaccacgucgcuct

SEQ ID NO: 19437 - DNA, 17 bp, Artificial Sequence
  Synthetic
agcucgccctccuacca

SEQ ID NO: 19438 - DNA, 21 bp, Artificial Sequence
  Synthetic
gctcagcugcaaagaatgugt

SEQ ID NO: 19439 - DNA, 22 bp, Artificial Sequence
  Synthetic
tggtccuacgatcagtccuacc

SEQ ID NO: 19440 - DNA, 22 bp, Artificial Sequence
  Synthetic
agtgggcuccatctggtactua

SEQ ID NO: 19441 - DNA, 18 bp, Artificial Sequence
  Synthetic
cctttuccgagcggcuca

SEQ ID NO: 19442 - DNA, 20 bp, Artificial Sequence
  Synthetic
tctcagcucagccgaguagt

SEQ ID NO: 19443 - DNA, 28 bp, Artificial Sequence
  Synthetic
tgtataacatcccugatgtctgcattug

SEQ ID NO: 19444 - DNA, 19 bp, Artificial Sequence
  Synthetic
caacgccucgctcatctug

SEQ ID NO: 19445 - DNA, 21 bp, Artificial Sequence
  Synthetic
ccgtctgguaggagctgttug

SEQ ID NO: 19446 - DNA, 21 bp, Artificial Sequence
  Synthetic
agugccaaagucagacaagut

SEQ ID NO: 19447 - DNA, 23 bp, Artificial Sequence
  Synthetic
ctattugaacagguagacggcua

SEQ ID NO: 19448 - DNA, 23 bp, Artificial Sequence
  Synthetic
gctggtgtgaucaggttgtcaua

SEQ ID NO: 19449 - DNA, 21 bp, Artificial Sequence
  Synthetic
acactgggagcucaacaaguc

SEQ ID NO: 19450 - DNA, 17 bp, Artificial Sequence
  Synthetic
gcggcugtcacgaucca

SEQ ID NO: 19451 - DNA, 19 bp, Artificial Sequence
  Synthetic
tugaacucaagccgccaga

SEQ ID NO: 19452 - DNA, 26 bp, Artificial Sequence
  Synthetic
cggcacttgugttcagtttcauaaag

SEQ ID NO: 19453 - DNA, 28 bp, Artificial Sequence
  Synthetic
atttgtgtttgctuatgccttaaccaut

SEQ ID NO: 19454 - DNA, 19 bp, Artificial Sequence
  Synthetic
tcgaggcuccctgcactua

SEQ ID NO: 19455 - DNA, 22 bp, Artificial Sequence
  Synthetic
gttgcactcucctccttctucc

SEQ ID NO: 19456 - DNA, 21 bp, Artificial Sequence
  Synthetic
gtcccuaccctgttccaucct

SEQ ID NO: 19457 - DNA, 18 bp, Artificial Sequence
  Synthetic
cagugaccccagccacuc

SEQ ID NO: 19458 - DNA, 17 bp, Artificial Sequence
  Synthetic
ccugcccacagcuggaa

SEQ ID NO: 19459 - DNA, 23 bp, Artificial Sequence
  Synthetic
ggagaugaagtauaggcagcagt

SEQ ID NO: 19460 - DNA, 18 bp, Artificial Sequence
  Synthetic
cgcatugcgacttcguga

SEQ ID NO: 19461 - DNA, 17 bp, Artificial Sequence
  Synthetic
cgcgcaccuggtcauct

SEQ ID NO: 19462 - DNA, 17 bp, Artificial Sequence
  Synthetic
cgguccgcattucgcct

SEQ ID NO: 19463 - DNA, 19 bp, Artificial Sequence
  Synthetic
gctggaacutcacgggcut

SEQ ID NO: 19464 - DNA, 22 bp, Artificial Sequence
  Synthetic
cagagugacccagtgatgttug

SEQ ID NO: 19465 - DNA, 23 bp, Artificial Sequence
  Synthetic
ggacacagccutgtacttcucat

SEQ ID NO: 19466 - DNA, 24 bp, Artificial Sequence
  Synthetic
gtguagagagagaggcugaaaaut

SEQ ID NO: 19467 - DNA, 21 bp, Artificial Sequence
  Synthetic
cccatcgauctccatguccag

SEQ ID NO: 19468 - DNA, 21 bp, Artificial Sequence
  Synthetic
tgtgtccuttggttgtugcct

SEQ ID NO: 19469 - DNA, 22 bp, Artificial Sequence
  Synthetic
gtatgcgauggtggugacaaac

SEQ ID NO: 19470 - DNA, 20 bp, Artificial Sequence
  Synthetic
ggagcuggccccgactcaut

SEQ ID NO: 19471 - DNA, 24 bp, Artificial Sequence
  Synthetic
gcccaatctuctgagatgcuccgt

SEQ ID NO: 19472 - DNA, 30 bp, Artificial Sequence
  Synthetic
ggttttattaatgauttttgctcacagugt

SEQ ID NO: 19473 - DNA, 25 bp, Artificial Sequence
  Synthetic
ccactgtgtccutgattgtgtacug

SEQ ID NO: 19474 - DNA, 25 bp, Artificial Sequence
  Synthetic
ctcacagagtaucatgtctccctug

SEQ ID NO: 19475 - DNA, 28 bp, Artificial Sequence
  Synthetic
ccaaatuaacgcucaggaaaaatacaut

SEQ ID NO: 19476 - DNA, 20 bp, Artificial Sequence
  Synthetic
tcagcuggcgcttacaguag

SEQ ID NO: 19477 - DNA, 23 bp, Artificial Sequence
  Synthetic
catucuacgggaaggagatctug

SEQ ID NO: 19478 - DNA, 28 bp, Artificial Sequence
  Synthetic
cgggaaccaugatctatttaugaggaga

SEQ ID NO: 19479 - DNA, 22 bp, Artificial Sequence
  Synthetic
gactgaccacacagugacauca

SEQ ID NO: 19480 - DNA, 21 bp, Artificial Sequence
  Synthetic
ggtgtctttucctgctaccug

SEQ ID NO: 19481 - DNA, 22 bp, Artificial Sequence
  Synthetic
caatctccaggagcutctgcut

SEQ ID NO: 19482 - DNA, 20 bp, Artificial Sequence
  Synthetic
cccaagcccugatgcaugat

SEQ ID NO: 19483 - DNA, 24 bp, Artificial Sequence
  Synthetic
gaatatccagagcugtctcccuct

SEQ ID NO: 19484 - DNA, 23 bp, Artificial Sequence
  Synthetic
cctctcagcutcttctctgctut

SEQ ID NO: 19485 - DNA, 24 bp, Artificial Sequence
  Synthetic
ctctcttgauatctggtccauccc

SEQ ID NO: 19486 - DNA, 23 bp, Artificial Sequence
  Synthetic
ggacucgaggagagacatgtuct

SEQ ID NO: 19487 - DNA, 21 bp, Artificial Sequence
  Synthetic
agtacccaugccctgaatgug

SEQ ID NO: 19488 - DNA, 21 bp, Artificial Sequence
  Synthetic
ggaacaccguggtgggtttua

SEQ ID NO: 19489 - DNA, 20 bp, Artificial Sequence
  Synthetic
ccugggaatgcuagccagag

SEQ ID NO: 19490 - DNA, 20 bp, Artificial Sequence
  Synthetic
tccactgucaaccctcucca

SEQ ID NO: 19491 - DNA, 21 bp, Artificial Sequence
  Synthetic
atucccagccctugaaaacct

SEQ ID NO: 19492 - DNA, 22 bp, Artificial Sequence
  Synthetic
gcaggagccutttcaggacuaa

SEQ ID NO: 19493 - DNA, 24 bp, Artificial Sequence
  Synthetic
caagagaaaagaucgcaugtccua

SEQ ID NO: 19494 - DNA, 23 bp, Artificial Sequence
  Synthetic
gttggcatcagugaacacctuac

SEQ ID NO: 19495 - DNA, 20 bp, Artificial Sequence
  Synthetic
ccattccccagugtggcauc

SEQ ID NO: 19496 - DNA, 23 bp, Artificial Sequence
  Synthetic
ctgtttgaugacttccuggcaga

SEQ ID NO: 19497 - DNA, 21 bp, Artificial Sequence
  Synthetic
ggagctggagaugcacacuat

SEQ ID NO: 19498 - DNA, 17 bp, Artificial Sequence
  Synthetic
gtcgtucacccgcucca

SEQ ID NO: 19499 - DNA, 17 bp, Artificial Sequence
  Synthetic
guacacucggcgcacct

SEQ ID NO: 19500 - DNA, 21 bp, Artificial Sequence
  Synthetic
gccactguctcacactugcat

SEQ ID NO: 19501 - DNA, 22 bp, Artificial Sequence
  Synthetic
gtgtggtctcuacagaggcaut

SEQ ID NO: 19502 - DNA, 22 bp, Artificial Sequence
  Synthetic
cccccaugctaattugaaggac

SEQ ID NO: 19503 - DNA, 23 bp, Artificial Sequence
  Synthetic
ggtgtctgacugtgacttcucct

SEQ ID NO: 19504 - DNA, 21 bp, Artificial Sequence
  Synthetic
gtccaaagutcacugcaggga

SEQ ID NO: 19505 - DNA, 22 bp, Artificial Sequence
  Synthetic
tcttcctgtcuctctgctgcua

SEQ ID NO: 19506 - DNA, 17 bp, Artificial Sequence
  Synthetic
ccuccgcaggacuggaa

SEQ ID NO: 19507 - DNA, 18 bp, Artificial Sequence
  Synthetic
ccctccaggucaccucac

SEQ ID NO: 19508 - DNA, 27 bp, Artificial Sequence
  Synthetic
tctgtctagaguttgggaatcttuacc

SEQ ID NO: 19509 - DNA, 26 bp, Artificial Sequence
  Synthetic
ggttctctggucctgtagattugaga

SEQ ID NO: 19510 - DNA, 24 bp, Artificial Sequence
  Synthetic
aagggtcctguagctagaaaguct

SEQ ID NO: 19511 - DNA, 18 bp, Artificial Sequence
  Synthetic
ccctggaccacugctcug

SEQ ID NO: 19512 - DNA, 27 bp, Artificial Sequence
  Synthetic
tctctccagaguttggaaatcttuacc

SEQ ID NO: 19513 - DNA, 27 bp, Artificial Sequence
  Synthetic
acatccaugaaaggaaaaaggttcuct

SEQ ID NO: 19514 - DNA, 20 bp, Artificial Sequence
  Synthetic
caaaggucctgaggcuggaa

SEQ ID NO: 19515 - DNA, 18 bp, Artificial Sequence
  Synthetic
ccctccaggucaccucac

SEQ ID NO: 19516 - DNA, 28 bp, Artificial Sequence
  Synthetic
tctctctagaguttggaaatcttuacca

SEQ ID NO: 19517 - DNA, 20 bp, Artificial Sequence
  Synthetic
gtgcagggacaaacgutcuc

SEQ ID NO: 19518 - DNA, 19 bp, Artificial Sequence
  Synthetic
gggccugatcacatcucct

SEQ ID NO: 19519 - DNA, 19 bp, Artificial Sequence
  Synthetic
cagcagcutcagcauggaa

SEQ ID NO: 19520 - DNA, 20 bp, Artificial Sequence
  Synthetic
gguccagaagggcatcugag

SEQ ID NO: 19521 - DNA, 20 bp, Artificial Sequence
  Synthetic
cacgactucggcttcugaca

SEQ ID NO: 19522 - DNA, 18 bp, Artificial Sequence
  Synthetic
ggucccagcccagacuca

SEQ ID NO: 19523 - DNA, 23 bp, Artificial Sequence
  Synthetic
tcccactcttucttcctctccuc

SEQ ID NO: 19524 - DNA, 18 bp, Artificial Sequence
  Synthetic
gtgccuccgggcagauag

SEQ ID NO: 19525 - DNA, 23 bp, Artificial Sequence
  Synthetic
ccacattccccucccaaattcut

SEQ ID NO: 19526 - DNA, 23 bp, Artificial Sequence
  Synthetic
ctaggatcacucctcagucacca

SEQ ID NO: 19527 - DNA, 19 bp, Artificial Sequence
  Synthetic
ctctgtggutggcgtcuct

SEQ ID NO: 19528 - DNA, 21 bp, Artificial Sequence
  Synthetic
ggagaggagggcugaggaaut

SEQ ID NO: 19529 - DNA, 28 bp, Artificial Sequence
  Synthetic
tgctgacatagaautagaaaacgtccut

SEQ ID NO: 19530 - DNA, 17 bp, Artificial Sequence
  Synthetic
gccaucccgagctggut

SEQ ID NO: 19531 - DNA, 22 bp, Artificial Sequence
  Synthetic
cagtgctagcuccatggctuag

SEQ ID NO: 19532 - DNA, 27 bp, Artificial Sequence
  Synthetic
cautataaagatcaugcccaagaagcc

SEQ ID NO: 19533 - DNA, 25 bp, Artificial Sequence
  Synthetic
tctcgtgaatcutctcagagguagt

SEQ ID NO: 19534 - DNA, 22 bp, Artificial Sequence
  Synthetic
ccagacutgtctgtucccagaa

SEQ ID NO: 19535 - DNA, 28 bp, Artificial Sequence
  Synthetic
ccttcgatgatautgccaaatacttcuc

SEQ ID NO: 19536 - DNA, 25 bp, Artificial Sequence
  Synthetic
actuggagaaguaaaaccatacucc

SEQ ID NO: 19537 - DNA, 25 bp, Artificial Sequence
  Synthetic
ggaatccatutctactccaucacct

SEQ ID NO: 19538 - DNA, 17 bp, Artificial Sequence
  Synthetic
gctgcgugtgcgcttug

SEQ ID NO: 19539 - DNA, 18 bp, Artificial Sequence
  Synthetic
cctgagggccutccucga

SEQ ID NO: 19540 - DNA, 28 bp, Artificial Sequence
  Synthetic
gggtaattcuggacaaagttaguaacct

SEQ ID NO: 19541 - DNA, 21 bp, Artificial Sequence
  Synthetic
cttgatgtugcggtccactug

SEQ ID NO: 19542 - DNA, 28 bp, Artificial Sequence
  Synthetic
aatgcctctgucttaaatacattgguga

SEQ ID NO: 19543 - DNA, 20 bp, Artificial Sequence
  Synthetic
ggtacaucacgggcacaugg

SEQ ID NO: 19544 - DNA, 26 bp, Artificial Sequence
  Synthetic
aatagttgaauggaaatagccuccag

SEQ ID NO: 19545 - DNA, 22 bp, Artificial Sequence
  Synthetic
cattguagcagccugaccaaag

SEQ ID NO: 19546 - DNA, 28 bp, Artificial Sequence
  Synthetic
ccctaactcttcuataatggcagtctuc

SEQ ID NO: 19547 - DNA, 25 bp, Artificial Sequence
  Synthetic
ttgaatgtccuctttctttggcuaa

SEQ ID NO: 19548 - DNA, 24 bp, Artificial Sequence
  Synthetic
gggagauatgttcuagaagccact

SEQ ID NO: 19549 - DNA, 26 bp, Artificial Sequence
  Synthetic
tcactccatcutcatcagctctuact

SEQ ID NO: 19550 - DNA, 21 bp, Artificial Sequence
  Synthetic
ctcttugactcgcuggacgaa

SEQ ID NO: 19551 - DNA, 27 bp, Artificial Sequence
  Synthetic
tccaaaggaagaagaautaaccugacc

SEQ ID NO: 19552 - DNA, 22 bp, Artificial Sequence
  Synthetic
aatggucaggaaattgcuccca

SEQ ID NO: 19553 - DNA, 28 bp, Artificial Sequence
  Synthetic
cgaagagugagctaacaaagtucaaaat

SEQ ID NO: 19554 - DNA, 20 bp, Artificial Sequence
  Synthetic
ctaccaaccuccccacccua

SEQ ID NO: 19555 - DNA, 23 bp, Artificial Sequence
  Synthetic
accuatgaccuccaagagagcaa

SEQ ID NO: 19556 - DNA, 21 bp, Artificial Sequence
  Synthetic
ggcugacggacttatucacca

SEQ ID NO: 19557 - DNA, 21 bp, Artificial Sequence
  Synthetic
gcgagacccagacugctttua

SEQ ID NO: 19558 - DNA, 22 bp, Artificial Sequence
  Synthetic
tctgctggagutcatcctgcua

SEQ ID NO: 19559 - DNA, 18 bp, Artificial Sequence
  Synthetic
tgggaucugcgagcagac

SEQ ID NO: 19560 - DNA, 20 bp, Artificial Sequence
  Synthetic
cctccacguacccctcucag

SEQ ID NO: 19561 - DNA, 20 bp, Artificial Sequence
  Synthetic
cgtccuggacgaugcagaag

SEQ ID NO: 19562 - DNA, 20 bp, Artificial Sequence
  Synthetic
ggagcctcgucatcgtcaut

SEQ ID NO: 19563 - DNA, 20 bp, Artificial Sequence
  Synthetic
acagagcuccaagaggugac

SEQ ID NO: 19564 - DNA, 22 bp, Artificial Sequence
  Synthetic
ggtgtccaaacugacaatgcug

SEQ ID NO: 19565 - DNA, 20 bp, Artificial Sequence
  Synthetic
gcgcgggagacutactttug

SEQ ID NO: 19566 - DNA, 21 bp, Artificial Sequence
  Synthetic
gtcugggccaagaggaagaug

SEQ ID NO: 19567 - DNA, 28 bp, Artificial Sequence
  Synthetic
cccggcuttataaatagatugaacacaa

SEQ ID NO: 19568 - DNA, 20 bp, Artificial Sequence
  Synthetic
gcacugagaggctcuccaga

SEQ ID NO: 19569 - DNA, 20 bp, Artificial Sequence
  Synthetic
ggguagacgccttcctucac

SEQ ID NO: 19570 - DNA, 22 bp, Artificial Sequence
  Synthetic
cacugggaacaagctgtauggt

SEQ ID NO: 19571 - DNA, 22 bp, Artificial Sequence
  Synthetic
ggacttccagutgaaggcctug

SEQ ID NO: 19572 - DNA, 22 bp, Artificial Sequence
  Synthetic
cggctggcuttcccagtaatut

SEQ ID NO: 19573 - DNA, 21 bp, Artificial Sequence
  Synthetic
ttggagaacugcgtguaggac

SEQ ID NO: 19574 - DNA, 18 bp, Artificial Sequence
  Synthetic
gagccugcccttcuccac

SEQ ID NO: 19575 - DNA, 18 bp, Artificial Sequence
  Synthetic
gcgtccugggtgtggtuc

SEQ ID NO: 19576 - DNA, 17 bp, Artificial Sequence
  Synthetic
cuggacagcgacgugga

SEQ ID NO: 19577 - DNA, 19 bp, Artificial Sequence
  Synthetic
gcgggaagaaugagtgcug

SEQ ID NO: 19578 - DNA, 17 bp, Artificial Sequence
  Synthetic
gggacgcccucaaggug

SEQ ID NO: 19579 - DNA, 18 bp, Artificial Sequence
  Synthetic
gccgaugctcagguccag

SEQ ID NO: 19580 - DNA, 22 bp, Artificial Sequence
  Synthetic
gtacgtaacccuctgtgctgut

SEQ ID NO: 19581 - DNA, 19 bp, Artificial Sequence
  Synthetic
cctgaccugcacugaggac

SEQ ID NO: 19582 - DNA, 25 bp, Artificial Sequence
  Synthetic
cattagctugaaaccatttcuggga

SEQ ID NO: 19583 - DNA, 19 bp, Artificial Sequence
  Synthetic
acctaccugtacggcugct

SEQ ID NO: 19584 - DNA, 18 bp, Artificial Sequence
  Synthetic
cgttcgcggutggttugc

SEQ ID NO: 19585 - DNA, 22 bp, Artificial Sequence
  Synthetic
cgtctaaaagugcgtggttguc

SEQ ID NO: 19586 - DNA, 17 bp, Artificial Sequence
  Synthetic
ggccgccuacgaggaug

SEQ ID NO: 19587 - DNA, 18 bp, Artificial Sequence
  Synthetic
agggaugggcucacgagt

SEQ ID NO: 19588 - DNA, 19 bp, Artificial Sequence
  Synthetic
agggttctcuggacgctug

SEQ ID NO: 19589 - DNA, 18 bp, Artificial Sequence
  Synthetic
cgtccttcguggctggug

SEQ ID NO: 19590 - DNA, 28 bp, Artificial Sequence
  Synthetic
acgtaattcgtaacuctctttgctgtua

SEQ ID NO: 19591 - DNA, 25 bp, Artificial Sequence
  Synthetic
aaaaugttttagaaugcaagcacca

SEQ ID NO: 19592 - DNA, 22 bp, Artificial Sequence
  Synthetic
ttccatctuctacagggugggt

SEQ ID NO: 19593 - DNA, 26 bp, Artificial Sequence
  Synthetic
ttttccgacugactgaaacttcauct

SEQ ID NO: 19594 - DNA, 21 bp, Artificial Sequence
  Synthetic
catgctactuctggcgtguca

SEQ ID NO: 19595 - DNA, 23 bp, Artificial Sequence
  Synthetic
tccagagaugactucacagagga

SEQ ID NO: 19596 - DNA, 28 bp, Artificial Sequence
  Synthetic
cttcctgagatucatccttcttctucaa

SEQ ID NO: 19597 - DNA, 23 bp, Artificial Sequence
  Synthetic
aggtgatgauggaatctgaucct

SEQ ID NO: 19598 - DNA, 26 bp, Artificial Sequence
  Synthetic
caatagctggcuttcacagagauact

SEQ ID NO: 19599 - DNA, 17 bp, Artificial Sequence
  Synthetic
gccacagcuccccguat

SEQ ID NO: 19600 - DNA, 22 bp, Artificial Sequence
  Synthetic
acctctctccutctgcatcucc

SEQ ID NO: 19601 - DNA, 20 bp, Artificial Sequence
  Synthetic
tggtgggccauctccacuat

SEQ ID NO: 19602 - DNA, 24 bp, Artificial Sequence
  Synthetic
gctcctctgcuccaacaacttaua

SEQ ID NO: 19603 - DNA, 23 bp, Artificial Sequence
  Synthetic
gatgctgtgtutggccttcttut

SEQ ID NO: 19604 - DNA, 22 bp, Artificial Sequence
  Synthetic
ggtctacatgugttgcagcuct

SEQ ID NO: 19605 - DNA, 17 bp, Artificial Sequence
  Synthetic
gggugggaagcctccug

SEQ ID NO: 19606 - DNA, 22 bp, Artificial Sequence
  Synthetic
cactaauggcctttuccccaca

SEQ ID NO: 19607 - DNA, 21 bp, Artificial Sequence
  Synthetic
gtctcctggcutgatggaguc

SEQ ID NO: 19608 - DNA, 21 bp, Artificial Sequence
  Synthetic
ggccaaaaaugtgagcctcuc

SEQ ID NO: 19609 - DNA, 21 bp, Artificial Sequence
  Synthetic
gttagggtugggctgggaaut

SEQ ID NO: 19610 - DNA, 26 bp, Artificial Sequence
  Synthetic
acacaccuaagttgtgaaaaugagaa

SEQ ID NO: 19611 - DNA, 21 bp, Artificial Sequence
  Synthetic
ggtggtgguggcataggtuat

SEQ ID NO: 19612 - DNA, 24 bp, Artificial Sequence
  Synthetic
ggctgacttacuggatccatguag

SEQ ID NO: 19613 - DNA, 28 bp, Artificial Sequence
  Synthetic
cacttcagttatguacctgatgggtaut

SEQ ID NO: 19614 - DNA, 28 bp, Artificial Sequence
  Synthetic
agaataaacaagacaacutacgtcguca

SEQ ID NO: 19615 - DNA, 27 bp, Artificial Sequence
  Synthetic
ctgttgtaataguggatgatcguggaa

SEQ ID NO: 19616 - DNA, 26 bp, Artificial Sequence
  Synthetic
cccccacccuttttaattctacguaa

SEQ ID NO: 19617 - DNA, 27 bp, Artificial Sequence
  Synthetic
gtttgttgggaauctacctgctgauat

SEQ ID NO: 19618 - DNA, 17 bp, Artificial Sequence
  Synthetic
gaccugggccctgctua

SEQ ID NO: 19619 - DNA, 17 bp, Artificial Sequence
  Synthetic
ccgccugcagtcaccuc

SEQ ID NO: 19620 - DNA, 22 bp, Artificial Sequence
  Synthetic
cgctcttcucgctcaagatcug

SEQ ID NO: 19621 - DNA, 22 bp, Artificial Sequence
  Synthetic
acatccacaucgactgaugcaa

SEQ ID NO: 19622 - DNA, 21 bp, Artificial Sequence
  Synthetic
caagguccaggagccattcua

SEQ ID NO: 19623 - DNA, 19 bp, Artificial Sequence
  Synthetic
tgagauggccggctaucct

SEQ ID NO: 19624 - DNA, 17 bp, Artificial Sequence
  Synthetic
cgagtggugccggguat

SEQ ID NO: 19625 - DNA, 21 bp, Artificial Sequence
  Synthetic
gcagcactcucctccttcuga

SEQ ID NO: 19626 - DNA, 28 bp, Artificial Sequence
  Synthetic
cttgggtgauggaaaaatgaaatcugat

SEQ ID NO: 19627 - DNA, 28 bp, Artificial Sequence
  Synthetic
gctttgtccttaucttgatcatccauct

SEQ ID NO: 19628 - DNA, 23 bp, Artificial Sequence
  Synthetic
aguccaggagaaaagctcaucac

SEQ ID NO: 19629 - DNA, 21 bp, Artificial Sequence
  Synthetic
gagtccauccggacatugacc

SEQ ID NO: 19630 - DNA, 25 bp, Artificial Sequence
  Synthetic
cctggcccauaatgtgtttctttua

SEQ ID NO: 19631 - DNA, 23 bp, Artificial Sequence
  Synthetic
gcttttctugtttttggcugcct

SEQ ID NO: 19632 - DNA, 28 bp, Artificial Sequence
  Synthetic
gcttatctuttgataggcugagggaaaa

SEQ ID NO: 19633 - DNA, 22 bp, Artificial Sequence
  Synthetic
ttcccttgagugactggaguct

SEQ ID NO: 19634 - DNA, 22 bp, Artificial Sequence
  Synthetic
ccattccuggcatgatccttug

SEQ ID NO: 19635 - DNA, 28 bp, Artificial Sequence
  Synthetic
tttttgaaaatcgutgttgctgttgtug

SEQ ID NO: 19636 - DNA, 24 bp, Artificial Sequence
  Synthetic
caatauacagcccauaaccgagua

SEQ ID NO: 19637 - DNA, 22 bp, Artificial Sequence
  Synthetic
ctctcgcgguagtacaatcugt

SEQ ID NO: 19638 - DNA, 20 bp, Artificial Sequence
  Synthetic
gctttcccggutcgaaggut

SEQ ID NO: 19639 - DNA, 26 bp, Artificial Sequence
  Synthetic
cgcagatacgccaguattgagaaaua

SEQ ID NO: 19640 - DNA, 22 bp, Artificial Sequence
  Synthetic
cccactgugcttctgtctguat

SEQ ID NO: 19641 - DNA, 21 bp, Artificial Sequence
  Synthetic
gccccaauggtgtggattuga

SEQ ID NO: 19642 - DNA, 23 bp, Artificial Sequence
  Synthetic
ggttctggugcattcatgacuga

SEQ ID NO: 19643 - DNA, 25 bp, Artificial Sequence
  Synthetic
acacccagcccuaacattgttaaua

SEQ ID NO: 19644 - DNA, 31 bp, Artificial Sequence
  Synthetic
gtaggatgaaagacuaaatcaaagagaccut

SEQ ID NO: 19645 - DNA, 27 bp, Artificial Sequence
  Synthetic
ccaggtagugcatcttcatuaaaagca

SEQ ID NO: 19646 - DNA, 22 bp, Artificial Sequence
  Synthetic
cactgtgtcutcaacagcagut

SEQ ID NO: 19647 - DNA, 23 bp, Artificial Sequence
  Synthetic
ctgctgccagutttgttgatuac

SEQ ID NO: 19648 - DNA, 26 bp, Artificial Sequence
  Synthetic
tggacatccacutgggtgaaataaug

SEQ ID NO: 19649 - DNA, 27 bp, Artificial Sequence
  Synthetic
caggtgttgucagcatcatagtcauat

SEQ ID NO: 19650 - DNA, 24 bp, Artificial Sequence
  Synthetic
gatggcccautatgagaagauggt

SEQ ID NO: 19651 - DNA, 22 bp, Artificial Sequence
  Synthetic
gaagttgaagcuggagagccut

SEQ ID NO: 19652 - DNA, 28 bp, Artificial Sequence
  Synthetic
aggaattggtcutggagaaaaatctuca

SEQ ID NO: 19653 - DNA, 26 bp, Artificial Sequence
  Synthetic
gaaaacactggautaccaaaggctut

SEQ ID NO: 19654 - DNA, 23 bp, Artificial Sequence
  Synthetic
attccacacugtccaaactcucc

SEQ ID NO: 19655 - DNA, 21 bp, Artificial Sequence
  Synthetic
acuttggcgataugggcacat

SEQ ID NO: 19656 - DNA, 24 bp, Artificial Sequence
  Synthetic
gtgtattacctucgtctgctguca

SEQ ID NO: 19657 - DNA, 28 bp, Artificial Sequence
  Synthetic
tgttgtttttcagaaauccaaagctugt

SEQ ID NO: 19658 - DNA, 18 bp, Artificial Sequence
  Synthetic
cggcgggutactcagcuc

SEQ ID NO: 19659 - DNA, 22 bp, Artificial Sequence
  Synthetic
cctaacttcutgctccgcucac

SEQ ID NO: 19660 - DNA, 19 bp, Artificial Sequence
  Synthetic
gggagucacgttcctcugg

SEQ ID NO: 19661 - DNA, 21 bp, Artificial Sequence
  Synthetic
acacutacaucaccgaagcgt

SEQ ID NO: 19662 - DNA, 21 bp, Artificial Sequence
  Synthetic
cagagatcacuttccccuggt

SEQ ID NO: 19663 - DNA, 25 bp, Artificial Sequence
  Synthetic
agaacgggtaguctctttctctcuc

SEQ ID NO: 19664 - DNA, 28 bp, Artificial Sequence
  Synthetic
gccaaattagcaaugtctggcaaaatua

SEQ ID NO: 19665 - DNA, 24 bp, Artificial Sequence
  Synthetic
gtgccaaaucgatcaaattcucgt

SEQ ID NO: 19666 - DNA, 28 bp, Artificial Sequence
  Synthetic
ccacccttactauacagagatcgtgaua

SEQ ID NO: 19667 - DNA, 20 bp, Artificial Sequence
  Synthetic
guccaaggaccaaccauccc

SEQ ID NO: 19668 - DNA, 22 bp, Artificial Sequence
  Synthetic
gcgagaccguaaaaactcugca

SEQ ID NO: 19669 - DNA, 20 bp, Artificial Sequence
  Synthetic
gggacutcagctuggaggaa

SEQ ID NO: 19670 - DNA, 19 bp, Artificial Sequence
  Synthetic
gttcugacagccggtccuc

SEQ ID NO: 19671 - DNA, 24 bp, Artificial Sequence
  Synthetic
ggtgttttccutgtctttgtugcc

SEQ ID NO: 19672 - DNA, 30 bp, Artificial Sequence
  Synthetic
ggtaugagaauaagaagagagaaaactugg

SEQ ID NO: 19673 - DNA, 26 bp, Artificial Sequence
  Synthetic
cttcaggaatcucacttttcaacuct

SEQ ID NO: 19674 - DNA, 24 bp, Artificial Sequence
  Synthetic
cagttcgugggcttgttttgtauc

SEQ ID NO: 19675 - DNA, 29 bp, Artificial Sequence
  Synthetic
acccagcctaaucttgtttttcttatgut

SEQ ID NO: 19676 - DNA, 27 bp, Artificial Sequence
  Synthetic
catctacaaaguggttctggatuagct

SEQ ID NO: 19677 - DNA, 26 bp, Artificial Sequence
  Synthetic
caattaacccugattactggttucca

SEQ ID NO: 19678 - DNA, 20 bp, Artificial Sequence
  Synthetic
gaccactgugactgggtgut

SEQ ID NO: 19679 - DNA, 22 bp, Artificial Sequence
  Synthetic
caggtagcucagaccattcucc

SEQ ID NO: 19680 - DNA, 25 bp, Artificial Sequence
  Synthetic
ccaggaccauaccaaacatctcaut

SEQ ID NO: 19681 - DNA, 22 bp, Artificial Sequence
  Synthetic
ctcagugagccagttgctaucc

SEQ ID NO: 19682 - DNA, 21 bp, Artificial Sequence
  Synthetic
tttgcctccutggcaaggtua

SEQ ID NO: 19683 - DNA, 20 bp, Artificial Sequence
  Synthetic
aggcaccgugttgacttcug

SEQ ID NO: 19684 - DNA, 21 bp, Artificial Sequence
  Synthetic
ggtuggccccattttucaaca

SEQ ID NO: 19685 - DNA, 26 bp, Artificial Sequence
  Synthetic
gggagttuaagatttcattgugcaag

SEQ ID NO: 19686 - DNA, 19 bp, Artificial Sequence
  Synthetic
tgcauccaggagacgctug

SEQ ID NO: 19687 - DNA, 26 bp, Artificial Sequence
  Synthetic
tgagtgaugaagatgaagaugcagag

SEQ ID NO: 19688 - DNA, 23 bp, Artificial Sequence
  Synthetic
ccattcaggacacuctggagcua

SEQ ID NO: 19689 - DNA, 27 bp, Artificial Sequence
  Synthetic
tcagaagcuaacctaattggtacugga

SEQ ID NO: 19690 - DNA, 30 bp, Artificial Sequence
  Synthetic
cccagcagaauaataaacagaatgaugaca

SEQ ID NO: 19691 - DNA, 28 bp, Artificial Sequence
  Synthetic
aagttgcccuctaaatgaatctaaugct

SEQ ID NO: 19692 - DNA, 23 bp, Artificial Sequence
  Synthetic
catagcagcugacttcucaccat

SEQ ID NO: 19693 - DNA, 25 bp, Artificial Sequence
  Synthetic
accctggttautgtggtattgaugc

SEQ ID NO: 19694 - DNA, 22 bp, Artificial Sequence
  Synthetic
cagctcaucacactggttgtug

SEQ ID NO: 19695 - DNA, 21 bp, Artificial Sequence
  Synthetic
caguattgugccgacaaagct

SEQ ID NO: 19696 - DNA, 28 bp, Artificial Sequence
  Synthetic
aaaccaggtttaauctcagttctgtuca

SEQ ID NO: 19697 - DNA, 21 bp, Artificial Sequence
  Synthetic
gaatggagggacutgtgcugt

SEQ ID NO: 19698 - DNA, 24 bp, Artificial Sequence
  Synthetic
actgtagccuccaatcctauccat

SEQ ID NO: 19699 - DNA, 21 bp, Artificial Sequence
  Synthetic
aagggtggtuatcccttgcug

SEQ ID NO: 19700 - DNA, 21 bp, Artificial Sequence
  Synthetic
actcatcgagutgctccucac

SEQ ID NO: 19701 - DNA, 28 bp, Artificial Sequence
  Synthetic
atgttcttctaugacatttctcccucac

SEQ ID NO: 19702 - DNA, 24 bp, Artificial Sequence
  Synthetic
gctgcatucattgatctcauggag

SEQ ID NO: 19703 - DNA, 24 bp, Artificial Sequence
  Synthetic
aguagtaagucacaggcaccagat

SEQ ID NO: 19704 - DNA, 23 bp, Artificial Sequence
  Synthetic
gcttaagagcugactggcauact

SEQ ID NO: 19705 - DNA, 23 bp, Artificial Sequence
  Synthetic
attgacgagugtatcuccaagcc

SEQ ID NO: 19706 - DNA, 21 bp, Artificial Sequence
  Synthetic
acucaggcacugacaaagcaa

SEQ ID NO: 19707 - DNA, 29 bp, Artificial Sequence
  Synthetic
ggtgaatattgaugaatgtgcctcaaauc

SEQ ID NO: 19708 - DNA, 22 bp, Artificial Sequence
  Synthetic
cucaaagccccattugacaact

SEQ ID NO: 19709 - DNA, 22 bp, Artificial Sequence
  Synthetic
aatcccugcatccauggaaact

SEQ ID NO: 19710 - DNA, 24 bp, Artificial Sequence
  Synthetic
ggtauctgagcataugccaacagt

SEQ ID NO: 19711 - DNA, 20 bp, Artificial Sequence
  Synthetic
gaacgatggucgctgcatug

SEQ ID NO: 19712 - DNA, 21 bp, Artificial Sequence
  Synthetic
ccccatucagacacggaguac

SEQ ID NO: 19713 - DNA, 23 bp, Artificial Sequence
  Synthetic
acccattggtauaagccctgcua

SEQ ID NO: 19714 - DNA, 24 bp, Artificial Sequence
  Synthetic
aatggcactcautgatgtccauct

SEQ ID NO: 19715 - DNA, 24 bp, Artificial Sequence
  Synthetic
gtggaaacucaactgctttgaucc

SEQ ID NO: 19716 - DNA, 25 bp, Artificial Sequence
  Synthetic
tcaatgttctcacugcagtcatcuc

SEQ ID NO: 19717 - DNA, 22 bp, Artificial Sequence
  Synthetic
cagaggaugtggatgaaugcct

SEQ ID NO: 19718 - DNA, 22 bp, Artificial Sequence
  Synthetic
gtcccctaaucctgggacacua

SEQ ID NO: 19719 - DNA, 24 bp, Artificial Sequence
  Synthetic
cagtactgugacagcctgtatgug

SEQ ID NO: 19720 - DNA, 25 bp, Artificial Sequence
  Synthetic
gacattuaagagccagacaccauga

SEQ ID NO: 19721 - DNA, 21 bp, Artificial Sequence
  Synthetic
catatgcucagccgggauacc

SEQ ID NO: 19722 - DNA, 22 bp, Artificial Sequence
  Synthetic
accaguaacatuccacagaagc

SEQ ID NO: 19723 - DNA, 26 bp, Artificial Sequence
  Synthetic
gagatggctaugaaccctgtguaaat

SEQ ID NO: 19724 - DNA, 17 bp, Artificial Sequence
  Synthetic
ggacccucccguggact

SEQ ID NO: 19725 - DNA, 20 bp, Artificial Sequence
  Synthetic
ctgccatguactccagccut

SEQ ID NO: 19726 - DNA, 24 bp, Artificial Sequence
  Synthetic
aatgaactgtuccatgctctccut

SEQ ID NO: 19727 - DNA, 22 bp, Artificial Sequence
  Synthetic
gcctggtcaguaagagtctgut

SEQ ID NO: 19728 - DNA, 22 bp, Artificial Sequence
  Synthetic
ctgtctuagggcactgtaguca

SEQ ID NO: 19729 - DNA, 29 bp, Artificial Sequence
  Synthetic
cagaagattctgutgtgttgtcatttuct

SEQ ID NO: 19730 - DNA, 23 bp, Artificial Sequence
  Synthetic
agacaattgtucccctgaaugct

SEQ ID NO: 19731 - DNA, 24 bp, Artificial Sequence
  Synthetic
acaagtgcutggaaatactugggt

SEQ ID NO: 19732 - DNA, 20 bp, Artificial Sequence
  Synthetic
ggtccccucttaccuggagt

SEQ ID NO: 19733 - DNA, 20 bp, Artificial Sequence
  Synthetic
tcccaccutcaagagcugga

SEQ ID NO: 19734 - DNA, 27 bp, Artificial Sequence
  Synthetic
ctaaauagagccagaaauaggaagguc

SEQ ID NO: 19735 - DNA, 24 bp, Artificial Sequence
  Synthetic
tggaagagcaucttggtgaaaucc

SEQ ID NO: 19736 - DNA, 21 bp, Artificial Sequence
  Synthetic
gttctatggugcccctuggag

SEQ ID NO: 19737 - DNA, 25 bp, Artificial Sequence
  Synthetic
ctgacaccccauttgcttcttacua

SEQ ID NO: 19738 - DNA, 21 bp, Artificial Sequence
  Synthetic
tgctgttggautcggcctuag

SEQ ID NO: 19739 - DNA, 28 bp, Artificial Sequence
  Synthetic
aggattccagtuctctgtagaacaucat

SEQ ID NO: 19740 - DNA, 24 bp, Artificial Sequence
  Synthetic
gtcccaatcuctttcccagatuct

SEQ ID NO: 19741 - DNA, 25 bp, Artificial Sequence
  Synthetic
gggaccagccuaatttcttatcguc

SEQ ID NO: 19742 - DNA, 23 bp, Artificial Sequence
  Synthetic
aagaaaguacccaaacagugcca

SEQ ID NO: 19743 - DNA, 21 bp, Artificial Sequence
  Synthetic
tctactcuccagggctucagg

SEQ ID NO: 19744 - DNA, 23 bp, Artificial Sequence
  Synthetic
cagaggaacuagccagtgtugag

SEQ ID NO: 19745 - DNA, 24 bp, Artificial Sequence
  Synthetic
ccacaacagcacauccaactttua

SEQ ID NO: 19746 - DNA, 24 bp, Artificial Sequence
  Synthetic
gatagcgtugtttgcattgugaca

SEQ ID NO: 19747 - DNA, 23 bp, Artificial Sequence
  Synthetic
ctcagactgucctgatccctgua

SEQ ID NO: 19748 - DNA, 24 bp, Artificial Sequence
  Synthetic
ctactctcacucagaccctcttug

SEQ ID NO: 19749 - DNA, 21 bp, Artificial Sequence
  Synthetic
gaacaccaugctgagccttug

SEQ ID NO: 19750 - DNA, 23 bp, Artificial Sequence
  Synthetic
cctgaagacaccugttactgucc

SEQ ID NO: 19751 - DNA, 25 bp, Artificial Sequence
  Synthetic
ctcatgtttctcutgggtcctctut

SEQ ID NO: 19752 - DNA, 20 bp, Artificial Sequence
  Synthetic
gccagtgcucagtaggcaug

SEQ ID NO: 19753 - DNA, 22 bp, Artificial Sequence
  Synthetic
ttacgcagucggcuagaagaag

SEQ ID NO: 19754 - DNA, 31 bp, Artificial Sequence
  Synthetic
ggtttatattccaguaacttacctgttguct

SEQ ID NO: 19755 - DNA, 24 bp, Artificial Sequence
  Synthetic
caaatgcaacuggttgatccugaa

SEQ ID NO: 19756 - DNA, 27 bp, Artificial Sequence
  Synthetic
tttttagccaugagttcaagttccuct

SEQ ID NO: 19757 - DNA, 22 bp, Artificial Sequence
  Synthetic
cucaaaggagguagcagauacc

SEQ ID NO: 19758 - DNA, 21 bp, Artificial Sequence
  Synthetic
gttagagaugggtgctuggga

SEQ ID NO: 19759 - DNA, 24 bp, Artificial Sequence
  Synthetic
gtgatttccucttactaggcugct

SEQ ID NO: 19760 - DNA, 27 bp, Artificial Sequence
  Synthetic
ctgctgaatgauactctcttgttccut

SEQ ID NO: 19761 - DNA, 29 bp, Artificial Sequence
  Synthetic
actgattattgcuctctttatggctguag

SEQ ID NO: 19762 - DNA, 27 bp, Artificial Sequence
  Synthetic
tccagagcaacagcuttatcatgtaut

SEQ ID NO: 19763 - DNA, 29 bp, Artificial Sequence
  Synthetic
gaaactatttttgguctcaggaattucgg

SEQ ID NO: 19764 - DNA, 20 bp, Artificial Sequence
  Synthetic
ccagtuggcgctctttcugt

SEQ ID NO: 19765 - DNA, 20 bp, Artificial Sequence
  Synthetic
gcttgcccuccttgtgatug

SEQ ID NO: 19766 - DNA, 24 bp, Artificial Sequence
  Synthetic
ccctgctttucagagtttcctuga

SEQ ID NO: 19767 - DNA, 28 bp, Artificial Sequence
  Synthetic
catttgaggcuaaaagacatcatugacc

SEQ ID NO: 19768 - DNA, 24 bp, Artificial Sequence
  Synthetic
agggataacucacaggtgtctugt

SEQ ID NO: 19769 - DNA, 25 bp, Artificial Sequence
  Synthetic
tcttgattauaagcccauccagagc

SEQ ID NO: 19770 - DNA, 21 bp, Artificial Sequence
  Synthetic
aggagauacttcuggccacct

SEQ ID NO: 19771 - DNA, 24 bp, Artificial Sequence
  Synthetic
ggtggagaaugaggatcagaucca

SEQ ID NO: 19772 - DNA, 25 bp, Artificial Sequence
  Synthetic
gggcaataacugtgtcgaatcgaua

SEQ ID NO: 19773 - DNA, 18 bp, Artificial Sequence
  Synthetic
cgcuggatctuccacacg

SEQ ID NO: 19774 - DNA, 23 bp, Artificial Sequence
  Synthetic
gccaggctcugattcagttctuc

SEQ ID NO: 19775 - DNA, 25 bp, Artificial Sequence
  Synthetic
cctgctatacuagaccatgctauct

SEQ ID NO: 19776 - DNA, 23 bp, Artificial Sequence
  Synthetic
gaagagccuagaauagcgaccaa

SEQ ID NO: 19777 - DNA, 21 bp, Artificial Sequence
  Synthetic
tcaagcugcgcatctactucc

SEQ ID NO: 19778 - DNA, 24 bp, Artificial Sequence
  Synthetic
caaggaauatgtcugcacaaacgg

SEQ ID NO: 19779 - DNA, 27 bp, Artificial Sequence
  Synthetic
gaatgtgccagutagaatgatccuagt

SEQ ID NO: 19780 - DNA, 20 bp, Artificial Sequence
  Synthetic
ccgguaaggcgtgtagugag

SEQ ID NO: 19781 - DNA, 21 bp, Artificial Sequence
  Synthetic
aggaaccguagctaggacugg

SEQ ID NO: 19782 - DNA, 29 bp, Artificial Sequence
  Synthetic
ttctaactgccccaautaaaatgcaatut

SEQ ID NO: 19783 - DNA, 22 bp, Artificial Sequence
  Synthetic
gaagctaacgcugcatgatcug

SEQ ID NO: 19784 - DNA, 27 bp, Artificial Sequence
  Synthetic
atgggcagtcutcctctatatttcuct

SEQ ID NO: 19785 - DNA, 26 bp, Artificial Sequence
  Synthetic
ctttgtcttcauctctggttcugact

SEQ ID NO: 19786 - DNA, 25 bp, Artificial Sequence
  Synthetic
cttgctgtgggcutaatggttagua

SEQ ID NO: 19787 - DNA, 24 bp, Artificial Sequence
  Synthetic
tgttcctttutgacctttcuccct

SEQ ID NO: 19788 - DNA, 21 bp, Artificial Sequence
  Synthetic
tccatcaggcutcccuacaca

SEQ ID NO: 19789 - DNA, 21 bp, Artificial Sequence
  Synthetic
tccttcaaaugcaggcugagg

SEQ ID NO: 19790 - DNA, 21 bp, Artificial Sequence
  Synthetic
tgttccaugaacccacaagug

SEQ ID NO: 19791 - DNA, 28 bp, Artificial Sequence
  Synthetic
ggacaagtautctgaagcttugaaggat

SEQ ID NO: 19792 - DNA, 19 bp, Artificial Sequence
  Synthetic
ggcuagccctagaguacgg

SEQ ID NO: 19793 - DNA, 18 bp, Artificial Sequence
  Synthetic
tgcuggcguaagcaacca

SEQ ID NO: 19794 - DNA, 24 bp, Artificial Sequence
  Synthetic
ctgtcctaaaacagugaggcctua

SEQ ID NO: 19795 - DNA, 28 bp, Artificial Sequence
  Synthetic
gatactgtaagucctgtcttugaggaaa

SEQ ID NO: 19796 - DNA, 18 bp, Artificial Sequence
  Synthetic
ctgcccugcaggugacaa

SEQ ID NO: 19797 - DNA, 20 bp, Artificial Sequence
  Synthetic
gcagctctucagggacagug

SEQ ID NO: 19798 - DNA, 28 bp, Artificial Sequence
  Synthetic
tcacaaaatcautccataaactcuggct

SEQ ID NO: 19799 - DNA, 23 bp, Artificial Sequence
  Synthetic
gagctggtcaucacctttgauct

SEQ ID NO: 19800 - DNA, 26 bp, Artificial Sequence
  Synthetic
cagacccaagccaaauatggattcua

SEQ ID NO: 19801 - DNA, 23 bp, Artificial Sequence
  Synthetic
ggaaagagaucctgggctuagag

SEQ ID NO: 19802 - DNA, 17 bp, Artificial Sequence
  Synthetic
ctccucgggacugcgat

SEQ ID NO: 19803 - DNA, 17 bp, Artificial Sequence
  Synthetic
gcaatgccugcctgucc

SEQ ID NO: 19804 - DNA, 22 bp, Artificial Sequence
  Synthetic
ggccctttccutgactctgtug

SEQ ID NO: 19805 - DNA, 22 bp, Artificial Sequence
  Synthetic
ccatgacacugcagcttctgut

SEQ ID NO: 19806 - DNA, 22 bp, Artificial Sequence
  Synthetic
atgtcaccagugaccucaacag

SEQ ID NO: 19807 - DNA, 25 bp, Artificial Sequence
  Synthetic
tctttugagggaagaagagaugagt

SEQ ID NO: 19808 - DNA, 21 bp, Artificial Sequence
  Synthetic
acgucaacaacggcaacuaca

SEQ ID NO: 19809 - DNA, 18 bp, Artificial Sequence
  Synthetic
gggcagggutcaggaugg

SEQ ID NO: 19810 - DNA, 22 bp, Artificial Sequence
  Synthetic
catttcaugacattggguggca

SEQ ID NO: 19811 - DNA, 19 bp, Artificial Sequence
  Synthetic
ctgccctugacccagcaua

SEQ ID NO: 19812 - DNA, 19 bp, Artificial Sequence
  Synthetic
tgagctgcucaccatgcug

SEQ ID NO: 19813 - DNA, 18 bp, Artificial Sequence
  Synthetic
gugctgguaccggaggaa

SEQ ID NO: 19814 - DNA, 21 bp, Artificial Sequence
  Synthetic
cagggacuggtggtcaagaut

SEQ ID NO: 19815 - DNA, 23 bp, Artificial Sequence
  Synthetic
gggatccagggugtctacagtut

SEQ ID NO: 19816 - DNA, 21 bp, Artificial Sequence
  Synthetic
accagagguctacgccaucat

SEQ ID NO: 19817 - DNA, 18 bp, Artificial Sequence
  Synthetic
tccggcuaaccacuccca

SEQ ID NO: 19818 - DNA, 27 bp, Artificial Sequence
  Synthetic
actctctactauggtgtcatctttucc

SEQ ID NO: 19819 - DNA, 29 bp, Artificial Sequence
  Synthetic
acatatacataccugcactcaaagcaaua

SEQ ID NO: 19820 - DNA, 21 bp, Artificial Sequence
  Synthetic
gctttguccacagatguggga

SEQ ID NO: 19821 - DNA, 19 bp, Artificial Sequence
  Synthetic
gctgggagccucctttcut

SEQ ID NO: 19822 - DNA, 22 bp, Artificial Sequence
  Synthetic
ccccctuccctgtttatccuga

SEQ ID NO: 19823 - DNA, 17 bp, Artificial Sequence
  Synthetic
ctgggcugctcguccat

SEQ ID NO: 19824 - DNA, 26 bp, Artificial Sequence
  Synthetic
tgtagucaaagaacacaaaugtgtug

SEQ ID NO: 19825 - DNA, 19 bp, Artificial Sequence
  Synthetic
cgccutccgcuaacagcat

SEQ ID NO: 19826 - DNA, 22 bp, Artificial Sequence
  Synthetic
caaaggagautgagcggauggt

SEQ ID NO: 19827 - DNA, 21 bp, Artificial Sequence
  Synthetic
cagaucagggacucccagaga

SEQ ID NO: 19828 - DNA, 26 bp, Artificial Sequence
  Synthetic
ggaaataagcgaauccgguacaagaa

SEQ ID NO: 19829 - DNA, 21 bp, Artificial Sequence
  Synthetic
agttgagggcgagutagctug

SEQ ID NO: 19830 - DNA, 22 bp, Artificial Sequence
  Synthetic
ccaugttaucagccagacagga

SEQ ID NO: 19831 - DNA, 25 bp, Artificial Sequence
  Synthetic
ggccctauggctttgaaataatugg

SEQ ID NO: 19832 - DNA, 19 bp, Artificial Sequence
  Synthetic
ccatgaccuccagcuacgg

SEQ ID NO: 19833 - DNA, 20 bp, Artificial Sequence
  Synthetic
ggcttccuccaggtcuagca

SEQ ID NO: 19834 - DNA, 23 bp, Artificial Sequence
  Synthetic
ccttatgcctucttgcctccuaa

SEQ ID NO: 19835 - DNA, 19 bp, Artificial Sequence
  Synthetic
caggacgagguacgauggg

SEQ ID NO: 19836 - DNA, 22 bp, Artificial Sequence
  Synthetic
catcaacauggccaacagcaut

SEQ ID NO: 19837 - DNA, 29 bp, Artificial Sequence
  Synthetic
ggtttttgatttctucttaggcctgttua

SEQ ID NO: 19838 - DNA, 20 bp, Artificial Sequence
  Synthetic
gactggcugagcuggacaat

SEQ ID NO: 19839 - DNA, 20 bp, Artificial Sequence
  Synthetic
gatgtcuccgtacgtguggt

SEQ ID NO: 19840 - DNA, 20 bp, Artificial Sequence
  Synthetic
gagaaggugaacccggugag

SEQ ID NO: 19841 - DNA, 22 bp, Artificial Sequence
  Synthetic
tggtcttcuctctggtcaugga

SEQ ID NO: 19842 - DNA, 18 bp, Artificial Sequence
  Synthetic
atccagcugcacagcuca

SEQ ID NO: 19843 - DNA, 17 bp, Artificial Sequence
  Synthetic
gccccacugctguccat

SEQ ID NO: 19844 - DNA, 20 bp, Artificial Sequence
  Synthetic
agtggagugaagcacaccug

SEQ ID NO: 19845 - DNA, 21 bp, Artificial Sequence
  Synthetic
cttcatcugggcactgtccut

SEQ ID NO: 19846 - DNA, 17 bp, Artificial Sequence
  Synthetic
gcucacccacagccuct

SEQ ID NO: 19847 - DNA, 21 bp, Artificial Sequence
  Synthetic
tggctgatucctaggcagtug

SEQ ID NO: 19848 - DNA, 30 bp, Artificial Sequence
  Synthetic
cttgatuagagaaggaaauatggtgauaca

SEQ ID NO: 19849 - DNA, 26 bp, Artificial Sequence
  Synthetic
tctggtttuacactcaagctgucaat

SEQ ID NO: 19850 - DNA, 23 bp, Artificial Sequence
  Synthetic
tcttttggttutgcaggcttugg

SEQ ID NO: 19851 - DNA, 25 bp, Artificial Sequence
  Synthetic
gtatgctguagacgctcgtatucat

SEQ ID NO: 19852 - DNA, 26 bp, Artificial Sequence
  Synthetic
tgtcacagccaaaaucaatucaagag

SEQ ID NO: 19853 - DNA, 29 bp, Artificial Sequence
  Synthetic
ccaaaaatactatcugaaaaaggcagtut

SEQ ID NO: 19854 - DNA, 30 bp, Artificial Sequence
  Synthetic
ggttctaaguagaaataaaacctggugact

SEQ ID NO: 19855 - DNA, 24 bp, Artificial Sequence
  Synthetic
gctaagcatugtcccatcatucaa

SEQ ID NO: 19856 - DNA, 21 bp, Artificial Sequence
  Synthetic
gctcgtucatccacatugcca

SEQ ID NO: 19857 - DNA, 24 bp, Artificial Sequence
  Synthetic
tggttuaaggcaacattggcuaca

SEQ ID NO: 19858 - DNA, 22 bp, Artificial Sequence
  Synthetic
cttctctgccagutctccaguc

SEQ ID NO: 19859 - DNA, 29 bp, Artificial Sequence
  Synthetic
gagctgttgtcagautgaatcatttcaut

SEQ ID NO: 19860 - DNA, 22 bp, Artificial Sequence
  Synthetic
gaggguagcccctcagatauca

SEQ ID NO: 19861 - DNA, 27 bp, Artificial Sequence
  Synthetic
ggagctgatggucttttgattctttut

SEQ ID NO: 19862 - DNA, 20 bp, Artificial Sequence
  Synthetic
gcacagtugccaggcttaug

SEQ ID NO: 19863 - DNA, 25 bp, Artificial Sequence
  Synthetic
tttaaaaugaggtgttguccccaga

SEQ ID NO: 19864 - DNA, 25 bp, Artificial Sequence
  Synthetic
ctcttcttgaacagcuggtatccut

SEQ ID NO: 19865 - DNA, 30 bp, Artificial Sequence
  Synthetic
aataattttctagctucttagggctccauc

SEQ ID NO: 19866 - DNA, 21 bp, Artificial Sequence
  Synthetic
gtgcttttucacctggcaugg

SEQ ID NO: 19867 - DNA, 27 bp, Artificial Sequence
  Synthetic
aaguatcaactgcuaaacaagagcact

SEQ ID NO: 19868 - DNA, 22 bp, Artificial Sequence
  Synthetic
cctgaaugctcaaatgtuggca

SEQ ID NO: 19869 - DNA, 23 bp, Artificial Sequence
  Synthetic
ttccccattugaactggtagucc

SEQ ID NO: 19870 - DNA, 25 bp, Artificial Sequence
  Synthetic
gtgtcaattuacaggaatggtuccc

SEQ ID NO: 19871 - DNA, 21 bp, Artificial Sequence
  Synthetic
gccttcatguctggtgacuga

SEQ ID NO: 19872 - DNA, 28 bp, Artificial Sequence
  Synthetic
cctattacttttcugtcagtgagatugt

SEQ ID NO: 19873 - DNA, 21 bp, Artificial Sequence
  Synthetic
gagagcuggttgcaguagagg

SEQ ID NO: 19874 - DNA, 24 bp, Artificial Sequence
  Synthetic
ccagtgtacagugaatctgguagg

SEQ ID NO: 19875 - DNA, 22 bp, Artificial Sequence
  Synthetic
tcagtcaguagctgcugaagga

SEQ ID NO: 19876 - DNA, 21 bp, Artificial Sequence
  Synthetic
tccccauggcaactacagaug

SEQ ID NO: 19877 - DNA, 22 bp, Artificial Sequence
  Synthetic
agggaaggcuatggtgcaatut

SEQ ID NO: 19878 - DNA, 18 bp, Artificial Sequence
  Synthetic
cgggaccuccctgtcgua

SEQ ID NO: 19879 - DNA, 21 bp, Artificial Sequence
  Synthetic
cagttctagcuccacccctuc

SEQ ID NO: 19880 - DNA, 21 bp, Artificial Sequence
  Synthetic
tttgauggagcacaggcucat

SEQ ID NO: 19881 - DNA, 19 bp, Artificial Sequence
  Synthetic
cgctcgagugcccattuga

SEQ ID NO: 19882 - DNA, 22 bp, Artificial Sequence
  Synthetic
cccattgauggagtagguggag

SEQ ID NO: 19883 - DNA, 22 bp, Artificial Sequence
  Synthetic
gtaacuaccccagagucaccca

SEQ ID NO: 19884 - DNA, 22 bp, Artificial Sequence
  Synthetic
ccctgagaucagcuggagaagt

SEQ ID NO: 19885 - DNA, 19 bp, Artificial Sequence
  Synthetic
ccagcgcaucgtagaccug

SEQ ID NO: 19886 - DNA, 25 bp, Artificial Sequence
  Synthetic
ctggcutcttactttugggaacaag

SEQ ID NO: 19887 - DNA, 26 bp, Artificial Sequence
  Synthetic
tgacaaaagccutcacctacugaaaa

SEQ ID NO: 19888 - DNA, 27 bp, Artificial Sequence
  Synthetic
gaagucaacaauagggaggttaaugat

SEQ ID NO: 19889 - DNA, 24 bp, Artificial Sequence
  Synthetic
ctgtaagucctggtcaucggaaaa

SEQ ID NO: 19890 - DNA, 23 bp, Artificial Sequence
  Synthetic
gtggttttggutgaaagcttugc

SEQ ID NO: 19891 - DNA, 26 bp, Artificial Sequence
  Synthetic
cagtcaacacagautttggtgaugaa

SEQ ID NO: 19892 - DNA, 27 bp, Artificial Sequence
  Synthetic
ctccaatcctucctataaatagguggt

SEQ ID NO: 19893 - DNA, 26 bp, Artificial Sequence
  Synthetic
atttagacggtaugcaacaggacaut

SEQ ID NO: 19894 - DNA, 29 bp, Artificial Sequence
  Synthetic
ccaggttattttauacctcacctcatugt

SEQ ID NO: 19895 - DNA, 28 bp, Artificial Sequence
  Synthetic
ccatttttgtttucctttgtgtcatucc

SEQ ID NO: 19896 - DNA, 17 bp, Artificial Sequence
  Synthetic
ccgcggutccctagcuc

SEQ ID NO: 19897 - DNA, 18 bp, Artificial Sequence
  Synthetic
acacacgguccacagcuc

SEQ ID NO: 19898 - DNA, 28 bp, Artificial Sequence
  Synthetic
tggcaatgaaguactacaccucaaaaat

SEQ ID NO: 19899 - DNA, 32 bp, Artificial Sequence
  Synthetic
aaccaatataattaccutacctcagctauaca

SEQ ID NO: 19900 - DNA, 30 bp, Artificial Sequence
  Synthetic
ctacctguaagaaagcagttttacucaact

SEQ ID NO: 19901 - DNA, 29 bp, Artificial Sequence
  Synthetic
accttgttatguacaaagacaatcctuaa

SEQ ID NO: 19902 - DNA, 24 bp, Artificial Sequence
  Synthetic
gcagaccacuctttcactagtcut

SEQ ID NO: 19903 - DNA, 23 bp, Artificial Sequence
  Synthetic
agcaaattctuggaagcagucct

SEQ ID NO: 19904 - DNA, 27 bp, Artificial Sequence
  Synthetic
cagctgacaucgttcttaguaaaacag

SEQ ID NO: 19905 - DNA, 32 bp, Artificial Sequence
  Synthetic
ttccagattcatcautatgcatatcatttugg

SEQ ID NO: 19906 - DNA, 20 bp, Artificial Sequence
  Synthetic
ccgtuaagcacacccaguca

SEQ ID NO: 19907 - DNA, 30 bp, Artificial Sequence
  Synthetic
aatttttaagtatauttcccctgcuccact

SEQ ID NO: 19908 - DNA, 22 bp, Artificial Sequence
  Synthetic
cccatgucagcaagtgctctut

SEQ ID NO: 19909 - DNA, 24 bp, Artificial Sequence
  Synthetic
cattcaagtcacaugcaagctcug

SEQ ID NO: 19910 - DNA, 32 bp, Artificial Sequence
  Synthetic
attaaaatggtacagauccccttttctaugaa

SEQ ID NO: 19911 - DNA, 24 bp, Artificial Sequence
  Synthetic
atgtcatuagccatgcaucaggaa

SEQ ID NO: 19912 - DNA, 30 bp, Artificial Sequence
  Synthetic
ttatataaaaugacagcagaugaccaaaga

SEQ ID NO: 19913 - DNA, 32 bp, Artificial Sequence
  Synthetic
ccacatcagaaaauattaaaccacactaucat

SEQ ID NO: 19914 - DNA, 29 bp, Artificial Sequence
  Synthetic
cagggtatatcauggtaaaatgtgugact

SEQ ID NO: 19915 - DNA, 19 bp, Artificial Sequence
  Synthetic
ggcgaccaugaacacacuc

SEQ ID NO: 19916 - DNA, 29 bp, Artificial Sequence
  Synthetic
gatcttttcagtagugtgattaggcgtua

SEQ ID NO: 19917 - DNA, 24 bp, Artificial Sequence
  Synthetic
aagcatatgcacaaugttgggaug

SEQ ID NO: 19918 - DNA, 22 bp, Artificial Sequence
  Synthetic
gccctguactatctgcatuccc

SEQ ID NO: 19919 - DNA, 21 bp, Artificial Sequence
  Synthetic
ccgtgtggaacuggaagctua

SEQ ID NO: 19920 - DNA, 27 bp, Artificial Sequence
  Synthetic
gagactuaagggaagggaaagaaugac

SEQ ID NO: 19921 - DNA, 21 bp, Artificial Sequence
  Synthetic
ctgggaacccugatgacucac

SEQ ID NO: 19922 - DNA, 17 bp, Artificial Sequence
  Synthetic
cccctcugcccagacuc

SEQ ID NO: 19923 - DNA, 23 bp, Artificial Sequence
  Synthetic
tgtgcaagauacctcacccuaca

SEQ ID NO: 19924 - DNA, 30 bp, Artificial Sequence
  Synthetic
cttttacctcugaaaatatcaatcgtugcc

SEQ ID NO: 19925 - DNA, 21 bp, Artificial Sequence
  Synthetic
cucccggcagaaggaauacaa

SEQ ID NO: 19926 - DNA, 22 bp, Artificial Sequence
  Synthetic
acctttttcuggacctgtuggg

SEQ ID NO: 19927 - DNA, 22 bp, Artificial Sequence
  Synthetic
gaugggagaaauacggagaaug

SEQ ID NO: 19928 - DNA, 25 bp, Artificial Sequence
  Synthetic
gatataccuggagccatttcctcug

SEQ ID NO: 19929 - DNA, 23 bp, Artificial Sequence
  Synthetic
cctcctcaatucctctggcagua

SEQ ID NO: 19930 - DNA, 23 bp, Artificial Sequence
  Synthetic
gccgctuaccaacctccttuaat

SEQ ID NO: 19931 - DNA, 27 bp, Artificial Sequence
  Synthetic
ggaggagggugaaggttaaaaactuac

SEQ ID NO: 19932 - DNA, 25 bp, Artificial Sequence
  Synthetic
ccgccctctutcacttttatctcua

SEQ ID NO: 19933 - DNA, 21 bp, Artificial Sequence
  Synthetic
gatagcgaaagcucccctucc

SEQ ID NO: 19934 - DNA, 26 bp, Artificial Sequence
  Synthetic
agggaggaaugataaaggttaaguga

SEQ ID NO: 19935 - DNA, 24 bp, Artificial Sequence
  Synthetic
ccaagacaccuataaggaggucag

SEQ ID NO: 19936 - DNA, 20 bp, Artificial Sequence
  Synthetic
catacugccagggtcctguc

SEQ ID NO: 19937 - DNA, 20 bp, Artificial Sequence
  Synthetic
tgctgtgtuggagcaagugt

SEQ ID NO: 19938 - DNA, 23 bp, Artificial Sequence
  Synthetic
cctagaaauggcatguggagacc

SEQ ID NO: 19939 - DNA, 22 bp, Artificial Sequence
  Synthetic
ggccctgaucatcatggtucat

SEQ ID NO: 19940 - DNA, 22 bp, Artificial Sequence
  Synthetic
cgcacacaagcaaauggaaugt

SEQ ID NO: 19941 - DNA, 25 bp, Artificial Sequence
  Synthetic
agaagaggaagaccuggagcaauaa

SEQ ID NO: 19942 - DNA, 18 bp, Artificial Sequence
  Synthetic
gcccctgcuggaacaguc

SEQ ID NO: 19943 - DNA, 26 bp, Artificial Sequence
  Synthetic
gtatggacaaaguaagccttggacut

SEQ ID NO: 19944 - DNA, 26 bp, Artificial Sequence
  Synthetic
tgcctcagggaautgaatatttggut

SEQ ID NO: 19945 - DNA, 21 bp, Artificial Sequence
  Synthetic
caccaggcauggatttuccag

SEQ ID NO: 19946 - DNA, 19 bp, Artificial Sequence
  Synthetic
ccccgggaaugagatggut

SEQ ID NO: 19947 - DNA, 33 bp, Artificial Sequence
  Synthetic
agaatgtactattattucatcagtgaaatccut

SEQ ID NO: 19948 - DNA, 26 bp, Artificial Sequence
  Synthetic
cccctcacauttgaaaatcaactuca

SEQ ID NO: 19949 - DNA, 19 bp, Artificial Sequence
  Synthetic
ctcaggaaaggcccugguc

SEQ ID NO: 19950 - DNA, 22 bp, Artificial Sequence
  Synthetic
tgtttggccutcttctcgctut

SEQ ID NO: 19951 - DNA, 21 bp, Artificial Sequence
  Synthetic
ccctgctugtctcaaccaugt

SEQ ID NO: 19952 - DNA, 20 bp, Artificial Sequence
  Synthetic
aggacgtauggagccaguct

SEQ ID NO: 19953 - DNA, 21 bp, Artificial Sequence
  Synthetic
gcggugtttttaucaacggca

SEQ ID NO: 19954 - DNA, 18 bp, Artificial Sequence
  Synthetic
ggaccuctgcccuccaag

SEQ ID NO: 19955 - DNA, 18 bp, Artificial Sequence
  Synthetic
acaagucgggcaccaugt

SEQ ID NO: 19956 - DNA, 17 bp, Artificial Sequence
  Synthetic
acatcuggcgcctgcut

SEQ ID NO: 19957 - DNA, 21 bp, Artificial Sequence
  Synthetic
gactccagguctccagacugt

SEQ ID NO: 19958 - DNA, 22 bp, Artificial Sequence
  Synthetic
augaacaggatugacaccagca

SEQ ID NO: 19959 - DNA, 24 bp, Artificial Sequence
  Synthetic
gaugacaaggcctctuccaaaaac

SEQ ID NO: 19960 - DNA, 21 bp, Artificial Sequence
  Synthetic
ccccaggaagaaucccttguc

SEQ ID NO: 19961 - DNA, 21 bp, Artificial Sequence
  Synthetic
gtgagtcccautcccgtgtut

SEQ ID NO: 19962 - DNA, 18 bp, Artificial Sequence
  Synthetic
cccctuggccagacacuc

SEQ ID NO: 19963 - DNA, 24 bp, Artificial Sequence
  Synthetic
gctgaaaggccccuttatgtuaca

SEQ ID NO: 19964 - DNA, 22 bp, Artificial Sequence
  Synthetic
cctagcaccugttctgcagaut

SEQ ID NO: 19965 - DNA, 28 bp, Artificial Sequence
  Synthetic
caagccccauaaaactcacaattttuct

SEQ ID NO: 19966 - DNA, 17 bp, Artificial Sequence
  Synthetic
cuccaccagcccacuca

SEQ ID NO: 19967 - DNA, 28 bp, Artificial Sequence
  Synthetic
ctataacttccttgugccttgtgtctua

SEQ ID NO: 19968 - DNA, 27 bp, Artificial Sequence
  Synthetic
cactcacctccucattctctatctuga

SEQ ID NO: 19969 - DNA, 22 bp, Artificial Sequence
  Synthetic
caaccacagauggtggctgtua

SEQ ID NO: 19970 - DNA, 25 bp, Artificial Sequence
  Synthetic
gccagatugagcaagtagtcatucc

SEQ ID NO: 19971 - DNA, 22 bp, Artificial Sequence
  Synthetic
aaatcacaaaccccgucctcut

SEQ ID NO: 19972 - DNA, 20 bp, Artificial Sequence
  Synthetic
gcaaagaccugggacacgua

SEQ ID NO: 19973 - DNA, 24 bp, Artificial Sequence
  Synthetic
ttggtatcuggttctgcaucagac

SEQ ID NO: 19974 - DNA, 17 bp, Artificial Sequence
  Synthetic
cucccagcccgcatcuc

SEQ ID NO: 19975 - DNA, 28 bp, Artificial Sequence
  Synthetic
gaaataaaucaaacagcctgtcagtucc

SEQ ID NO: 19976 - DNA, 21 bp, Artificial Sequence
  Synthetic
cgtactcuagcctccacucct

SEQ ID NO: 19977 - DNA, 19 bp, Artificial Sequence
  Synthetic
ccaugccaggcagtgtuga

SEQ ID NO: 19978 - DNA, 23 bp, Artificial Sequence
  Synthetic
tcctggagutttggtaccuagga

SEQ ID NO: 19979 - DNA, 22 bp, Artificial Sequence
  Synthetic
gcgaugttgttgtuggaggaac

SEQ ID NO: 19980 - DNA, 19 bp, Artificial Sequence
  Synthetic
cgttacgugagtgccagug

SEQ ID NO: 19981 - DNA, 21 bp, Artificial Sequence
  Synthetic
caguagagaggguagctccua

SEQ ID NO: 19982 - DNA, 18 bp, Artificial Sequence
  Synthetic
gcccaagcggugagtgua

SEQ ID NO: 19983 - DNA, 22 bp, Artificial Sequence
  Synthetic
cgaaggcaaugagaatccacug

SEQ ID NO: 19984 - DNA, 22 bp, Artificial Sequence
  Synthetic
agaaatuccccaagcacctucc

SEQ ID NO: 19985 - DNA, 22 bp, Artificial Sequence
  Synthetic
tcaataucccccaccccatcut

SEQ ID NO: 19986 - DNA, 26 bp, Artificial Sequence
  Synthetic
gtcttgacucatgggtgtatucacaa

SEQ ID NO: 19987 - DNA, 22 bp, Artificial Sequence
  Synthetic
cgctttcugggtcaauaggaga

SEQ ID NO: 19988 - DNA, 26 bp, Artificial Sequence
  Synthetic
acattccatucacaagaacagaucca

SEQ ID NO: 19989 - DNA, 28 bp, Artificial Sequence
  Synthetic
gtctcuggagcattatttatuacagggt

SEQ ID NO: 19990 - DNA, 27 bp, Artificial Sequence
  Synthetic
tgatcttaacugtcggauccacaaaaa

SEQ ID NO: 19991 - DNA, 22 bp, Artificial Sequence
  Synthetic
gcaatggctutagtgtccacug

SEQ ID NO: 19992 - DNA, 29 bp, Artificial Sequence
  Synthetic
ttacataaacagutttctgaaccugggat

SEQ ID NO: 19993 - DNA, 25 bp, Artificial Sequence
  Synthetic
gggtgatgtguttgaacttgattut

SEQ ID NO: 19994 - DNA, 21 bp, Artificial Sequence
  Synthetic
ctgcgaaagccutttggugac

SEQ ID NO: 19995 - DNA, 22 bp, Artificial Sequence
  Synthetic
ccatcaucccaccctcttucat

SEQ ID NO: 19996 - DNA, 19 bp, Artificial Sequence
  Synthetic
gggutgaatuccccagggt

SEQ ID NO: 19997 - DNA, 26 bp, Artificial Sequence
  Synthetic
ccaaagaggacacugaattagaguga

SEQ ID NO: 19998 - DNA, 25 bp, Artificial Sequence
  Synthetic
gttcagattuaagcctgaggagcut

SEQ ID NO: 19999 - DNA, 27 bp, Artificial Sequence
  Synthetic
ccactgtgtttuctcctccattttuag

SEQ ID NO: 20000 - DNA, 26 bp, Artificial Sequence
  Synthetic
ccaaagacaaaguagacagccaauga

SEQ ID NO: 20001 - DNA, 21 bp, Artificial Sequence
  Synthetic
ccacaaggaguggtgguacag

SEQ ID NO: 20002 - DNA, 24 bp, Artificial Sequence
  Synthetic
tgacagacugttggtttgaauccc

SEQ ID NO: 20003 - DNA, 23 bp, Artificial Sequence
  Synthetic
gctcctguggaagtttccagtuc

SEQ ID NO: 20004 - DNA, 23 bp, Artificial Sequence
  Synthetic
gcatctgtugctgttgtttcuga

SEQ ID NO: 20005 - DNA, 22 bp, Artificial Sequence
  Synthetic
gggagcaacuttttgtggucct

SEQ ID NO: 20006 - DNA, 29 bp, Artificial Sequence
  Synthetic
caagttgaaaugaacaaaagatgctucct

SEQ ID NO: 20007 - DNA, 24 bp, Artificial Sequence
  Synthetic
gtgtgtctgaugtggagagugaaa

SEQ ID NO: 20008 - DNA, 22 bp, Artificial Sequence
  Synthetic
ccttctagcucactggtugcat

SEQ ID NO: 20009 - DNA, 21 bp, Artificial Sequence
  Synthetic
cctgatcctuccaccaagcug

SEQ ID NO: 20010 - DNA, 25 bp, Artificial Sequence
  Synthetic
cutcattcattcatucccaccacaa

SEQ ID NO: 20011 - DNA, 23 bp, Artificial Sequence
  Synthetic
cagcttaucccggctaatggtua

SEQ ID NO: 20012 - DNA, 29 bp, Artificial Sequence
  Synthetic
caatcgtgaacaaauacctcaaactcuaa

SEQ ID NO: 20013 - DNA, 26 bp, Artificial Sequence
  Synthetic
ttctcccagauaatagatgccacuca

SEQ ID NO: 20014 - DNA, 24 bp, Artificial Sequence
  Synthetic
cacatctgcaugctgttttctcug

SEQ ID NO: 20015 - DNA, 27 bp, Artificial Sequence
  Synthetic
aaagttactttggutcttttgctgcut

SEQ ID NO: 20016 - DNA, 26 bp, Artificial Sequence
  Synthetic
cactctctattucctgcctcctttut

SEQ ID NO: 20017 - DNA, 22 bp, Artificial Sequence
  Synthetic
gtgcaagcaccugaaauaagca

SEQ ID NO: 20018 - DNA, 26 bp, Artificial Sequence
  Synthetic
gtgguagaaggcttttctugagagaa

SEQ ID NO: 20019 - DNA, 21 bp, Artificial Sequence
  Synthetic
ctuggcaacagaccacttucc

SEQ ID NO: 20020 - DNA, 28 bp, Artificial Sequence
  Synthetic
ggacaggcttuacttgctatacttucaa

SEQ ID NO: 20021 - DNA, 22 bp, Artificial Sequence
  Synthetic
gcccauggaagaaacaagucct

SEQ ID NO: 20022 - DNA, 27 bp, Artificial Sequence
  Synthetic
atgtcctccttcucctctttcatcuaa

SEQ ID NO: 20023 - DNA, 24 bp, Artificial Sequence
  Synthetic
ccagggagaauaggcguaataaug

SEQ ID NO: 20024 - DNA, 23 bp, Artificial Sequence
  Synthetic
gtgctaccgaugctctgcttaua

SEQ ID NO: 20025 - DNA, 27 bp, Artificial Sequence
  Synthetic
actctgaagcugaaaatattgagccut

SEQ ID NO: 20026 - DNA, 28 bp, Artificial Sequence
  Synthetic
tccaagtcttttuctttgcacctacuaa

SEQ ID NO: 20027 - DNA, 20 bp, Artificial Sequence
  Synthetic
gggcagaauctgattuggca

SEQ ID NO: 20028 - DNA, 28 bp, Artificial Sequence
  Synthetic
gggagaacaacaucttttaattgctuca

SEQ ID NO: 20029 - DNA, 28 bp, Artificial Sequence
  Synthetic
acagagaccuaaggacatcatcctatuc

SEQ ID NO: 20030 - DNA, 20 bp, Artificial Sequence
  Synthetic
gccgtcgcuctctttcugat

SEQ ID NO: 20031 - DNA, 28 bp, Artificial Sequence
  Synthetic
agagattttaaaaagagcucagcaccut

SEQ ID NO: 20032 - DNA, 28 bp, Artificial Sequence
  Synthetic
tggaatttcttcauccttcccaataugg

SEQ ID NO: 20033 - DNA, 26 bp, Artificial Sequence
  Synthetic
agaagcagatacuaagcaggacacua

SEQ ID NO: 20034 - DNA, 21 bp, Artificial Sequence
  Synthetic
tggtaatggugctgcaugagt

SEQ ID NO: 20035 - DNA, 28 bp, Artificial Sequence
  Synthetic
tggtgauaccttatctacugcagaagaa

SEQ ID NO: 20036 - DNA, 19 bp, Artificial Sequence
  Synthetic
caggutccttcugccacct

SEQ ID NO: 20037 - DNA, 23 bp, Artificial Sequence
  Synthetic
gtccgagagaugtgcaaggaaut

SEQ ID NO: 20038 - DNA, 25 bp, Artificial Sequence
  Synthetic
gatgtcaaugagagccatcatguct

SEQ ID NO: 20039 - DNA, 19 bp, Artificial Sequence
  Synthetic
tccacccugaccgctauga

SEQ ID NO: 20040 - DNA, 21 bp, Artificial Sequence
  Synthetic
ccctggcutaggacctgugat

SEQ ID NO: 20041 - DNA, 19 bp, Artificial Sequence
  Synthetic
tctgactgccugccttguc

SEQ ID NO: 20042 - DNA, 21 bp, Artificial Sequence
  Synthetic
actccuagcactgugagggat

SEQ ID NO: 20043 - DNA, 22 bp, Artificial Sequence
  Synthetic
cgcagtugggcactataugagg

SEQ ID NO: 20044 - DNA, 19 bp, Artificial Sequence
  Synthetic
cagugtttcuccgcaccag

SEQ ID NO: 20045 - DNA, 22 bp, Artificial Sequence
  Synthetic
ccugcagaagaagaaguggcaa

SEQ ID NO: 20046 - DNA, 20 bp, Artificial Sequence
  Synthetic
ccaccucccttcuccacgat

SEQ ID NO: 20047 - DNA, 20 bp, Artificial Sequence
  Synthetic
tgaccaccacutggatgcug

SEQ ID NO: 20048 - DNA, 19 bp, Artificial Sequence
  Synthetic
ctgcutcgctcuagcacca

SEQ ID NO: 20049 - DNA, 17 bp, Artificial Sequence
  Synthetic
agccctugccacctucc

SEQ ID NO: 20050 - DNA, 23 bp, Artificial Sequence
  Synthetic
cttttcagccagugagaggguag

SEQ ID NO: 20051 - DNA, 23 bp, Artificial Sequence
  Synthetic
cgtcagaccutagaacugaggga

SEQ ID NO: 20052 - DNA, 30 bp, Artificial Sequence
  Synthetic
agcggaaaaagagaauatgaagatgagaut

SEQ ID NO: 20053 - DNA, 23 bp, Artificial Sequence
  Synthetic
ccagttgauggccttgtuagcat

SEQ ID NO: 20054 - DNA, 23 bp, Artificial Sequence
  Synthetic
ctttggtttugagtctgcugcaa

SEQ ID NO: 20055 - DNA, 25 bp, Artificial Sequence
  Synthetic
agatagtgaggucattgaaccucct

SEQ ID NO: 20056 - DNA, 28 bp, Artificial Sequence
  Synthetic
catctaccacuttagcagagagugaaaa

SEQ ID NO: 20057 - DNA, 22 bp, Artificial Sequence
  Synthetic
tccugcaggccaactgaaauac

SEQ ID NO: 20058 - DNA, 26 bp, Artificial Sequence
  Synthetic
gggtgactaauttctactggtuccaa

SEQ ID NO: 20059 - DNA, 22 bp, Artificial Sequence
  Synthetic
ccactactutgagcagcuccat

SEQ ID NO: 20060 - DNA, 30 bp, Artificial Sequence
  Synthetic
ttcttctcatcaucacctttatctgcatut

SEQ ID NO: 20061 - DNA, 28 bp, Artificial Sequence
  Synthetic
cggtattcugccaaaaccaaatctttua

SEQ ID NO: 20062 - DNA, 29 bp, Artificial Sequence
  Synthetic
cagtcatatctcacuaaactgtccttuga

SEQ ID NO: 20063 - DNA, 25 bp, Artificial Sequence
  Synthetic
agccaggacugtagcttuaaaaaca

SEQ ID NO: 20064 - DNA, 28 bp, Artificial Sequence
  Synthetic
agaagaatctcuccatttttgcagagut

SEQ ID NO: 20065 - DNA, 28 bp, Artificial Sequence
  Synthetic
acagcttgtatgucaatggatactctug

SEQ ID NO: 20066 - DNA, 21 bp, Artificial Sequence
  Synthetic
caggtctcugcgtgttucaag

SEQ ID NO: 20067 - DNA, 27 bp, Artificial Sequence
  Synthetic
atgatggccaacaaguaccaagataut

SEQ ID NO: 20068 - DNA, 26 bp, Artificial Sequence
  Synthetic
aaataatgaagtgugaggctgcctua

SEQ ID NO: 20069 - DNA, 30 bp, Artificial Sequence
  Synthetic
ggtttataatgaugcacatatccuggagaa

SEQ ID NO: 20070 - DNA, 23 bp, Artificial Sequence
  Synthetic
gtcacaaagucttctgccugaac

SEQ ID NO: 20071 - DNA, 31 bp, Artificial Sequence
  Synthetic
tttgtggtcatccguatattaagaaaacuga

SEQ ID NO: 20072 - DNA, 31 bp, Artificial Sequence
  Synthetic
tggcattttcaaacautaaattcagaucaca

SEQ ID NO: 20073 - DNA, 25 bp, Artificial Sequence
  Synthetic
agtgcttgucaagattttgcatugg

SEQ ID NO: 20074 - DNA, 25 bp, Artificial Sequence
  Synthetic
actaagaaggcauttcgctagucaa

SEQ ID NO: 20075 - DNA, 26 bp, Artificial Sequence
  Synthetic
acatccttcccugtctaattgcttut

SEQ ID NO: 20076 - DNA, 30 bp, Artificial Sequence
  Synthetic
catttcatgatgtucaatttcagcctttut

SEQ ID NO: 20077 - DNA, 21 bp, Artificial Sequence
  Synthetic
tgccatagaaggugcccatug

SEQ ID NO: 20078 - DNA, 27 bp, Artificial Sequence
  Synthetic
actgacatguacctgtttttaacugca

SEQ ID NO: 20079 - DNA, 24 bp, Artificial Sequence
  Synthetic
ccagtcttcuccagcttactugaa

SEQ ID NO: 20080 - DNA, 31 bp, Artificial Sequence
  Synthetic
tggtatcttccaatuggtatctttccaaaut

SEQ ID NO: 20081 - DNA, 22 bp, Artificial Sequence
  Synthetic
tggtttcucagcccattgacut

SEQ ID NO: 20082 - DNA, 24 bp, Artificial Sequence
  Synthetic
agagcagguagaaaccaugtaauc

SEQ ID NO: 20083 - DNA, 21 bp, Artificial Sequence
  Synthetic
aagaagagcuacctcccctuc

SEQ ID NO: 20084 - DNA, 28 bp, Artificial Sequence
  Synthetic
guttttatttcagttaauggccagccaa

SEQ ID NO: 20085 - DNA, 20 bp, Artificial Sequence
  Synthetic
ggttcuccaggtggtuccaa

SEQ ID NO: 20086 - DNA, 26 bp, Artificial Sequence
  Synthetic
gaaggcctugtgttggatacuaaact

SEQ ID NO: 20087 - DNA, 22 bp, Artificial Sequence
  Synthetic
cctgtatatgguggctgctgug

SEQ ID NO: 20088 - DNA, 25 bp, Artificial Sequence
  Synthetic
ttgcctttucagcaagctataguca

SEQ ID NO: 20089 - DNA, 20 bp, Artificial Sequence
  Synthetic
ctgagcaggcagutgtugag

SEQ ID NO: 20090 - DNA, 22 bp, Artificial Sequence
  Synthetic
cctaatccutatgcgcguaacc

SEQ ID NO: 20091 - DNA, 20 bp, Artificial Sequence
  Synthetic
ggaguctttugggaggccaa

SEQ ID NO: 20092 - DNA, 22 bp, Artificial Sequence
  Synthetic
ccuagacaaagcagugaggcat

SEQ ID NO: 20093 - DNA, 22 bp, Artificial Sequence
  Synthetic
gaagagccuggagacugaacac

SEQ ID NO: 20094 - DNA, 24 bp, Artificial Sequence
  Synthetic
gaaguccagccgaacatagaugat

SEQ ID NO: 20095 - DNA, 21 bp, Artificial Sequence
  Synthetic
ggtgagtcuaggctcccaugt

SEQ ID NO: 20096 - DNA, 28 bp, Artificial Sequence
  Synthetic
aatgaacacaccccauctataaagacug

SEQ ID NO: 20097 - DNA, 19 bp, Artificial Sequence
  Synthetic
ctcttuggcggguggaaga

SEQ ID NO: 20098 - DNA, 26 bp, Artificial Sequence
  Synthetic
agaacggauggaggatattccacuat

SEQ ID NO: 20099 - DNA, 23 bp, Artificial Sequence
  Synthetic
tgacccgagucattgaagtcuct

SEQ ID NO: 20100 - DNA, 23 bp, Artificial Sequence
  Synthetic
agcacatgggugtagactgttuc

SEQ ID NO: 20101 - DNA, 27 bp, Artificial Sequence
  Synthetic
ttgttgtgactutgaactgctacuact

SEQ ID NO: 20102 - DNA, 18 bp, Artificial Sequence
  Synthetic
acctcggccgucacctua

SEQ ID NO: 20103 - DNA, 21 bp, Artificial Sequence
  Synthetic
gtttctgcucctgttgctugg

SEQ ID NO: 20104 - DNA, 23 bp, Artificial Sequence
  Synthetic
gcaagaaaauaccccctccauca

SEQ ID NO: 20105 - DNA, 24 bp, Artificial Sequence
  Synthetic
cggttgccuactggttcaatuact

SEQ ID NO: 20106 - DNA, 30 bp, Artificial Sequence
  Synthetic
gcaatgtatgtcuatcctccaaatguagaa

SEQ ID NO: 20107 - DNA, 23 bp, Artificial Sequence
  Synthetic
tagacacagguagaagacugcac

SEQ ID NO: 20108 - DNA, 30 bp, Artificial Sequence
  Synthetic
ttaaaatgaaaaaccutacaggaaauggct

SEQ ID NO: 20109 - DNA, 25 bp, Artificial Sequence
  Synthetic
gcgtctggaauaagatggcattgua

SEQ ID NO: 20110 - DNA, 27 bp, Artificial Sequence
  Synthetic
gtatctaccauggaggagaaccctuat

SEQ ID NO: 20111 - DNA, 31 bp, Artificial Sequence
  Synthetic
ggatcatactgcuaaacactaatataaccut

SEQ ID NO: 20112 - DNA, 23 bp, Artificial Sequence
  Synthetic
tggccaguacctcatggatuaga

SEQ ID NO: 20113 - DNA, 25 bp, Artificial Sequence
  Synthetic
tggagttucctaagagauggaagaa

SEQ ID NO: 20114 - DNA, 32 bp, Artificial Sequence
  Synthetic
agtaacagactagcuagagacaatgaatuaag

SEQ ID NO: 20115 - DNA, 30 bp, Artificial Sequence
  Synthetic
cacttacctgtgacuccatagaaaatctut

SEQ ID NO: 20116 - DNA, 26 bp, Artificial Sequence
  Synthetic
cagtgtttuagatggctcatucacaa

SEQ ID NO: 20117 - DNA, 25 bp, Artificial Sequence
  Synthetic
gcaaaaccucgaaccataggatcug

SEQ ID NO: 20118 - DNA, 30 bp, Artificial Sequence
  Synthetic
ttaattttgcacgautcttttagatcugag

SEQ ID NO: 20119 - DNA, 22 bp, Artificial Sequence
  Synthetic
ccattgccucgacttgcctaut

SEQ ID NO: 20120 - DNA, 30 bp, Artificial Sequence
  Synthetic
aagcaaagguacctagtaaagttttuaact

SEQ ID NO: 20121 - DNA, 29 bp, Artificial Sequence
  Synthetic
aaagatgatctcautgttctgaaacagua

SEQ ID NO: 20122 - DNA, 28 bp, Artificial Sequence
  Synthetic
acactattaugcaaattcagugcaaagg

SEQ ID NO: 20123 - DNA, 25 bp, Artificial Sequence
  Synthetic
caaacaccgacagacucatcuaaca

SEQ ID NO: 20124 - DNA, 26 bp, Artificial Sequence
  Synthetic
tggacacuttttggaucacaagaaga

SEQ ID NO: 20125 - DNA, 28 bp, Artificial Sequence
  Synthetic
aaattctcttgtcuttgtgcattctugg

SEQ ID NO: 20126 - DNA, 25 bp, Artificial Sequence
  Synthetic
tgagcaagaggcuttggagtattuc

SEQ ID NO: 20127 - DNA, 31 bp, Artificial Sequence
  Synthetic
agagtgagctttcautttctcagttatctut

SEQ ID NO: 20128 - DNA, 17 bp, Artificial Sequence
  Synthetic
cgucaagcggcccauga

SEQ ID NO: 20129 - DNA, 23 bp, Artificial Sequence
  Synthetic
cgtcuccgacaaaagttuccact

SEQ ID NO: 20130 - DNA, 18 bp, Artificial Sequence
  Synthetic
cuggagcaacggcagcua

SEQ ID NO: 20131 - DNA, 20 bp, Artificial Sequence
  Synthetic
gcgagccgutcatgtagguc

SEQ ID NO: 20132 - DNA, 19 bp, Artificial Sequence
  Synthetic
ggccatuaacggcacacug

SEQ ID NO: 20133 - DNA, 21 bp, Artificial Sequence
  Synthetic
tttgagcguaccgggtttuct

SEQ ID NO: 20134 - DNA, 28 bp, Artificial Sequence
  Synthetic
ggaccutgtatagatcuggaggaaagaa

SEQ ID NO: 20135 - DNA, 29 bp, Artificial Sequence
  Synthetic
gtcgcttggagacuagctctaaatatuat

SEQ ID NO: 20136 - DNA, 26 bp, Artificial Sequence
  Synthetic
gagaggcttcutgctgaattttgaut

SEQ ID NO: 20137 - DNA, 29 bp, Artificial Sequence
  Synthetic
gagatggttcgccaguacttattctaaut

SEQ ID NO: 20138 - DNA, 24 bp, Artificial Sequence
  Synthetic
cttttgttcgaucccaacttucca

SEQ ID NO: 20139 - DNA, 30 bp, Artificial Sequence
  Synthetic
tacagagccgaaucttttaaaatacaacua

SEQ ID NO: 20140 - DNA, 26 bp, Artificial Sequence
  Synthetic
tgaataguccaagtagcuagagccaa

SEQ ID NO: 20141 - DNA, 24 bp, Artificial Sequence
  Synthetic
gtctccttuccgacatgtcttcug

SEQ ID NO: 20142 - DNA, 24 bp, Artificial Sequence
  Synthetic
acgtaattggaaucagtgcucacc

SEQ ID NO: 20143 - DNA, 22 bp, Artificial Sequence
  Synthetic
tcgctggucagttcgtgatuaa

SEQ ID NO: 20144 - DNA, 20 bp, Artificial Sequence
  Synthetic
cccacaagcucgtguccaat

SEQ ID NO: 20145 - DNA, 28 bp, Artificial Sequence
  Synthetic
acctttcctcagguaaagctaactttut

SEQ ID NO: 20146 - DNA, 25 bp, Artificial Sequence
  Synthetic
accgttctuccctaatcauaaaacc

SEQ ID NO: 20147 - DNA, 25 bp, Artificial Sequence
  Synthetic
tccttcaaucacactcagttuccac

SEQ ID NO: 20148 - DNA, 26 bp, Artificial Sequence
  Synthetic
attcaauagggaagagtctcaugcac

SEQ ID NO: 20149 - DNA, 28 bp, Artificial Sequence
  Synthetic
ggtgatcatagutgataagaacgguaga

SEQ ID NO: 20150 - DNA, 17 bp, Artificial Sequence
  Synthetic
acagcagcuggcacuca

SEQ ID NO: 20151 - DNA, 20 bp, Artificial Sequence
  Synthetic
gaguctccagugagggagga

SEQ ID NO: 20152 - DNA, 20 bp, Artificial Sequence
  Synthetic
gccgcaggautccagaucag

SEQ ID NO: 20153 - DNA, 17 bp, Artificial Sequence
  Synthetic
ggccccaucaccuccat

SEQ ID NO: 20154 - DNA, 17 bp, Artificial Sequence
  Synthetic
cgcgcguacctggacuc

SEQ ID NO: 20155 - DNA, 19 bp, Artificial Sequence
  Synthetic
gcauccgcaccacttucac

SEQ ID NO: 20156 - DNA, 23 bp, Artificial Sequence
  Synthetic
tgcaggaacugaagtcagcauag

SEQ ID NO: 20157 - DNA, 28 bp, Artificial Sequence
  Synthetic
gagccatccagaaccutttcaatgtaua

SEQ ID NO: 20158 - DNA, 24 bp, Artificial Sequence
  Synthetic
tccttttctcugagatgcttuggg

SEQ ID NO: 20159 - DNA, 21 bp, Artificial Sequence
  Synthetic
caagtguacaaccctgtgugg

SEQ ID NO: 20160 - DNA, 19 bp, Artificial Sequence
  Synthetic
tggtaccugcctccuacga

SEQ ID NO: 20161 - DNA, 32 bp, Artificial Sequence
  Synthetic
tgttactcttattuaaagaaggaaggagauga

SEQ ID NO: 20162 - DNA, 27 bp, Artificial Sequence
  Synthetic
ccatccatcaaautggtgtacacttug

SEQ ID NO: 20163 - DNA, 27 bp, Artificial Sequence
  Synthetic
gacaacugacatttuagaaagcggaat

SEQ ID NO: 20164 - DNA, 23 bp, Artificial Sequence
  Synthetic
cugatccgtgcuaaggaagaaga

SEQ ID NO: 20165 - DNA, 25 bp, Artificial Sequence
  Synthetic
ctttcctuggaagacactcatcuac

SEQ ID NO: 20166 - DNA, 20 bp, Artificial Sequence
  Synthetic
gagauccacucccgagacag

SEQ ID NO: 20167 - DNA, 23 bp, Artificial Sequence
  Synthetic
tgtcctgacugttgaggaacuca

SEQ ID NO: 20168 - DNA, 19 bp, Artificial Sequence
  Synthetic
cagagagcuggctacggug

SEQ ID NO: 20169 - DNA, 24 bp, Artificial Sequence
  Synthetic
tcactgcaacuttcatgacaggut

SEQ ID NO: 20170 - DNA, 30 bp, Artificial Sequence
  Synthetic
cttttctgttctucattttcatacccauct

SEQ ID NO: 20171 - DNA, 23 bp, Artificial Sequence
  Synthetic
cagctctttcuttggcttctcug

SEQ ID NO: 20172 - DNA, 22 bp, Artificial Sequence
  Synthetic
gcaacctgaugatttcctgcug

SEQ ID NO: 20173 - DNA, 26 bp, Artificial Sequence
  Synthetic
caacttgauaggtgaagcucaacaaa

SEQ ID NO: 20174 - DNA, 23 bp, Artificial Sequence
  Synthetic
ggtttaactguctccctcctucc

SEQ ID NO: 20175 - DNA, 20 bp, Artificial Sequence
  Synthetic
cagcaatgucaggcccauac

SEQ ID NO: 20176 - DNA, 30 bp, Artificial Sequence
  Synthetic
attcatttttgagguttggttgtuaacact

SEQ ID NO: 20177 - DNA, 25 bp, Artificial Sequence
  Synthetic
cctcguttttgtaggugacaccaat

SEQ ID NO: 20178 - DNA, 22 bp, Artificial Sequence
  Synthetic
gttccagcagutccacctucat

SEQ ID NO: 20179 - DNA, 20 bp, Artificial Sequence
  Synthetic
ggaaggaaccccucgaaucc

SEQ ID NO: 20180 - DNA, 25 bp, Artificial Sequence
  Synthetic
cctgtaugaagggaagccagaauag

SEQ ID NO: 20181 - DNA, 26 bp, Artificial Sequence
  Synthetic
tccattagccutttggtcttgttuca

SEQ ID NO: 20182 - DNA, 27 bp, Artificial Sequence
  Synthetic
ctaatgcctaauggtgctacagttuct

SEQ ID NO: 20183 - DNA, 25 bp, Artificial Sequence
  Synthetic
caggacaacucattagtagccugac

SEQ ID NO: 20184 - DNA, 25 bp, Artificial Sequence
  Synthetic
gcccatcucctgcagaaaauaacat

SEQ ID NO: 20185 - DNA, 23 bp, Artificial Sequence
  Synthetic
agtgaacacugagctttgctuga

SEQ ID NO: 20186 - DNA, 23 bp, Artificial Sequence
  Synthetic
catacagacugcagggacaauga

SEQ ID NO: 20187 - DNA, 24 bp, Artificial Sequence
  Synthetic
tgtctcgacccutcagaatctcut

SEQ ID NO: 20188 - DNA, 26 bp, Artificial Sequence
  Synthetic
caagttgaaatgaaucaagggcaguc

SEQ ID NO: 20189 - DNA, 25 bp, Artificial Sequence
  Synthetic
gtttgggaauctgctctttgtugaa

SEQ ID NO: 20190 - DNA, 25 bp, Artificial Sequence
  Synthetic
ctttggccagacuaaaguggaagaa

SEQ ID NO: 20191 - DNA, 28 bp, Artificial Sequence
  Synthetic
cctgtattttgcaugcacttgattucat

SEQ ID NO: 20192 - DNA, 28 bp, Artificial Sequence
  Synthetic
tccaaauaatgtgaucccaaagcaagat

SEQ ID NO: 20193 - DNA, 28 bp, Artificial Sequence
  Synthetic
catggttatgtaucaagtacctttgcug

SEQ ID NO: 20194 - DNA, 26 bp, Artificial Sequence
  Synthetic
aggtaacuaagcaagagaauccacct

SEQ ID NO: 20195 - DNA, 26 bp, Artificial Sequence
  Synthetic
tggccctgacauttcaacttttacut

SEQ ID NO: 20196 - DNA, 27 bp, Artificial Sequence
  Synthetic
agacacatggcguttatccagaatuag

SEQ ID NO: 20197 - DNA, 27 bp, Artificial Sequence
  Synthetic
aagugaagttctcttucacaagacaca

SEQ ID NO: 20198 - DNA, 18 bp, Artificial Sequence
  Synthetic
cccgugccatgtttuccc

SEQ ID NO: 20199 - DNA, 28 bp, Artificial Sequence
  Synthetic
gaagagugaagacgattacaactuacca

SEQ ID NO: 20200 - DNA, 26 bp, Artificial Sequence
  Synthetic
gtggcagcuattagagaaatcaugga

SEQ ID NO: 20201 - DNA, 25 bp, Artificial Sequence
  Synthetic
ggcaacccuagaatagctaagccua

SEQ ID NO: 20202 - DNA, 25 bp, Artificial Sequence
  Synthetic
gggtgccttutcattaagagguagg

SEQ ID NO: 20203 - DNA, 23 bp, Artificial Sequence
  Synthetic
actatttcugccaggccacuaga

SEQ ID NO: 20204 - DNA, 28 bp, Artificial Sequence
  Synthetic
gacagaaggguaaagctattaggatuga

SEQ ID NO: 20205 - DNA, 23 bp, Artificial Sequence
  Synthetic
ggtaacccaautctcagggucag

SEQ ID NO: 20206 - DNA, 28 bp, Artificial Sequence
  Synthetic
gcaccatatatugtgtttgggatucaaa

SEQ ID NO: 20207 - DNA, 22 bp, Artificial Sequence
  Synthetic
gttggugccataagaguggaca

SEQ ID NO: 20208 - DNA, 24 bp, Artificial Sequence
  Synthetic
gcgaaaagucaggatgtuagcaga

SEQ ID NO: 20209 - DNA, 27 bp, Artificial Sequence
  Synthetic
cgttttcagttugttttgtacgtgaug

SEQ ID NO: 20210 - DNA, 22 bp, Artificial Sequence
  Synthetic
ccacaucacccucagacagagt

SEQ ID NO: 20211 - DNA, 24 bp, Artificial Sequence
  Synthetic
gcagcttgagaugaggtggaauag

SEQ ID NO: 20212 - DNA, 27 bp, Artificial Sequence
  Synthetic
ttauggaaaccaaaataugcagggaga

SEQ ID NO: 20213 - DNA, 24 bp, Artificial Sequence
  Synthetic
ccatgtttggautgctcagatugg

SEQ ID NO: 20214 - DNA, 24 bp, Artificial Sequence
  Synthetic
gaugctaatggucaggaaaagcag

SEQ ID NO: 20215 - DNA, 25 bp, Artificial Sequence
  Synthetic
aatgagaatugacccatgagtugga

SEQ ID NO: 20216 - DNA, 21 bp, Artificial Sequence
  Synthetic
cccacttaccugcgtttcauc

SEQ ID NO: 20217 - DNA, 28 bp, Artificial Sequence
  Synthetic
gtctttucaagtgagguaaccaacaaaa

SEQ ID NO: 20218 - DNA, 24 bp, Artificial Sequence
  Synthetic
caactgttgcauggtagcagatut

SEQ ID NO: 20219 - DNA, 27 bp, Artificial Sequence
  Synthetic
ctactaaggacccuttattcacaguca

SEQ ID NO: 20220 - DNA, 31 bp, Artificial Sequence
  Synthetic
tcaactatccaaautaaatacaatgguggga

SEQ ID NO: 20221 - DNA, 21 bp, Artificial Sequence
  Synthetic
gccctcuagcagtctggtuac

SEQ ID NO: 20222 - DNA, 27 bp, Artificial Sequence
  Synthetic
ggaagtagtcgcutactcatttctcut

SEQ ID NO: 20223 - DNA, 30 bp, Artificial Sequence
  Synthetic
gagagagctugaagaaatgtttuaacaaat

SEQ ID NO: 20224 - DNA, 26 bp, Artificial Sequence
  Synthetic
gtgtgatgtaauaggtttcagugcag

SEQ ID NO: 20225 - DNA, 27 bp, Artificial Sequence
  Synthetic
aatccaggucttccatatuccaaacag

SEQ ID NO: 20226 - DNA, 25 bp, Artificial Sequence
  Synthetic
gagatgggaaauatggcttctcuga

SEQ ID NO: 20227 - DNA, 30 bp, Artificial Sequence
  Synthetic
cctgttggtattuggatactggataaagua

SEQ ID NO: 20228 - DNA, 29 bp, Artificial Sequence
  Synthetic
cttgcaguaagagattgttctaugaaagg

SEQ ID NO: 20229 - DNA, 24 bp, Artificial Sequence
  Synthetic
gtattctttgcugtaccgctctug

SEQ ID NO: 20230 - DNA, 24 bp, Artificial Sequence
  Synthetic
attggtgautgctacaatucagga

SEQ ID NO: 20231 - DNA, 32 bp, Artificial Sequence
  Synthetic
tcttctgctatcaccauctttagtaactacut

SEQ ID NO: 20232 - DNA, 22 bp, Artificial Sequence
  Synthetic
gcttugccgagccctataacut

SEQ ID NO: 20233 - DNA, 25 bp, Artificial Sequence
  Synthetic
aggatcaaagaguaagcgcttcauc

SEQ ID NO: 20234 - DNA, 24 bp, Artificial Sequence
  Synthetic
cctacaggaagcuatcctctgcut

SEQ ID NO: 20235 - DNA, 22 bp, Artificial Sequence
  Synthetic
ctcctcaaccauctcctgugac

SEQ ID NO: 20236 - DNA, 21 bp, Artificial Sequence
  Synthetic
gcagtauagaggacggagcug

SEQ ID NO: 20237 - DNA, 21 bp, Artificial Sequence
  Synthetic
cagaaguaccagcagguggat

SEQ ID NO: 20238 - DNA, 19 bp, Artificial Sequence
  Synthetic
aatctgtucctgcggucac

SEQ ID NO: 20239 - DNA, 20 bp, Artificial Sequence
  Synthetic
cggcuaggaacgtgctcauc

SEQ ID NO: 20240 - DNA, 21 bp, Artificial Sequence
  Synthetic
atgtgaagagcaucagccugt

SEQ ID NO: 20241 - DNA, 27 bp, Artificial Sequence
  Synthetic
tggacaugaaaggagaugtcaaataug

SEQ ID NO: 20242 - DNA, 19 bp, Artificial Sequence
  Synthetic
ccttggtggugggcactut

SEQ ID NO: 20243 - DNA, 26 bp, Artificial Sequence
  Synthetic
cttatgtcggagcugaagatcaugag

SEQ ID NO: 20244 - DNA, 20 bp, Artificial Sequence
  Synthetic
agctcccacguggagtcaua

SEQ ID NO: 20245 - DNA, 22 bp, Artificial Sequence
  Synthetic
ggcctgagacuccctctgauaa

SEQ ID NO: 20246 - DNA, 21 bp, Artificial Sequence
  Synthetic
tgtgcucaccacctcaaacuc

SEQ ID NO: 20247 - DNA, 18 bp, Artificial Sequence
  Synthetic
gcuggcagccaacccuac

SEQ ID NO: 20248 - DNA, 20 bp, Artificial Sequence
  Synthetic
gtgcggutgtcttugaacca

SEQ ID NO: 20249 - DNA, 17 bp, Artificial Sequence
  Synthetic
cctgacggucaccccut

SEQ ID NO: 20250 - DNA, 23 bp, Artificial Sequence
  Synthetic
ccacctcatucccgatcacaaug

SEQ ID NO: 20251 - DNA, 21 bp, Artificial Sequence
  Synthetic
gctgaagugctagtggcuggt

SEQ ID NO: 20252 - DNA, 22 bp, Artificial Sequence
  Synthetic
ctgatgccuccagtugacaaga

SEQ ID NO: 20253 - DNA, 21 bp, Artificial Sequence
  Synthetic
tcacacugaccaacctcacug

SEQ ID NO: 20254 - DNA, 21 bp, Artificial Sequence
  Synthetic
caaaguttcagugcgacgaga

SEQ ID NO: 20255 - DNA, 19 bp, Artificial Sequence
  Synthetic
ggtcgaugccgaagcugat

SEQ ID NO: 20256 - DNA, 17 bp, Artificial Sequence
  Synthetic
gggcccucctgtgtcuc

SEQ ID NO: 20257 - DNA, 18 bp, Artificial Sequence
  Synthetic
ggcgauggaagcgcttut

SEQ ID NO: 20258 - DNA, 19 bp, Artificial Sequence
  Synthetic
gccucaacgactccaucca

SEQ ID NO: 20259 - DNA, 17 bp, Artificial Sequence
  Synthetic
tggugggcucacaccag

SEQ ID NO: 20260 - DNA, 26 bp, Artificial Sequence
  Synthetic
aaaggccgacaaagautatcacttua

SEQ ID NO: 20261 - DNA, 29 bp, Artificial Sequence
  Synthetic
tagaaactaaaaggcugaaatcaaguagg

SEQ ID NO: 20262 - DNA, 25 bp, Artificial Sequence
  Synthetic
ctttgaaauaacaccaccagtgguc

SEQ ID NO: 20263 - DNA, 23 bp, Artificial Sequence
  Synthetic
agcaacugcacuaaagaggacaa

SEQ ID NO: 20264 - DNA, 22 bp, Artificial Sequence
  Synthetic
gggucagggacagtgatuaaga

SEQ ID NO: 20265 - DNA, 24 bp, Artificial Sequence
  Synthetic
cccacgtguaaatgtagccactua

SEQ ID NO: 20266 - DNA, 31 bp, Artificial Sequence
  Synthetic
gaattttctaaagguatctctctcggtguat

SEQ ID NO: 20267 - DNA, 26 bp, Artificial Sequence
  Synthetic
atcatguccccagaaaatccagtuac

SEQ ID NO: 20268 - DNA, 24 bp, Artificial Sequence
  Synthetic
gatggaucagacctgtgaacuacc

SEQ ID NO: 20269 - DNA, 24 bp, Artificial Sequence
  Synthetic
ccactgacagucgataactgcaua

SEQ ID NO: 20270 - DNA, 27 bp, Artificial Sequence
  Synthetic
actatcaagaauggctttctgcactut

SEQ ID NO: 20271 - DNA, 24 bp, Artificial Sequence
  Synthetic
agtctcataatugcaggtggcaut

SEQ ID NO: 20272 - DNA, 27 bp, Artificial Sequence
  Synthetic
ccagattccaguaccagtacatuagga

SEQ ID NO: 20273 - DNA, 23 bp, Artificial Sequence
  Synthetic
aagtttccctutaagtggccugt

SEQ ID NO: 20274 - DNA, 23 bp, Artificial Sequence
  Synthetic
caaucgtcatgttugaaggcaga

SEQ ID NO: 20275 - DNA, 29 bp, Artificial Sequence
  Synthetic
ggccattttctutctttttcttactugct

SEQ ID NO: 20276 - DNA, 28 bp, Artificial Sequence
  Synthetic
agctctgataauccaaaaaggactagug

SEQ ID NO: 20277 - DNA, 27 bp, Artificial Sequence
  Synthetic
ggctatttgcuatcctggaaagtucat

SEQ ID NO: 20278 - DNA, 24 bp, Artificial Sequence
  Synthetic
cccatagaacacagcucagaguct

SEQ ID NO: 20279 - DNA, 26 bp, Artificial Sequence
  Synthetic
cttctgttttgcutttaccctagugt

SEQ ID NO: 20280 - DNA, 28 bp, Artificial Sequence
  Synthetic
ttccgaaguataaagugcaaacacaaag

SEQ ID NO: 20281 - DNA, 26 bp, Artificial Sequence
  Synthetic
gtagtttuagaccatccacttuccca

SEQ ID NO: 20282 - DNA, 23 bp, Artificial Sequence
  Synthetic
gatgactgcucaaaacctgguct

SEQ ID NO: 20283 - DNA, 21 bp, Artificial Sequence
  Synthetic
ctaggatuggcggagttcuga

SEQ ID NO: 20284 - DNA, 25 bp, Artificial Sequence
  Synthetic
gggcagaagaucctaguaaagagga

SEQ ID NO: 20285 - DNA, 21 bp, Artificial Sequence
  Synthetic
tctgggccutttccgtttuca

SEQ ID NO: 20286 - DNA, 29 bp, Artificial Sequence
  Synthetic
acggttaaatgttugtgataaatccagug

SEQ ID NO: 20287 - DNA, 28 bp, Artificial Sequence
  Synthetic
tcagaaggacaaugtttatcagcactut

SEQ ID NO: 20288 - DNA, 23 bp, Artificial Sequence
  Synthetic
ggtcgauctagtgcucagaacaa

SEQ ID NO: 20289 - DNA, 21 bp, Artificial Sequence
  Synthetic
gcaactcagcaugtccaccuc

SEQ ID NO: 20290 - DNA, 28 bp, Artificial Sequence
  Synthetic
cattcctctguaaatggtgttgtttuca

SEQ ID NO: 20291 - DNA, 28 bp, Artificial Sequence
  Synthetic
cacttcaaacttacuactgcattacgut

SEQ ID NO: 20292 - DNA, 23 bp, Artificial Sequence
  Synthetic
ggagaacuaatgccucacaggac

SEQ ID NO: 20293 - DNA, 23 bp, Artificial Sequence
  Synthetic
cacaagugggcaaacatttcuct

SEQ ID NO: 20294 - DNA, 21 bp, Artificial Sequence
  Synthetic
ggtgctcccuccacatctgua

SEQ ID NO: 20295 - DNA, 30 bp, Artificial Sequence
  Synthetic
gaaaatatctgtugccaattaaacugaggt

SEQ ID NO: 20296 - DNA, 26 bp, Artificial Sequence
  Synthetic
tggatgtacacauacatgactugcag

SEQ ID NO: 20297 - DNA, 25 bp, Artificial Sequence
  Synthetic
ctgctttacagucattgcaauacca

SEQ ID NO: 20298 - DNA, 28 bp, Artificial Sequence
  Synthetic
gcaaaggaguggatgggacatauaaaaa

SEQ ID NO: 20299 - DNA, 23 bp, Artificial Sequence
  Synthetic
aaggcaguttcaaaauggagcat

SEQ ID NO: 20300 - DNA, 22 bp, Artificial Sequence
  Synthetic
ctttuccaagcgccaataucca

SEQ ID NO: 20301 - DNA, 28 bp, Artificial Sequence
  Synthetic
tgtcaaggaucaatgataucaagcaact

SEQ ID NO: 20302 - DNA, 24 bp, Artificial Sequence
  Synthetic
ccaactgugaaacacagaaguggt

SEQ ID NO: 20303 - DNA, 25 bp, Artificial Sequence
  Synthetic
caaaagcccugaaattcagatguca

SEQ ID NO: 20304 - DNA, 24 bp, Artificial Sequence
  Synthetic
aucacaaaggagugagaagaugag

SEQ ID NO: 20305 - DNA, 22 bp, Artificial Sequence
  Synthetic
atggagagaacgaguagcggua

SEQ ID NO: 20306 - DNA, 22 bp, Artificial Sequence
  Synthetic
agagcaaucaacaggaauggct

SEQ ID NO: 20307 - DNA, 26 bp, Artificial Sequence
  Synthetic
agtcagttctcucaagaggtcttuca

SEQ ID NO: 20308 - DNA, 23 bp, Artificial Sequence
  Synthetic
ggataaatccauaggtgcugcca

SEQ ID NO: 20309 - DNA, 22 bp, Artificial Sequence
  Synthetic
tcagtaggccugtctgaaguct

SEQ ID NO: 20310 - DNA, 21 bp, Artificial Sequence
  Synthetic
gcataugccgagagctgtuga

SEQ ID NO: 20311 - DNA, 25 bp, Artificial Sequence
  Synthetic
tcatauaaaaaggcctuggcaggag

SEQ ID NO: 20312 - DNA, 21 bp, Artificial Sequence
  Synthetic
ccugggaaaagcctcaucacg

SEQ ID NO: 20313 - DNA, 26 bp, Artificial Sequence
  Synthetic
ctggaagtgtautttgctctggttug

SEQ ID NO: 20314 - DNA, 24 bp, Artificial Sequence
  Synthetic
caggttttcttuccctagctccuc

SEQ ID NO: 20315 - DNA, 20 bp, Artificial Sequence
  Synthetic
actgcacugtactccucggt

SEQ ID NO: 20316 - DNA, 23 bp, Artificial Sequence
  Synthetic
tgcaggaacaaautctccaggut

SEQ ID NO: 20317 - DNA, 21 bp, Artificial Sequence
  Synthetic
cagaccccugtgatgctgtua

SEQ ID NO: 20318 - DNA, 23 bp, Artificial Sequence
  Synthetic
tcgagttcttuctgcagagctut

SEQ ID NO: 20319 - DNA, 21 bp, Artificial Sequence
  Synthetic
aggcagaggcacutcuacaga

SEQ ID NO: 20320 - DNA, 18 bp, Artificial Sequence
  Synthetic
gcacuagccccacuccaa

SEQ ID NO: 20321 - DNA, 18 bp, Artificial Sequence
  Synthetic
cuggagggccaggaaucg

SEQ ID NO: 20322 - DNA, 24 bp, Artificial Sequence
  Synthetic
gcttttggcuactatggaccacuc

SEQ ID NO: 20323 - DNA, 27 bp, Artificial Sequence
  Synthetic
acaagcaacacauttttatcagcguaa

SEQ ID NO: 20324 - DNA, 26 bp, Artificial Sequence
  Synthetic
tgcttgttuaggtccctttcuagaga

SEQ ID NO: 20325 - DNA, 25 bp, Artificial Sequence
  Synthetic
aagacaggccutagcatactatgua

SEQ ID NO: 20326 - DNA, 20 bp, Artificial Sequence
  Synthetic
gctcggtcuactcaggcauc

SEQ ID NO: 20327 - DNA, 19 bp, Artificial Sequence
  Synthetic
ccagggtcuccgtcaggut

SEQ ID NO: 20328 - DNA, 20 bp, Artificial Sequence
  Synthetic
ccggugcaagatctctucga

SEQ ID NO: 20329 - DNA, 19 bp, Artificial Sequence
  Synthetic
gccgcgautgaggtcgaua

SEQ ID NO: 20330 - DNA, 21 bp, Artificial Sequence
  Synthetic
gugggcctcugagaagcaaat

SEQ ID NO: 20331 - DNA, 25 bp, Artificial Sequence
  Synthetic
tggttctggatutcttcgaaggtug

SEQ ID NO: 20332 - DNA, 19 bp, Artificial Sequence
  Synthetic
gccagggucacagcacauc

SEQ ID NO: 20333 - DNA, 22 bp, Artificial Sequence
  Synthetic
gaaggatcuggacctcatgcuc

SEQ ID NO: 20334 - DNA, 19 bp, Artificial Sequence
  Synthetic
cctcttcgcuaggcagcuc

SEQ ID NO: 20335 - DNA, 20 bp, Artificial Sequence
  Synthetic
tggtgcccauaggtgtgtuc

SEQ ID NO: 20336 - DNA, 21 bp, Artificial Sequence
  Synthetic
agggaggagucgggtatucaa

SEQ ID NO: 20337 - DNA, 21 bp, Artificial Sequence
  Synthetic
ccugaatgtguacagcagcga

SEQ ID NO: 20338 - DNA, 20 bp, Artificial Sequence
  Synthetic
ggctatugggagcactgtug

SEQ ID NO: 20339 - DNA, 19 bp, Artificial Sequence
  Synthetic
cgggaguacctguccgaga

SEQ ID NO: 20340 - DNA, 24 bp, Artificial Sequence
  Synthetic
catgtaatgcaugacagcctgtug

SEQ ID NO: 20341 - DNA, 20 bp, Artificial Sequence
  Synthetic
aggaggacacgugcctcaua

SEQ ID NO: 20342 - DNA, 22 bp, Artificial Sequence
  Synthetic
tcagattccugggagccuagag

SEQ ID NO: 20343 - DNA, 22 bp, Artificial Sequence
  Synthetic
caggtgaagauggcgatgugat

SEQ ID NO: 20344 - DNA, 25 bp, Artificial Sequence
  Synthetic
caagaggccuaagattgtatgugca

SEQ ID NO: 20345 - DNA, 23 bp, Artificial Sequence
  Synthetic
gtcatcagccutatccagcucat

SEQ ID NO: 20346 - DNA, 27 bp, Artificial Sequence
  Synthetic
gacuggtatagtcttucacggaaacaa

SEQ ID NO: 20347 - DNA, 29 bp, Artificial Sequence
  Synthetic
agtttctcttctutacagacctacuaggg

SEQ ID NO: 20348 - DNA, 28 bp, Artificial Sequence
  Synthetic
gctttacgcaaauaagtaagaaggtcuc

SEQ ID NO: 20349 - DNA, 25 bp, Artificial Sequence
  Synthetic
ctaggactccugcttctgtcatauc

SEQ ID NO: 20350 - DNA, 24 bp, Artificial Sequence
  Synthetic
ttgcctaggugctccataatgaug

SEQ ID NO: 20351 - DNA, 27 bp, Artificial Sequence
  Synthetic
ggugacagtgcttauaaacgaagacaa

SEQ ID NO: 20352 - DNA, 27 bp, Artificial Sequence
  Synthetic
caccaaacccuagattatttgcagcua

SEQ ID NO: 20353 - DNA, 28 bp, Artificial Sequence
  Synthetic
cagaaccagaatutaaggtggaagauga

SEQ ID NO: 20354 - DNA, 30 bp, Artificial Sequence
  Synthetic
aactgaaacacagagutttctgagtatuga

SEQ ID NO: 20355 - DNA, 28 bp, Artificial Sequence
  Synthetic
ggtcctgctuatgtctgtaataucacaa

SEQ ID NO: 20356 - DNA, 24 bp, Artificial Sequence
  Synthetic
ctaccutctgtagcucaacccaaa

SEQ ID NO: 20357 - DNA, 23 bp, Artificial Sequence
  Synthetic
ccactcugaggaaatgtggtgua

SEQ ID NO: 20358 - DNA, 24 bp, Artificial Sequence
  Synthetic
tttaggtccauttggcttgugaga

SEQ ID NO: 20359 - DNA, 28 bp, Artificial Sequence
  Synthetic
cccaaactccatuacttctttccatcut

SEQ ID NO: 20360 - DNA, 21 bp, Artificial Sequence
  Synthetic
gtagggcuggtgatgccauac

SEQ ID NO: 20361 - DNA, 27 bp, Artificial Sequence
  Synthetic
gataaagcgttuctgtctctagctuca

SEQ ID NO: 20362 - DNA, 25 bp, Artificial Sequence
  Synthetic
caggtacugtgataactcuccaaca

SEQ ID NO: 20363 - DNA, 31 bp, Artificial Sequence
  Synthetic
caaaaggaatcaaugttcttgtaatgugact

SEQ ID NO: 20364 - DNA, 30 bp, Artificial Sequence
  Synthetic
ccttgtgttcaagaucaacatcaaatacut

SEQ ID NO: 20365 - DNA, 22 bp, Artificial Sequence
  Synthetic
ccactctctucttggctgtgut

SEQ ID NO: 20366 - DNA, 29 bp, Artificial Sequence
  Synthetic
cacacacacacgccuctaaattattatut

SEQ ID NO: 20367 - DNA, 28 bp, Artificial Sequence
  Synthetic
ggagaacactacugaatgcaattttugt

SEQ ID NO: 20368 - DNA, 29 bp, Artificial Sequence
  Synthetic
ccattccagatcaugaaaagtgagatuct

SEQ ID NO: 20369 - DNA, 28 bp, Artificial Sequence
  Synthetic
tctttctgtcacuccttatacctacugg

SEQ ID NO: 20370 - DNA, 24 bp, Artificial Sequence
  Synthetic
ggagtaggguaagcaggaaugaaa

SEQ ID NO: 20371 - DNA, 19 bp, Artificial Sequence
  Synthetic
gtggucggctgttcuggat

SEQ ID NO: 20372 - DNA, 24 bp, Artificial Sequence
  Synthetic
aggagtcugctttaagtacucaca

SEQ ID NO: 20373 - DNA, 27 bp, Artificial Sequence
  Synthetic
gaaagutcccttgtacuacagacacag

SEQ ID NO: 20374 - DNA, 23 bp, Artificial Sequence
  Synthetic
gagatauccgtcccatucagcag

SEQ ID NO: 20375 - DNA, 24 bp, Artificial Sequence
  Synthetic
tgaggtgcagaugtgatttgtuga

SEQ ID NO: 20376 - DNA, 24 bp, Artificial Sequence
  Synthetic
gagaacutgctcucacagaaacct

SEQ ID NO: 20377 - DNA, 23 bp, Artificial Sequence
  Synthetic
ctttgaatuaggcccttcugcct

SEQ ID NO: 20378 - DNA, 28 bp, Artificial Sequence
  Synthetic
ccaaacccaaatucttctatgtgacuca

SEQ ID NO: 20379 - DNA, 22 bp, Artificial Sequence
  Synthetic
ccatctcatccuacctcgcauc

SEQ ID NO: 20380 - DNA, 22 bp, Artificial Sequence
  Synthetic
aggtgcacuaatagagggugga

SEQ ID NO: 20381 - DNA, 27 bp, Artificial Sequence
  Synthetic
gtacaatuccaacagaacagatacuca

SEQ ID NO: 20382 - DNA, 23 bp, Artificial Sequence
  Synthetic
caccctcatucctgtgtagcuaa

SEQ ID NO: 20383 - DNA, 25 bp, Artificial Sequence
  Synthetic
gtgaaacacguctctccaaattgut

SEQ ID NO: 20384 - DNA, 21 bp, Artificial Sequence
  Synthetic
cgcugtgaagauccaaaccac

SEQ ID NO: 20385 - DNA, 24 bp, Artificial Sequence
  Synthetic
gggtgctgautctataatgcugat

SEQ ID NO: 20386 - DNA, 26 bp, Artificial Sequence
  Synthetic
tgcaaaugggaatcctctuacacaaa

SEQ ID NO: 20387 - DNA, 28 bp, Artificial Sequence
  Synthetic
actcaccattguctgttattgtctctug

SEQ ID NO: 20388 - DNA, 30 bp, Artificial Sequence
  Synthetic
gcttcggaauaagacagtaaatgttctuca

SEQ ID NO: 20389 - DNA, 27 bp, Artificial Sequence
  Synthetic
aaacaaagcaaaauccatcagctacuc

SEQ ID NO: 20390 - DNA, 25 bp, Artificial Sequence
  Synthetic
ttgactttccutctcttctccucct

SEQ ID NO: 20391 - DNA, 24 bp, Artificial Sequence
  Synthetic
cggaatttaaagutgcgtgtguct

SEQ ID NO: 20392 - DNA, 24 bp, Artificial Sequence
  Synthetic
cctaagggccucattttccttuct

SEQ ID NO: 20393 - DNA, 23 bp, Artificial Sequence
  Synthetic
gctgtcauagccgagaacaaugg

SEQ ID NO: 20394 - DNA, 24 bp, Artificial Sequence
  Synthetic
tttccttttggucttcaggtugga

SEQ ID NO: 20395 - DNA, 22 bp, Artificial Sequence
  Synthetic
cggaaggtuccatgggattcug

SEQ ID NO: 20396 - DNA, 20 bp, Artificial Sequence
  Synthetic
ggagaagccuatgagcccut

SEQ ID NO: 20397 - DNA, 21 bp, Artificial Sequence
  Synthetic
tgtgctgcacautcagtguga

SEQ ID NO: 20398 - DNA, 21 bp, Artificial Sequence
  Synthetic
caccagcgutccaagucagat

SEQ ID NO: 20399 - DNA, 21 bp, Artificial Sequence
  Synthetic
gcttttcugcacttgctcguc

SEQ ID NO: 20400 - DNA, 23 bp, Artificial Sequence
  Synthetic
gatctgccugttctttccacuca

SEQ ID NO: 20401 - DNA, 20 bp, Artificial Sequence
  Synthetic
tggttgggaugctgacacuc

SEQ ID NO: 20402 - DNA, 17 bp, Artificial Sequence
  Synthetic
gcctcccugctggacut

SEQ ID NO: 20403 - DNA, 20 bp, Artificial Sequence
  Synthetic
ctgtcauccaacctggcuca

SEQ ID NO: 20404 - DNA, 26 bp, Artificial Sequence
  Synthetic
ctgaatattuaaaagcaacgcuggga

SEQ ID NO: 20405 - DNA, 23 bp, Artificial Sequence
  Synthetic
gacgataccccugaggagatuct

SEQ ID NO: 20406 - DNA, 19 bp, Artificial Sequence
  Synthetic
gctuggcaaagccgaaguc

SEQ ID NO: 20407 - DNA, 19 bp, Artificial Sequence
  Synthetic
cctcccuctcctgcucagt

SEQ ID NO: 20408 - DNA, 17 bp, Artificial Sequence
  Synthetic
cgcugcacucacacagg

SEQ ID NO: 20409 - DNA, 23 bp, Artificial Sequence
  Synthetic
ggcuacgagaucaaggaggacat

SEQ ID NO: 20410 - DNA, 21 bp, Artificial Sequence
  Synthetic
caccgauagagggaaccacug

SEQ ID NO: 20411 - DNA, 26 bp, Artificial Sequence
  Synthetic
gccctgtctugctttccttgtatuaa

SEQ ID NO: 20412 - DNA, 17 bp, Artificial Sequence
  Synthetic
gggcaggcucaccauga

SEQ ID NO: 20413 - DNA, 22 bp, Artificial Sequence
  Synthetic
gaguaaggaggccatugaccac

SEQ ID NO: 20414 - DNA, 23 bp, Artificial Sequence
  Synthetic
caggctguggagatggtcuaaag

SEQ ID NO: 20415 - DNA, 27 bp, Artificial Sequence
  Synthetic
acaccagccauaaaacaagtuaaacgt

SEQ ID NO: 20416 - DNA, 22 bp, Artificial Sequence
  Synthetic
tccaggtgucctttgtgtucag

SEQ ID NO: 20417 - DNA, 23 bp, Artificial Sequence
  Synthetic
atgugaaggagggcttugagaag

SEQ ID NO: 20418 - DNA, 19 bp, Artificial Sequence
  Synthetic
ccagcaacugtgcgatugg

SEQ ID NO: 20419 - DNA, 17 bp, Artificial Sequence
  Synthetic
ctctgcguccctuggct

SEQ ID NO: 20420 - DNA, 32 bp, Artificial Sequence
  Synthetic
cgataaaaccaattautccatacagtgacuac

SEQ ID NO: 20421 - DNA, 24 bp, Artificial Sequence
  Synthetic
agcgagaugaagaaactgaucacc

SEQ ID NO: 20422 - DNA, 28 bp, Artificial Sequence
  Synthetic
cacccagccgcuatagttctaattaaua

SEQ ID NO: 20423 - DNA, 30 bp, Artificial Sequence
  Synthetic
caggatatggttugaatcatttttgtgtut

SEQ ID NO: 20424 - DNA, 26 bp, Artificial Sequence
  Synthetic
ctgtaattctgtuccccttcacttug

SEQ ID NO: 20425 - DNA, 32 bp, Artificial Sequence
  Synthetic
ctcaggttgatguagctgtgaaaattaauaag

SEQ ID NO: 20426 - DNA, 26 bp, Artificial Sequence
  Synthetic
ccacatcugaaaaagagtcgtcagut

SEQ ID NO: 20427 - DNA, 20 bp, Artificial Sequence
  Synthetic
gcagcactuccgtggatuct

SEQ ID NO: 20428 - DNA, 21 bp, Artificial Sequence
  Synthetic
tcgcaguctggaaauggacac

SEQ ID NO: 20429 - DNA, 22 bp, Artificial Sequence
  Synthetic
aggatagtcccugaccctctuc

SEQ ID NO: 20430 - DNA, 29 bp, Artificial Sequence
  Synthetic
gtcaaaggcauaaagaacaaacuaacaca

SEQ ID NO: 20431 - DNA, 22 bp, Artificial Sequence
  Synthetic
atttcacaaugcacgcauggag

SEQ ID NO: 20432 - DNA, 24 bp, Artificial Sequence
  Synthetic
gcaataagaggcgutgaaguaacc

SEQ ID NO: 20433 - DNA, 24 bp, Artificial Sequence
  Synthetic
actgtatcattucagcaggcaucc

SEQ ID NO: 20434 - DNA, 28 bp, Artificial Sequence
  Synthetic
gggtcaagtgaguggataaaaatatugt

SEQ ID NO: 20435 - DNA, 32 bp, Artificial Sequence
  Synthetic
tatcttagtcctuactttacactctcttucag

SEQ ID NO: 20436 - DNA, 29 bp, Artificial Sequence
  Synthetic
catccagactgtuttctactaactcctut

SEQ ID NO: 20437 - DNA, 30 bp, Artificial Sequence
  Synthetic
acttgatttgtttcutgtaactgatttcuc

SEQ ID NO: 20438 - DNA, 26 bp, Artificial Sequence
  Synthetic
tcttacgatutctaactgtuggccat

SEQ ID NO: 20439 - DNA, 27 bp, Artificial Sequence
  Synthetic
aaatgaagauagaacgtgctcacauga

SEQ ID NO: 20440 - DNA, 22 bp, Artificial Sequence
  Synthetic
ggttagctaugctgcagctgut

SEQ ID NO: 20441 - DNA, 26 bp, Artificial Sequence
  Synthetic
agacccactcagugtttgtaaatgut

SEQ ID NO: 20442 - DNA, 20 bp, Artificial Sequence
  Synthetic
ttaggcggauctggttggug

SEQ ID NO: 20443 - DNA, 19 bp, Artificial Sequence
  Synthetic
cactgguggttgggucagt

SEQ ID NO: 20444 - DNA, 21 bp, Artificial Sequence
  Synthetic
cgtcttttcccauccctggug

SEQ ID NO: 20445 - DNA, 20 bp, Artificial Sequence
  Synthetic
gtgcucagcctctgugaaga

SEQ ID NO: 20446 - DNA, 25 bp, Artificial Sequence
  Synthetic
gcctcaagugacacctcacctcuct

SEQ ID NO: 20447 - DNA, 23 bp, Artificial Sequence
  Synthetic
ccagggcttugaaggaagtgugc

SEQ ID NO: 20448 - DNA, 20 bp, Artificial Sequence
  Synthetic
tctgaggucccccttctgut

SEQ ID NO: 20449 - DNA, 17 bp, Artificial Sequence
  Synthetic
gtgcagugttgggcugg

SEQ ID NO: 20450 - DNA, 23 bp, Artificial Sequence
  Synthetic
ctccttcuctggaaagaauggca

SEQ ID NO: 20451 - DNA, 24 bp, Artificial Sequence
  Synthetic
cttagagaaggccutggcaaucat

SEQ ID NO: 20452 - DNA, 18 bp, Artificial Sequence
  Synthetic
ctguggctggtugaggca

SEQ ID NO: 20453 - DNA, 21 bp, Artificial Sequence
  Synthetic
aggcagucgaggaatgguact

SEQ ID NO: 20454 - DNA, 21 bp, Artificial Sequence
  Synthetic
ccuattcacucccgcaccaac

SEQ ID NO: 20455 - DNA, 21 bp, Artificial Sequence
  Synthetic
ggugaggaagaagagcctuga

SEQ ID NO: 20456 - DNA, 29 bp, Artificial Sequence
  Synthetic
agttaattgtuaaatccagtauggccaca

SEQ ID NO: 20457 - DNA, 27 bp, Artificial Sequence
  Synthetic
acattaauagccaacaacacaccauga

SEQ ID NO: 20458 - DNA, 25 bp, Artificial Sequence
  Synthetic
ctgatggcgaaacuaagaacatugg

SEQ ID NO: 20459 - DNA, 24 bp, Artificial Sequence
  Synthetic
gaagggcttucggttttcacuaag

SEQ ID NO: 20460 - DNA, 21 bp, Artificial Sequence
  Synthetic
tccccugcagattguaagcag

SEQ ID NO: 20461 - DNA, 27 bp, Artificial Sequence
  Synthetic
tgatctattagaugagtaaggcgcuca

SEQ ID NO: 20462 - DNA, 22 bp, Artificial Sequence
  Synthetic
tgcactuctagctcugcaacat

SEQ ID NO: 20463 - DNA, 27 bp, Artificial Sequence
  Synthetic
gtaataatcagcauccaccctgcaaua

SEQ ID NO: 20464 - DNA, 25 bp, Artificial Sequence
  Synthetic
cattaacuagggaggttucccagag

SEQ ID NO: 20465 - DNA, 28 bp, Artificial Sequence
  Synthetic
tgaattgttaagaugctgatcucgaagt

SEQ ID NO: 20466 - DNA, 19 bp, Artificial Sequence
  Synthetic
ggcaccggutgtcaaugga

SEQ ID NO: 20467 - DNA, 30 bp, Artificial Sequence
  Synthetic
gttttactggaguttttcagatggatugag

SEQ ID NO: 20468 - DNA, 23 bp, Artificial Sequence
  Synthetic
tgtgccutaaatgactucaggct

SEQ ID NO: 20469 - DNA, 23 bp, Artificial Sequence
  Synthetic
tgttggcagcagauctgttgtua

SEQ ID NO: 20470 - DNA, 28 bp, Artificial Sequence
  Synthetic
cagaagaugctgaattugaacagaagat

SEQ ID NO: 20471 - DNA, 31 bp, Artificial Sequence
  Synthetic
tugacaaataggttttuaaaagaccaagcaa

SEQ ID NO: 20472 - DNA, 25 bp, Artificial Sequence
  Synthetic
actgtgttatgutgtgcctaaugct

SEQ ID NO: 20473 - DNA, 30 bp, Artificial Sequence
  Synthetic
tctcctgaatgucaatcagtttctttctut

SEQ ID NO: 20474 - DNA, 27 bp, Artificial Sequence
  Synthetic
actcttttaggcuacagcaaauccaaa

SEQ ID NO: 20475 - DNA, 20 bp, Artificial Sequence
  Synthetic
cagctagaccutgcctccuc

SEQ ID NO: 20476 - DNA, 22 bp, Artificial Sequence
  Synthetic
gaatattggcccauaggccuga

SEQ ID NO: 20477 - DNA, 28 bp, Artificial Sequence
  Synthetic
cttgtcttggcuaaaggacgataattut

SEQ ID NO: 20478 - DNA, 26 bp, Artificial Sequence
  Synthetic
cctcaaguacacttcataaugcacca

SEQ ID NO: 20479 - DNA, 23 bp, Artificial Sequence
  Synthetic
ggtctugctcttttcucccagaa

SEQ ID NO: 20480 - DNA, 27 bp, Artificial Sequence
  Synthetic
tcagaatatcuctacacccagugaaca

SEQ ID NO: 20481 - DNA, 29 bp, Artificial Sequence
  Synthetic
aagactgtttacaaucagtaccttggtut

SEQ ID NO: 20482 - DNA, 24 bp, Artificial Sequence
  Synthetic
agcagtatgccugatccaguagat

SEQ ID NO: 20483 - DNA, 29 bp, Artificial Sequence
  Synthetic
tgtttttaactctgcutttcagctgagua

SEQ ID NO: 20484 - DNA, 26 bp, Artificial Sequence
  Synthetic
gaagagcctgutcaagcaaaagtaut

SEQ ID NO: 20485 - DNA, 30 bp, Artificial Sequence
  Synthetic
gctgaaaaccuccttatattaaugcaaacc

SEQ ID NO: 20486 - DNA, 30 bp, Artificial Sequence
  Synthetic
ccttccatctgcutttatttttgaatcugt

SEQ ID NO: 20487 - DNA, 27 bp, Artificial Sequence
  Synthetic
acattttctcctutttcatggctcuca

SEQ ID NO: 20488 - DNA, 28 bp, Artificial Sequence
  Synthetic
cacttagatcaagcautagccagaauga

SEQ ID NO: 20489 - DNA, 20 bp, Artificial Sequence
  Synthetic
cugtagtaccugcaccagca

SEQ ID NO: 20490 - DNA, 24 bp, Artificial Sequence
  Synthetic
aggattcacuggcaaaatttgcug

SEQ ID NO: 20491 - DNA, 28 bp, Artificial Sequence
  Synthetic
tgcttctatttuccttttgcatctcugt

SEQ ID NO: 20492 - DNA, 28 bp, Artificial Sequence
  Synthetic
ggtgtatgatggucccaaaaatguaaga

SEQ ID NO: 20493 - DNA, 30 bp, Artificial Sequence
  Synthetic
ccaaactgtuccaataaatgaccuacaaaa

SEQ ID NO: 20494 - DNA, 24 bp, Artificial Sequence
  Synthetic
cttgattgctcutattcaggcgua

SEQ ID NO: 20495 - DNA, 28 bp, Artificial Sequence
  Synthetic
cttccaagatatugaggtaacagggtut

SEQ ID NO: 20496 - DNA, 30 bp, Artificial Sequence
  Synthetic
ggatgactggttuggatctagagtatguat

SEQ ID NO: 20497 - DNA, 28 bp, Artificial Sequence
  Synthetic
tgtcagtttcaguggtaaatctucaact

SEQ ID NO: 20498 - DNA, 33 bp, Artificial Sequence
  Synthetic
acagagaacaatgutaaattctagtaatucgat

SEQ ID NO: 20499 - DNA, 25 bp, Artificial Sequence
  Synthetic
tgtaaggacagagutagaugagcct

SEQ ID NO: 20500 - DNA, 24 bp, Artificial Sequence
  Synthetic
ggatcctgaagaucctgtgttugt

SEQ ID NO: 20501 - DNA, 28 bp, Artificial Sequence
  Synthetic
ccagcattggauttttctcagttgttua

SEQ ID NO: 20502 - DNA, 27 bp, Artificial Sequence
  Synthetic
ggatgaacagugtccatatctatuggg

SEQ ID NO: 20503 - DNA, 26 bp, Artificial Sequence
  Synthetic
gtccttacctuccagtgaactgtuat

SEQ ID NO: 20504 - DNA, 20 bp, Artificial Sequence
  Synthetic
agacgactugcctgcaugag

SEQ ID NO: 20505 - DNA, 27 bp, Artificial Sequence
  Synthetic
agaatguggcaagaactacaauaccaa

SEQ ID NO: 20506 - DNA, 25 bp, Artificial Sequence
  Synthetic
agtcttgttguatgcacttguaggg

SEQ ID NO: 20507 - DNA, 21 bp, Artificial Sequence
  Synthetic
ggaaacguaagcgtggugaaa

SEQ ID NO: 20508 - DNA, 30 bp, Artificial Sequence
  Synthetic
ctggttgacaatauatctatgccactttug

SEQ ID NO: 20509 - DNA, 22 bp, Artificial Sequence
  Synthetic
cagctgccuggaatggatauga

SEQ ID NO: 20510 - DNA, 22 bp, Artificial Sequence
  Synthetic
gtcacaguggcggtaugaaaag

SEQ ID NO: 20511 - DNA, 21 bp, Artificial Sequence
  Synthetic
cttatgucaccccgaauggca

SEQ ID NO: 20512 - DNA, 24 bp, Artificial Sequence
  Synthetic
gttgctgatgcauttgtctctguc

SEQ ID NO: 20513 - DNA, 29 bp, Artificial Sequence
  Synthetic
tgctagcctcuctataatactcacttugt

SEQ ID NO: 20514 - DNA, 24 bp, Artificial Sequence
  Synthetic
catacggagugtggcataacuagg

SEQ ID NO: 20515 - DNA, 22 bp, Artificial Sequence
  Synthetic
caacaucatgcuggagcagaag

SEQ ID NO: 20516 - DNA, 19 bp, Artificial Sequence
  Synthetic
ctggucaggcaccgacuac

SEQ ID NO: 20517 - DNA, 24 bp, Artificial Sequence
  Synthetic
caacaagcucctccaaaucagact

SEQ ID NO: 20518 - DNA, 26 bp, Artificial Sequence
  Synthetic
acccaccaauaaagtaacagtgcaut

SEQ ID NO: 20519 - DNA, 28 bp, Artificial Sequence
  Synthetic
agaaacagtaguccctactcagtgauac

SEQ ID NO: 20520 - DNA, 22 bp, Artificial Sequence
  Synthetic
aggtcattgaugatggctugct

SEQ ID NO: 20521 - DNA, 29 bp, Artificial Sequence
  Synthetic
gtagactggauaaactcttctgtttguca

SEQ ID NO: 20522 - DNA, 21 bp, Artificial Sequence
  Synthetic
ggaacugctgtccugcaagag

SEQ ID NO: 20523 - DNA, 22 bp, Artificial Sequence
  Synthetic
gctgcugaccaccaaatcugat

SEQ ID NO: 20524 - DNA, 25 bp, Artificial Sequence
  Synthetic
caaattgcccauttttaggtcuggt

SEQ ID NO: 20525 - DNA, 23 bp, Artificial Sequence
  Synthetic
gttugcagcaguacaggaaauag

SEQ ID NO: 20526 - DNA, 22 bp, Artificial Sequence
  Synthetic
ccatttgttccuttgggccaut

SEQ ID NO: 20527 - DNA, 23 bp, Artificial Sequence
  Synthetic
tgtgtgtgtgaugaatccggauc

SEQ ID NO: 20528 - DNA, 21 bp, Artificial Sequence
  Synthetic
cccaaggugaacuccaggaat

SEQ ID NO: 20529 - DNA, 24 bp, Artificial Sequence
  Synthetic
aggtgtatucagaagttccaugcg

SEQ ID NO: 20530 - DNA, 29 bp, Artificial Sequence
  Synthetic
tgaaggaaguagcacaggaataaauacac

SEQ ID NO: 20531 - DNA, 25 bp, Artificial Sequence
  Synthetic
tgatucagaagaggagggtuaugat

SEQ ID NO: 20532 - DNA, 21 bp, Artificial Sequence
  Synthetic
cgttgcctuccaggttcacua

SEQ ID NO: 20533 - DNA, 26 bp, Artificial Sequence
  Synthetic
gtgtgaatugtgtttcctugaaaggg

SEQ ID NO: 20534 - DNA, 27 bp, Artificial Sequence
  Synthetic
cagtcctctuaccttgttctttgauct

SEQ ID NO: 20535 - DNA, 28 bp, Artificial Sequence
  Synthetic
agaactugcagagttgattttugcaaat

SEQ ID NO: 20536 - DNA, 27 bp, Artificial Sequence
  Synthetic
ctctcaaagguacatgagaaaggugaa

SEQ ID NO: 20537 - DNA, 29 bp, Artificial Sequence
  Synthetic
tcaccactgagcaaaugtttgaaattaug

SEQ ID NO: 20538 - DNA, 26 bp, Artificial Sequence
  Synthetic
ccagatggattuctggaagtagagut

SEQ ID NO: 20539 - DNA, 32 bp, Artificial Sequence
  Synthetic
tctttgttatttctuctctttcttacctaucc

SEQ ID NO: 20540 - DNA, 27 bp, Artificial Sequence
  Synthetic
agttattgtcugagtttgtguccacag

SEQ ID NO: 20541 - DNA, 27 bp, Artificial Sequence
  Synthetic
gcaaatcagcaagaauagaaacgtcut

SEQ ID NO: 20542 - DNA, 22 bp, Artificial Sequence
  Synthetic
gcttgtttugcaggactcctut

SEQ ID NO: 20543 - DNA, 30 bp, Artificial Sequence
  Synthetic
tttaccttgcautcttttctttttcuacag

SEQ ID NO: 20544 - DNA, 30 bp, Artificial Sequence
  Synthetic
aaataatgcttcaautacctgtacugggat

SEQ ID NO: 20545 - DNA, 32 bp, Artificial Sequence
  Synthetic
attttattctaauaggcaaggtuttagaccua

SEQ ID NO: 20546 - DNA, 32 bp, Artificial Sequence
  Synthetic
gcttataacataatuacctgtttggcatucaa

SEQ ID NO: 20547 - DNA, 30 bp, Artificial Sequence
  Synthetic
tatttttacagtttutacccacctctugat

SEQ ID NO: 20548 - DNA, 28 bp, Artificial Sequence
  Synthetic
tcctccaagtugcaatatagcttgatut

SEQ ID NO: 20549 - DNA, 23 bp, Artificial Sequence
  Synthetic
aaaattgccauctctgcaacuct

SEQ ID NO: 20550 - DNA, 22 bp, Artificial Sequence
  Synthetic
gcatgattucggctgaucgact

SEQ ID NO: 20551 - DNA, 27 bp, Artificial Sequence
  Synthetic
ttcgtgtacatgugtatgtgtctauca

SEQ ID NO: 20552 - DNA, 19 bp, Artificial Sequence
  Synthetic
tgctggtggugtgtccauc

SEQ ID NO: 20553 - DNA, 22 bp, Artificial Sequence
  Synthetic
gcccgatacugtggctcattut

SEQ ID NO: 20554 - DNA, 20 bp, Artificial Sequence
  Synthetic
gcugccagaacacgaaacuc

SEQ ID NO: 20555 - DNA, 24 bp, Artificial Sequence
  Synthetic
tgcttacagtacuctcctcctcuc

SEQ ID NO: 20556 - DNA, 22 bp, Artificial Sequence
  Synthetic
aacctcacuccagttgtttucc

SEQ ID NO: 20557 - DNA, 28 bp, Artificial Sequence
  Synthetic
acgtcaagaagaaaugattgaucacaga

SEQ ID NO: 20558 - DNA, 22 bp, Artificial Sequence
  Synthetic
ggctaatagugcatggtcgcut

SEQ ID NO: 20559 - DNA, 22 bp, Artificial Sequence
  Synthetic
actgaactgugctggtttcuga

SEQ ID NO: 20560 - DNA, 24 bp, Artificial Sequence
  Synthetic
gtgaaatgtcautgccaaacugct

SEQ ID NO: 20561 - DNA, 21 bp, Artificial Sequence
  Synthetic
gcaatgggccutcctcttcut

SEQ ID NO: 20562 - DNA, 22 bp, Artificial Sequence
  Synthetic
gcattguggagtgcttcucagt

SEQ ID NO: 20563 - DNA, 28 bp, Artificial Sequence
  Synthetic
gatgttgaattucttctgttcactugct

SEQ ID NO: 20564 - DNA, 30 bp, Artificial Sequence
  Synthetic
tgaaggaaaggutctccaattatgtucaaa

SEQ ID NO: 20565 - DNA, 20 bp, Artificial Sequence
  Synthetic
gctgccuctctcctcucaac

SEQ ID NO: 20566 - DNA, 24 bp, Artificial Sequence
  Synthetic
gaagaatccugtggagaugcagag

SEQ ID NO: 20567 - DNA, 27 bp, Artificial Sequence
  Synthetic
aatgttgcaagaugagatctgtcatut

SEQ ID NO: 20568 - DNA, 24 bp, Artificial Sequence
  Synthetic
catgatagtauggttggctuggga

SEQ ID NO: 20569 - DNA, 24 bp, Artificial Sequence
  Synthetic
ctatcttugaccagaggcaugaaa

SEQ ID NO: 20570 - DNA, 22 bp, Artificial Sequence
  Synthetic
ggtgttugccgtgcuagaaaaa

SEQ ID NO: 20571 - DNA, 22 bp, Artificial Sequence
  Synthetic
aaauccccacatugcacaaacc

SEQ ID NO: 20572 - DNA, 25 bp, Artificial Sequence
  Synthetic
ctttgacattcgcutctcatgctut

SEQ ID NO: 20573 - DNA, 27 bp, Artificial Sequence
  Synthetic
aaactgactaugcacatcttttccuca

SEQ ID NO: 20574 - DNA, 28 bp, Artificial Sequence
  Synthetic
cacaagacccautaaaacctattccuca

SEQ ID NO: 20575 - DNA, 25 bp, Artificial Sequence
  Synthetic
tttttccatuggattcctucgcaag

SEQ ID NO: 20576 - DNA, 30 bp, Artificial Sequence
  Synthetic
tgacaaaattcaaagaauccacatgactug

SEQ ID NO: 20577 - DNA, 23 bp, Artificial Sequence
  Synthetic
gcattgaggccutggatgaacut

SEQ ID NO: 20578 - DNA, 22 bp, Artificial Sequence
  Synthetic
ccctcaugggacatcatgctut

SEQ ID NO: 20579 - DNA, 26 bp, Artificial Sequence
  Synthetic
gagacaatccuttctctgctauccag

SEQ ID NO: 20580 - DNA, 26 bp, Artificial Sequence
  Synthetic
atccaagacagacaaautgctcucat

SEQ ID NO: 20581 - DNA, 24 bp, Artificial Sequence
  Synthetic
gtacagcuaaagaagcagcttugg

SEQ ID NO: 20582 - DNA, 23 bp, Artificial Sequence
  Synthetic
ggaactgccaucattttcugggt

SEQ ID NO: 20583 - DNA, 24 bp, Artificial Sequence
  Synthetic
ccatgctggauctctgtgaugaaa

SEQ ID NO: 20584 - DNA, 32 bp, Artificial Sequence
  Synthetic
atggacttatgagguatattcaaatagucaca

SEQ ID NO: 20585 - DNA, 25 bp, Artificial Sequence
  Synthetic
caaaattgtctucgggaaacagcua

SEQ ID NO: 20586 - DNA, 21 bp, Artificial Sequence
  Synthetic
ttgaatccuccgccgttctut

SEQ ID NO: 20587 - DNA, 23 bp, Artificial Sequence
  Synthetic
ccgaaaaccagcugtcattgaug

SEQ ID NO: 20588 - DNA, 29 bp, Artificial Sequence
  Synthetic
caacatgttctcaaugttctttcccatut

SEQ ID NO: 20589 - DNA, 23 bp, Artificial Sequence
  Synthetic
gttttctguggctgagcaucaag

SEQ ID NO: 20590 - DNA, 28 bp, Artificial Sequence
  Synthetic
gctgtgttgguttatttggaatctucac

SEQ ID NO: 20591 - DNA, 26 bp, Artificial Sequence
  Synthetic
tgaagattgaugatgaagtucacgct

SEQ ID NO: 20592 - DNA, 24 bp, Artificial Sequence
  Synthetic
cuttctgaaugggaaggaaaggct

SEQ ID NO: 20593 - DNA, 23 bp, Artificial Sequence
  Synthetic
tttgaagttccugggcctaacuc

SEQ ID NO: 20594 - DNA, 29 bp, Artificial Sequence
  Synthetic
tctttgccaggtutccgtttataatagut

SEQ ID NO: 20595 - DNA, 20 bp, Artificial Sequence
  Synthetic
ctcaggtgguggagagtugt

SEQ ID NO: 20596 - DNA, 26 bp, Artificial Sequence
  Synthetic
ggagagattccauggatctttcacut

SEQ ID NO: 20597 - DNA, 23 bp, Artificial Sequence
  Synthetic
ccccuccaaggagaguaagaagg

SEQ ID NO: 20598 - DNA, 24 bp, Artificial Sequence
  Synthetic
accttgcugaacattguaagccat

SEQ ID NO: 20599 - DNA, 24 bp, Artificial Sequence
  Synthetic
gaaaactucctgatggugacacag

SEQ ID NO: 20600 - DNA, 25 bp, Artificial Sequence
  Synthetic
gattgggaaaauttggacuccacag

SEQ ID NO: 20601 - DNA, 24 bp, Artificial Sequence
  Synthetic
ctgauacaggaagagcagauccag

SEQ ID NO: 20602 - DNA, 25 bp, Artificial Sequence
  Synthetic
aggtcccatcucagattctgaauca

SEQ ID NO: 20603 - DNA, 27 bp, Artificial Sequence
  Synthetic
aggataaggaccaagaugctatuacct

SEQ ID NO: 20604 - DNA, 21 bp, Artificial Sequence
  Synthetic
aagcctgccaagugcttctua

SEQ ID NO: 20605 - DNA, 19 bp, Artificial Sequence
  Synthetic
ctgccgccaucatgucaga

SEQ ID NO: 20606 - DNA, 20 bp, Artificial Sequence
  Synthetic
gggtcagugacggtcauagg

SEQ ID NO: 20607 - DNA, 22 bp, Artificial Sequence
  Synthetic
aggacagaaguggaggagacug

SEQ ID NO: 20608 - DNA, 19 bp, Artificial Sequence
  Synthetic
cacactgcucccgatguca

SEQ ID NO: 20609 - DNA, 21 bp, Artificial Sequence
  Synthetic
acgtggagutggcattugact

SEQ ID NO: 20610 - DNA, 30 bp, Artificial Sequence
  Synthetic
tgttttatgcagaautatctgtccauaaga

SEQ ID NO: 20611 - DNA, 19 bp, Artificial Sequence
  Synthetic
caaccagucccagctucca

SEQ ID NO: 20612 - DNA, 22 bp, Artificial Sequence
  Synthetic
gaaagaucaagggaagccucga

SEQ ID NO: 20613 - DNA, 22 bp, Artificial Sequence
  Synthetic
tgtaguccgccagaggatagug

SEQ ID NO: 20614 - DNA, 28 bp, Artificial Sequence
  Synthetic
aggttttgtgaagucgtaagtgtauacc

SEQ ID NO: 20615 - DNA, 23 bp, Artificial Sequence
  Synthetic
tcacgatgaucctgacaatgcuc

SEQ ID NO: 20616 - DNA, 29 bp, Artificial Sequence
  Synthetic
gatcaggattccautctttctctctucaa

SEQ ID NO: 20617 - DNA, 27 bp, Artificial Sequence
  Synthetic
atcttcccaacautgtagaactcagug

SEQ ID NO: 20618 - DNA, 25 bp, Artificial Sequence
  Synthetic
acagagatcaagcauggtcaagtut

SEQ ID NO: 20619 - DNA, 31 bp, Artificial Sequence
  Synthetic
ctaagcttccaaauctactacaacttcauct

SEQ ID NO: 20620 - DNA, 24 bp, Artificial Sequence
  Synthetic
gcattcacugacacagccuaaagt

SEQ ID NO: 20621 - DNA, 30 bp, Artificial Sequence
  Synthetic
tttttggagtcaaaguacattgccaataug

SEQ ID NO: 20622 - DNA, 17 bp, Artificial Sequence
  Synthetic
caggccguggtcaguct

SEQ ID NO: 20623 - DNA, 18 bp, Artificial Sequence
  Synthetic
ggctacugccagcccauc

SEQ ID NO: 20624 - DNA, 19 bp, Artificial Sequence
  Synthetic
cacuaccacggugggaaga

SEQ ID NO: 20625 - DNA, 19 bp, Artificial Sequence
  Synthetic
ggagctucggcacuacgag

SEQ ID NO: 20626 - DNA, 19 bp, Artificial Sequence
  Synthetic
cccggcccaaucacaauga

SEQ ID NO: 20627 - DNA, 18 bp, Artificial Sequence
  Synthetic
gcutgcccuggagcacat

SEQ ID NO: 20628 - DNA, 26 bp, Artificial Sequence
  Synthetic
ccacaaagccccutataatacacuca

SEQ ID NO: 20629 - DNA, 18 bp, Artificial Sequence
  Synthetic
cccaacggcuacccctuc

SEQ ID NO: 20630 - DNA, 19 bp, Artificial Sequence
  Synthetic
acccattcuggtcggtgug

SEQ ID NO: 20631 - DNA, 24 bp, Artificial Sequence
  Synthetic
gcctctgttcutcccgtttttgua

SEQ ID NO: 20632 - DNA, 27 bp, Artificial Sequence
  Synthetic
ccaacatgacauacttcacgttacuga

SEQ ID NO: 20633 - DNA, 22 bp, Artificial Sequence
  Synthetic
ggacautgtaccucgggaaacc

SEQ ID NO: 20634 - DNA, 19 bp, Artificial Sequence
  Synthetic
ctgagggugtcctgtguca

SEQ ID NO: 20635 - DNA, 19 bp, Artificial Sequence
  Synthetic
gcuttgcccaugaaacgca

SEQ ID NO: 20636 - DNA, 19 bp, Artificial Sequence
  Synthetic
ggaagtcagugccccgtuc

SEQ ID NO: 20637 - DNA, 21 bp, Artificial Sequence
  Synthetic
acgtccaucagcaatgucaca

SEQ ID NO: 20638 - DNA, 24 bp, Artificial Sequence
  Synthetic
gaaautccgatcaaugagcacagg

SEQ ID NO: 20639 - DNA, 21 bp, Artificial Sequence
  Synthetic
cttttgttctgugcccccaut

SEQ ID NO: 20640 - DNA, 21 bp, Artificial Sequence
  Synthetic
gctttgtccucgttccagtug

SEQ ID NO: 20641 - DNA, 22 bp, Artificial Sequence
  Synthetic
gtggaaacugcttccugggaat

SEQ ID NO: 20642 - DNA, 23 bp, Artificial Sequence
  Synthetic
ccatgtaaccaugaccaaccuca

SEQ ID NO: 20643 - DNA, 22 bp, Artificial Sequence
  Synthetic
ggctctttucatggtctcguct

SEQ ID NO: 20644 - DNA, 21 bp, Artificial Sequence
  Synthetic
cgccttaccugctgctcatua

SEQ ID NO: 20645 - DNA, 28 bp, Artificial Sequence
  Synthetic
tcaactcatgauacagaccccuaaagaa

SEQ ID NO: 20646 - DNA, 17 bp, Artificial Sequence
  Synthetic
ctccgcucctccgtcut

SEQ ID NO: 20647 - DNA, 24 bp, Artificial Sequence
  Synthetic
gggtttttacacuttccgttccut

SEQ ID NO: 20648 - DNA, 24 bp, Artificial Sequence
  Synthetic
gugtctatgcuaccagaaggagga

SEQ ID NO: 20649 - DNA, 21 bp, Artificial Sequence
  Synthetic
gctauattgggctuggacgca

SEQ ID NO: 20650 - DNA, 19 bp, Artificial Sequence
  Synthetic
aucaccagcagcagcauca

SEQ ID NO: 20651 - DNA, 19 bp, Artificial Sequence
  Synthetic
agtgccucgtcccauaacg

SEQ ID NO: 20652 - DNA, 21 bp, Artificial Sequence
  Synthetic
cttcccgcucttccactucaa

SEQ ID NO: 20653 - DNA, 19 bp, Artificial Sequence
  Synthetic
cgtacggguggctcucaag

SEQ ID NO: 20654 - DNA, 23 bp, Artificial Sequence
  Synthetic
gtcaggucctacctcttuccaga

SEQ ID NO: 20655 - DNA, 25 bp, Artificial Sequence
  Synthetic
ctgagacacutctgaaaucgacagt

SEQ ID NO: 20656 - DNA, 22 bp, Artificial Sequence
  Synthetic
ctgcatgaugaatgcccttguc

SEQ ID NO: 20657 - DNA, 29 bp, Artificial Sequence
  Synthetic
ccagacacaaaaucattcaatcaactcut

SEQ ID NO: 20658 - DNA, 23 bp, Artificial Sequence
  Synthetic
gtctgtgtgccugtgtgtcauaa

SEQ ID NO: 20659 - DNA, 22 bp, Artificial Sequence
  Synthetic
aaauccacgaaggcacugaagt

SEQ ID NO: 20660 - DNA, 21 bp, Artificial Sequence
  Synthetic
ccagcgcaucttctaccugaa

SEQ ID NO: 20661 - DNA, 22 bp, Artificial Sequence
  Synthetic
aacctatcccuttgctgcguag

SEQ ID NO: 20662 - DNA, 28 bp, Artificial Sequence
  Synthetic
ggtatatcaacttcutggtcaaggtcut

SEQ ID NO: 20663 - DNA, 21 bp, Artificial Sequence
  Synthetic
gctuggaccaggugaaggaac

SEQ ID NO: 20664 - DNA, 26 bp, Artificial Sequence
  Synthetic
ccactgtcaugtaaatatccctucca

SEQ ID NO: 20665 - DNA, 20 bp, Artificial Sequence
  Synthetic
gtggagacuggcgttuaggg

SEQ ID NO: 20666 - DNA, 24 bp, Artificial Sequence
  Synthetic
gctgacctguaattttctggccua

SEQ ID NO: 20667 - DNA, 28 bp, Artificial Sequence
  Synthetic
acaguggcaaacaagattaagtuagaga

SEQ ID NO: 20668 - DNA, 24 bp, Artificial Sequence
  Synthetic
ccataugaaagcaagtcucagcat

SEQ ID NO: 20669 - DNA, 22 bp, Artificial Sequence
  Synthetic
ctcccagggacuggagaaaaut

SEQ ID NO: 20670 - DNA, 29 bp, Artificial Sequence
  Synthetic
ttttgttgtacugaaattgggtctacuga

SEQ ID NO: 20671 - DNA, 20 bp, Artificial Sequence
  Synthetic
gcagacucgagcgttcctug

SEQ ID NO: 20672 - DNA, 21 bp, Artificial Sequence
  Synthetic
caatccaucacctggcctuga

SEQ ID NO: 20673 - DNA, 26 bp, Artificial Sequence
  Synthetic
caaggaaatcugcttagggttcucat

SEQ ID NO: 20674 - DNA, 27 bp, Artificial Sequence
  Synthetic
ttggtttgcuccattttcttgtttuca

SEQ ID NO: 20675 - DNA, 28 bp, Artificial Sequence
  Synthetic
gtgggcaacutaagaaaaattcugaagt

SEQ ID NO: 20676 - DNA, 23 bp, Artificial Sequence
  Synthetic
ctgtggattgguacctacgtcut

SEQ ID NO: 20677 - DNA, 23 bp, Artificial Sequence
  Synthetic
ccttgaaaucaaagccuccagct

SEQ ID NO: 20678 - DNA, 25 bp, Artificial Sequence
  Synthetic
auttgaacaatgtuaggaggaacca

SEQ ID NO: 20679 - DNA, 22 bp, Artificial Sequence
  Synthetic
acaggcaatucagctcgacuag

SEQ ID NO: 20680 - DNA, 28 bp, Artificial Sequence
  Synthetic
cacttgctttcuattatgtgaaccucca

SEQ ID NO: 20681 - DNA, 21 bp, Artificial Sequence
  Synthetic
gugatgaagguggcagagagg

SEQ ID NO: 20682 - DNA, 23 bp, Artificial Sequence
  Synthetic
ttttaagccuacccuggaaagca

SEQ ID NO: 20683 - DNA, 28 bp, Artificial Sequence
  Synthetic
acatccaatatutctacccaacucacag

SEQ ID NO: 20684 - DNA, 25 bp, Artificial Sequence
  Synthetic
acttcttttucaagcaggacgauct

SEQ ID NO: 20685 - DNA, 28 bp, Artificial Sequence
  Synthetic
cacaaacatugcaagctgaattuaaaca

SEQ ID NO: 20686 - DNA, 28 bp, Artificial Sequence
  Synthetic
caaacagaaagauttggacguaacaact

SEQ ID NO: 20687 - DNA, 26 bp, Artificial Sequence
  Synthetic
gcagataaccagagucacgatttcut

SEQ ID NO: 20688 - DNA, 28 bp, Artificial Sequence
  Synthetic
tttactgggagautcctttactugaacc

SEQ ID NO: 20689 - DNA, 22 bp, Artificial Sequence
  Synthetic
caggtgatucagcctcttccuc

SEQ ID NO: 20690 - DNA, 23 bp, Artificial Sequence
  Synthetic
gatttctugcagccaaactgucc

SEQ ID NO: 20691 - DNA, 22 bp, Artificial Sequence
  Synthetic
ccccaccacacccuatcacuat

SEQ ID NO: 20692 - DNA, 22 bp, Artificial Sequence
  Synthetic
tgttctcucacccacucacact

SEQ ID NO: 20693 - DNA, 21 bp, Artificial Sequence
  Synthetic
ggaaggacuaggtgcaccaug

SEQ ID NO: 20694 - DNA, 29 bp, Artificial Sequence
  Synthetic
aacataaacatttugcttgcattctgtua

SEQ ID NO: 20695 - DNA, 26 bp, Artificial Sequence
  Synthetic
tggagtgcutctttcactttucaaga

SEQ ID NO: 20696 - DNA, 26 bp, Artificial Sequence
  Synthetic
gtcaucttttgctaaauccaacccat

SEQ ID NO: 20697 - DNA, 22 bp, Artificial Sequence
  Synthetic
gatgtgattccugagggaggug

SEQ ID NO: 20698 - DNA, 25 bp, Artificial Sequence
  Synthetic
caaccaauaaggcttcauccacaag

SEQ ID NO: 20699 - DNA, 20 bp, Artificial Sequence
  Synthetic
ctgctgguggtgctacugag

SEQ ID NO: 20700 - DNA, 22 bp, Artificial Sequence
  Synthetic
acttcaucagctttgccugaga

SEQ ID NO: 20701 - DNA, 23 bp, Artificial Sequence
  Synthetic
ctgggcaagaacaggutctttut

SEQ ID NO: 20702 - DNA, 22 bp, Artificial Sequence
  Synthetic
acatcaaguacccccauagcct

SEQ ID NO: 20703 - DNA, 21 bp, Artificial Sequence
  Synthetic
gtgttgttggugagctggtug

SEQ ID NO: 20704 - DNA, 23 bp, Artificial Sequence
  Synthetic
gtgctgcaagugtcttttcctuc

SEQ ID NO: 20705 - DNA, 22 bp, Artificial Sequence
  Synthetic
gtgtugggagaagactguccaa

SEQ ID NO: 20706 - DNA, 25 bp, Artificial Sequence
  Synthetic
gatgacctctcaucctatcttgcut

SEQ ID NO: 20707 - DNA, 22 bp, Artificial Sequence
  Synthetic
gctgaaugggtttttgtuggct

SEQ ID NO: 20708 - DNA, 26 bp, Artificial Sequence
  Synthetic
cctatttctgttugtttgcctctgut

SEQ ID NO: 20709 - DNA, 20 bp, Artificial Sequence
  Synthetic
cccagagggcutguaaaggc

SEQ ID NO: 20710 - DNA, 21 bp, Artificial Sequence
  Synthetic
gggaccaccuttgtcttucga

SEQ ID NO: 20711 - DNA, 28 bp, Artificial Sequence
  Synthetic
cacacactuccaaccttatttaatgcut

SEQ ID NO: 20712 - DNA, 23 bp, Artificial Sequence
  Synthetic
gtttactugaaggccuccggaat

SEQ ID NO: 20713 - DNA, 19 bp, Artificial Sequence
  Synthetic
ctgagtccccugaccagug

SEQ ID NO: 20714 - DNA, 17 bp, Artificial Sequence
  Synthetic
ccagtggcugcacguct

SEQ ID NO: 20715 - DNA, 19 bp, Artificial Sequence
  Synthetic
ccugcagccagcaaacauc

SEQ ID NO: 20716 - DNA, 18 bp, Artificial Sequence
  Synthetic
ggccuaccatgccaugct

SEQ ID NO: 20717 - DNA, 20 bp, Artificial Sequence
  Synthetic
ggcccugaatttcactgugg

SEQ ID NO: 20718 - DNA, 20 bp, Artificial Sequence
  Synthetic
gtctgacagguagccauggg

SEQ ID NO: 20719 - DNA, 18 bp, Artificial Sequence
  Synthetic
ccuggcctguggaagcaa

SEQ ID NO: 20720 - DNA, 19 bp, Artificial Sequence
  Synthetic
tgatgucccggtuggcaaa

SEQ ID NO: 20721 - DNA, 21 bp, Artificial Sequence
  Synthetic
gcttccuctggtgauggaacc

SEQ ID NO: 20722 - DNA, 17 bp, Artificial Sequence
  Synthetic
cucccagggccacguaa

SEQ ID NO: 20723 - DNA, 20 bp, Artificial Sequence
  Synthetic
gcagaugccaacauccagga

SEQ ID NO: 20724 - DNA, 17 bp, Artificial Sequence
  Synthetic
ggctgcuggcaccctua

SEQ ID NO: 20725 - DNA, 18 bp, Artificial Sequence
  Synthetic
caguggacucagcagcac

SEQ ID NO: 20726 - DNA, 17 bp, Artificial Sequence
  Synthetic
ggcguccgctcactuga

SEQ ID NO: 20727 - DNA, 23 bp, Artificial Sequence
  Synthetic
cctttgtgctuctgttcttcgug

SEQ ID NO: 20728 - DNA, 17 bp, Artificial Sequence
  Synthetic
agcgaggccutcaccug

SEQ ID NO: 20729 - DNA, 20 bp, Artificial Sequence
  Synthetic
cacaccaacguggtctucaa

SEQ ID NO: 20730 - DNA, 18 bp, Artificial Sequence
  Synthetic
ctgtcacaguggccguca

SEQ ID NO: 20731 - DNA, 17 bp, Artificial Sequence
  Synthetic
cagccugcagugcaaca

SEQ ID NO: 20732 - DNA, 18 bp, Artificial Sequence
  Synthetic
cgggaacuggcatucggg

SEQ ID NO: 20733 - DNA, 19 bp, Artificial Sequence
  Synthetic
accgtccugtcttcccuct

SEQ ID NO: 20734 - DNA, 17 bp, Artificial Sequence
  Synthetic
caggugcagctguagcc

SEQ ID NO: 20735 - DNA, 19 bp, Artificial Sequence
  Synthetic
gctugggccacugacgaaa

SEQ ID NO: 20736 - DNA, 18 bp, Artificial Sequence
  Synthetic
gtgagcacucguccacca

SEQ ID NO: 20737 - DNA, 19 bp, Artificial Sequence
  Synthetic
ctgggccucacctgtcuac

SEQ ID NO: 20738 - DNA, 21 bp, Artificial Sequence
  Synthetic
agtcgcacucattgacaucgt

SEQ ID NO: 20739 - DNA, 17 bp, Artificial Sequence
  Synthetic
cccaccaaugcccucca

SEQ ID NO: 20740 - DNA, 17 bp, Artificial Sequence
  Synthetic
ccggcagucgtcgaugt

SEQ ID NO: 20741 - DNA, 21 bp, Artificial Sequence
  Synthetic
catcaacgagugcgttcugag

SEQ ID NO: 20742 - DNA, 20 bp, Artificial Sequence
  Synthetic
agcaggcagutgcacttgua

SEQ ID NO: 20743 - DNA, 18 bp, Artificial Sequence
  Synthetic
gtgcuggacaugccgagt

SEQ ID NO: 20744 - DNA, 19 bp, Artificial Sequence
  Synthetic
gaccucagacaggcaggug

SEQ ID NO: 20745 - DNA, 18 bp, Artificial Sequence
  Synthetic
ccugccctuagggagcat

SEQ ID NO: 20746 - DNA, 17 bp, Artificial Sequence
  Synthetic
gcaggugaagguggcga

SEQ ID NO: 20747 - DNA, 19 bp, Artificial Sequence
  Synthetic
caggtcuggtcatgggugt

SEQ ID NO: 20748 - DNA, 19 bp, Artificial Sequence
  Synthetic
ggtucgagacgcactcgut

SEQ ID NO: 20749 - DNA, 18 bp, Artificial Sequence
  Synthetic
ccuggagcagcctcucac

SEQ ID NO: 20750 - DNA, 20 bp, Artificial Sequence
  Synthetic
aatgttcucgctgcagucct

SEQ ID NO: 20751 - DNA, 18 bp, Artificial Sequence
  Synthetic
ggccgacagcucctgtuc

SEQ ID NO: 20752 - DNA, 18 bp, Artificial Sequence
  Synthetic
gguaggagccgaccucgt

SEQ ID NO: 20753 - DNA, 21 bp, Artificial Sequence
  Synthetic
cttcgaggccucctacatcug

SEQ ID NO: 20754 - DNA, 20 bp, Artificial Sequence
  Synthetic
catagtcugccacgcctcug

SEQ ID NO: 20755 - DNA, 20 bp, Artificial Sequence
  Synthetic
aactaacugcccuggcacat

SEQ ID NO: 20756 - DNA, 25 bp, Artificial Sequence
  Synthetic
tttgagggatgautcaaaggtggut

SEQ ID NO: 20757 - DNA, 20 bp, Artificial Sequence
  Synthetic
agtccctccgugcatcacua

SEQ ID NO: 20758 - DNA, 22 bp, Artificial Sequence
  Synthetic
ggtgtcatugtggctagtuggt

SEQ ID NO: 20759 - DNA, 31 bp, Artificial Sequence
  Synthetic
caagagucaaaagttaaaauacgcaaaaagg

SEQ ID NO: 20760 - DNA, 26 bp, Artificial Sequence
  Synthetic
gctcatgctagutcagcaaatatugg

SEQ ID NO: 20761 - DNA, 29 bp, Artificial Sequence
  Synthetic
aaaacccaaaggaaguataagccaaguaa

SEQ ID NO: 20762 - DNA, 24 bp, Artificial Sequence
  Synthetic
aaaactggcucctcaagagugaaa

SEQ ID NO: 20763 - DNA, 24 bp, Artificial Sequence
  Synthetic
gggagtcacuagccaatctgauag

SEQ ID NO: 20764 - DNA, 21 bp, Artificial Sequence
  Synthetic
tggcttguccagaaccaucag

SEQ ID NO: 20765 - DNA, 27 bp, Artificial Sequence
  Synthetic
gcatcccattttuatcctttccttcut

SEQ ID NO: 20766 - DNA, 21 bp, Artificial Sequence
  Synthetic
gccccaugaatacttccuggt

SEQ ID NO: 20767 - DNA, 27 bp, Artificial Sequence
  Synthetic
ccagtgctattutgatgtttatgcuca

SEQ ID NO: 20768 - DNA, 26 bp, Artificial Sequence
  Synthetic
gtatacctgtautgggaaatgagucg

SEQ ID NO: 20769 - DNA, 22 bp, Artificial Sequence
  Synthetic
agaaaggcugctcaactctugt

SEQ ID NO: 20770 - DNA, 20 bp, Artificial Sequence
  Synthetic
cuatgtctcgaucccgccat

SEQ ID NO: 20771 - DNA, 23 bp, Artificial Sequence
  Synthetic
ccagggctuaaagtcttgacuga

SEQ ID NO: 20772 - DNA, 24 bp, Artificial Sequence
  Synthetic
gccaaauccaaaaaggttccacut

SEQ ID NO: 20773 - DNA, 25 bp, Artificial Sequence
  Synthetic
tctataucaggaaggacttgggugt

SEQ ID NO: 20774 - DNA, 21 bp, Artificial Sequence
  Synthetic
acagtgtgugctcctttuccc

SEQ ID NO: 20775 - DNA, 28 bp, Artificial Sequence
  Synthetic
tgggatccagguaagaatcagataacut

SEQ ID NO: 20776 - DNA, 23 bp, Artificial Sequence
  Synthetic
acatcaatgggaacutcctggug

SEQ ID NO: 20777 - DNA, 25 bp, Artificial Sequence
  Synthetic
ctcccactcauaccaagagtttcut

SEQ ID NO: 20778 - DNA, 28 bp, Artificial Sequence
  Synthetic
caatgtagaaaaugagaagcaggtucat

SEQ ID NO: 20779 - DNA, 23 bp, Artificial Sequence
  Synthetic
ctctgtcugatttgcuaggacca

SEQ ID NO: 20780 - DNA, 26 bp, Artificial Sequence
  Synthetic
ttacaggcagauttugacaacaaacc

SEQ ID NO: 20781 - DNA, 23 bp, Artificial Sequence
  Synthetic
tgcctgtcaugctgtcttcatut

SEQ ID NO: 20782 - DNA, 27 bp, Artificial Sequence
  Synthetic
gtacactguttaccagcugaaacaaat

SEQ ID NO: 20783 - DNA, 28 bp, Artificial Sequence
  Synthetic
gatcacaacucatatcaguagcaacaga

SEQ ID NO: 20784 - DNA, 26 bp, Artificial Sequence
  Synthetic
ggagattaacatuggagcaagtggua

SEQ ID NO: 20785 - DNA, 27 bp, Artificial Sequence
  Synthetic
cttacagtguagaggatagcttugcag

SEQ ID NO: 20786 - DNA, 27 bp, Artificial Sequence
  Synthetic
caagcatccacaaagucacatgaauat

SEQ ID NO: 20787 - DNA, 21 bp, Artificial Sequence
  Synthetic
tcttgguggcaactgaugcaa

SEQ ID NO: 20788 - DNA, 26 bp, Artificial Sequence
  Synthetic
cagcaaaaauacaaucaggagaaggg

SEQ ID NO: 20789 - DNA, 28 bp, Artificial Sequence
  Synthetic
tgataacttacaacugtgggcttcttut

SEQ ID NO: 20790 - DNA, 23 bp, Artificial Sequence
  Synthetic
aaggtgaaggutgaaccatugga

SEQ ID NO: 20791 - DNA, 21 bp, Artificial Sequence
  Synthetic
gcacacuggttagguggagag

SEQ ID NO: 20792 - DNA, 28 bp, Artificial Sequence
  Synthetic
gccatgaactuctttactaacccuacaa

SEQ ID NO: 20793 - DNA, 28 bp, Artificial Sequence
  Synthetic
tcagtcatgatugaggtaatttgugcag

SEQ ID NO: 20794 - DNA, 25 bp, Artificial Sequence
  Synthetic
ccattgcatucaaatttggcauact

SEQ ID NO: 20795 - DNA, 21 bp, Artificial Sequence
  Synthetic
catcacagcagutggacagug

SEQ ID NO: 20796 - DNA, 26 bp, Artificial Sequence
  Synthetic
tcaaggaattgauccagagacttgug

SEQ ID NO: 20797 - DNA, 21 bp, Artificial Sequence
  Synthetic
acatguaagggagagctugga

SEQ ID NO: 20798 - DNA, 21 bp, Artificial Sequence
  Synthetic
aatgaatgugcacgacccgua

SEQ ID NO: 20799 - DNA, 22 bp, Artificial Sequence
  Synthetic
ttggagccaaacucatctgugt

SEQ ID NO: 20800 - DNA, 23 bp, Artificial Sequence
  Synthetic
aaaggcaaccccuaccaaaagua

SEQ ID NO: 20801 - DNA, 28 bp, Artificial Sequence
  Synthetic
tcagcgaataagutttagtgttgtcuga

SEQ ID NO: 20802 - DNA, 24 bp, Artificial Sequence
  Synthetic
gatggagccccucattaattcuga

SEQ ID NO: 20803 - DNA, 25 bp, Artificial Sequence
  Synthetic
agaatgctgcucatcttcttccaut

SEQ ID NO: 20804 - DNA, 23 bp, Artificial Sequence
  Synthetic
agccccaacauggttttgaacua

SEQ ID NO: 20805 - DNA, 29 bp, Artificial Sequence
  Synthetic
ggttcaattcattuacttcagaggacugt

SEQ ID NO: 20806 - DNA, 25 bp, Artificial Sequence
  Synthetic
acaagcttgguctaatgggaauacg

SEQ ID NO: 20807 - DNA, 23 bp, Artificial Sequence
  Synthetic
actatgucccccaaatgcttcug

SEQ ID NO: 20808 - DNA, 18 bp, Artificial Sequence
  Synthetic
tccguggcagugaaccag

SEQ ID NO: 20809 - DNA, 18 bp, Artificial Sequence
  Synthetic
ccgagacccaugccagug

SEQ ID NO: 20810 - DNA, 18 bp, Artificial Sequence
  Synthetic
gctcccgguaggttuggt

SEQ ID NO: 20811 - DNA, 19 bp, Artificial Sequence
  Synthetic
gcucacggacaacgaggug

SEQ ID NO: 20812 - DNA, 21 bp, Artificial Sequence
  Synthetic
ccccagcuctcacctguagaa

SEQ ID NO: 20813 - DNA, 20 bp, Artificial Sequence
  Synthetic
ctggacgugactccuaagcc

SEQ ID NO: 20814 - DNA, 18 bp, Artificial Sequence
  Synthetic
aggcacgaacutguggct

SEQ ID NO: 20815 - DNA, 18 bp, Artificial Sequence
  Synthetic
ccctccacccauggctuc

SEQ ID NO: 20816 - DNA, 17 bp, Artificial Sequence
  Synthetic
gaccaggguggcugcat

SEQ ID NO: 20817 - DNA, 21 bp, Artificial Sequence
  Synthetic
ccgggaccuccagtaccauag

SEQ ID NO: 20818 - DNA, 19 bp, Artificial Sequence
  Synthetic
tggcagguaacggcttgut

SEQ ID NO: 20819 - DNA, 19 bp, Artificial Sequence
  Synthetic
gagutgugcacgcacagag

SEQ ID NO: 20820 - DNA, 21 bp, Artificial Sequence
  Synthetic
cccacccccauttagatcuga

SEQ ID NO: 20821 - DNA, 22 bp, Artificial Sequence
  Synthetic
ctgggttguagcaactcuccat

SEQ ID NO: 20822 - DNA, 23 bp, Artificial Sequence
  Synthetic
cacaatgcuactatgccctugga

SEQ ID NO: 20823 - DNA, 19 bp, Artificial Sequence
  Synthetic
gcugtccactuagcccacc

SEQ ID NO: 20824 - DNA, 27 bp, Artificial Sequence
  Synthetic
cctgcatgugactaagaagaacaugat

SEQ ID NO: 20825 - DNA, 21 bp, Artificial Sequence
  Synthetic
cctcccugctccttccaugag

SEQ ID NO: 20826 - DNA, 23 bp, Artificial Sequence
  Synthetic
gccagggaagcuctaggguaaat

SEQ ID NO: 20827 - DNA, 21 bp, Artificial Sequence
  Synthetic
tgugggagagaaguccccaaa

SEQ ID NO: 20828 - DNA, 25 bp, Artificial Sequence
  Synthetic
gacacaataacugggctcaatcuca

SEQ ID NO: 20829 - DNA, 19 bp, Artificial Sequence
  Synthetic
ctcctccagcucctccgua

SEQ ID NO: 20830 - DNA, 20 bp, Artificial Sequence
  Synthetic
gagatgcugcagcgagguat

SEQ ID NO: 20831 - DNA, 17 bp, Artificial Sequence
  Synthetic
cggugacgccgtagucg

SEQ ID NO: 20832 - DNA, 20 bp, Artificial Sequence
  Synthetic
ctggcucaccctgcttucat

SEQ ID NO: 20833 - DNA, 20 bp, Artificial Sequence
  Synthetic
gccagatgcauggctgaguc

SEQ ID NO: 20834 - DNA, 20 bp, Artificial Sequence
  Synthetic
ggaccaugctgtggtgucaa

SEQ ID NO: 20835 - DNA, 19 bp, Artificial Sequence
  Synthetic
ccctgagggugagacugac

SEQ ID NO: 20836 - DNA, 23 bp, Artificial Sequence
  Synthetic
tgtctgtatgugtgtcccccuaa

SEQ ID NO: 20837 - DNA, 20 bp, Artificial Sequence
  Synthetic
gaggttguctgtcgguacgt

SEQ ID NO: 20838 - DNA, 17 bp, Artificial Sequence
  Synthetic
ccagccucaggugcact

SEQ ID NO: 20839 - DNA, 28 bp, Artificial Sequence
  Synthetic
atgagaatccttuatttgtcccaacuga

SEQ ID NO: 20840 - DNA, 17 bp, Artificial Sequence
  Synthetic
ggutggguggcccagac

SEQ ID NO: 20841 - DNA, 27 bp, Artificial Sequence
  Synthetic
ggataaagaacagguggcatatacuca

SEQ ID NO: 20842 - DNA, 25 bp, Artificial Sequence
  Synthetic
acagtgagucaagaatucagcacat

SEQ ID NO: 20843 - DNA, 20 bp, Artificial Sequence
  Synthetic
tucccacaggaaggctugag

SEQ ID NO: 20844 - DNA, 21 bp, Artificial Sequence
  Synthetic
ccaacctgaguggtgtcagug

SEQ ID NO: 20845 - DNA, 20 bp, Artificial Sequence
  Synthetic
aggaggaaggcugguggaat

SEQ ID NO: 20846 - DNA, 21 bp, Artificial Sequence
  Synthetic
ccagctccucactgtcuccat

SEQ ID NO: 20847 - DNA, 21 bp, Artificial Sequence
  Synthetic
ggatgcucctcaguggcaaag

SEQ ID NO: 20848 - DNA, 25 bp, Artificial Sequence
  Synthetic
ctgaaaagaagcugaaggtcuccat

SEQ ID NO: 20849 - DNA, 24 bp, Artificial Sequence
  Synthetic
aactgttacacuggaagtcacugg

SEQ ID NO: 20850 - DNA, 22 bp, Artificial Sequence
  Synthetic
ggaacctcugtgtggtgugaat

SEQ ID NO: 20851 - DNA, 21 bp, Artificial Sequence
  Synthetic
tgaggacuatgccauggacga

SEQ ID NO: 20852 - DNA, 24 bp, Artificial Sequence
  Synthetic
actaaggcctugtgaggtatcuga

SEQ ID NO: 20853 - DNA, 24 bp, Artificial Sequence
  Synthetic
gcagccuaattcaggatugggaaa

SEQ ID NO: 20854 - DNA, 27 bp, Artificial Sequence
  Synthetic
gcttctggguaaggaaagtctcttuag

SEQ ID NO: 20855 - DNA, 22 bp, Artificial Sequence
  Synthetic
ggcagccutctccatgaaugag

SEQ ID NO: 20856 - DNA, 21 bp, Artificial Sequence
  Synthetic
ttttgctccuccgctaucaca

SEQ ID NO: 20857 - DNA, 29 bp, Artificial Sequence
  Synthetic
tggcatctaguaaaactgattaggagcua

SEQ ID NO: 20858 - DNA, 21 bp, Artificial Sequence
  Synthetic
ggagtctgcutggagctgaug

SEQ ID NO: 20859 - DNA, 24 bp, Artificial Sequence
  Synthetic
tgttugacgaagtccauaaaccct

SEQ ID NO: 20860 - DNA, 23 bp, Artificial Sequence
  Synthetic
cctacuagactggugccaggaaa

SEQ ID NO: 20861 - DNA, 26 bp, Artificial Sequence
  Synthetic
ttgctgtcautcatgactaugcagat

SEQ ID NO: 20862 - DNA, 23 bp, Artificial Sequence
  Synthetic
catgagagccautcagctgtuct

SEQ ID NO: 20863 - DNA, 21 bp, Artificial Sequence
  Synthetic
ggtacacguaggcaacuaggc

SEQ ID NO: 20864 - DNA, 26 bp, Artificial Sequence
  Synthetic
agtcugggagaacagatttctugaga

SEQ ID NO: 20865 - DNA, 22 bp, Artificial Sequence
  Synthetic
gccutttgattcugggaagcac

SEQ ID NO: 20866 - DNA, 25 bp, Artificial Sequence
  Synthetic
cggattccatucaaattcactgucc

SEQ ID NO: 20867 - DNA, 22 bp, Artificial Sequence
  Synthetic
gaggaggagcauccgtcuaaaa

SEQ ID NO: 20868 - DNA, 28 bp, Artificial Sequence
  Synthetic
tgggctctttatuaaacaacgagatgut

SEQ ID NO: 20869 - DNA, 29 bp, Artificial Sequence
  Synthetic
tcactatttatgtgutaggtggctttcug

SEQ ID NO: 20870 - DNA, 26 bp, Artificial Sequence
  Synthetic
ctcacacttaccuttccgaccaauag

SEQ ID NO: 20871 - DNA, 29 bp, Artificial Sequence
  Synthetic
cacaggtattattcucactaaggttggut

SEQ ID NO: 20872 - DNA, 33 bp, Artificial Sequence
  Synthetic
tgagactataactcuctactaagaagaacucaa

SEQ ID NO: 20873 - DNA, 28 bp, Artificial Sequence
  Synthetic
ggaagagcatuaagaagttggtttugaa

SEQ ID NO: 20874 - DNA, 25 bp, Artificial Sequence
  Synthetic
agtaggtgtaguaagagccttcugg

SEQ ID NO: 20875 - DNA, 28 bp, Artificial Sequence
  Synthetic
aatgacaaagaugaggattgaaatcugg

SEQ ID NO: 20876 - DNA, 21 bp, Artificial Sequence
  Synthetic
gccctccaaucttaggtuggt

SEQ ID NO: 20877 - DNA, 27 bp, Artificial Sequence
  Synthetic
tttttaagtaacugacctcuggcacaa

SEQ ID NO: 20878 - DNA, 28 bp, Artificial Sequence
  Synthetic
tcaaattacagucaactgcagaaaccua

SEQ ID NO: 20879 - DNA, 22 bp, Artificial Sequence
  Synthetic
cctggaggucttttugggacag

SEQ ID NO: 20880 - DNA, 25 bp, Artificial Sequence
  Synthetic
tcaagtgcutactagtuccaaaggc

SEQ ID NO: 20881 - DNA, 18 bp, Artificial Sequence
  Synthetic
accaggugggagcaggua

SEQ ID NO: 20882 - DNA, 25 bp, Artificial Sequence
  Synthetic
ctgcaaagaaauatacaugcgggaa

SEQ ID NO: 20883 - DNA, 24 bp, Artificial Sequence
  Synthetic
tcttuggaaccacaaauaccacct

SEQ ID NO: 20884 - DNA, 29 bp, Artificial Sequence
  Synthetic
agaaggagggaaaaagutaagtacaucag

SEQ ID NO: 20885 - DNA, 25 bp, Artificial Sequence
  Synthetic
acatctgcauttggttcuagcaaca

SEQ ID NO: 20886 - DNA, 29 bp, Artificial Sequence
  Synthetic
agatgtttgtgguttgttcatttcagaug

SEQ ID NO: 20887 - DNA, 27 bp, Artificial Sequence
  Synthetic
tcaatcatgtccutttgggaatctgut

SEQ ID NO: 20888 - DNA, 23 bp, Artificial Sequence
  Synthetic
cacaugacagaaaagcagcugaa

SEQ ID NO: 20889 - DNA, 26 bp, Artificial Sequence
  Synthetic
tagactcaaaucagcctaaactgucc

SEQ ID NO: 20890 - DNA, 18 bp, Artificial Sequence
  Synthetic
cgggcaggcaucactguc

SEQ ID NO: 20891 - DNA, 24 bp, Artificial Sequence
  Synthetic
tgtctcttucaggcaaagcacuaa

SEQ ID NO: 20892 - DNA, 20 bp, Artificial Sequence
  Synthetic
gtcgcttcauccccctucag

SEQ ID NO: 20893 - DNA, 23 bp, Artificial Sequence
  Synthetic
ccauagtcuaagaaggccaccag

SEQ ID NO: 20894 - DNA, 22 bp, Artificial Sequence
  Synthetic
cctagtgcucaggctagaucag

SEQ ID NO: 20895 - DNA, 18 bp, Artificial Sequence
  Synthetic
gcagcgcaaucgagtgug

SEQ ID NO: 20896 - DNA, 23 bp, Artificial Sequence
  Synthetic
caaagaugccctugagaggaagt

SEQ ID NO: 20897 - DNA, 20 bp, Artificial Sequence
  Synthetic
cctggacucgggtcguaaga

SEQ ID NO: 20898 - DNA, 24 bp, Artificial Sequence
  Synthetic
caggctgucaatactcaaguccag

SEQ ID NO: 20899 - DNA, 21 bp, Artificial Sequence
  Synthetic
ccactgcugccttaggcttut

SEQ ID NO: 20900 - DNA, 22 bp, Artificial Sequence
  Synthetic
tgttttggcuttctccatcugt

SEQ ID NO: 20901 - DNA, 22 bp, Artificial Sequence
  Synthetic
gaatgaacugcaagcccagtug

SEQ ID NO: 20902 - DNA, 21 bp, Artificial Sequence
  Synthetic
gcucctgatcttugggagggt

SEQ ID NO: 20903 - DNA, 20 bp, Artificial Sequence
  Synthetic
ctggaggugatgacugccaa

SEQ ID NO: 20904 - DNA, 17 bp, Artificial Sequence
  Synthetic
ggccugcttgctcugct

SEQ ID NO: 20905 - DNA, 17 bp, Artificial Sequence
  Synthetic
ccugcagcucgagcaca

SEQ ID NO: 20906 - DNA, 22 bp, Artificial Sequence
  Synthetic
agcttcuggctcttctcugact

SEQ ID NO: 20907 - DNA, 25 bp, Artificial Sequence
  Synthetic
gagaggaaaaauagcctcaucagca

SEQ ID NO: 20908 - DNA, 18 bp, Artificial Sequence
  Synthetic
gctgtcagccugctccug

SEQ ID NO: 20909 - DNA, 22 bp, Artificial Sequence
  Synthetic
ctgaaggaacagcuggcuaaga

SEQ ID NO: 20910 - DNA, 20 bp, Artificial Sequence
  Synthetic
cttcuccagggcaaggucag

SEQ ID NO: 20911 - DNA, 19 bp, Artificial Sequence
  Synthetic
gcagagcagaugggcaaug

SEQ ID NO: 20912 - DNA, 22 bp, Artificial Sequence
  Synthetic
ggagctcagcuagttcgttcug

SEQ ID NO: 20913 - DNA, 24 bp, Artificial Sequence
  Synthetic
ccaggaacagcugatgacttugaa

SEQ ID NO: 20914 - DNA, 21 bp, Artificial Sequence
  Synthetic
ctttcgtucccgcttatgcug

SEQ ID NO: 20915 - DNA, 24 bp, Artificial Sequence
  Synthetic
caaagaguccttgaaggucaccaa

SEQ ID NO: 20916 - DNA, 21 bp, Artificial Sequence
  Synthetic
cagccttcuccttctccagug

SEQ ID NO: 20917 - DNA, 21 bp, Artificial Sequence
  Synthetic
gagcagcagutgaaggaggua

SEQ ID NO: 20918 - DNA, 21 bp, Artificial Sequence
  Synthetic
tgaggtuggagatggagcuct

SEQ ID NO: 20919 - DNA, 22 bp, Artificial Sequence
  Synthetic
cucttgcugcaaacaacacaca

SEQ ID NO: 20920 - DNA, 21 bp, Artificial Sequence
  Synthetic
actcagctutgcacatguggt

SEQ ID NO: 20921 - DNA, 21 bp, Artificial Sequence
  Synthetic
cagctacaggaugcccucaat

SEQ ID NO: 20922 - DNA, 21 bp, Artificial Sequence
  Synthetic
aggaaugcagggagagctgua

SEQ ID NO: 20923 - DNA, 22 bp, Artificial Sequence
  Synthetic
acagauagccatgaugcagcag

SEQ ID NO: 20924 - DNA, 28 bp, Artificial Sequence
  Synthetic
ctctagaagtuaggaatgtgaggaaugg

SEQ ID NO: 20925 - DNA, 21 bp, Artificial Sequence
  Synthetic
tgaagagctcuccccaccuag

SEQ ID NO: 20926 - DNA, 22 bp, Artificial Sequence
  Synthetic
cctccccaguctggtatuccat

SEQ ID NO: 20927 - DNA, 26 bp, Artificial Sequence
  Synthetic
tgttttctacgutgttgtcatugcag

SEQ ID NO: 20928 - DNA, 25 bp, Artificial Sequence
  Synthetic
ggaagtaaggautttgctgctugag

SEQ ID NO: 20929 - DNA, 29 bp, Artificial Sequence
  Synthetic
cagttaaatgguaaagaccacaaagcaut

SEQ ID NO: 20930 - DNA, 27 bp, Artificial Sequence
  Synthetic
tgtgaaaacaaguaatagcugaaaggt

SEQ ID NO: 20931 - DNA, 26 bp, Artificial Sequence
  Synthetic
gtaautgttctcccugggaaaaacag

SEQ ID NO: 20932 - DNA, 25 bp, Artificial Sequence
  Synthetic
agcautttauaacacgagacgcagt

SEQ ID NO: 20933 - DNA, 22 bp, Artificial Sequence
  Synthetic
cctcucagaaccagaacctucc

SEQ ID NO: 20934 - DNA, 20 bp, Artificial Sequence
  Synthetic
tggcugtgcaacuggagaag

SEQ ID NO: 20935 - DNA, 29 bp, Artificial Sequence
  Synthetic
gggaatttagtgcautttccattctatug

SEQ ID NO: 20936 - DNA, 25 bp, Artificial Sequence
  Synthetic
tgacataggaugtacagatggguga

SEQ ID NO: 20937 - DNA, 25 bp, Artificial Sequence
  Synthetic
aatgtttttatcugtggtgggugga

SEQ ID NO: 20938 - DNA, 22 bp, Artificial Sequence
  Synthetic
ctctaatgcugcctgctttucc

SEQ ID NO: 20939 - DNA, 23 bp, Artificial Sequence
  Synthetic
gaccatttcaugacctgggtgua

SEQ ID NO: 20940 - DNA, 30 bp, Artificial Sequence
  Synthetic
aggaacttcttauagatgtcaagacctuct

SEQ ID NO: 20941 - DNA, 27 bp, Artificial Sequence
  Synthetic
tcctttagagaccuatttggagctaut

SEQ ID NO: 20942 - DNA, 29 bp, Artificial Sequence
  Synthetic
atgtgaaaaacuagagtctgtgaaaacut

SEQ ID NO: 20943 - DNA, 26 bp, Artificial Sequence
  Synthetic
tcagaatcagauggatgcacttctug

SEQ ID NO: 20944 - DNA, 22 bp, Artificial Sequence
  Synthetic
acctttgtaccugggagctgut

SEQ ID NO: 20945 - DNA, 31 bp, Artificial Sequence
  Synthetic
ggtcttcaaatcuctcattacaactcaucat

SEQ ID NO: 20946 - DNA, 17 bp, Artificial Sequence
  Synthetic
ccggugacactgtgcug

SEQ ID NO: 20947 - DNA, 17 bp, Artificial Sequence
  Synthetic
gggacccuccggctcut

SEQ ID NO: 20948 - DNA, 19 bp, Artificial Sequence
  Synthetic
ggtacugcaggguggaggt

SEQ ID NO: 20949 - DNA, 18 bp, Artificial Sequence
  Synthetic
gggctgcuaaccctcugt

SEQ ID NO: 20950 - DNA, 24 bp, Artificial Sequence
  Synthetic
ggacctgugggaagaaggaaatua

SEQ ID NO: 20951 - DNA, 22 bp, Artificial Sequence
  Synthetic
cattgacccuggtcttctccuc

SEQ ID NO: 20952 - DNA, 22 bp, Artificial Sequence
  Synthetic
cacutacgttttugccagagca

SEQ ID NO: 20953 - DNA, 20 bp, Artificial Sequence
  Synthetic
ccaggaaacagccucagcuc

SEQ ID NO: 20954 - DNA, 27 bp, Artificial Sequence
  Synthetic
gaacatgaaagaugtgtgtttcucaca

SEQ ID NO: 20955 - DNA, 23 bp, Artificial Sequence
  Synthetic
ggautcaaauaagcagccggaag

SEQ ID NO: 20956 - DNA, 19 bp, Artificial Sequence
  Synthetic
ctgttgccaugctguggaa

SEQ ID NO: 20957 - DNA, 28 bp, Artificial Sequence
  Synthetic
atcttgtgatuaagagaagaaggctguc

SEQ ID NO: 20958 - DNA, 29 bp, Artificial Sequence
  Synthetic
agattttcatcuaaatgttggacgtucct

SEQ ID NO: 20959 - DNA, 21 bp, Artificial Sequence
  Synthetic
ctcgatcccaccugctactuc

SEQ ID NO: 20960 - DNA, 20 bp, Artificial Sequence
  Synthetic
caacgtgcagcucctggaua

SEQ ID NO: 20961 - DNA, 24 bp, Artificial Sequence
  Synthetic
tgtttccuccaacaactgcaugat

SEQ ID NO: 20962 - DNA, 23 bp, Artificial Sequence
  Synthetic
tgattctagcuctgtccctucct

SEQ ID NO: 20963 - DNA, 30 bp, Artificial Sequence
  Synthetic
ggactgtttactacaugctggaagtataut

SEQ ID NO: 20964 - DNA, 20 bp, Artificial Sequence
  Synthetic
cgccgaugagggacatcaug

SEQ ID NO: 20965 - DNA, 21 bp, Artificial Sequence
  Synthetic
gcccagccugactttcuacag

SEQ ID NO: 20966 - DNA, 19 bp, Artificial Sequence
  Synthetic
cgcaccugcagcatuaagg

SEQ ID NO: 20967 - DNA, 23 bp, Artificial Sequence
  Synthetic
cccagctugaactcagtctcuaa

SEQ ID NO: 20968 - DNA, 20 bp, Artificial Sequence
  Synthetic
gatggagutggcguagccat

SEQ ID NO: 20969 - DNA, 23 bp, Artificial Sequence
  Synthetic
ctttctgtgggutcctcaacuga

SEQ ID NO: 20970 - DNA, 20 bp, Artificial Sequence
  Synthetic
gaagcugttgtugggcacag

SEQ ID NO: 20971 - DNA, 23 bp, Artificial Sequence
  Synthetic
aatgaccacaugtcaccuccaaa

SEQ ID NO: 20972 - DNA, 20 bp, Artificial Sequence
  Synthetic
cttagcagccuctgctcuga

SEQ ID NO: 20973 - DNA, 18 bp, Artificial Sequence
  Synthetic
ggctggugaatgcuggac

SEQ ID NO: 20974 - DNA, 27 bp, Artificial Sequence
  Synthetic
gcagutactccttugagacaccaaaaa

SEQ ID NO: 20975 - DNA, 28 bp, Artificial Sequence
  Synthetic
tctcctgattugcctgtaagagtttuag

SEQ ID NO: 20976 - DNA, 25 bp, Artificial Sequence
  Synthetic
tgaatgttugagacagcttcaccut

SEQ ID NO: 20977 - DNA, 27 bp, Artificial Sequence
  Synthetic
aatgggttuacagagagttgugaaact

SEQ ID NO: 20978 - DNA, 25 bp, Artificial Sequence
  Synthetic
gactctgtttugctttactgacugg

SEQ ID NO: 20979 - DNA, 25 bp, Artificial Sequence
  Synthetic
tgtatttggaacugtgaacctucat

SEQ ID NO: 20980 - DNA, 27 bp, Artificial Sequence
  Synthetic
caaataccctugttgttcttcguaaca

SEQ ID NO: 20981 - DNA, 20 bp, Artificial Sequence
  Synthetic
tgatucccccggaaccaauc

SEQ ID NO: 20982 - DNA, 25 bp, Artificial Sequence
  Synthetic
ggaatgagaagcauctttgccttut

SEQ ID NO: 20983 - DNA, 23 bp, Artificial Sequence
  Synthetic
tcacctcctauatgcccagaucc

SEQ ID NO: 20984 - DNA, 20 bp, Artificial Sequence
  Synthetic
tcacagcuggaggaguaggt

SEQ ID NO: 20985 - DNA, 19 bp, Artificial Sequence
  Synthetic
cuccaaagaggccuccagt

SEQ ID NO: 20986 - DNA, 20 bp, Artificial Sequence
  Synthetic
ggaaucacagcuggcagagt

SEQ ID NO: 20987 - DNA, 18 bp, Artificial Sequence
  Synthetic
cccagcuaccccatccuc

SEQ ID NO: 20988 - DNA, 20 bp, Artificial Sequence
  Synthetic
tggagtagtugggcctccut

SEQ ID NO: 20989 - DNA, 18 bp, Artificial Sequence
  Synthetic
cagcugcaactccuccct

SEQ ID NO: 20990 - DNA, 19 bp, Artificial Sequence
  Synthetic
ggtagcugggcctccttut

SEQ ID NO: 20991 - DNA, 22 bp, Artificial Sequence
  Synthetic
aaggaggtcuagctaccccauc

SEQ ID NO: 20992 - DNA, 18 bp, Artificial Sequence
  Synthetic
gtgtggaugccccttugg

SEQ ID NO: 20993 - DNA, 17 bp, Artificial Sequence
  Synthetic
ccccagcugcaacucct

SEQ ID NO: 20994 - DNA, 22 bp, Artificial Sequence
  Synthetic
gggtagtgutactccttuggga

SEQ ID NO: 20995 - DNA, 27 bp, Artificial Sequence
  Synthetic
cagagaauagtctttcttuccaaggct

SEQ ID NO: 20996 - DNA, 22 bp, Artificial Sequence
  Synthetic
gcacagacuttgggattucagg

SEQ ID NO: 20997 - DNA, 27 bp, Artificial Sequence
  Synthetic
ctaaaaaccacccagutaaggaaggua

SEQ ID NO: 20998 - DNA, 23 bp, Artificial Sequence
  Synthetic
ttttctttgcuagggtggctuca

SEQ ID NO: 20999 - DNA, 23 bp, Artificial Sequence
  Synthetic
cucaccaucaagaaagacccuac

SEQ ID NO: 21000 - DNA, 25 bp, Artificial Sequence
  Synthetic
gaggagaaacacaaguagctaccuc

SEQ ID NO: 21001 - DNA, 27 bp, Artificial Sequence
  Synthetic
aaaagctctccuaatgccacttaucat

SEQ ID NO: 21002 - DNA, 25 bp, Artificial Sequence
  Synthetic
gcactaggaccugtttgaccuaaaa

SEQ ID NO: 21003 - DNA, 23 bp, Artificial Sequence
  Synthetic
tcaactcaguctcttcctguggt

SEQ ID NO: 21004 - DNA, 24 bp, Artificial Sequence
  Synthetic
gagctgacagagutatcacugacc

SEQ ID NO: 21005 - DNA, 24 bp, Artificial Sequence
  Synthetic
tgatagcuccaactcugaaaggga

SEQ ID NO: 21006 - DNA, 22 bp, Artificial Sequence
  Synthetic
agtgacacucaaggcugaagac

SEQ ID NO: 21007 - DNA, 24 bp, Artificial Sequence
  Synthetic
gtgtttccuaggaggcatgttgua

SEQ ID NO: 21008 - DNA, 26 bp, Artificial Sequence
  Synthetic
ctggtgtaacuctttatttgucccct

SEQ ID NO: 21009 - DNA, 27 bp, Artificial Sequence
  Synthetic
gatgttccaugtaatacuggaccaact

SEQ ID NO: 21010 - DNA, 29 bp, Artificial Sequence
  Synthetic
acatgagagtgcutgaaaacactaatgua

SEQ ID NO: 21011 - DNA, 25 bp, Artificial Sequence
  Synthetic
acccaatgttuccaccataggatuc

SEQ ID NO: 21012 - DNA, 27 bp, Artificial Sequence
  Synthetic
tctttttctgtgacuctttgacacgua

SEQ ID NO: 21013 - DNA, 32 bp, Artificial Sequence
  Synthetic
cagggcaggatguttttatatctatttttgut

SEQ ID NO: 21014 - DNA, 22 bp, Artificial Sequence
  Synthetic
ggtgaatgacutttggcggaug

SEQ ID NO: 21015 - DNA, 30 bp, Artificial Sequence
  Synthetic
atctgacatguctgatacttuaaaaacagt

SEQ ID NO: 21016 - DNA, 21 bp, Artificial Sequence
  Synthetic
ctggaggaggugcaccauaag

SEQ ID NO: 21017 - DNA, 24 bp, Artificial Sequence
  Synthetic
acagttaaagagcuaggagugggt

SEQ ID NO: 21018 - DNA, 25 bp, Artificial Sequence
  Synthetic
cacatgtgcacucttccaaattuca

SEQ ID NO: 21019 - DNA, 31 bp, Artificial Sequence
  Synthetic
ggtaaaaagaattuccttcagcactactuac

SEQ ID NO: 21020 - DNA, 17 bp, Artificial Sequence
  Synthetic
cagagcgcugggcuagg

SEQ ID NO: 21021 - DNA, 17 bp, Artificial Sequence
  Synthetic
gcugcagggccagguat

SEQ ID NO: 21022 - DNA, 19 bp, Artificial Sequence
  Synthetic
gctccagcucgtacaccug

SEQ ID NO: 21023 - DNA, 19 bp, Artificial Sequence
  Synthetic
cgcttacaguctcccgcut

SEQ ID NO: 21024 - DNA, 17 bp, Artificial Sequence
  Synthetic
gccgccgucatgtggua

SEQ ID NO: 21025 - DNA, 21 bp, Artificial Sequence
  Synthetic
tccccuggaggaaagcuacaa

SEQ ID NO: 21026 - DNA, 23 bp, Artificial Sequence
  Synthetic
ccctttggttuggctatgaccuc

SEQ ID NO: 21027 - DNA, 23 bp, Artificial Sequence
  Synthetic
cccagttgutgaaagctcuggaa

SEQ ID NO: 21028 - DNA, 30 bp, Artificial Sequence
  Synthetic
ccttttcactaguttcagtttctgtucaac

SEQ ID NO: 21029 - DNA, 23 bp, Artificial Sequence
  Synthetic
gctgtccttuctctaggcatcut

SEQ ID NO: 21030 - DNA, 23 bp, Artificial Sequence
  Synthetic
acaacgggaautcaatgccaugt

SEQ ID NO: 21031 - DNA, 28 bp, Artificial Sequence
  Synthetic
catttggaaaaugaaggccugaaaaaga

SEQ ID NO: 21032 - DNA, 23 bp, Artificial Sequence
  Synthetic
ccatgatgugcagcttcuccaat

SEQ ID NO: 21033 - DNA, 23 bp, Artificial Sequence
  Synthetic
cauaaccaguagaaaaggctguc

SEQ ID NO: 21034 - DNA, 26 bp, Artificial Sequence
  Synthetic
cgtgaagaugaaacaagaattgucca

SEQ ID NO: 21035 - DNA, 25 bp, Artificial Sequence
  Synthetic
acctcttttucccttccugaaacag

SEQ ID NO: 21036 - DNA, 24 bp, Artificial Sequence
  Synthetic
ccagttcatcuttgagaagguggt

SEQ ID NO: 21037 - DNA, 21 bp, Artificial Sequence
  Synthetic
ctggtaagttuccccagccua

SEQ ID NO: 21038 - DNA, 30 bp, Artificial Sequence
  Synthetic
gctattcattaccgugtgctgtaaattuat

SEQ ID NO: 21039 - DNA, 28 bp, Artificial Sequence
  Synthetic
aacggaaactguaaaacaagaaaaugct

SEQ ID NO: 21040 - DNA, 25 bp, Artificial Sequence
  Synthetic
gctgaggaaugtttcagtgactucc

SEQ ID NO: 21041 - DNA, 25 bp, Artificial Sequence
  Synthetic
gutgtatgaagatgugagccgagaa

SEQ ID NO: 21042 - DNA, 21 bp, Artificial Sequence
  Synthetic
acagagctcguccctgtacut

SEQ ID NO: 21043 - DNA, 22 bp, Artificial Sequence
  Synthetic
tttggaugagccagctacugag

SEQ ID NO: 21044 - DNA, 24 bp, Artificial Sequence
  Synthetic
gtctggagatutctgtgctcauct

SEQ ID NO: 21045 - DNA, 27 bp, Artificial Sequence
  Synthetic
gctggaaagacuagaaatggaacauga

SEQ ID NO: 21046 - DNA, 18 bp, Artificial Sequence
  Synthetic
cacacucctgggugagct

SEQ ID NO: 21047 - DNA, 24 bp, Artificial Sequence
  Synthetic
agaagcccaguttcagtctgatug

SEQ ID NO: 21048 - DNA, 20 bp, Artificial Sequence
  Synthetic
cttcccuctcccgcucaaag

SEQ ID NO: 21049 - DNA, 20 bp, Artificial Sequence
  Synthetic
acatcaugaggccactugca

SEQ ID NO: 21050 - DNA, 25 bp, Artificial Sequence
  Synthetic
tttcatctgtucaatgaccagcuct

SEQ ID NO: 21051 - DNA, 27 bp, Artificial Sequence
  Synthetic
cattccttagutaaactggatguccct

SEQ ID NO: 21052 - DNA, 25 bp, Artificial Sequence
  Synthetic
gcattgctccugttcttttgaguaa

SEQ ID NO: 21053 - DNA, 30 bp, Artificial Sequence
  Synthetic
tgagaatcugacaaacaaactucagagaaa

SEQ ID NO: 21054 - DNA, 18 bp, Artificial Sequence
  Synthetic
gguggtgggugaggagga

SEQ ID NO: 21055 - DNA, 26 bp, Artificial Sequence
  Synthetic
gaucaggtggucagagaaaaagagaa

SEQ ID NO: 21056 - DNA, 25 bp, Artificial Sequence
  Synthetic
ttcaacccttcuccagtttgtcaut

SEQ ID NO: 21057 - DNA, 20 bp, Artificial Sequence
  Synthetic
ggatgatgggaugggccaug

SEQ ID NO: 21058 - DNA, 27 bp, Artificial Sequence
  Synthetic
gcatgtggucaactacactttuaccat

SEQ ID NO: 21059 - DNA, 26 bp, Artificial Sequence
  Synthetic
actgcaagaaguttgtgaagattugg

SEQ ID NO: 21060 - DNA, 23 bp, Artificial Sequence
  Synthetic
gtcactucaggaaactccuccac

SEQ ID NO: 21061 - DNA, 22 bp, Artificial Sequence
  Synthetic
gagtggcagcuaagaacugaga

SEQ ID NO: 21062 - DNA, 31 bp, Artificial Sequence
  Synthetic
ccaggtagctcguattttactaatgaaauct

SEQ ID NO: 21063 - DNA, 20 bp, Artificial Sequence
  Synthetic
catcauggcgaaggcatcut

SEQ ID NO: 21064 - DNA, 22 bp, Artificial Sequence
  Synthetic
gagactagaggcugggtcuaca

SEQ ID NO: 21065 - DNA, 23 bp, Artificial Sequence
  Synthetic
tgttgctaatguggaaccgtgut

SEQ ID NO: 21066 - DNA, 23 bp, Artificial Sequence
  Synthetic
gctcttcauagggcagggtauct

SEQ ID NO: 21067 - DNA, 22 bp, Artificial Sequence
  Synthetic
tgggaggaagcaaauacugcaa

SEQ ID NO: 21068 - DNA, 21 bp, Artificial Sequence
  Synthetic
agatgtggguccatcctcugt

SEQ ID NO: 21069 - DNA, 25 bp, Artificial Sequence
  Synthetic
agaccacatggcuctgatatctgua

SEQ ID NO: 21070 - DNA, 27 bp, Artificial Sequence
  Synthetic
cctgatagaauaaaagaggctcagcua

SEQ ID NO: 21071 - DNA, 24 bp, Artificial Sequence
  Synthetic
ctttacctuggccaaacagttguc

SEQ ID NO: 21072 - DNA, 28 bp, Artificial Sequence
  Synthetic
atattattggaguctgtgcgactuaaga

SEQ ID NO: 21073 - DNA, 24 bp, Artificial Sequence
  Synthetic
actgggaaggaaguccucattaua

SEQ ID NO: 21074 - DNA, 25 bp, Artificial Sequence
  Synthetic
ggatagcttugccttgcaactttuc

SEQ ID NO: 21075 - DNA, 32 bp, Artificial Sequence
  Synthetic
aaaagtcauaagacctctttattucacagaac

SEQ ID NO: 21076 - DNA, 23 bp, Artificial Sequence
  Synthetic
gaaagaacccccuggttgtaaut

SEQ ID NO: 21077 - DNA, 30 bp, Artificial Sequence
  Synthetic
cactcatgtatctutgcttttcttttggua

SEQ ID NO: 21078 - DNA, 24 bp, Artificial Sequence
  Synthetic
tagtcaagcugtaccattugcaac

SEQ ID NO: 21079 - DNA, 28 bp, Artificial Sequence
  Synthetic
gagctctgucaaggagtaaagtacaaut

SEQ ID NO: 21080 - DNA, 28 bp, Artificial Sequence
  Synthetic
actagaatgcaagaautacaacacuaca

SEQ ID NO: 21081 - DNA, 30 bp, Artificial Sequence
  Synthetic
ccaagctttgauctgtattaagcaatucaa

SEQ ID NO: 21082 - DNA, 21 bp, Artificial Sequence
  Synthetic
gtagtgcagutcctcctgcuc

SEQ ID NO: 21083 - DNA, 19 bp, Artificial Sequence
  Synthetic
agcgacacugcgatuccat

SEQ ID NO: 21084 - DNA, 23 bp, Artificial Sequence
  Synthetic
ttcctgctaaguttccagaggug

SEQ ID NO: 21085 - DNA, 21 bp, Artificial Sequence
  Synthetic
cagaggcuctcaagctguaga

SEQ ID NO: 21086 - DNA, 24 bp, Artificial Sequence
  Synthetic
gtcuttctttctgauacagccact

SEQ ID NO: 21087 - DNA, 25 bp, Artificial Sequence
  Synthetic
cgatcaatgccutctctctctcuct

SEQ ID NO: 21088 - DNA, 17 bp, Artificial Sequence
  Synthetic
actgccuccccgagugt

SEQ ID NO: 21089 - DNA, 21 bp, Artificial Sequence
  Synthetic
cgcatgcugcccggatauaaa

SEQ ID NO: 21090 - DNA, 28 bp, Artificial Sequence
  Synthetic
tgtttgcaaggaauctagaagaattuca

SEQ ID NO: 21091 - DNA, 23 bp, Artificial Sequence
  Synthetic
cctgatccacugaattgacugct

SEQ ID NO: 21092 - DNA, 28 bp, Artificial Sequence
  Synthetic
gtttgattguctgtcaataaaugaaggg

SEQ ID NO: 21093 - DNA, 24 bp, Artificial Sequence
  Synthetic
cttactugacagcctggtaaucca

SEQ ID NO: 21094 - DNA, 28 bp, Artificial Sequence
  Synthetic
gctgtgtgcautagctacaaataguaac

SEQ ID NO: 21095 - DNA, 28 bp, Artificial Sequence
  Synthetic
gctatauaaagaaaaaggcutaccgtut

SEQ ID NO: 21096 - DNA, 28 bp, Artificial Sequence
  Synthetic
tctctttccauctagagttatccuccac

SEQ ID NO: 21097 - DNA, 23 bp, Artificial Sequence
  Synthetic
gctcaccuagaatgctgtcugat

SEQ ID NO: 21098 - DNA, 22 bp, Artificial Sequence
  Synthetic
cactgagtuaacccaggtgugt

SEQ ID NO: 21099 - DNA, 21 bp, Artificial Sequence
  Synthetic
agaggctctuaccagggagug

SEQ ID NO: 21100 - DNA, 27 bp, Artificial Sequence
  Synthetic
ccttaactttaggutggaactcaucgg

SEQ ID NO: 21101 - DNA, 28 bp, Artificial Sequence
  Synthetic
ctgtcugcattatttcugaaaaccaaca

SEQ ID NO: 21102 - DNA, 22 bp, Artificial Sequence
  Synthetic
gcttacgcgugcgggatatuaa

SEQ ID NO: 21103 - DNA, 25 bp, Artificial Sequence
  Synthetic
tgttctagacuaaggatgacugcca

SEQ ID NO: 21104 - DNA, 19 bp, Artificial Sequence
  Synthetic
gcucaagggacucagccaa

SEQ ID NO: 21105 - DNA, 17 bp, Artificial Sequence
  Synthetic
ggcatggugggctccug

SEQ ID NO: 21106 - DNA, 20 bp, Artificial Sequence
  Synthetic
ccgcccuggataacgtctut

SEQ ID NO: 21107 - DNA, 19 bp, Artificial Sequence
  Synthetic
gtgtgccucgaagcactug

SEQ ID NO: 21108 - DNA, 20 bp, Artificial Sequence
  Synthetic
tgagctcaagugcgacauca

SEQ ID NO: 21109 - DNA, 19 bp, Artificial Sequence
  Synthetic
gatcagcucctcggtcucg

SEQ ID NO: 21110 - DNA, 20 bp, Artificial Sequence
  Synthetic
tggctucgacgagtucaagg

SEQ ID NO: 21111 - DNA, 29 bp, Artificial Sequence
  Synthetic
tttctgtcaaauggagatgatctcttcug

SEQ ID NO: 21112 - DNA, 19 bp, Artificial Sequence
  Synthetic
cctgaccuggctctgugac

SEQ ID NO: 21113 - DNA, 19 bp, Artificial Sequence
  Synthetic
agccaaccutgcctcctuc

SEQ ID NO: 21114 - DNA, 20 bp, Artificial Sequence
  Synthetic
tcagaugccgaaaacucggt

SEQ ID NO: 21115 - DNA, 20 bp, Artificial Sequence
  Synthetic
gactgtccucagcacagcut

SEQ ID NO: 21116 - DNA, 19 bp, Artificial Sequence
  Synthetic
ccgatgcugagccucacag

SEQ ID NO: 21117 - DNA, 21 bp, Artificial Sequence
  Synthetic
ggagaccaaguccgaauaggg

SEQ ID NO: 21118 - DNA, 21 bp, Artificial Sequence
  Synthetic
gcttgacaugtcttccguggt

SEQ ID NO: 21119 - DNA, 24 bp, Artificial Sequence
  Synthetic
gtggugggaatgtaatuggagagg

SEQ ID NO: 21120 - DNA, 22 bp, Artificial Sequence
  Synthetic
tgaatcccugacgcttggttut

SEQ ID NO: 21121 - DNA, 22 bp, Artificial Sequence
  Synthetic
aaaccagagguctgtcttcugc

SEQ ID NO: 21122 - DNA, 21 bp, Artificial Sequence
  Synthetic
cugcccaguccagaagatuag

SEQ ID NO: 21123 - DNA, 22 bp, Artificial Sequence
  Synthetic
gagcucagaaagcugaggaagt

SEQ ID NO: 21124 - DNA, 19 bp, Artificial Sequence
  Synthetic
gctggcccagcaugtcuac

SEQ ID NO: 21125 - DNA, 20 bp, Artificial Sequence
  Synthetic
gcacucagcagctccaugaa

SEQ ID NO: 21126 - DNA, 22 bp, Artificial Sequence
  Synthetic
tgutgtatgtguagcaggcact

SEQ ID NO: 21127 - DNA, 24 bp, Artificial Sequence
  Synthetic
ccccaatcuacctggacattctug

SEQ ID NO: 21128 - DNA, 21 bp, Artificial Sequence
  Synthetic
tctuatgagcccucccccaat

SEQ ID NO: 21129 - DNA, 24 bp, Artificial Sequence
  Synthetic
gcatcatguaccggaagttcacua

SEQ ID NO: 21130 - DNA, 19 bp, Artificial Sequence
  Synthetic
accauacccgaggcgauct

SEQ ID NO: 21131 - DNA, 27 bp, Artificial Sequence
  Synthetic
tctccttgatcucctgatttctctcug

SEQ ID NO: 21132 - DNA, 21 bp, Artificial Sequence
  Synthetic
ccttuccaaaggctcccucac

SEQ ID NO: 21133 - DNA, 21 bp, Artificial Sequence
  Synthetic
tcuccctgtgucaccaaacga

SEQ ID NO: 21134 - DNA, 21 bp, Artificial Sequence
  Synthetic
catgccaaugaccacagtguc

SEQ ID NO: 21135 - DNA, 20 bp, Artificial Sequence
  Synthetic
ctgcgtcuctcttggtgugt

SEQ ID NO: 21136 - DNA, 22 bp, Artificial Sequence
  Synthetic
ccagtggguttttggcaaugag

SEQ ID NO: 21137 - DNA, 19 bp, Artificial Sequence
  Synthetic
ctgcacuggctgcacaaug

SEQ ID NO: 21138 - DNA, 24 bp, Artificial Sequence
  Synthetic
tcaagactacagugtgatcacucc

SEQ ID NO: 21139 - DNA, 22 bp, Artificial Sequence
  Synthetic
gagagggugacaacgctgtuat

SEQ ID NO: 21140 - DNA, 21 bp, Artificial Sequence
  Synthetic
ccagcacutcagtaccuggac

SEQ ID NO: 21141 - DNA, 28 bp, Artificial Sequence
  Synthetic
gagcattatttgugccagacttgtttua

SEQ ID NO: 21142 - DNA, 22 bp, Artificial Sequence
  Synthetic
tcccattgcugttccctgaauc

SEQ ID NO: 21143 - DNA, 21 bp, Artificial Sequence
  Synthetic
gautttcttgcugggaagcgt

SEQ ID NO: 21144 - DNA, 28 bp, Artificial Sequence
  Synthetic
catggtuccaggcaagtaauaacaaaat

SEQ ID NO: 21145 - DNA, 19 bp, Artificial Sequence
  Synthetic
cgagaaccuggctcgcauc

SEQ ID NO: 21146 - DNA, 17 bp, Artificial Sequence
  Synthetic
gcgtgaugcgccgguaa

SEQ ID NO: 21147 - DNA, 22 bp, Artificial Sequence
  Synthetic
cagaaccttccucctcttccuc

SEQ ID NO: 21148 - DNA, 27 bp, Artificial Sequence
  Synthetic
ttctttctgtagcucccttgttttcut

SEQ ID NO: 21149 - DNA, 27 bp, Artificial Sequence
  Synthetic
cgctgacatgtuagaggaggagtatua

SEQ ID NO: 21150 - DNA, 26 bp, Artificial Sequence
  Synthetic
ctcatgaccacautctctgtgaagut

SEQ ID NO: 21151 - DNA, 28 bp, Artificial Sequence
  Synthetic
tctcggaagaauaatttcatcaccaguc

SEQ ID NO: 21152 - DNA, 20 bp, Artificial Sequence
  Synthetic
cacgcccuctacctgaucaa

SEQ ID NO: 21153 - DNA, 21 bp, Artificial Sequence
  Synthetic
cggccgcutatgataaacugg

SEQ ID NO: 21154 - DNA, 23 bp, Artificial Sequence
  Synthetic
acctggaugttgagaguggagat

SEQ ID NO: 21155 - DNA, 23 bp, Artificial Sequence
  Synthetic
agaagcucaacgtgtcuacgaag

SEQ ID NO: 21156 - DNA, 32 bp, Artificial Sequence
  Synthetic
aaaaatacuaagaggcccaatatauccagaaa

SEQ ID NO: 21157 - DNA, 23 bp, Artificial Sequence
  Synthetic
tgaaatggucgggtacagacuct

SEQ ID NO: 21158 - DNA, 20 bp, Artificial Sequence
  Synthetic
ccacgcugagagtcgtctua

SEQ ID NO: 21159 - DNA, 29 bp, Artificial Sequence
  Synthetic
tatttttcctgacauactcttgacaguct

SEQ ID NO: 21160 - DNA, 27 bp, Artificial Sequence
  Synthetic
agatcctagtuacccaactttctcuga

SEQ ID NO: 21161 - DNA, 22 bp, Artificial Sequence
  Synthetic
ccugacaaagaggaggutagut

SEQ ID NO: 21162 - DNA, 24 bp, Artificial Sequence
  Synthetic
tttggtaagcugcccatctacaut

SEQ ID NO: 21163 - DNA, 27 bp, Artificial Sequence
  Synthetic
ccatgtaucataactgctugcgaagat

SEQ ID NO: 21164 - DNA, 24 bp, Artificial Sequence
  Synthetic
ggcatgtgtutctacagagcugat

SEQ ID NO: 21165 - DNA, 25 bp, Artificial Sequence
  Synthetic
actaaacaautcgacagtucaggca

SEQ ID NO: 21166 - DNA, 25 bp, Artificial Sequence
  Synthetic
aggtcctcttcuaagtcctccatut

SEQ ID NO: 21167 - DNA, 24 bp, Artificial Sequence
  Synthetic
cttgaaaaagugaagtcctgcuca

SEQ ID NO: 21168 - DNA, 23 bp, Artificial Sequence
  Synthetic
gtgacttctuccttggacctgut

SEQ ID NO: 21169 - DNA, 22 bp, Artificial Sequence
  Synthetic
gctgggcccacugaagataaug

SEQ ID NO: 21170 - DNA, 24 bp, Artificial Sequence
  Synthetic
gcactgugcaagaatgtttttcug

SEQ ID NO: 21171 - DNA, 25 bp, Artificial Sequence
  Synthetic
aaatctcccagugacactcttgaug

SEQ ID NO: 21172 - DNA, 25 bp, Artificial Sequence
  Synthetic
gtcgtgagtaguaagttcactgcua

SEQ ID NO: 21173 - DNA, 27 bp, Artificial Sequence
  Synthetic
accagaaaaaggugttgatacatucct

SEQ ID NO: 21174 - DNA, 21 bp, Artificial Sequence
  Synthetic
tgcttttgcucaccacuaggg

SEQ ID NO: 21175 - DNA, 29 bp, Artificial Sequence
  Synthetic
tggagaaaagacauctatcacacttgaug

SEQ ID NO: 21176 - DNA, 30 bp, Artificial Sequence
  Synthetic
taacaccttaatutgagaatacgatucact

SEQ ID NO: 21177 - DNA, 22 bp, Artificial Sequence
  Synthetic
ccactugcccagtattgtuggt

SEQ ID NO: 21178 - DNA, 21 bp, Artificial Sequence
  Synthetic
gctgcugggcactagtatcuc

SEQ ID NO: 21179 - DNA, 23 bp, Artificial Sequence
  Synthetic
gacctcuccaatctacugggact

SEQ ID NO: 21180 - DNA, 21 bp, Artificial Sequence
  Synthetic
acctgtccaugcagtttgucc

SEQ ID NO: 21181 - DNA, 21 bp, Artificial Sequence
  Synthetic
ttggagcccutctttgtucgt

SEQ ID NO: 21182 - DNA, 23 bp, Artificial Sequence
  Synthetic
ggcattcautcccagguaggact

SEQ ID NO: 21183 - DNA, 26 bp, Artificial Sequence
  Synthetic
ccactttataugggctgtcgtuacac

SEQ ID NO: 21184 - DNA, 23 bp, Artificial Sequence
  Synthetic
catttucaggaggacucccaagg

SEQ ID NO: 21185 - DNA, 27 bp, Artificial Sequence
  Synthetic
gtgcctctucaatccattctttuacag

SEQ ID NO: 21186 - DNA, 22 bp, Artificial Sequence
  Synthetic
gaagtcaucgtcaguccccaaa

SEQ ID NO: 21187 - DNA, 20 bp, Artificial Sequence
  Synthetic
gggagaauctggagcugacc

SEQ ID NO: 21188 - DNA, 22 bp, Artificial Sequence
  Synthetic
ccaacgtcauccaggttgtuct

SEQ ID NO: 21189 - DNA, 21 bp, Artificial Sequence
  Synthetic
cgagcccutaggacaaugacc

SEQ ID NO: 21190 - DNA, 21 bp, Artificial Sequence
  Synthetic
ggctcagcgaguttccactua

SEQ ID NO: 21191 - DNA, 23 bp, Artificial Sequence
  Synthetic
ccagacacaucacatctctccug

SEQ ID NO: 21192 - DNA, 20 bp, Artificial Sequence
  Synthetic
cccactgcaucaggttccuc

SEQ ID NO: 21193 - DNA, 28 bp, Artificial Sequence
  Synthetic
agatttggaaaagacgcuagaagcauat

SEQ ID NO: 21194 - DNA, 25 bp, Artificial Sequence
  Synthetic
gtaatguagauagagggttgtggug

SEQ ID NO: 21195 - DNA, 26 bp, Artificial Sequence
  Synthetic
gcaattagagccuttaggttggucaa

SEQ ID NO: 21196 - DNA, 22 bp, Artificial Sequence
  Synthetic
aagacccatccuggctcatcua

SEQ ID NO: 21197 - DNA, 24 bp, Artificial Sequence
  Synthetic
gtcttcuacttcagcugcagagag

SEQ ID NO: 21198 - DNA, 21 bp, Artificial Sequence
  Synthetic
tggaacagaggcuctctcuca

SEQ ID NO: 21199 - DNA, 26 bp, Artificial Sequence
  Synthetic
gttccttcttuccctcccttactuag

SEQ ID NO: 21200 - DNA, 20 bp, Artificial Sequence
  Synthetic
ctgautcacagcuccaccca

SEQ ID NO: 21201 - DNA, 19 bp, Artificial Sequence
  Synthetic
ccuccaccgcagtgcuaat

SEQ ID NO: 21202 - DNA, 20 bp, Artificial Sequence
  Synthetic
gctcctggagugcgcttuat

SEQ ID NO: 21203 - DNA, 21 bp, Artificial Sequence
  Synthetic
acccucttaacuccgggacag

SEQ ID NO: 21204 - DNA, 25 bp, Artificial Sequence
  Synthetic
gtagcatctguatcaggcaaaguca

SEQ ID NO: 21205 - DNA, 32 bp, Artificial Sequence
  Synthetic
tagctaactaactucagaacaccaacttauac

SEQ ID NO: 21206 - DNA, 20 bp, Artificial Sequence
  Synthetic
ccagtgugcaggguggcaag

SEQ ID NO: 21207 - DNA, 27 bp, Artificial Sequence
  Synthetic
ctcatcttgggccugtgttatctccua

SEQ ID NO: 21208 - DNA, 24 bp, Artificial Sequence
  Synthetic
agttggcaaaacaucttgtugagg

SEQ ID NO: 21209 - DNA, 18 bp, Artificial Sequence
  Synthetic
gggtugcaggaggtgcut

SEQ ID NO: 21210 - DNA, 20 bp, Artificial Sequence
  Synthetic
cagcccaacccutgtcctua

SEQ ID NO: 21211 - DNA, 22 bp, Artificial Sequence
  Synthetic
tgtgaguggatccatuggaagg

SEQ ID NO: 21212 - DNA, 23 bp, Artificial Sequence
  Synthetic
gccttcttccucctcctccauag

SEQ ID NO: 21213 - DNA, 22 bp, Artificial Sequence
  Synthetic
cttctcagagcuggatggacug

SEQ ID NO: 21214 - DNA, 23 bp, Artificial Sequence
  Synthetic
agaaaagaaaacugcccccacua

SEQ ID NO: 21215 - DNA, 24 bp, Artificial Sequence
  Synthetic
caggtgatuaagtacgtgcuccag

SEQ ID NO: 21216 - DNA, 21 bp, Artificial Sequence
  Synthetic
gggtacucacgagtgatgcug

SEQ ID NO: 21217 - DNA, 19 bp, Artificial Sequence
  Synthetic
ctccagugacctgcucgaa

SEQ ID NO: 21218 - DNA, 23 bp, Artificial Sequence
  Synthetic
ctcgagtugaacagtggagaguc

SEQ ID NO: 21219 - DNA, 25 bp, Artificial Sequence
  Synthetic
ctaactatctgtucccaaccccauc

SEQ ID NO: 21220 - DNA, 19 bp, Artificial Sequence
  Synthetic
agacauagcagggcgctuc

SEQ ID NO: 21221 - DNA, 22 bp, Artificial Sequence
  Synthetic
gtactaaccccaggutgagguc

SEQ ID NO: 21222 - DNA, 20 bp, Artificial Sequence
  Synthetic
ggagcuctagcugggagacc

SEQ ID NO: 21223 - DNA, 20 bp, Artificial Sequence
  Synthetic
gccaauaaggcggagagugt

SEQ ID NO: 21224 - DNA, 18 bp, Artificial Sequence
  Synthetic
gggtuagagcccgaggug

SEQ ID NO: 21225 - DNA, 20 bp, Artificial Sequence
  Synthetic
cactagccutggtcccugag

SEQ ID NO: 21226 - DNA, 20 bp, Artificial Sequence
  Synthetic
tgcuatcacuggaggaccca

SEQ ID NO: 21227 - DNA, 21 bp, Artificial Sequence
  Synthetic
ctgggaggugagaaaaggugt

SEQ ID NO: 21228 - DNA, 21 bp, Artificial Sequence
  Synthetic
ggcgagaggaacucactctuc

SEQ ID NO: 21229 - DNA, 19 bp, Artificial Sequence
  Synthetic
ctgatgccuccttcccgut

SEQ ID NO: 21230 - DNA, 21 bp, Artificial Sequence
  Synthetic
ggcagaggucttctccagtuc

SEQ ID NO: 21231 - DNA, 23 bp, Artificial Sequence
  Synthetic
cttagtggatucttcgcagccua

SEQ ID NO: 21232 - DNA, 23 bp, Artificial Sequence
  Synthetic
gcaagagcagautcaagagcugt

SEQ ID NO: 21233 - DNA, 21 bp, Artificial Sequence
  Synthetic
acctatacccuggaggagcug

SEQ ID NO: 21234 - DNA, 17 bp, Artificial Sequence
  Synthetic
cagccucacccgacgua

SEQ ID NO: 21235 - DNA, 22 bp, Artificial Sequence
  Synthetic
ctacctgtaacugggcctgtug

SEQ ID NO: 21236 - DNA, 19 bp, Artificial Sequence
  Synthetic
cccaucagccccttcuagg

SEQ ID NO: 21237 - DNA, 22 bp, Artificial Sequence
  Synthetic
ctggctgugatcgaacttcuca

SEQ ID NO: 21238 - DNA, 24 bp, Artificial Sequence
  Synthetic
agcagaacacacauaccaaaguca

SEQ ID NO: 21239 - DNA, 26 bp, Artificial Sequence
  Synthetic
aagcaaatuccccaaaacacaguaac

SEQ ID NO: 21240 - DNA, 28 bp, Artificial Sequence
  Synthetic
cacacctgucccctaatacttaattuga

SEQ ID NO: 21241 - DNA, 29 bp, Artificial Sequence
  Synthetic
tgcacaatccacautgatatactguaaca

SEQ ID NO: 21242 - DNA, 22 bp, Artificial Sequence
  Synthetic
cagcagtutggccacuacaaat

SEQ ID NO: 21243 - DNA, 28 bp, Artificial Sequence
  Synthetic
ccttgagtaaaauaaactgcttcacauc

SEQ ID NO: 21244 - DNA, 21 bp, Artificial Sequence
  Synthetic
gccattcucaagaggcaguca

SEQ ID NO: 21245 - DNA, 32 bp, Artificial Sequence
  Synthetic
atatagttagauaaaaaccaatgctcucacct

SEQ ID NO: 21246 - DNA, 24 bp, Artificial Sequence
  Synthetic
accuacagaccuggagacaagaag

SEQ ID NO: 21247 - DNA, 27 bp, Artificial Sequence
  Synthetic
cagctaaacccaautaacttagtguga

SEQ ID NO: 21248 - DNA, 21 bp, Artificial Sequence
  Synthetic
gtggaatccugatgctccugt

SEQ ID NO: 21249 - DNA, 26 bp, Artificial Sequence
  Synthetic
accataaaaccuttggaagtguaagt

SEQ ID NO: 21250 - DNA, 26 bp, Artificial Sequence
  Synthetic
ggttgtcagtgcutcagtaaagctua

SEQ ID NO: 21251 - DNA, 28 bp, Artificial Sequence
  Synthetic
gctccaggaguacgtagtaattctucat

SEQ ID NO: 21252 - DNA, 25 bp, Artificial Sequence
  Synthetic
tgaagtgtcagugcataacctctug

SEQ ID NO: 21253 - DNA, 21 bp, Artificial Sequence
  Synthetic
ccaugtgcttugaggcagact

SEQ ID NO: 21254 - DNA, 26 bp, Artificial Sequence
  Synthetic
ggaggaggauccatagatttgtcuga

SEQ ID NO: 21255 - DNA, 26 bp, Artificial Sequence
  Synthetic
tcatagaacccutacgttcacugact

SEQ ID NO: 21256 - DNA, 26 bp, Artificial Sequence
  Synthetic
gggcattgauggcaaatcattaaugt

SEQ ID NO: 21257 - DNA, 27 bp, Artificial Sequence
  Synthetic
gttcagagcugccttcagtatgatuat

SEQ ID NO: 21258 - DNA, 27 bp, Artificial Sequence
  Synthetic
cattgtttgcugtttctcttttcucca

SEQ ID NO: 21259 - DNA, 29 bp, Artificial Sequence
  Synthetic
cacaguaaaacccactaatactugaaggt

SEQ ID NO: 21260 - DNA, 27 bp, Artificial Sequence
  Synthetic
aaggccatgtuagtaaatttgcatcug

SEQ ID NO: 21261 - DNA, 24 bp, Artificial Sequence
  Synthetic
ctctcaaaccgaucagccaauact

SEQ ID NO: 21262 - DNA, 31 bp, Artificial Sequence
  Synthetic
caggtataataaacucctattcgtgcattuc

SEQ ID NO: 21263 - DNA, 27 bp, Artificial Sequence
  Synthetic
gcggttcuatgtgaaaagaugacaaac

SEQ ID NO: 21264 - DNA, 31 bp, Artificial Sequence
  Synthetic
caaaccttatacucaattctcaactcctugt

SEQ ID NO: 21265 - DNA, 23 bp, Artificial Sequence
  Synthetic
cttcatacggugagacaauggca

SEQ ID NO: 21266 - DNA, 23 bp, Artificial Sequence
  Synthetic
tcataagugacggcaatgtgcut

SEQ ID NO: 21267 - DNA, 30 bp, Artificial Sequence
  Synthetic
aatctaaattuaaauggagagtgttcacua

SEQ ID NO: 21268 - DNA, 29 bp, Artificial Sequence
  Synthetic
aggcatcagguacatgaaaaagaagaaut

SEQ ID NO: 21269 - DNA, 30 bp, Artificial Sequence
  Synthetic
ttctgtuaagagauccaaaacatagtatut

SEQ ID NO: 21270 - DNA, 21 bp, Artificial Sequence
  Synthetic
ctggcugagcacauagagcat

SEQ ID NO: 21271 - DNA, 30 bp, Artificial Sequence
  Synthetic
agaaaagcaaugaatcgttuacaaaacaca

SEQ ID NO: 21272 - DNA, 21 bp, Artificial Sequence
  Synthetic
atucggccaaaagatguccct

SEQ ID NO: 21273 - DNA, 26 bp, Artificial Sequence
  Synthetic
tgguctcatttuaaaagcaacaaacc

SEQ ID NO: 21274 - DNA, 31 bp, Artificial Sequence
  Synthetic
tgattttcattgaccaucacatgctaauagt

SEQ ID NO: 21275 - DNA, 27 bp, Artificial Sequence
  Synthetic
tcagcttgtcaagaauagcagtaacuc

SEQ ID NO: 21276 - DNA, 24 bp, Artificial Sequence
  Synthetic
gtgctaaaacuttgagtcccaugt

SEQ ID NO: 21277 - DNA, 32 bp, Artificial Sequence
  Synthetic
gcaatatcatcccacauaagatgttgttcuaa

SEQ ID NO: 21278 - DNA, 30 bp, Artificial Sequence
  Synthetic
gttctcattacccaaautttacttgctgut

SEQ ID NO: 21279 - DNA, 27 bp, Artificial Sequence
  Synthetic
caaagcaaaaguctctctctcauagga

SEQ ID NO: 21280 - DNA, 29 bp, Artificial Sequence
  Synthetic
aaattctgttttccuaaaaggcactugag

SEQ ID NO: 21281 - DNA, 30 bp, Artificial Sequence
  Synthetic
tgcactcattttcuatacagtaattaccut

SEQ ID NO: 21282 - DNA, 25 bp, Artificial Sequence
  Synthetic
gagccttuaaagaaagctactgugt

SEQ ID NO: 21283 - DNA, 30 bp, Artificial Sequence
  Synthetic
ttgaaattgaguccaacaaaatgatccaut

SEQ ID NO: 21284 - DNA, 22 bp, Artificial Sequence
  Synthetic
acctgccaccgutttcctttua

SEQ ID NO: 21285 - DNA, 32 bp, Artificial Sequence
  Synthetic
gatatgtatccauaggaacattttccatugaa

SEQ ID NO: 21286 - DNA, 32 bp, Artificial Sequence
  Synthetic
tcccatttatagacacugtagttaatgaacut

SEQ ID NO: 21287 - DNA, 26 bp, Artificial Sequence
  Synthetic
gttgtgatcccugattccatttctug

SEQ ID NO: 21288 - DNA, 28 bp, Artificial Sequence
  Synthetic
cagataacaatucagccacaaaguaaaa

SEQ ID NO: 21289 - DNA, 26 bp, Artificial Sequence
  Synthetic
acactggcctcugctaagtattcaua

SEQ ID NO: 21290 - DNA, 30 bp, Artificial Sequence
  Synthetic
tctgttacaatuaaaagataccttgctugt

SEQ ID NO: 21291 - DNA, 27 bp, Artificial Sequence
  Synthetic
acagaaaccttcautttgccaaaagut

SEQ ID NO: 21292 - DNA, 21 bp, Artificial Sequence
  Synthetic
cctaccacuggccactguaac

SEQ ID NO: 21293 - DNA, 32 bp, Artificial Sequence
  Synthetic
gtgaagagcccaugttaagttgatttuaaaaa

SEQ ID NO: 21294 - DNA, 21 bp, Artificial Sequence
  Synthetic
ggugttaccggugaagaagcc

SEQ ID NO: 21295 - DNA, 17 bp, Artificial Sequence
  Synthetic
gtcccauccccggtgut

SEQ ID NO: 21296 - DNA, 24 bp, Artificial Sequence
  Synthetic
tgtctattguggcagcugaacaaa

SEQ ID NO: 21297 - DNA, 24 bp, Artificial Sequence
  Synthetic
tggatcagagugacttgucagact

SEQ ID NO: 21298 - DNA, 26 bp, Artificial Sequence
  Synthetic
ctttctggtguaatgctatctuccct

SEQ ID NO: 21299 - DNA, 22 bp, Artificial Sequence
  Synthetic
agtcctgtttucttggctgtug

SEQ ID NO: 21300 - DNA, 22 bp, Artificial Sequence
  Synthetic
gtugccaaggacagcgtuaaaa

SEQ ID NO: 21301 - DNA, 24 bp, Artificial Sequence
  Synthetic
cctttggcutttgtgttgugacag

SEQ ID NO: 21302 - DNA, 21 bp, Artificial Sequence
  Synthetic
ctttgggcugactccaugagt

SEQ ID NO: 21303 - DNA, 32 bp, Artificial Sequence
  Synthetic
tggaacagtcaagaauttattcaaactttguc

SEQ ID NO: 21304 - DNA, 27 bp, Artificial Sequence
  Synthetic
attccctuaaaaccaagacttuacaca

SEQ ID NO: 21305 - DNA, 29 bp, Artificial Sequence
  Synthetic
ctcacaguactgaagaugaacaagaagag

SEQ ID NO: 21306 - DNA, 27 bp, Artificial Sequence
  Synthetic
aaaagaaauaaggcaauggagaaaggt

SEQ ID NO: 21307 - DNA, 31 bp, Artificial Sequence
  Synthetic
agatgaatttttaacuccagacggtgaauat

SEQ ID NO: 21308 - DNA, 23 bp, Artificial Sequence
  Synthetic
ccgtcttgucaaacttgccatut

SEQ ID NO: 21309 - DNA, 22 bp, Artificial Sequence
  Synthetic
tccttggcaucctcagaguagt

SEQ ID NO: 21310 - DNA, 26 bp, Artificial Sequence
  Synthetic
gagacacacagaaguctaaaggcaua

SEQ ID NO: 21311 - DNA, 27 bp, Artificial Sequence
  Synthetic
cagatgaacaauttcagtgcacucaag

SEQ ID NO: 21312 - DNA, 22 bp, Artificial Sequence
  Synthetic
gcccataaagacaugcgctcut

SEQ ID NO: 21313 - DNA, 24 bp, Artificial Sequence
  Synthetic
ccacgacugaggagtatctcauca

SEQ ID NO: 21314 - DNA, 24 bp, Artificial Sequence
  Synthetic
tcaucttccaaaaucaagcagcct

SEQ ID NO: 21315 - DNA, 21 bp, Artificial Sequence
  Synthetic
gccccagauccatgtctgaug

SEQ ID NO: 21316 - DNA, 26 bp, Artificial Sequence
  Synthetic
ccctattcucctgagttagguaagca

SEQ ID NO: 21317 - DNA, 27 bp, Artificial Sequence
  Synthetic
tcaggctuccgaaaccttactatgaua

SEQ ID NO: 21318 - DNA, 22 bp, Artificial Sequence
  Synthetic
tccccaagggagaucaactuca

SEQ ID NO: 21319 - DNA, 23 bp, Artificial Sequence
  Synthetic
ccctgagauacctgcattuccag

SEQ ID NO: 21320 - DNA, 19 bp, Artificial Sequence
  Synthetic
gccttgggcutccttcuca

SEQ ID NO: 21321 - DNA, 26 bp, Artificial Sequence
  Synthetic
gctgaaactctutcctgtccttguag

SEQ ID NO: 21322 - DNA, 21 bp, Artificial Sequence
  Synthetic
aaggctgggugatggagacua

SEQ ID NO: 21323 - DNA, 23 bp, Artificial Sequence
  Synthetic
ccatcauccagggcttctctuac

SEQ ID NO: 21324 - DNA, 24 bp, Artificial Sequence
  Synthetic
ctcatctuaacagcacaaccccua

SEQ ID NO: 21325 - DNA, 23 bp, Artificial Sequence
  Synthetic
cactttttgtugcggcgttatug

SEQ ID NO: 21326 - DNA, 28 bp, Artificial Sequence
  Synthetic
gcaagttaaaugccagattgacatttug

SEQ ID NO: 21327 - DNA, 23 bp, Artificial Sequence
  Synthetic
cagcgctugaatgttatgctuct

SEQ ID NO: 21328 - DNA, 28 bp, Artificial Sequence
  Synthetic
ggtttatggaatugtcatttgacctuca

SEQ ID NO: 21329 - DNA, 29 bp, Artificial Sequence
  Synthetic
aaaatagtgtuaagaaagagcctgtucct

SEQ ID NO: 21330 - DNA, 26 bp, Artificial Sequence
  Synthetic
tttgatgtcacutgcactttagguct

SEQ ID NO: 21331 - DNA, 25 bp, Artificial Sequence
  Synthetic
acatttgtcttugctttgacagugg

SEQ ID NO: 21332 - DNA, 22 bp, Artificial Sequence
  Synthetic
tgcaguttgaagaugggcagaa

SEQ ID NO: 21333 - DNA, 22 bp, Artificial Sequence
  Synthetic
cactctutccctctuagagcgt

SEQ ID NO: 21334 - DNA, 25 bp, Artificial Sequence
  Synthetic
aacagttttgtgucactgtctguct

SEQ ID NO: 21335 - DNA, 17 bp, Artificial Sequence
  Synthetic
caggaagcugcgaugcc

SEQ ID NO: 21336 - DNA, 22 bp, Artificial Sequence
  Synthetic
gtgttcccuagccatccatuca

SEQ ID NO: 21337 - DNA, 19 bp, Artificial Sequence
  Synthetic
ccacaguggctcggaguag

SEQ ID NO: 21338 - DNA, 22 bp, Artificial Sequence
  Synthetic
gacggagaucaccatcgucaaa

SEQ ID NO: 21339 - DNA, 22 bp, Artificial Sequence
  Synthetic
catctggatcuccaccctctug

SEQ ID NO: 21340 - DNA, 18 bp, Artificial Sequence
  Synthetic
gccggacacugtccucct

SEQ ID NO: 21341 - DNA, 21 bp, Artificial Sequence
  Synthetic
caggcctucccagaaactuga

SEQ ID NO: 21342 - DNA, 19 bp, Artificial Sequence
  Synthetic
tggtcaguggctucacagg

SEQ ID NO: 21343 - DNA, 19 bp, Artificial Sequence
  Synthetic
cccacaccuggctcucaga

SEQ ID NO: 21344 - DNA, 20 bp, Artificial Sequence
  Synthetic
aaaaucagccggaagucggt

SEQ ID NO: 21345 - DNA, 18 bp, Artificial Sequence
  Synthetic
accccugtgcuccaggaa

SEQ ID NO: 21346 - DNA, 19 bp, Artificial Sequence
  Synthetic
cgcacauccctctgctuca

SEQ ID NO: 21347 - DNA, 21 bp, Artificial Sequence
  Synthetic
ggcaaguagagauggaaccct

SEQ ID NO: 21348 - DNA, 20 bp, Artificial Sequence
  Synthetic
gcagagtutctccacuggga

SEQ ID NO: 21349 - DNA, 19 bp, Artificial Sequence
  Synthetic
ccgctguagggccctctua

SEQ ID NO: 21350 - DNA, 21 bp, Artificial Sequence
  Synthetic
ccgagaagacuaccagcucgt

SEQ ID NO: 21351 - DNA, 20 bp, Artificial Sequence
  Synthetic
cggtagtgaccugccaggua

SEQ ID NO: 21352 - DNA, 22 bp, Artificial Sequence
  Synthetic
tcgtgtcgugtgtttacaccuc

SEQ ID NO: 21353 - DNA, 24 bp, Artificial Sequence
  Synthetic
cgtcctccuttccaggattucaac

SEQ ID NO: 21354 - DNA, 29 bp, Artificial Sequence
  Synthetic
cgaaacttuccaaagaucttaccagtaut

SEQ ID NO: 21355 - DNA, 25 bp, Artificial Sequence
  Synthetic
ctctgaccaggaugggtttatuacc

SEQ ID NO: 21356 - DNA, 21 bp, Artificial Sequence
  Synthetic
cattcatcggcutccatcugc

SEQ ID NO: 21357 - DNA, 24 bp, Artificial Sequence
  Synthetic
tgtgtcugggcagtttaucaaagt

SEQ ID NO: 21358 - DNA, 23 bp, Artificial Sequence
  Synthetic
gaaaatgtggccutcgccaauaa

SEQ ID NO: 21359 - DNA, 24 bp, Artificial Sequence
  Synthetic
ctataataugcaggccagagucct

SEQ ID NO: 21360 - DNA, 21 bp, Artificial Sequence
  Synthetic
cctcucagggtttcaugagga

SEQ ID NO: 21361 - DNA, 24 bp, Artificial Sequence
  Synthetic
ggactuggagagaaaggcatucag

SEQ ID NO: 21362 - DNA, 20 bp, Artificial Sequence
  Synthetic
gctccaaguctcucgccaag

SEQ ID NO: 21363 - DNA, 20 bp, Artificial Sequence
  Synthetic
gccggaaggugctgatgaug

SEQ ID NO: 21364 - DNA, 21 bp, Artificial Sequence
  Synthetic
ccttgacccugccaagaugaa

SEQ ID NO: 21365 - DNA, 22 bp, Artificial Sequence
  Synthetic
caaaggacgcaaaguaccctug

SEQ ID NO: 21366 - DNA, 21 bp, Artificial Sequence
  Synthetic
ccccaugcagctgaucaaaca

SEQ ID NO: 21367 - DNA, 23 bp, Artificial Sequence
  Synthetic
gaagaatgtcugctgcaggauct

SEQ ID NO: 21368 - DNA, 20 bp, Artificial Sequence
  Synthetic
aaaugtcgggtucaccccaa

SEQ ID NO: 21369 - DNA, 19 bp, Artificial Sequence
  Synthetic
agagctccuccacgaugct

SEQ ID NO: 21370 - DNA, 23 bp, Artificial Sequence
  Synthetic
gcaggaguacttucacagacaga

SEQ ID NO: 21371 - DNA, 22 bp, Artificial Sequence
  Synthetic
tccugacacgagggattuagga

SEQ ID NO: 21372 - DNA, 21 bp, Artificial Sequence
  Synthetic
gcagtctguccacatcgauga

SEQ ID NO: 21373 - DNA, 19 bp, Artificial Sequence
  Synthetic
ccauctgccctuccaccac

SEQ ID NO: 21374 - DNA, 19 bp, Artificial Sequence
  Synthetic
ggctgcugagaagctgugt

SEQ ID NO: 21375 - DNA, 18 bp, Artificial Sequence
  Synthetic
gaggcucataccguggca

SEQ ID NO: 21376 - DNA, 23 bp, Artificial Sequence
  Synthetic
gacggcaaccuagagttacugac

SEQ ID NO: 21377 - DNA, 22 bp, Artificial Sequence
  Synthetic
ggaaagaaagccutccacucac

SEQ ID NO: 21378 - DNA, 20 bp, Artificial Sequence
  Synthetic
ggtttctugcccagcuccat

SEQ ID NO: 21379 - DNA, 20 bp, Artificial Sequence
  Synthetic
gcatccaguccccatcaugc

SEQ ID NO: 21380 - DNA, 17 bp, Artificial Sequence
  Synthetic
gccctgcugtccgtcuc

SEQ ID NO: 21381 - DNA, 17 bp, Artificial Sequence
  Synthetic
gctgccutgcatgugct

SEQ ID NO: 21382 - DNA, 24 bp, Artificial Sequence
  Synthetic
cagaactgautgcccttctuggat

SEQ ID NO: 21383 - DNA, 21 bp, Artificial Sequence
  Synthetic
tcauctgctcugaggcaaacc

SEQ ID NO: 21384 - DNA, 31 bp, Artificial Sequence
  Synthetic
aggaataatatttcuctttctgcagcttuca

SEQ ID NO: 21385 - DNA, 22 bp, Artificial Sequence
  Synthetic
aggcagttgaugaagagcaugt

SEQ ID NO: 21386 - DNA, 23 bp, Artificial Sequence
  Synthetic
cggttgaataccugcaagaggug

SEQ ID NO: 21387 - DNA, 28 bp, Artificial Sequence
  Synthetic
gaagaactagttucccatacttccugaa

SEQ ID NO: 21388 - DNA, 24 bp, Artificial Sequence
  Synthetic
atgaatacaaggcuctccgtgaug

SEQ ID NO: 21389 - DNA, 24 bp, Artificial Sequence
  Synthetic
tgacauaaaccagggaacaugcag

SEQ ID NO: 21390 - DNA, 20 bp, Artificial Sequence
  Synthetic
gttttgcaacaucgctcgug

SEQ ID NO: 21391 - DNA, 23 bp, Artificial Sequence
  Synthetic
gggagaaggccagautcttuagg

SEQ ID NO: 21392 - DNA, 26 bp, Artificial Sequence
  Synthetic
ctctgtcttgtgutctctcgttctut

SEQ ID NO: 21393 - DNA, 22 bp, Artificial Sequence
  Synthetic
cggauaaggaggaagaccacug

SEQ ID NO: 21394 - DNA, 27 bp, Artificial Sequence
  Synthetic
gctctaacccugtggccaaaataauat

SEQ ID NO: 21395 - DNA, 27 bp, Artificial Sequence
  Synthetic
tctttgccatttutctgttccacaaug

SEQ ID NO: 21396 - DNA, 21 bp, Artificial Sequence
  Synthetic
ccacgccuagattctgugagg

SEQ ID NO: 21397 - DNA, 23 bp, Artificial Sequence
  Synthetic
gtggcaagaggauctcaaacuca

SEQ ID NO: 21398 - DNA, 22 bp, Artificial Sequence
  Synthetic
gcaggagutcgatcuggagaag

SEQ ID NO: 21399 - DNA, 21 bp, Artificial Sequence
  Synthetic
gctgctuccctctcucgagaa

SEQ ID NO: 21400 - DNA, 22 bp, Artificial Sequence
  Synthetic
gcccccacucaggaattctaut

SEQ ID NO: 21401 - DNA, 26 bp, Artificial Sequence
  Synthetic
gaggaagagaucagacutactttgug

SEQ ID NO: 21402 - DNA, 22 bp, Artificial Sequence
  Synthetic
accatgcugaggagactgttut

SEQ ID NO: 21403 - DNA, 24 bp, Artificial Sequence
  Synthetic
cgagcaguatctcttcugggaact

SEQ ID NO: 21404 - DNA, 27 bp, Artificial Sequence
  Synthetic
gaggtgacaauatggctgctaauagat

SEQ ID NO: 21405 - DNA, 25 bp, Artificial Sequence
  Synthetic
atcttcttugcctgttatggucaaa

SEQ ID NO: 21406 - DNA, 20 bp, Artificial Sequence
  Synthetic
tgtcctggguaaccttgcug

SEQ ID NO: 21407 - DNA, 27 bp, Artificial Sequence
  Synthetic
tcctcttcuccaattatcctguaggaa

SEQ ID NO: 21408 - DNA, 24 bp, Artificial Sequence
  Synthetic
tggttaactugacccatcatuccc

SEQ ID NO: 21409 - DNA, 24 bp, Artificial Sequence
  Synthetic
tgttgtgtcutgtttcagguccaa

SEQ ID NO: 21410 - DNA, 27 bp, Artificial Sequence
  Synthetic
caactctggugttaatgtctuagagga

SEQ ID NO: 21411 - DNA, 22 bp, Artificial Sequence
  Synthetic
ggtccuggagggatgaaucaga

SEQ ID NO: 21412 - DNA, 19 bp, Artificial Sequence
  Synthetic
tcucccagaggcgguaagg

SEQ ID NO: 21413 - DNA, 20 bp, Artificial Sequence
  Synthetic
ctcgggacutgccgatagug

SEQ ID NO: 21414 - DNA, 27 bp, Artificial Sequence
  Synthetic
gtggagagagugaaacattugcaaaaa

SEQ ID NO: 21415 - DNA, 29 bp, Artificial Sequence
  Synthetic
catccaatgtuctctgtatgguaacacat

SEQ ID NO: 21416 - DNA, 32 bp, Artificial Sequence
  Synthetic
attttctatatagcuccatcaagtatgauggt

SEQ ID NO: 21417 - DNA, 22 bp, Artificial Sequence
  Synthetic
tgtcgaugcacgattactuggt

SEQ ID NO: 21418 - DNA, 30 bp, Artificial Sequence
  Synthetic
aagtaggcagccuttataaaagcaaatuaa

SEQ ID NO: 21419 - DNA, 20 bp, Artificial Sequence
  Synthetic
ctgaagauggccgtttuggt

SEQ ID NO: 21420 - DNA, 24 bp, Artificial Sequence
  Synthetic
ttcctaaggutgcacauaggcaaa

SEQ ID NO: 21421 - DNA, 27 bp, Artificial Sequence
  Synthetic
cttgggtagaucttatgaacagcauct

SEQ ID NO: 21422 - DNA, 30 bp, Artificial Sequence
  Synthetic
acagaaagctggucacttgattaattuaga

SEQ ID NO: 21423 - DNA, 26 bp, Artificial Sequence
  Synthetic
gcctttcacaaaacucatcctgagua

SEQ ID NO: 21424 - DNA, 18 bp, Artificial Sequence
  Synthetic
gcugggcatgtucacgga

SEQ ID NO: 21425 - DNA, 22 bp, Artificial Sequence
  Synthetic
ccatcagguacttgccgaugag

SEQ ID NO: 21426 - DNA, 17 bp, Artificial Sequence
  Synthetic
tcccugggcctgugagt

SEQ ID NO: 21427 - DNA, 20 bp, Artificial Sequence
  Synthetic
gcacacugggaaacgctuct

SEQ ID NO: 21428 - DNA, 17 bp, Artificial Sequence
  Synthetic
aggcacugcacccgtuc

SEQ ID NO: 21429 - DNA, 19 bp, Artificial Sequence
  Synthetic
cacutacagggugacccca

SEQ ID NO: 21430 - DNA, 19 bp, Artificial Sequence
  Synthetic
ctcagcucaggccacacut

SEQ ID NO: 21431 - DNA, 20 bp, Artificial Sequence
  Synthetic
gccctggauttggtgcucag

SEQ ID NO: 21432 - DNA, 22 bp, Artificial Sequence
  Synthetic
cacggaggcauaccttucacat

SEQ ID NO: 21433 - DNA, 21 bp, Artificial Sequence
  Synthetic
agcggaaccugaaucccaaag

SEQ ID NO: 21434 - DNA, 21 bp, Artificial Sequence
  Synthetic
cccggaaggccucgttaauat

SEQ ID NO: 21435 - DNA, 20 bp, Artificial Sequence
  Synthetic
cctuggcgcatcacuaacag

SEQ ID NO: 21436 - DNA, 18 bp, Artificial Sequence
  Synthetic
gggcctucagctcctuct

SEQ ID NO: 21437 - DNA, 19 bp, Artificial Sequence
  Synthetic
cctgacccuaggcctgtug

SEQ ID NO: 21438 - DNA, 21 bp, Artificial Sequence
  Synthetic
agcgtctgucctgcaaatuct

SEQ ID NO: 21439 - DNA, 18 bp, Artificial Sequence
  Synthetic
tcgcaccccautcacguc

SEQ ID NO: 21440 - DNA, 18 bp, Artificial Sequence
  Synthetic
ccauacccaggaggcugt

SEQ ID NO: 21441 - DNA, 18 bp, Artificial Sequence
  Synthetic
cagggcuaccagcugcat

SEQ ID NO: 21442 - DNA, 22 bp, Artificial Sequence
  Synthetic
ccatgtaccugccacguagaag

SEQ ID NO: 21443 - DNA, 18 bp, Artificial Sequence
  Synthetic
tgatcguggtcccuccgt

SEQ ID NO: 21444 - DNA, 20 bp, Artificial Sequence
  Synthetic
gggtgggugacagatttgut

SEQ ID NO: 21445 - DNA, 23 bp, Artificial Sequence
  Synthetic
cactaacctuccttctcccctug

SEQ ID NO: 21446 - DNA, 21 bp, Artificial Sequence
  Synthetic
tcctaccugaaccuccgaact

SEQ ID NO: 21447 - DNA, 21 bp, Artificial Sequence
  Synthetic
gactguagggtttggttugcc

SEQ ID NO: 21448 - DNA, 19 bp, Artificial Sequence
  Synthetic
gcaccuccacgtagcugag

SEQ ID NO: 21449 - DNA, 17 bp, Artificial Sequence
  Synthetic
tgcaaggcgcuguacga

SEQ ID NO: 21450 - DNA, 21 bp, Artificial Sequence
  Synthetic
cctcccaagggcauaggtcut

SEQ ID NO: 21451 - DNA, 21 bp, Artificial Sequence
  Synthetic
agatccccgaugaggagcuac

SEQ ID NO: 21452 - DNA, 17 bp, Artificial Sequence
  Synthetic
ccctccgacugcgggua

SEQ ID NO: 21453 - DNA, 17 bp, Artificial Sequence
  Synthetic
ggagugcaggccucaca

SEQ ID NO: 21454 - DNA, 17 bp, Artificial Sequence
  Synthetic
ccutccccuggagccat

SEQ ID NO: 21455 - DNA, 20 bp, Artificial Sequence
  Synthetic
gtgcatcuggtgcatgtugt

SEQ ID NO: 21456 - DNA, 27 bp, Artificial Sequence
  Synthetic
aggctgtaaaaaucacagacataugct

SEQ ID NO: 21457 - DNA, 19 bp, Artificial Sequence
  Synthetic
cugguccggaagacatcug

SEQ ID NO: 21458 - DNA, 22 bp, Artificial Sequence
  Synthetic
tgggacgcacugttttctctut

SEQ ID NO: 21459 - DNA, 22 bp, Artificial Sequence
  Synthetic
caccauagaagagggagcucac

SEQ ID NO: 21460 - DNA, 19 bp, Artificial Sequence
  Synthetic
caaccctcucaccgcctut

SEQ ID NO: 21461 - DNA, 21 bp, Artificial Sequence
  Synthetic
ctcaatggucgctttggtucg

SEQ ID NO: 21462 - DNA, 20 bp, Artificial Sequence
  Synthetic
tgtccaccaugctgcugaag

SEQ ID NO: 21463 - DNA, 23 bp, Artificial Sequence
  Synthetic
gccttggucagcttctggattut

SEQ ID NO: 21464 - DNA, 24 bp, Artificial Sequence
  Synthetic
gcctgaccgugtctctctctatut

SEQ ID NO: 21465 - DNA, 20 bp, Artificial Sequence
  Synthetic
gaccaacgccutagggcuag

SEQ ID NO: 21466 - DNA, 20 bp, Artificial Sequence
  Synthetic
gaggtgacaugggcttguct

SEQ ID NO: 21467 - DNA, 19 bp, Artificial Sequence
  Synthetic
ctgtgucgggacccctuac

SEQ ID NO: 21468 - DNA, 19 bp, Artificial Sequence
  Synthetic
agtggctggugtccctgua

SEQ ID NO: 21469 - DNA, 17 bp, Artificial Sequence
  Synthetic
tggcagcggguacucac

SEQ ID NO: 21470 - DNA, 25 bp, Artificial Sequence
  Synthetic
gaaguacatgattguggacgaaggt

SEQ ID NO: 21471 - DNA, 19 bp, Artificial Sequence
  Synthetic
gugggcagcaggaagtuga

SEQ ID NO: 21472 - DNA, 21 bp, Artificial Sequence
  Synthetic
cattatgugtccccugcaggt

SEQ ID NO: 21473 - DNA, 18 bp, Artificial Sequence
  Synthetic
gggcccaccutcttgucc

SEQ ID NO: 21474 - DNA, 29 bp, Artificial Sequence
  Synthetic
agcttcttgatagaautcttcccaaacuc

SEQ ID NO: 21475 - DNA, 21 bp, Artificial Sequence
  Synthetic
ccctguaagaaacgccucact

SEQ ID NO: 21476 - DNA, 24 bp, Artificial Sequence
  Synthetic
ccaccttcccutttatgaccucct

SEQ ID NO: 21477 - DNA, 20 bp, Artificial Sequence
  Synthetic
cttctccuccacgctgtuga

SEQ ID NO: 21478 - DNA, 19 bp, Artificial Sequence
  Synthetic
ctgcatgcugatgcctcuc

SEQ ID NO: 21479 - DNA, 18 bp, Artificial Sequence
  Synthetic
ctccgcgucgtcctugat

SEQ ID NO: 21480 - DNA, 18 bp, Artificial Sequence
  Synthetic
ggtgauagccgccggtuc

SEQ ID NO: 21481 - DNA, 22 bp, Artificial Sequence
  Synthetic
gcaggtacaacgucagggtuac

SEQ ID NO: 21482 - DNA, 20 bp, Artificial Sequence
  Synthetic
cgtcttgcagucggtctuca

SEQ ID NO: 21483 - DNA, 18 bp, Artificial Sequence
  Synthetic
cccccgggacucacatuc

SEQ ID NO: 21484 - DNA, 19 bp, Artificial Sequence
  Synthetic
cucaggaaguggcagcgaa

SEQ ID NO: 21485 - DNA, 25 bp, Artificial Sequence
  Synthetic
ctccaagtcugaaactacatcugct

SEQ ID NO: 21486 - DNA, 25 bp, Artificial Sequence
  Synthetic
acgcaccuccagaagaaacuaaaag

SEQ ID NO: 21487 - DNA, 18 bp, Artificial Sequence
  Synthetic
cgcatcccugcacacgua

SEQ ID NO: 21488 - DNA, 25 bp, Artificial Sequence
  Synthetic
atgaggagaagauggagatucagga

SEQ ID NO: 21489 - DNA, 22 bp, Artificial Sequence
  Synthetic
gcagatgcatutcctcccacut

SEQ ID NO: 21490 - DNA, 22 bp, Artificial Sequence
  Synthetic
ggctggtctugaagccatgaua

SEQ ID NO: 21491 - DNA, 27 bp, Artificial Sequence
  Synthetic
aggcaaacattuagatggtaaccucat

SEQ ID NO: 21492 - DNA, 20 bp, Artificial Sequence
  Synthetic
ccatcgcggugctcauagac

SEQ ID NO: 21493 - DNA, 19 bp, Artificial Sequence
  Synthetic
cagcgaacgcugagtctuc

SEQ ID NO: 21494 - DNA, 22 bp, Artificial Sequence
  Synthetic
gagctguccagtgactttgugt

SEQ ID NO: 21495 - DNA, 21 bp, Artificial Sequence
  Synthetic
cttcacuagcggcacaaagug

SEQ ID NO: 21496 - DNA, 19 bp, Artificial Sequence
  Synthetic
gggagttugccaaggugct

SEQ ID NO: 21497 - DNA, 21 bp, Artificial Sequence
  Synthetic
ccttgctgagcuctgggatuc

SEQ ID NO: 21498 - DNA, 21 bp, Artificial Sequence
  Synthetic
ggccugagaucaccaagacag

SEQ ID NO: 21499 - DNA, 22 bp, Artificial Sequence
  Synthetic
gatgtgcuagttccaccuccag

SEQ ID NO: 21500 - DNA, 25 bp, Artificial Sequence
  Synthetic
ggagatguccataaaagttgaugca

SEQ ID NO: 21501 - DNA, 20 bp, Artificial Sequence
  Synthetic
cggatgccaaucacctcgut

SEQ ID NO: 21502 - DNA, 21 bp, Artificial Sequence
  Synthetic
tctctctcacccucaccctuc

SEQ ID NO: 21503 - DNA, 20 bp, Artificial Sequence
  Synthetic
gtagtcaugcggtgcaggua

SEQ ID NO: 21504 - DNA, 22 bp, Artificial Sequence
  Synthetic
tctctctcccugtctccttucg

SEQ ID NO: 21505 - DNA, 21 bp, Artificial Sequence
  Synthetic
gctccgtgcuttctaggtcut

SEQ ID NO: 21506 - DNA, 22 bp, Artificial Sequence
  Synthetic
agtttatugggcatgcgucagt

SEQ ID NO: 21507 - DNA, 25 bp, Artificial Sequence
  Synthetic
gcctgttaacaccutgttccttauc

SEQ ID NO: 21508 - DNA, 20 bp, Artificial Sequence
  Synthetic
cctgagcucccagttccuga

SEQ ID NO: 21509 - DNA, 25 bp, Artificial Sequence
  Synthetic
ataagttattccgutggtggctuct

SEQ ID NO: 21510 - DNA, 18 bp, Artificial Sequence
  Synthetic
tctccagcucgctcucca

SEQ ID NO: 21511 - DNA, 17 bp, Artificial Sequence
  Synthetic
gggccccugagccttuc

SEQ ID NO: 21512 - DNA, 25 bp, Artificial Sequence
  Synthetic
gtggccctcuatgactatgagtcua

SEQ ID NO: 21513 - DNA, 20 bp, Artificial Sequence
  Synthetic
cuttgaagucccaccaccca

SEQ ID NO: 21514 - DNA, 17 bp, Artificial Sequence
  Synthetic
gcaggugcctacugcct

SEQ ID NO: 21515 - DNA, 18 bp, Artificial Sequence
  Synthetic
ctgcugcaggctgtugaa

SEQ ID NO: 21516 - DNA, 20 bp, Artificial Sequence
  Synthetic
ccactgagucagcctgcauc

SEQ ID NO: 21517 - DNA, 21 bp, Artificial Sequence
  Synthetic
agcatacaacugcaccagcut

SEQ ID NO: 21518 - DNA, 22 bp, Artificial Sequence
  Synthetic
gtacguggagcggatgaacuac

SEQ ID NO: 21519 - DNA, 19 bp, Artificial Sequence
  Synthetic
gcgccgugtactcattguc

SEQ ID NO: 21520 - DNA, 17 bp, Artificial Sequence
  Synthetic
tggugaaccgcgaggug

SEQ ID NO: 21521 - DNA, 19 bp, Artificial Sequence
  Synthetic
ccugcaggtacucgaaggt

SEQ ID NO: 21522 - DNA, 27 bp, Artificial Sequence
  Synthetic
agatagctcaugactcctgttaacuga

SEQ ID NO: 21523 - DNA, 24 bp, Artificial Sequence
  Synthetic
ggacttgctugattccaccctuac

SEQ ID NO: 21524 - DNA, 25 bp, Artificial Sequence
  Synthetic
tctagcactcugaccagcaatttut

SEQ ID NO: 21525 - DNA, 23 bp, Artificial Sequence
  Synthetic
ctcatcctcauctcgaggtcuct

SEQ ID NO: 21526 - DNA, 28 bp, Artificial Sequence
  Synthetic
ggcatcaaguggaaattcctagaacaua

SEQ ID NO: 21527 - DNA, 23 bp, Artificial Sequence
  Synthetic
agcagatutcttttccuggccaa

SEQ ID NO: 21528 - DNA, 26 bp, Artificial Sequence
  Synthetic
atgcattaguagagaacagcaatcug

SEQ ID NO: 21529 - DNA, 24 bp, Artificial Sequence
  Synthetic
aagtccaggaggcuctatctugaa

SEQ ID NO: 21530 - DNA, 25 bp, Artificial Sequence
  Synthetic
agtctgtctutactacactguccca

SEQ ID NO: 21531 - DNA, 25 bp, Artificial Sequence
  Synthetic
ccggactttcauctctttggactuc

SEQ ID NO: 21532 - DNA, 26 bp, Artificial Sequence
  Synthetic
ctaaatctgtugctttgtctccucca

SEQ ID NO: 21533 - DNA, 25 bp, Artificial Sequence
  Synthetic
ccctatcuggccaagcaatactuac

SEQ ID NO: 21534 - DNA, 22 bp, Artificial Sequence
  Synthetic
cctggttcutgaggacttugct

SEQ ID NO: 21535 - DNA, 26 bp, Artificial Sequence
  Synthetic
cagataattgaguttggaggtuccca

SEQ ID NO: 21536 - DNA, 29 bp, Artificial Sequence
  Synthetic
gacatggctgaugaagactatgagtttua

SEQ ID NO: 21537 - DNA, 24 bp, Artificial Sequence
  Synthetic
tttgttaagacutgctgcctcuct

SEQ ID NO: 21538 - DNA, 24 bp, Artificial Sequence
  Synthetic
tcgctctccguaaattaaccgtut

SEQ ID NO: 21539 - DNA, 19 bp, Artificial Sequence
  Synthetic
gctgauggcgtcacucagg

SEQ ID NO: 21540 - DNA, 18 bp, Artificial Sequence
  Synthetic
ggcctctgucctgtcgut

SEQ ID NO: 21541 - DNA, 18 bp, Artificial Sequence
  Synthetic
tgccccaucatgctgcuc

SEQ ID NO: 21542 - DNA, 22 bp, Artificial Sequence
  Synthetic
atttctgtguctcctccuccct

SEQ ID NO: 21543 - DNA, 18 bp, Artificial Sequence
  Synthetic
accgtgcucgcctctuac

SEQ ID NO: 21544 - DNA, 25 bp, Artificial Sequence
  Synthetic
gccagtatggaaautaccagcagua

SEQ ID NO: 21545 - DNA, 22 bp, Artificial Sequence
  Synthetic
catgaaaugagcacgctucaca

SEQ ID NO: 21546 - DNA, 22 bp, Artificial Sequence
  Synthetic
agagcccgaugacctttttcug

SEQ ID NO: 21547 - DNA, 20 bp, Artificial Sequence
  Synthetic
cctagcttguccccaggaug

SEQ ID NO: 21548 - DNA, 18 bp, Artificial Sequence
  Synthetic
gucatgccguacgcacac

SEQ ID NO: 21549 - DNA, 17 bp, Artificial Sequence
  Synthetic
tgguggcccccguagat

SEQ ID NO: 21550 - DNA, 17 bp, Artificial Sequence
  Synthetic
cccugcagcatgugcca

SEQ ID NO: 21551 - DNA, 17 bp, Artificial Sequence
  Synthetic
gccagucctcgctuccc

SEQ ID NO: 21552 - DNA, 24 bp, Artificial Sequence
  Synthetic
cattcctcacuagaactcauccga

SEQ ID NO: 21553 - DNA, 22 bp, Artificial Sequence
  Synthetic
caatgtguccccctcccauaac

SEQ ID NO: 21554 - DNA, 27 bp, Artificial Sequence
  Synthetic
ctgtggatgtuccttcttcaacaguat

SEQ ID NO: 21555 - DNA, 25 bp, Artificial Sequence
  Synthetic
cttagagaaggaaagaugagucggt

SEQ ID NO: 21556 - DNA, 28 bp, Artificial Sequence
  Synthetic
cctctatttuggtttattttugccacgt

SEQ ID NO: 21557 - DNA, 22 bp, Artificial Sequence
  Synthetic
cgaucagaggaagggtgtuaca

SEQ ID NO: 21558 - DNA, 22 bp, Artificial Sequence
  Synthetic
caccauggagaactgguaggag

SEQ ID NO: 21559 - DNA, 17 bp, Artificial Sequence
  Synthetic
catcggcaucggcaugt

SEQ ID NO: 21560 - DNA, 22 bp, Artificial Sequence
  Synthetic
agaggcaauggatcccagguat

SEQ ID NO: 21561 - DNA, 24 bp, Artificial Sequence
  Synthetic
gacatattugaacaagggccacuc

SEQ ID NO: 21562 - DNA, 18 bp, Artificial Sequence
  Synthetic
gtgtgggcugacccucat

SEQ ID NO: 21563 - DNA, 20 bp, Artificial Sequence
  Synthetic
cctccctgcuccccacaaua

SEQ ID NO: 21564 - DNA, 18 bp, Artificial Sequence
  Synthetic
tctccgggccaguaccut

SEQ ID NO: 21565 - DNA, 17 bp, Artificial Sequence
  Synthetic
gcagcauggtggaggug

SEQ ID NO: 21566 - DNA, 18 bp, Artificial Sequence
  Synthetic
tcgtgcuggcatcuacgg

SEQ ID NO: 21567 - DNA, 22 bp, Artificial Sequence
  Synthetic
cgcagtaauaaaggccccugaa

SEQ ID NO: 21568 - DNA, 29 bp, Artificial Sequence
  Synthetic
caaagccagacaagutcactgtttaauaa

SEQ ID NO: 21569 - DNA, 21 bp, Artificial Sequence
  Synthetic
ttugaacagguagacggcuaa

SEQ ID NO: 21570 - DNA, 23 bp, Artificial Sequence
  Synthetic
gggttcaguaggatctgguaagg

SEQ ID NO: 21571 - DNA, 24 bp, Artificial Sequence
  Synthetic
acagagaugcaacagcagataugt

SEQ ID NO: 21572 - DNA, 27 bp, Artificial Sequence
  Synthetic
ggtcttggagucataatttggaugaga

SEQ ID NO: 21573 - DNA, 26 bp, Artificial Sequence
  Synthetic
ctctgtgtttauggctctgagauact

SEQ ID NO: 21574 - DNA, 21 bp, Artificial Sequence
  Synthetic
cccatggugtctcctagtuga

SEQ ID NO: 21575 - DNA, 22 bp, Artificial Sequence
  Synthetic
ggaauagtggaugacagcggat

SEQ ID NO: 21576 - DNA, 20 bp, Artificial Sequence
  Synthetic
ccaaggucaaggctgacuca

SEQ ID NO: 21577 - DNA, 25 bp, Artificial Sequence
  Synthetic
acctctctuctgttttctcugcaag

SEQ ID NO: 21578 - DNA, 22 bp, Artificial Sequence
  Synthetic
ctaacgcagcuccttctctgua

SEQ ID NO: 21579 - DNA, 17 bp, Artificial Sequence
  Synthetic
gggccacucacccucag

SEQ ID NO: 21580 - DNA, 17 bp, Artificial Sequence
  Synthetic
ccacccutggctgcuct

SEQ ID NO: 21581 - DNA, 17 bp, Artificial Sequence
  Synthetic
gctcacccgcucctuca

SEQ ID NO: 21582 - DNA, 19 bp, Artificial Sequence
  Synthetic
cgcatugcgacttcgugaa

SEQ ID NO: 21583 - DNA, 17 bp, Artificial Sequence
  Synthetic
cgcgcaccuggtcauct

SEQ ID NO: 21584 - DNA, 18 bp, Artificial Sequence
  Synthetic
ccctccugatcccucgca

SEQ ID NO: 21585 - DNA, 19 bp, Artificial Sequence
  Synthetic
ctaccucggagccgaucat

SEQ ID NO: 21586 - DNA, 23 bp, Artificial Sequence
  Synthetic
tggaagagautctggauggcaac

SEQ ID NO: 21587 - DNA, 28 bp, Artificial Sequence
  Synthetic
agtguttcaatttaactucaacccaacc

SEQ ID NO: 21588 - DNA, 23 bp, Artificial Sequence
  Synthetic
ctgtgatccaugagaacgcauct

SEQ ID NO: 21589 - DNA, 21 bp, Artificial Sequence
  Synthetic
tgutcccacguaacacacagg

SEQ ID NO: 21590 - DNA, 21 bp, Artificial Sequence
  Synthetic
gaagtttgcccugaagctgug

SEQ ID NO: 21591 - DNA, 24 bp, Artificial Sequence
  Synthetic
tcucaaaacagtttugcagggaga

SEQ ID NO: 21592 - DNA, 17 bp, Artificial Sequence
  Synthetic
gcggaugaggcgtctug

SEQ ID NO: 21593 - DNA, 17 bp, Artificial Sequence
  Synthetic
tgtccccucgcctcugt

SEQ ID NO: 21594 - DNA, 22 bp, Artificial Sequence
  Synthetic
ctccgagaaaccuggttcttug

SEQ ID NO: 21595 - DNA, 22 bp, Artificial Sequence
  Synthetic
cctgcucagggaaaaacuggaa

SEQ ID NO: 21596 - DNA, 30 bp, Artificial Sequence
  Synthetic
gttcagaaatggcagutatctttagaauct

SEQ ID NO: 21597 - DNA, 32 bp, Artificial Sequence
  Synthetic
tgtcttccugaaaagggaatttaatutctuac

SEQ ID NO: 21598 - DNA, 26 bp, Artificial Sequence
  Synthetic
catttatgacccugagaacagacuga

SEQ ID NO: 21599 - DNA, 22 bp, Artificial Sequence
  Synthetic
agacagggaaagauctgcugga

SEQ ID NO: 21600 - DNA, 21 bp, Artificial Sequence
  Synthetic
tgtttttctucaccccucgca

SEQ ID NO: 21601 - DNA, 20 bp, Artificial Sequence
  Synthetic
cccagccccucagaaaucac

SEQ ID NO: 21602 - DNA, 21 bp, Artificial Sequence
  Synthetic
gcagaucagcugaagcaggac

SEQ ID NO: 21603 - DNA, 25 bp, Artificial Sequence
  Synthetic
aggaaagagaacaucaccaggacua

SEQ ID NO: 21604 - DNA, 25 bp, Artificial Sequence
  Synthetic
agaaatcgaggccutgaaacugaaa

SEQ ID NO: 21605 - DNA, 24 bp, Artificial Sequence
  Synthetic
cattaatgauggtcctgaucagca

SEQ ID NO: 21606 - DNA, 23 bp, Artificial Sequence
  Synthetic
gtggccttcuttgaagagctcua

SEQ ID NO: 21607 - DNA, 18 bp, Artificial Sequence
  Synthetic
cuggagcucccacggaaa

SEQ ID NO: 21608 - DNA, 22 bp, Artificial Sequence
  Synthetic
ggactuagagcggaagaagcuc

SEQ ID NO: 21609 - DNA, 24 bp, Artificial Sequence
  Synthetic
gactcctauggtgacctcucagat

SEQ ID NO: 21610 - DNA, 21 bp, Artificial Sequence
  Synthetic
agggtgatugagacaccccua

SEQ ID NO: 21611 - DNA, 20 bp, Artificial Sequence
  Synthetic
agtactugcgggcagcauac

SEQ ID NO: 21612 - DNA, 22 bp, Artificial Sequence
  Synthetic
gaagagagtgutgctggagugt

SEQ ID NO: 21613 - DNA, 21 bp, Artificial Sequence
  Synthetic
gccccuggaacctcttccuag

SEQ ID NO: 21614 - DNA, 19 bp, Artificial Sequence
  Synthetic
catcaugggaccgcacaug

SEQ ID NO: 21615 - DNA, 24 bp, Artificial Sequence
  Synthetic
ggcaagatctuccgtgatgtguat

SEQ ID NO: 21616 - DNA, 18 bp, Artificial Sequence
  Synthetic
gcctcgcutgccagucag

SEQ ID NO: 21617 - DNA, 19 bp, Artificial Sequence
  Synthetic
gccaagccuctttgccugt

SEQ ID NO: 21618 - DNA, 21 bp, Artificial Sequence
  Synthetic
gtccccaaauacctuggagct

SEQ ID NO: 21619 - DNA, 18 bp, Artificial Sequence
  Synthetic
cgccugcagcgagtacut

SEQ ID NO: 21620 - DNA, 27 bp, Artificial Sequence
  Synthetic
ttctatggaaaaaucctttccccugac

SEQ ID NO: 21621 - DNA, 21 bp, Artificial Sequence
  Synthetic
gcaugacaagacggcacugaa

SEQ ID NO: 21622 - DNA, 19 bp, Artificial Sequence
  Synthetic
actcugcccagucaaggaa

SEQ ID NO: 21623 - DNA, 17 bp, Artificial Sequence
  Synthetic
aaccgcaacgugcagug

SEQ ID NO: 21624 - DNA, 22 bp, Artificial Sequence
  Synthetic
cagacgucaagaaggagggaug

SEQ ID NO: 21625 - DNA, 22 bp, Artificial Sequence
  Synthetic
ccgctccuttgatgatcuccaa

SEQ ID NO: 21626 - DNA, 18 bp, Artificial Sequence
  Synthetic
gccguggcaactcaccuc

SEQ ID NO: 21627 - DNA, 17 bp, Artificial Sequence
  Synthetic
cggcgcgcucgatcuac

SEQ ID NO: 21628 - DNA, 25 bp, Artificial Sequence
  Synthetic
cctagttgagucactgccagaatut

SEQ ID NO: 21629 - DNA, 28 bp, Artificial Sequence
  Synthetic
cctcatactutctcttcataugcacaca

SEQ ID NO: 21630 - DNA, 28 bp, Artificial Sequence
  Synthetic
cactgatactgtutatctgtgacctuca

SEQ ID NO: 21631 - DNA, 26 bp, Artificial Sequence
  Synthetic
atcttctcagagcuacttgctttucc

SEQ ID NO: 21632 - DNA, 26 bp, Artificial Sequence
  Synthetic
catacctagcugagtcacugacaaat

SEQ ID NO: 21633 - DNA, 28 bp, Artificial Sequence
  Synthetic
tctgttacctagtutagtcatggcctua

SEQ ID NO: 21634 - DNA, 27 bp, Artificial Sequence
  Synthetic
cautataaagatcaugcccaagaagcc

SEQ ID NO: 21635 - DNA, 28 bp, Artificial Sequence
  Synthetic
gttcccaaaucatttcctctuaccagat

SEQ ID NO: 21636 - DNA, 21 bp, Artificial Sequence
  Synthetic
gcagacaugcctagctgaguc

SEQ ID NO: 21637 - DNA, 27 bp, Artificial Sequence
  Synthetic
acatagacgatttuctccgaggattuc

SEQ ID NO: 21638 - DNA, 25 bp, Artificial Sequence
  Synthetic
tgtttatcugcgaccttcacatugt

SEQ ID NO: 21639 - DNA, 28 bp, Artificial Sequence
  Synthetic
ccagatgtcutgttaatcttcuccaagg

SEQ ID NO: 21640 - DNA, 22 bp, Artificial Sequence
  Synthetic
tcatcctgacuggtcctcctut

SEQ ID NO: 21641 - DNA, 20 bp, Artificial Sequence
  Synthetic
tcccctgcuctcttcagugt

SEQ ID NO: 21642 - DNA, 20 bp, Artificial Sequence
  Synthetic
cctcaatguccagctgcuct

SEQ ID NO: 21643 - DNA, 25 bp, Artificial Sequence
  Synthetic
tgagggactcugaaccctacttauc

SEQ ID NO: 21644 - DNA, 19 bp, Artificial Sequence
  Synthetic
gcacacgcuctctggctua

SEQ ID NO: 21645 - DNA, 23 bp, Artificial Sequence
  Synthetic
atctgcatgugtttcttgcctuc

SEQ ID NO: 21646 - DNA, 22 bp, Artificial Sequence
  Synthetic
gaggtttggcugtagcctctua

SEQ ID NO: 21647 - DNA, 17 bp, Artificial Sequence
  Synthetic
ctucccaggcccucacc

SEQ ID NO: 21648 - DNA, 19 bp, Artificial Sequence
  Synthetic
tggacggcucaatgtgugg

SEQ ID NO: 21649 - DNA, 18 bp, Artificial Sequence
  Synthetic
cugcggcagcagctaaug

SEQ ID NO: 21650 - DNA, 22 bp, Artificial Sequence
  Synthetic
agctcguagaagctgucaggat

SEQ ID NO: 21651 - DNA, 26 bp, Artificial Sequence
  Synthetic
gggaataagguccttcattcaaucac

SEQ ID NO: 21652 - DNA, 17 bp, Artificial Sequence
  Synthetic
tucggccgcaugagaca

SEQ ID NO: 21653 - DNA, 17 bp, Artificial Sequence
  Synthetic
gcgcagugctagcucca

SEQ ID NO: 21654 - DNA, 26 bp, Artificial Sequence
  Synthetic
ctctggucctttagatcugagagaca

SEQ ID NO: 21655 - DNA, 28 bp, Artificial Sequence
  Synthetic
tctctctagaguttggaaaccttuacca

SEQ ID NO: 21656 - DNA, 27 bp, Artificial Sequence
  Synthetic
cacatagaagattutctccgaggctut

SEQ ID NO: 21657 - DNA, 20 bp, Artificial Sequence
  Synthetic
gcagacaugcctagcugagt

SEQ ID NO: 21658 - DNA, 28 bp, Artificial Sequence
  Synthetic
ctatttccccagucttttaagtgacugt

SEQ ID NO: 21659 - DNA, 21 bp, Artificial Sequence
  Synthetic
cucagtgatgucgggaggaag

SEQ ID NO: 21660 - DNA, 22 bp, Artificial Sequence
  Synthetic
agggctgtagucattgtggaug

SEQ ID NO: 21661 - DNA, 28 bp, Artificial Sequence
  Synthetic
gaattagcaatcuaaggtctacgtcuga

SEQ ID NO: 21662 - DNA, 23 bp, Artificial Sequence
  Synthetic
tcautgagauggagaagcagcag

SEQ ID NO: 21663 - DNA, 29 bp, Artificial Sequence
  Synthetic
gtcattttgtcctutcagctttaagacut

SEQ ID NO: 21664 - DNA, 29 bp, Artificial Sequence
  Synthetic
tgttatcactctauctacttcccttagug

SEQ ID NO: 21665 - DNA, 26 bp, Artificial Sequence
  Synthetic
agagccattaaccucctaagtcctua

SEQ ID NO: 21666 - DNA, 24 bp, Artificial Sequence
  Synthetic
cttuaagacccuaccaacaacuga

SEQ ID NO: 21667 - DNA, 30 bp, Artificial Sequence
  Synthetic
gttttgagaaacuagacactgcaacttaut

SEQ ID NO: 21668 - DNA, 23 bp, Artificial Sequence
  Synthetic
gagcutgaagtacauggcaggat

SEQ ID NO: 21669 - DNA, 23 bp, Artificial Sequence
  Synthetic
ttccttugcagtaatccauggct

SEQ ID NO: 21670 - DNA, 20 bp, Artificial Sequence
  Synthetic
ccagagcagccugctactua

SEQ ID NO: 21671 - DNA, 27 bp, Artificial Sequence
  Synthetic
agaaatccctggaugatgaagtgaaug

SEQ ID NO: 21672 - DNA, 20 bp, Artificial Sequence
  Synthetic
gagcgguacctgaagggtut

SEQ ID NO: 21673 - DNA, 21 bp, Artificial Sequence
  Synthetic
gattcgggucaacauggagga

SEQ ID NO: 21674 - DNA, 22 bp, Artificial Sequence
  Synthetic
tgacaagcucgctggtgattut

SEQ ID NO: 21675 - DNA, 21 bp, Artificial Sequence
  Synthetic
atgctgcuatcagtugcaggt

SEQ ID NO: 21676 - DNA, 22 bp, Artificial Sequence
  Synthetic
caaagccaacugtgcuaacgat

SEQ ID NO: 21677 - DNA, 24 bp, Artificial Sequence
  Synthetic
ctgtucaacaccaaatucgaaggg

SEQ ID NO: 21678 - DNA, 19 bp, Artificial Sequence
  Synthetic
gtctccutgacccucacca

SEQ ID NO: 21679 - DNA, 19 bp, Artificial Sequence
  Synthetic
ctgtgcaguagctcccgut

SEQ ID NO: 21680 - DNA, 18 bp, Artificial Sequence
  Synthetic
gccagggcaucucccaat

SEQ ID NO: 21681 - DNA, 18 bp, Artificial Sequence
  Synthetic
ccaaagggcugcaccuac

SEQ ID NO: 21682 - DNA, 18 bp, Artificial Sequence
  Synthetic
acagagaacgccgugugt

SEQ ID NO: 21683 - DNA, 19 bp, Artificial Sequence
  Synthetic
gggaccaggguggaaaugg

SEQ ID NO: 21684 - DNA, 19 bp, Artificial Sequence
  Synthetic
gggtcuccacgattcgugt

SEQ ID NO: 21685 - DNA, 21 bp, Artificial Sequence
  Synthetic
agagtctgugggtcagtggut

SEQ ID NO: 21686 - DNA, 20 bp, Artificial Sequence
  Synthetic
acgctgcgutgtctccttua

SEQ ID NO: 21687 - DNA, 19 bp, Artificial Sequence
  Synthetic
ggtgaagucctcgctggug

SEQ ID NO: 21688 - DNA, 22 bp, Artificial Sequence
  Synthetic
gttcugcccccaccattuagaa

SEQ ID NO: 21689 - DNA, 18 bp, Artificial Sequence
  Synthetic
cagggcgagcuctccuac

SEQ ID NO: 21690 - DNA, 24 bp, Artificial Sequence
  Synthetic
gtcautaaggacatugagccaggt

SEQ ID NO: 21691 - DNA, 20 bp, Artificial Sequence
  Synthetic
ccaggcatcugctcctctuc

SEQ ID NO: 21692 - DNA, 22 bp, Artificial Sequence
  Synthetic
gagtacaaaugcgaccagtguc

SEQ ID NO: 21693 - DNA, 17 bp, Artificial Sequence
  Synthetic
gtcugcagcctccugct

SEQ ID NO: 21694 - DNA, 22 bp, Artificial Sequence
  Synthetic
gttttaggugaggtcugccaca

SEQ ID NO: 21695 - DNA, 19 bp, Artificial Sequence
  Synthetic
gutcttgcccucgcagaag

SEQ ID NO: 21696 - DNA, 19 bp, Artificial Sequence
  Synthetic
cccacaucgctgcucaaga

SEQ ID NO: 21697 - DNA, 19 bp, Artificial Sequence
  Synthetic
gcggctcucgaacttcucc

SEQ ID NO: 21698 - DNA, 21 bp, Artificial Sequence
  Synthetic
ccgaggugcctgtcttctaut

SEQ ID NO: 21699 - DNA, 22 bp, Artificial Sequence
  Synthetic
cttcttctccugcatccccaug

SEQ ID NO: 21700 - DNA, 21 bp, Artificial Sequence
  Synthetic
caaagacgugaagcccaucct

SEQ ID NO: 21701 - DNA, 21 bp, Artificial Sequence
  Synthetic
ccccauagacgtggttctugc

SEQ ID NO: 21702 - DNA, 26 bp, Artificial Sequence
  Synthetic
accctaagauatgctgttguacagaa

SEQ ID NO: 21703 - DNA, 22 bp, Artificial Sequence
  Synthetic
aaagctcuccagcttctctguc

SEQ ID NO: 21704 - DNA, 22 bp, Artificial Sequence
  Synthetic
aatcucaccagacaccugagga

SEQ ID NO: 21705 - DNA, 22 bp, Artificial Sequence
  Synthetic
gccctgggaauggcatactuac

SEQ ID NO: 21706 - DNA, 20 bp, Artificial Sequence
  Synthetic
gtcctcucccaccucagagt

SEQ ID NO: 21707 - DNA, 20 bp, Artificial Sequence
  Synthetic
ccagcccgcgauagtttuct

SEQ ID NO: 21708 - DNA, 18 bp, Artificial Sequence
  Synthetic
ctcuccccggtcatuggt

SEQ ID NO: 21709 - DNA, 27 bp, Artificial Sequence
  Synthetic
tctttaactucaaatgcttccucagct

SEQ ID NO: 21710 - DNA, 20 bp, Artificial Sequence
  Synthetic
tcaccccaucaaccaccuct

SEQ ID NO: 21711 - DNA, 24 bp, Artificial Sequence
  Synthetic
gaaaagtcggaaugaaccatggug

SEQ ID NO: 21712 - DNA, 22 bp, Artificial Sequence
  Synthetic
acacacacacutccctcctgua

SEQ ID NO: 21713 - DNA, 28 bp, Artificial Sequence
  Synthetic
caagaaaggaucaaagugaacggaaaag

SEQ ID NO: 21714 - DNA, 18 bp, Artificial Sequence
  Synthetic
cucacgcggagccauact

SEQ ID NO: 21715 - DNA, 21 bp, Artificial Sequence
  Synthetic
ggcguggcaaagtgattagug

SEQ ID NO: 21716 - DNA, 22 bp, Artificial Sequence
  Synthetic
guggcagcggtauagagagaat

SEQ ID NO: 21717 - DNA, 21 bp, Artificial Sequence
  Synthetic
tgttgatuggcagctcagcua

SEQ ID NO: 21718 - DNA, 25 bp, Artificial Sequence
  Synthetic
caaaaccagagagaugcagaaacuc

SEQ ID NO: 21719 - DNA, 23 bp, Artificial Sequence
  Synthetic
aacatcaauggaggcaacacuct

SEQ ID NO: 21720 - DNA, 21 bp, Artificial Sequence
  Synthetic
gtctctguggctttccugact

SEQ ID NO: 21721 - DNA, 20 bp, Artificial Sequence
  Synthetic
tgacgucaggagccaagaug

SEQ ID NO: 21722 - DNA, 20 bp, Artificial Sequence
  Synthetic
ccuaaccacauccgccacaa

SEQ ID NO: 21723 - DNA, 19 bp, Artificial Sequence
  Synthetic
ggacccgguctcctgguag

SEQ ID NO: 21724 - DNA, 25 bp, Artificial Sequence
  Synthetic
gcucagaatcaagtucgggaagaaa

SEQ ID NO: 21725 - DNA, 19 bp, Artificial Sequence
  Synthetic
agcccagggaagutcccua

SEQ ID NO: 21726 - DNA, 19 bp, Artificial Sequence
  Synthetic
cggcgtucaaccacctuct

SEQ ID NO: 21727 - DNA, 20 bp, Artificial Sequence
  Synthetic
caccacugagauggcaggac

SEQ ID NO: 21728 - DNA, 18 bp, Artificial Sequence
  Synthetic
tcggccaccuccatcuca

SEQ ID NO: 21729 - DNA, 21 bp, Artificial Sequence
  Synthetic
cgtacuggccgtactgauagc

SEQ ID NO: 21730 - DNA, 20 bp, Artificial Sequence
  Synthetic
gaaacuggccaggcctacua

SEQ ID NO: 21731 - DNA, 19 bp, Artificial Sequence
  Synthetic
gggcuggtgaugagaagca

SEQ ID NO: 21732 - DNA, 21 bp, Artificial Sequence
  Synthetic
gtggaacgccaggautagcut

SEQ ID NO: 21733 - DNA, 26 bp, Artificial Sequence
  Synthetic
agtagagaguagtatcctgguggagt

SEQ ID NO: 21734 - DNA, 22 bp, Artificial Sequence
  Synthetic
tgatgtucacgcacaggtctut

SEQ ID NO: 21735 - DNA, 23 bp, Artificial Sequence
  Synthetic
tcagcgauggaagtctttggaug

SEQ ID NO: 21736 - DNA, 27 bp, Artificial Sequence
  Synthetic
caaattcaacaaugcctttccctguag

SEQ ID NO: 21737 - DNA, 29 bp, Artificial Sequence
  Synthetic
tgttcgtaatctutcaccttatgttucca

SEQ ID NO: 21738 - DNA, 28 bp, Artificial Sequence
  Synthetic
caaatagtcttutgaattcatccuccgt

SEQ ID NO: 21739 - DNA, 25 bp, Artificial Sequence
  Synthetic
agaggtctcuggtgtttgaaaacut

SEQ ID NO: 21740 - DNA, 17 bp, Artificial Sequence
  Synthetic
ggtggcugttgctgcug

SEQ ID NO: 21741 - DNA, 19 bp, Artificial Sequence
  Synthetic
cctccacgacutccgtuct

SEQ ID NO: 21742 - DNA, 27 bp, Artificial Sequence
  Synthetic
acatttgtctcuttcctttccatucca

SEQ ID NO: 21743 - DNA, 21 bp, Artificial Sequence
  Synthetic
acgcccacggaaauaauaggg

SEQ ID NO: 21744 - DNA, 25 bp, Artificial Sequence
  Synthetic
tctguaaaggagaaaaagucctcut

SEQ ID NO: 21745 - DNA, 21 bp, Artificial Sequence
  Synthetic
atggctucgagctctcagaug

SEQ ID NO: 21746 - DNA, 21 bp, Artificial Sequence
  Synthetic
ctggcuccacatatggcucat

SEQ ID NO: 21747 - DNA, 24 bp, Artificial Sequence
  Synthetic
caattaaacugccagctagugaga

SEQ ID NO: 21748 - DNA, 24 bp, Artificial Sequence
  Synthetic
gaagaagauggctgactuccacaa

SEQ ID NO: 21749 - DNA, 22 bp, Artificial Sequence
  Synthetic
cctcccattugcctgacttcuc

SEQ ID NO: 21750 - DNA, 28 bp, Artificial Sequence
  Synthetic
gaaagtcttccutttccattacucgaga

SEQ ID NO: 21751 - DNA, 20 bp, Artificial Sequence
  Synthetic
gcuaggcgacaccactuagg

SEQ ID NO: 21752 - DNA, 24 bp, Artificial Sequence
  Synthetic
tgggtccucaggaatgacatuaca

SEQ ID NO: 21753 - DNA, 22 bp, Artificial Sequence
  Synthetic
acctccaguataaggccauggt

SEQ ID NO: 21754 - DNA, 26 bp, Artificial Sequence
  Synthetic
gaggtaaaucgagagaatcaguggat

SEQ ID NO: 21755 - DNA, 25 bp, Artificial Sequence
  Synthetic
gggacagacaagaaacutaagaguc

SEQ ID NO: 21756 - DNA, 25 bp, Artificial Sequence
  Synthetic
agaggcaactacuctgggaacaaua

SEQ ID NO: 21757 - DNA, 22 bp, Artificial Sequence
  Synthetic
ctgtgtgucaaaggccctcuaa

SEQ ID NO: 21758 - DNA, 22 bp, Artificial Sequence
  Synthetic
ggctgcuaccaagaaacaguga

SEQ ID NO: 21759 - DNA, 28 bp, Artificial Sequence
  Synthetic
tgtaaaacguctcagacagtuaccaaaa

SEQ ID NO: 21760 - DNA, 28 bp, Artificial Sequence
  Synthetic
tgcttttgtcugcaaaacttcatttgua

SEQ ID NO: 21761 - DNA, 22 bp, Artificial Sequence
  Synthetic
gtccataccugaacagctuggt

SEQ ID NO: 21762 - DNA, 24 bp, Artificial Sequence
  Synthetic
cagagctauagcatttgccuccat

SEQ ID NO: 21763 - DNA, 28 bp, Artificial Sequence
  Synthetic
atgatggcttacuactttgtgtcttuca

SEQ ID NO: 21764 - DNA, 29 bp, Artificial Sequence
  Synthetic
accttctcaaaaagaugaaatgctcuaca

SEQ ID NO: 21765 - DNA, 23 bp, Artificial Sequence
  Synthetic
gggtgccaguaacaattcugaaa

SEQ ID NO: 21766 - DNA, 27 bp, Artificial Sequence
  Synthetic
atgttgctctctucaaaactgggaaua

SEQ ID NO: 21767 - DNA, 28 bp, Artificial Sequence
  Synthetic
aagatgauaccaaaatttccagugagga

SEQ ID NO: 21768 - DNA, 29 bp, Artificial Sequence
  Synthetic
aautaatagaacuaggaaagcaccaagca

SEQ ID NO: 21769 - DNA, 25 bp, Artificial Sequence
  Synthetic
acccaagacugagtcagataaugga

SEQ ID NO: 21770 - DNA, 28 bp, Artificial Sequence
  Synthetic
cttgccaagaatutagcggactatatug

SEQ ID NO: 21771 - DNA, 24 bp, Artificial Sequence
  Synthetic
tcccaaccacacgautttgtttut

SEQ ID NO: 21772 - DNA, 29 bp, Artificial Sequence
  Synthetic
ctggtttaactgauttggtattcctcuca

SEQ ID NO: 21773 - DNA, 23 bp, Artificial Sequence
  Synthetic
cctctgccuactccatuggaaat

SEQ ID NO: 21774 - DNA, 29 bp, Artificial Sequence
  Synthetic
accctaaacagucactaatgtacuagaca

SEQ ID NO: 21775 - DNA, 27 bp, Artificial Sequence
  Synthetic
tgagttttatgaaugcttcccttguga

SEQ ID NO: 21776 - DNA, 23 bp, Artificial Sequence
  Synthetic
caagtugtcaatgaaucgcacct

SEQ ID NO: 21777 - DNA, 28 bp, Artificial Sequence
  Synthetic
tcgagaagtaccugaatgcctagaaaua

SEQ ID NO: 21778 - DNA, 23 bp, Artificial Sequence
  Synthetic
gatgaaatcuccagttggcgtug

SEQ ID NO: 21779 - DNA, 28 bp, Artificial Sequence
  Synthetic
ccaagtttgctautccttgtgcttuaat

SEQ ID NO: 21780 - DNA, 20 bp, Artificial Sequence
  Synthetic
ggtggugaggactcgactuc

SEQ ID NO: 21781 - DNA, 21 bp, Artificial Sequence
  Synthetic
ggacttguccagguggagact

SEQ ID NO: 21782 - DNA, 21 bp, Artificial Sequence
  Synthetic
acggcctguttcatgagtuca

SEQ ID NO: 21783 - DNA, 17 bp, Artificial Sequence
  Synthetic
cctcuggcatgctuggc

SEQ ID NO: 21784 - DNA, 19 bp, Artificial Sequence
  Synthetic
caccautgccucgagacct

SEQ ID NO: 21785 - DNA, 19 bp, Artificial Sequence
  Synthetic
gtccggtuagctcgcugat

SEQ ID NO: 21786 - DNA, 20 bp, Artificial Sequence
  Synthetic
gggacctugggttcctctug

SEQ ID NO: 21787 - DNA, 20 bp, Artificial Sequence
  Synthetic
cauatggguccaggcagcat

SEQ ID NO: 21788 - DNA, 22 bp, Artificial Sequence
  Synthetic
ccactggauagcctagaucgca

SEQ ID NO: 21789 - DNA, 18 bp, Artificial Sequence
  Synthetic
ttttcgugggcggucact

SEQ ID NO: 21790 - DNA, 19 bp, Artificial Sequence
  Synthetic
ggagugcaccuagcaccag

SEQ ID NO: 21791 - DNA, 25 bp, Artificial Sequence
  Synthetic
cagatgcatgtuggaaggaaagtug

SEQ ID NO: 21792 - DNA, 19 bp, Artificial Sequence
  Synthetic
gtgatcagccuccctgugg

SEQ ID NO: 21793 - DNA, 23 bp, Artificial Sequence
  Synthetic
ccacggacaaugatcaugaccag

SEQ ID NO: 21794 - DNA, 30 bp, Artificial Sequence
  Synthetic
acuaagatttgtaattaugccaagaaacca

SEQ ID NO: 21795 - DNA, 26 bp, Artificial Sequence
  Synthetic
gaaatacgccaguaccgaaugaaaaa

SEQ ID NO: 21796 - DNA, 32 bp, Artificial Sequence
  Synthetic
acaaagatcatccuttcagagaaaataaugct

SEQ ID NO: 21797 - DNA, 25 bp, Artificial Sequence
  Synthetic
catactggauacagcuggacaagaa

SEQ ID NO: 21798 - DNA, 27 bp, Artificial Sequence
  Synthetic
tcttctctttccuacctctagaagcug

SEQ ID NO: 21799 - DNA, 24 bp, Artificial Sequence
  Synthetic
ccacacaacaacaugcaggttuat

SEQ ID NO: 21800 - DNA, 21 bp, Artificial Sequence
  Synthetic
gcugggaaaggatgauaggct

SEQ ID NO: 21801 - DNA, 17 bp, Artificial Sequence
  Synthetic
cccuccagctgtugcgg

SEQ ID NO: 21802 - DNA, 21 bp, Artificial Sequence
  Synthetic
cactgccuggagacacaaugt

SEQ ID NO: 21803 - DNA, 21 bp, Artificial Sequence
  Synthetic
ccaaccctaugttggccacug

SEQ ID NO: 21804 - DNA, 22 bp, Artificial Sequence
  Synthetic
cccacagaugacaggugagaga

SEQ ID NO: 21805 - DNA, 24 bp, Artificial Sequence
  Synthetic
accattttgccaaucgagacauca

SEQ ID NO: 21806 - DNA, 27 bp, Artificial Sequence
  Synthetic
agttctctaagggucacgtaactcuat

SEQ ID NO: 21807 - DNA, 22 bp, Artificial Sequence
  Synthetic
tggtggcagaacugatcaacug

SEQ ID NO: 21808 - DNA, 26 bp, Artificial Sequence
  Synthetic
gtcugtgatgatgtuagcagaagagt

SEQ ID NO: 21809 - DNA, 26 bp, Artificial Sequence
  Synthetic
caaccatagggutaactaccttcucc

SEQ ID NO: 21810 - DNA, 22 bp, Artificial Sequence
  Synthetic
tcatcgacccagugttcactug

SEQ ID NO: 21811 - DNA, 23 bp, Artificial Sequence
  Synthetic
tgtaatauagccacgggagtgug

SEQ ID NO: 21812 - DNA, 21 bp, Artificial Sequence
  Synthetic
cccccaautgacactctuccc

SEQ ID NO: 21813 - DNA, 23 bp, Artificial Sequence
  Synthetic
ccagtgugttcaagacucagacc

SEQ ID NO: 21814 - DNA, 20 bp, Artificial Sequence
  Synthetic
ccuggagcagttgtucaggt

SEQ ID NO: 21815 - DNA, 24 bp, Artificial Sequence
  Synthetic
tgacaaatactgugcagaccacut

SEQ ID NO: 21816 - DNA, 20 bp, Artificial Sequence
  Synthetic
cctcaucacagacgccaucc

SEQ ID NO: 21817 - DNA, 24 bp, Artificial Sequence
  Synthetic
cctccttattacucctgccagugt

SEQ ID NO: 21818 - DNA, 24 bp, Artificial Sequence
  Synthetic
tgaaaccaucaggcatgttacugg

SEQ ID NO: 21819 - DNA, 27 bp, Artificial Sequence
  Synthetic
caaagtttgtugagtaacttgcaguga

SEQ ID NO: 21820 - DNA, 23 bp, Artificial Sequence
  Synthetic
acttaagacaaugccctggaugg

SEQ ID NO: 21821 - DNA, 26 bp, Artificial Sequence
  Synthetic
ctatcagggtgucaactgtgagtaug

SEQ ID NO: 21822 - DNA, 26 bp, Artificial Sequence
  Synthetic
tgataccttcuctaaatgccacugga

SEQ ID NO: 21823 - DNA, 21 bp, Artificial Sequence
  Synthetic
gcctatguccatctggauggg

SEQ ID NO: 21824 - DNA, 24 bp, Artificial Sequence
  Synthetic
tctccctttcuctcgtaagaugct

SEQ ID NO: 21825 - DNA, 22 bp, Artificial Sequence
  Synthetic
gtaagaauggagggacctgcuc

SEQ ID NO: 21826 - DNA, 24 bp, Artificial Sequence
  Synthetic
gttauggcagagaccatggtucat

SEQ ID NO: 21827 - DNA, 21 bp, Artificial Sequence
  Synthetic
gaauagctccaugcaccccaa

SEQ ID NO: 21828 - DNA, 21 bp, Artificial Sequence
  Synthetic
caggtuccttggtucaggcat

SEQ ID NO: 21829 - DNA, 28 bp, Artificial Sequence
  Synthetic
tttctgatgtgtucagtttttaccccua

SEQ ID NO: 21830 - DNA, 21 bp, Artificial Sequence
  Synthetic
cacccacugagacctccagua

SEQ ID NO: 21831 - DNA, 20 bp, Artificial Sequence
  Synthetic
cctccaauccctgucgcaag

SEQ ID NO: 21832 - DNA, 21 bp, Artificial Sequence
  Synthetic
gttgcacuggtagccatugac

SEQ ID NO: 21833 - DNA, 22 bp, Artificial Sequence
  Synthetic
catggtcagugtcaggatggua

SEQ ID NO: 21834 - DNA, 23 bp, Artificial Sequence
  Synthetic
acacattctcuccctgctctcut

SEQ ID NO: 21835 - DNA, 23 bp, Artificial Sequence
  Synthetic
gagcaacccutgtgtgaacaaug

SEQ ID NO: 21836 - DNA, 28 bp, Artificial Sequence
  Synthetic
tgcttctacaguaaaatgtgcttcagut

SEQ ID NO: 21837 - DNA, 23 bp, Artificial Sequence
  Synthetic
caatatauttgcaccugcccaca

SEQ ID NO: 21838 - DNA, 21 bp, Artificial Sequence
  Synthetic
cccccatttugacaggcatug

SEQ ID NO: 21839 - DNA, 25 bp, Artificial Sequence
  Synthetic
tttcagacaggucacatgaagauga

SEQ ID NO: 21840 - DNA, 21 bp, Artificial Sequence
  Synthetic
aggtgccuccatugacacaag

SEQ ID NO: 21841 - DNA, 24 bp, Artificial Sequence
  Synthetic
caatgagugtgacatuccaggaca

SEQ ID NO: 21842 - DNA, 21 bp, Artificial Sequence
  Synthetic
cgactugacaggtgcacucat

SEQ ID NO: 21843 - DNA, 20 bp, Artificial Sequence
  Synthetic
ccgatgtgccucagggttua

SEQ ID NO: 21844 - DNA, 26 bp, Artificial Sequence
  Synthetic
attgtggtagguaacacacattccut

SEQ ID NO: 21845 - DNA, 22 bp, Artificial Sequence
  Synthetic
aggtgggaaugaatgctgauct

SEQ ID NO: 21846 - DNA, 18 bp, Artificial Sequence
  Synthetic
ccuggaaggcaaggguca

SEQ ID NO: 21847 - DNA, 21 bp, Artificial Sequence
  Synthetic
gctttggucaccacgtagcuc

SEQ ID NO: 21848 - DNA, 25 bp, Artificial Sequence
  Synthetic
tcctgattttcuggaaaagctguga

SEQ ID NO: 21849 - DNA, 22 bp, Artificial Sequence
  Synthetic
cttccctccucaccatgttcug

SEQ ID NO: 21850 - DNA, 21 bp, Artificial Sequence
  Synthetic
ctgggcccuttagttgccaua

SEQ ID NO: 21851 - DNA, 21 bp, Artificial Sequence
  Synthetic
gtggttgccuttacccccuag

SEQ ID NO: 21852 - DNA, 23 bp, Artificial Sequence
  Synthetic
tagctucccatgatcuccacaac

SEQ ID NO: 21853 - DNA, 22 bp, Artificial Sequence
  Synthetic
tctttgaguccctccagucaga

SEQ ID NO: 21854 - DNA, 20 bp, Artificial Sequence
  Synthetic
ctgccttuccaccttcuggt

SEQ ID NO: 21855 - DNA, 27 bp, Artificial Sequence
  Synthetic
tggccccatgauaataaatcaatccug

SEQ ID NO: 21856 - DNA, 20 bp, Artificial Sequence
  Synthetic
gttccagtugctcccguagg

SEQ ID NO: 21857 - DNA, 22 bp, Artificial Sequence
  Synthetic
ggattctccauctcccaccuct

SEQ ID NO: 21858 - DNA, 22 bp, Artificial Sequence
  Synthetic
cacacaaaugcagaagtgcuca

SEQ ID NO: 21859 - DNA, 18 bp, Artificial Sequence
  Synthetic
aggcaccautgcccucag

SEQ ID NO: 21860 - DNA, 23 bp, Artificial Sequence
  Synthetic
cctgtttccugagttctccacuc

SEQ ID NO: 21861 - DNA, 20 bp, Artificial Sequence
  Synthetic
aagcctgcuctgacauggac

SEQ ID NO: 21862 - DNA, 23 bp, Artificial Sequence
  Synthetic
ctgagagtatuccaaagcccugt

SEQ ID NO: 21863 - DNA, 28 bp, Artificial Sequence
  Synthetic
tcctaaggagcaaugacattgactacua

SEQ ID NO: 21864 - DNA, 24 bp, Artificial Sequence
  Synthetic
gatgagactcuccaggtcctttut

SEQ ID NO: 21865 - DNA, 28 bp, Artificial Sequence
  Synthetic
gtgattatucgtctagtcuggaaagacc

SEQ ID NO: 21866 - DNA, 19 bp, Artificial Sequence
  Synthetic
cccacacccugtgctctua

SEQ ID NO: 21867 - DNA, 23 bp, Artificial Sequence
  Synthetic
ctgtaacaccugcttctctuccc

SEQ ID NO: 21868 - DNA, 26 bp, Artificial Sequence
  Synthetic
ttttcactcaatcuaagcccacacut

SEQ ID NO: 21869 - DNA, 26 bp, Artificial Sequence
  Synthetic
gaataaacacagaacuggttggtucc

SEQ ID NO: 21870 - DNA, 22 bp, Artificial Sequence
  Synthetic
ctttcagcuccgcattcucaag

SEQ ID NO: 21871 - DNA, 22 bp, Artificial Sequence
  Synthetic
tgagttaatugcgggcugagat

SEQ ID NO: 21872 - DNA, 18 bp, Artificial Sequence
  Synthetic
ccgagcagcccutcgaug

SEQ ID NO: 21873 - DNA, 29 bp, Artificial Sequence
  Synthetic
ctttgcccctatutattctctgtagcuat

SEQ ID NO: 21874 - DNA, 21 bp, Artificial Sequence
  Synthetic
cgcuccaagcttctuccaaga

SEQ ID NO: 21875 - DNA, 24 bp, Artificial Sequence
  Synthetic
ggctaatccacuttccttccaugt

SEQ ID NO: 21876 - DNA, 21 bp, Artificial Sequence
  Synthetic
ggcgttccauagctggtaugt

SEQ ID NO: 21877 - DNA, 28 bp, Artificial Sequence
  Synthetic
ggcagaatattucaagacatttgtuccc

SEQ ID NO: 21878 - DNA, 30 bp, Artificial Sequence
  Synthetic
gagaaaagagtctuggccaaacctataaua

SEQ ID NO: 21879 - DNA, 24 bp, Artificial Sequence
  Synthetic
acutcattgacugccaaagaggat

SEQ ID NO: 21880 - DNA, 30 bp, Artificial Sequence
  Synthetic
gcttcctattugcagactataaatgcacua

SEQ ID NO: 21881 - DNA, 22 bp, Artificial Sequence
  Synthetic
atgctgcaggaccutctaagug

SEQ ID NO: 21882 - DNA, 25 bp, Artificial Sequence
  Synthetic
caccaagucagagataggtttugct

SEQ ID NO: 21883 - DNA, 29 bp, Artificial Sequence
  Synthetic
gggctatagaugaaaaattctctgctcua

SEQ ID NO: 21884 - DNA, 27 bp, Artificial Sequence
  Synthetic
caaatutcagagttctaugagcccagt

SEQ ID NO: 21885 - DNA, 23 bp, Artificial Sequence
  Synthetic
gaataagagucaacagcutcgug

SEQ ID NO: 21886 - DNA, 25 bp, Artificial Sequence
  Synthetic
actgagcucccacaaagacuaaaaa

SEQ ID NO: 21887 - DNA, 25 bp, Artificial Sequence
  Synthetic
aggtcaaaaugacacaauggcaaag

SEQ ID NO: 21888 - DNA, 24 bp, Artificial Sequence
  Synthetic
cagtcacatccucaggaaaaccut

SEQ ID NO: 21889 - DNA, 26 bp, Artificial Sequence
  Synthetic
gctgaaacaacaaaagcugaatucac

SEQ ID NO: 21890 - DNA, 19 bp, Artificial Sequence
  Synthetic
tggaaucggaagcctgcuc

SEQ ID NO: 21891 - DNA, 23 bp, Artificial Sequence
  Synthetic
tgaggagacugagagaagugcaa

SEQ ID NO: 21892 - DNA, 21 bp, Artificial Sequence
  Synthetic
ggttuccagggccttcugaac

SEQ ID NO: 21893 - DNA, 22 bp, Artificial Sequence
  Synthetic
gacggttgacaugtccgtctua

SEQ ID NO: 21894 - DNA, 22 bp, Artificial Sequence
  Synthetic
gaacctggagautgagctugga

SEQ ID NO: 21895 - DNA, 21 bp, Artificial Sequence
  Synthetic
attgagtggucacccaguagc

SEQ ID NO: 21896 - DNA, 20 bp, Artificial Sequence
  Synthetic
accgaaggcaccuacttguc

SEQ ID NO: 21897 - DNA, 19 bp, Artificial Sequence
  Synthetic
gatggcagcuctgguggaa

SEQ ID NO: 21898 - DNA, 18 bp, Artificial Sequence
  Synthetic
tctgttgcaugcgcucct

SEQ ID NO: 21899 - DNA, 20 bp, Artificial Sequence
  Synthetic
gcaccatgutcctgggtuga

SEQ ID NO: 21900 - DNA, 20 bp, Artificial Sequence
  Synthetic
gcccacagcauccttaccug

SEQ ID NO: 21901 - DNA, 21 bp, Artificial Sequence
  Synthetic
ggtgtctuctcctcgauccct

SEQ ID NO: 21902 - DNA, 18 bp, Artificial Sequence
  Synthetic
cagccaaagucgcaucgg

SEQ ID NO: 21903 - DNA, 17 bp, Artificial Sequence
  Synthetic
ccuggcagucccggaag

SEQ ID NO: 21904 - DNA, 21 bp, Artificial Sequence
  Synthetic
agtggtgugagcagtaagcuc

SEQ ID NO: 21905 - DNA, 22 bp, Artificial Sequence
  Synthetic
ccttctctugtgttccccucct

SEQ ID NO: 21906 - DNA, 24 bp, Artificial Sequence
  Synthetic
gctcaccuccttgagtttaucagt

SEQ ID NO: 21907 - DNA, 29 bp, Artificial Sequence
  Synthetic
ttagtgcaagaggauattcaatgtaagut

SEQ ID NO: 21908 - DNA, 26 bp, Artificial Sequence
  Synthetic
gggaagggauaaattggtaaugacaa

SEQ ID NO: 21909 - DNA, 26 bp, Artificial Sequence
  Synthetic
gtaaatggcucctttgcttcacuaag

SEQ ID NO: 21910 - DNA, 18 bp, Artificial Sequence
  Synthetic
ctccugagcacgguccag

SEQ ID NO: 21911 - DNA, 26 bp, Artificial Sequence
  Synthetic
gctttttcatgguagtcaacccugat

SEQ ID NO: 21912 - DNA, 21 bp, Artificial Sequence
  Synthetic
ttctctgccagutccagctuc

SEQ ID NO: 21913 - DNA, 23 bp, Artificial Sequence
  Synthetic
caaccctgcautgttgtgttugt

SEQ ID NO: 21914 - DNA, 17 bp, Artificial Sequence
  Synthetic
cucatcugccggcaagg

SEQ ID NO: 21915 - DNA, 19 bp, Artificial Sequence
  Synthetic
cuaaagcgggcccagaugt

SEQ ID NO: 21916 - DNA, 26 bp, Artificial Sequence
  Synthetic
ctgttgttttuggtgttgctaguaca

SEQ ID NO: 21917 - DNA, 26 bp, Artificial Sequence
  Synthetic
ctgttagtctctutcacagtcaggut

SEQ ID NO: 21918 - DNA, 21 bp, Artificial Sequence
  Synthetic
gagccatacccutaccccauc

SEQ ID NO: 21919 - DNA, 20 bp, Artificial Sequence
  Synthetic
tgtagtcguccccaggctua

SEQ ID NO: 21920 - DNA, 26 bp, Artificial Sequence
  Synthetic
gagggagagaagaaaucaactttgug

SEQ ID NO: 21921 - DNA, 23 bp, Artificial Sequence
  Synthetic
ttcccaagcugaccactcaauag

SEQ ID NO: 21922 - DNA, 22 bp, Artificial Sequence
  Synthetic
gtcacugacacagagugcagat

SEQ ID NO: 21923 - DNA, 27 bp, Artificial Sequence
  Synthetic
agagagagagaaugaaaaugaggagua

SEQ ID NO: 21924 - DNA, 19 bp, Artificial Sequence
  Synthetic
gtgggcaugggaacucaag

SEQ ID NO: 21925 - DNA, 19 bp, Artificial Sequence
  Synthetic
acagtccccguttcccuca

SEQ ID NO: 21926 - DNA, 21 bp, Artificial Sequence
  Synthetic
ggaaccctcugcactgttcut

SEQ ID NO: 21927 - DNA, 20 bp, Artificial Sequence
  Synthetic
ccttacaccaccucccucac

SEQ ID NO: 21928 - DNA, 20 bp, Artificial Sequence
  Synthetic
gacctccugctgttgctcut

SEQ ID NO: 21929 - DNA, 20 bp, Artificial Sequence
  Synthetic
cuggtctcatugagcacgga

SEQ ID NO: 21930 - DNA, 22 bp, Artificial Sequence
  Synthetic
gggttacuggaggctacagugt

SEQ ID NO: 21931 - DNA, 25 bp, Artificial Sequence
  Synthetic
gcacaagctuctacttcctatcuca

SEQ ID NO: 21932 - DNA, 19 bp, Artificial Sequence
  Synthetic
agacaguccccgcuacaac

SEQ ID NO: 21933 - DNA, 21 bp, Artificial Sequence
  Synthetic
cucagcaaggaagacctuccc

SEQ ID NO: 21934 - DNA, 23 bp, Artificial Sequence
  Synthetic
ggagttctaucctcccagccuat

SEQ ID NO: 21935 - DNA, 18 bp, Artificial Sequence
  Synthetic
cccgccagguacaccauc

SEQ ID NO: 21936 - DNA, 17 bp, Artificial Sequence
  Synthetic
ctugacgggctguccca

SEQ ID NO: 21937 - DNA, 21 bp, Artificial Sequence
  Synthetic
cgctctcgguggtgaactuac

SEQ ID NO: 21938 - DNA, 21 bp, Artificial Sequence
  Synthetic
ctacctggaugtcctgggcua

SEQ ID NO: 21939 - DNA, 19 bp, Artificial Sequence
  Synthetic
caccugtccctucccacat

SEQ ID NO: 21940 - DNA, 27 bp, Artificial Sequence
  Synthetic
ttgtgtgtttctutacagttggtcuct

SEQ ID NO: 21941 - DNA, 27 bp, Artificial Sequence
  Synthetic
cagccaagttttucaaagaagcacaua

SEQ ID NO: 21942 - DNA, 24 bp, Artificial Sequence
  Synthetic
gaccuaggaaaagguctgaagaut

SEQ ID NO: 21943 - DNA, 28 bp, Artificial Sequence
  Synthetic
gaatgacaaacagaaagaugggtgaaug

SEQ ID NO: 21944 - DNA, 17 bp, Artificial Sequence
  Synthetic
gggcugccgtagcctut

SEQ ID NO: 21945 - DNA, 22 bp, Artificial Sequence
  Synthetic
gtctccaatgucctgcttccuc

SEQ ID NO: 21946 - DNA, 18 bp, Artificial Sequence
  Synthetic
gctgaugcggcuggacaa

SEQ ID NO: 21947 - DNA, 23 bp, Artificial Sequence
  Synthetic
gtctgatcugtgagagttuggct

SEQ ID NO: 21948 - DNA, 28 bp, Artificial Sequence
  Synthetic
ggtgtgagccuttttgttattattucct

SEQ ID NO: 21949 - DNA, 23 bp, Artificial Sequence
  Synthetic
gctaactccuctttggcttccuc

SEQ ID NO: 21950 - DNA, 21 bp, Artificial Sequence
  Synthetic
gcuaccaatgtgucagcccat

SEQ ID NO: 21951 - DNA, 23 bp, Artificial Sequence
  Synthetic
tcccaatguaggaacagccagua

SEQ ID NO: 21952 - DNA, 22 bp, Artificial Sequence
  Synthetic
acccaatcucagaggacugact

SEQ ID NO: 21953 - DNA, 19 bp, Artificial Sequence
  Synthetic
ggaugcgattgcugggaga

SEQ ID NO: 21954 - DNA, 25 bp, Artificial Sequence
  Synthetic
gaaaaagaactuctccgtcagucac

SEQ ID NO: 21955 - DNA, 17 bp, Artificial Sequence
  Synthetic
catgcgccccucacuca

SEQ ID NO: 21956 - DNA, 22 bp, Artificial Sequence
  Synthetic
tcctacucaggagacgtgacug

SEQ ID NO: 21957 - DNA, 22 bp, Artificial Sequence
  Synthetic
ccgcugagaaacatguggaagt

SEQ ID NO: 21958 - DNA, 20 bp, Artificial Sequence
  Synthetic
ccaggugccaacagucaact

SEQ ID NO: 21959 - DNA, 27 bp, Artificial Sequence
  Synthetic
tctgccatggucccaatattttagtuc

SEQ ID NO: 21960 - DNA, 18 bp, Artificial Sequence
  Synthetic
gcgagguccaggcagaug

SEQ ID NO: 21961 - DNA, 21 bp, Artificial Sequence
  Synthetic
ctggagcucccttccctaaug

SEQ ID NO: 21962 - DNA, 19 bp, Artificial Sequence
  Synthetic
gactgcucgagugccgaat

SEQ ID NO: 21963 - DNA, 20 bp, Artificial Sequence
  Synthetic
ctcccaggcuctgtctgaug

SEQ ID NO: 21964 - DNA, 17 bp, Artificial Sequence
  Synthetic
cggcauggacagcagug

SEQ ID NO: 21965 - DNA, 21 bp, Artificial Sequence
  Synthetic
cctgcucaccctcatctucct

SEQ ID NO: 21966 - DNA, 22 bp, Artificial Sequence
  Synthetic
ggaugagaaagaggcucagcag

SEQ ID NO: 21967 - DNA, 28 bp, Artificial Sequence
  Synthetic
ccattgactcauactacttcccttctug

SEQ ID NO: 21968 - DNA, 26 bp, Artificial Sequence
  Synthetic
gagttactgtcugccaacattaguga

SEQ ID NO: 21969 - DNA, 26 bp, Artificial Sequence
  Synthetic
tgucttaauaacaaaguacacagcca

SEQ ID NO: 21970 - DNA, 28 bp, Artificial Sequence
  Synthetic
gctacttaggtuacaatcaggaggaaut

SEQ ID NO: 21971 - DNA, 32 bp, Artificial Sequence
  Synthetic
atataaggagaagauacagagagctagtatuc

SEQ ID NO: 21972 - DNA, 29 bp, Artificial Sequence
  Synthetic
cattaatggcgagugatagatauaaacca

SEQ ID NO: 21973 - DNA, 26 bp, Artificial Sequence
  Synthetic
tgcttggtcauaaaggattcuacacc

SEQ ID NO: 21974 - DNA, 24 bp, Artificial Sequence
  Synthetic
ctccagccccucctatagatucat

SEQ ID NO: 21975 - DNA, 28 bp, Artificial Sequence
  Synthetic
tgaagctctccaaauaagtagtaccugt

SEQ ID NO: 21976 - DNA, 19 bp, Artificial Sequence
  Synthetic
tgcucacccggaagucaga

SEQ ID NO: 21977 - DNA, 23 bp, Artificial Sequence
  Synthetic
ttgccaauccagaagtaaccugt

SEQ ID NO: 21978 - DNA, 31 bp, Artificial Sequence
  Synthetic
ccaaagataacaaagagautgcctcaattut

SEQ ID NO: 21979 - DNA, 28 bp, Artificial Sequence
  Synthetic
cactagtttgtgacuggtttgagaguat

SEQ ID NO: 21980 - DNA, 29 bp, Artificial Sequence
  Synthetic
ccagtataaaacuagaactggatgctuca

SEQ ID NO: 21981 - DNA, 25 bp, Artificial Sequence
  Synthetic
tggatccatcugttctttctttucc

SEQ ID NO: 21982 - DNA, 28 bp, Artificial Sequence
  Synthetic
tcctccacugagataatgacttctuacc

SEQ ID NO: 21983 - DNA, 31 bp, Artificial Sequence
  Synthetic
ctgatttactctgauttatagctgtcacugt

SEQ ID NO: 21984 - DNA, 30 bp, Artificial Sequence
  Synthetic
ttctagaaauacggaaguatgttacttaut

SEQ ID NO: 21985 - DNA, 20 bp, Artificial Sequence
  Synthetic
tgatcaaagguggcgtugct

SEQ ID NO: 21986 - DNA, 28 bp, Artificial Sequence
  Synthetic
ttgtgttactttauaaggcccgtgtuat

SEQ ID NO: 21987 - DNA, 22 bp, Artificial Sequence
  Synthetic
atttgctgtugcatgcctgauc

SEQ ID NO: 21988 - DNA, 21 bp, Artificial Sequence
  Synthetic
gaacaaccuccctccctcauc

SEQ ID NO: 21989 - DNA, 23 bp, Artificial Sequence
  Synthetic
ggatgctucaggatttgctgcua

SEQ ID NO: 21990 - DNA, 24 bp, Artificial Sequence
  Synthetic
tcagagutctcttcuccagcaaac

SEQ ID NO: 21991 - DNA, 29 bp, Artificial Sequence
  Synthetic
caaggatttaucacagtatcaaggaugct

SEQ ID NO: 21992 - DNA, 24 bp, Artificial Sequence
  Synthetic
gataaatgaucccgcacugagaca

SEQ ID NO: 21993 - DNA, 25 bp, Artificial Sequence
  Synthetic
atgacctctgugcatctagaguaca

SEQ ID NO: 21994 - DNA, 21 bp, Artificial Sequence
  Synthetic
cagaagagccucctucagcag

SEQ ID NO: 21995 - DNA, 27 bp, Artificial Sequence
  Synthetic
atggctgcagautgagataucaaaaat

SEQ ID NO: 21996 - DNA, 21 bp, Artificial Sequence
  Synthetic
aggactcccagcuttcaggua

SEQ ID NO: 21997 - DNA, 20 bp, Artificial Sequence
  Synthetic
ccctacucctccuacagcga

SEQ ID NO: 21998 - DNA, 25 bp, Artificial Sequence
  Synthetic
atccaaaaagguggagcuagauaaa

SEQ ID NO: 21999 - DNA, 22 bp, Artificial Sequence
  Synthetic
acccctctcuccttgttgtcuc

SEQ ID NO: 22000 - DNA, 20 bp, Artificial Sequence
  Synthetic
gcataggccuctgggtagug

SEQ ID NO: 22001 - DNA, 21 bp, Artificial Sequence
  Synthetic
tgatcaggauagcugccgact

SEQ ID NO: 22002 - DNA, 24 bp, Artificial Sequence
  Synthetic
tgtacacgagcaugtgtgtgtauc

SEQ ID NO: 22003 - DNA, 25 bp, Artificial Sequence
  Synthetic
catggccttucttctcttcaucaca

SEQ ID NO: 22004 - DNA, 19 bp, Artificial Sequence
  Synthetic
gatgucgcagggcctuaca

SEQ ID NO: 22005 - DNA, 22 bp, Artificial Sequence
  Synthetic
caaactccuacctgacccugac

SEQ ID NO: 22006 - DNA, 26 bp, Artificial Sequence
  Synthetic
cttcgagatauaaggtgctgagtugt

SEQ ID NO: 22007 - DNA, 31 bp, Artificial Sequence
  Synthetic
tcagaatugcagaaaaagaaaacuggaaaat

SEQ ID NO: 22008 - DNA, 27 bp, Artificial Sequence
  Synthetic
cttgaatgttugtcttttgtgaauggg

SEQ ID NO: 22009 - DNA, 28 bp, Artificial Sequence
  Synthetic
ggtcctaaaacaccaguacattcttcug

SEQ ID NO: 22010 - DNA, 26 bp, Artificial Sequence
  Synthetic
gggctcagcuatgaaagcagaauaaa

SEQ ID NO: 22011 - DNA, 30 bp, Artificial Sequence
  Synthetic
ctgtagtccacautttcttaatgctttuga

SEQ ID NO: 22012 - DNA, 25 bp, Artificial Sequence
  Synthetic
gataatagcucctcccaaactugct

SEQ ID NO: 22013 - DNA, 22 bp, Artificial Sequence
  Synthetic
tcggctacguttcagtcactug

SEQ ID NO: 22014 - DNA, 26 bp, Artificial Sequence
  Synthetic
cagtgtttccutaaacctgccauaac

SEQ ID NO: 22015 - DNA, 26 bp, Artificial Sequence
  Synthetic
gcctttttcgcucagttacaacuaga

SEQ ID NO: 22016 - DNA, 23 bp, Artificial Sequence
  Synthetic
ccatttgucctgttggucaggaa

SEQ ID NO: 22017 - DNA, 28 bp, Artificial Sequence
  Synthetic
caataagctcutttacaacacugaccac

SEQ ID NO: 22018 - DNA, 32 bp, Artificial Sequence
  Synthetic
cccatcgcaatauctaaagtgttagttttaut

SEQ ID NO: 22019 - DNA, 28 bp, Artificial Sequence
  Synthetic
aaagctacuttcttacctugaccaagat

SEQ ID NO: 22020 - DNA, 27 bp, Artificial Sequence
  Synthetic
agctgaggaugaatgcaaaatauagga

SEQ ID NO: 22021 - DNA, 20 bp, Artificial Sequence
  Synthetic
cagcaguccccagaacugac

SEQ ID NO: 22022 - DNA, 28 bp, Artificial Sequence
  Synthetic
ctcagttgaattugctgggttttatugt

SEQ ID NO: 22023 - DNA, 26 bp, Artificial Sequence
  Synthetic
cagctguaggaacatcgatttucaga

SEQ ID NO: 22024 - DNA, 30 bp, Artificial Sequence
  Synthetic
tattcaaatgttgauacttcagtcatucca

SEQ ID NO: 22025 - DNA, 30 bp, Artificial Sequence
  Synthetic
tgttagaaattucactactacaaugaccat

SEQ ID NO: 22026 - DNA, 27 bp, Artificial Sequence
  Synthetic
gaaaactctucggaaatttcugcagat

SEQ ID NO: 22027 - DNA, 30 bp, Artificial Sequence
  Synthetic
aagattcatttgtucagggattggataaut

SEQ ID NO: 22028 - DNA, 32 bp, Artificial Sequence
  Synthetic
tttctattcttagauatgaagagaaggcuact

SEQ ID NO: 22029 - DNA, 22 bp, Artificial Sequence
  Synthetic
gcgctggugggttttatcttut

SEQ ID NO: 22030 - DNA, 24 bp, Artificial Sequence
  Synthetic
ccttgcttgauccacaatcucagg

SEQ ID NO: 22031 - DNA, 24 bp, Artificial Sequence
  Synthetic
tggctcugcaggaagtttatgaut

SEQ ID NO: 22032 - DNA, 30 bp, Artificial Sequence
  Synthetic
ttttaatggacaugttctggaataugaact

SEQ ID NO: 22033 - DNA, 24 bp, Artificial Sequence
  Synthetic
tgctacuccatagaaugggagaca

SEQ ID NO: 22034 - DNA, 30 bp, Artificial Sequence
  Synthetic
aatgaagcaccaguttggaaatgaaatuaa

SEQ ID NO: 22035 - DNA, 25 bp, Artificial Sequence
  Synthetic
tcaugctgttttaugacagaaccaa

SEQ ID NO: 22036 - DNA, 26 bp, Artificial Sequence
  Synthetic
gaggaattugcaacgagagatugaaa

SEQ ID NO: 22037 - DNA, 22 bp, Artificial Sequence
  Synthetic
tgggaaattccuggaaccctug

SEQ ID NO: 22038 - DNA, 30 bp, Artificial Sequence
  Synthetic
agtagtgaccagguttagaatatctttucc

SEQ ID NO: 22039 - DNA, 25 bp, Artificial Sequence
  Synthetic
caccagctcuggagacatauagagt

SEQ ID NO: 22040 - DNA, 22 bp, Artificial Sequence
  Synthetic
caaguggacacagggactaugg

SEQ ID NO: 22041 - DNA, 21 bp, Artificial Sequence
  Synthetic
gatgggccugttcgtccttua

SEQ ID NO: 22042 - DNA, 23 bp, Artificial Sequence
  Synthetic
gtcataggttuggaacccgtuct

SEQ ID NO: 22043 - DNA, 22 bp, Artificial Sequence
  Synthetic
agtaagagacccuagggcucac

SEQ ID NO: 22044 - DNA, 21 bp, Artificial Sequence
  Synthetic
ccagctgcagugattctgtug

SEQ ID NO: 22045 - DNA, 28 bp, Artificial Sequence
  Synthetic
agataaauccaagaaaaagaacctcugt

SEQ ID NO: 22046 - DNA, 26 bp, Artificial Sequence
  Synthetic
tttttacacuaagcccagtcttcuga

SEQ ID NO: 22047 - DNA, 21 bp, Artificial Sequence
  Synthetic
catccaagacaaccugctgug

SEQ ID NO: 22048 - DNA, 24 bp, Artificial Sequence
  Synthetic
catgtggauaggattgagcctuca

SEQ ID NO: 22049 - DNA, 26 bp, Artificial Sequence
  Synthetic
gtgatgccaggagutaagaggatuac

SEQ ID NO: 22050 - DNA, 24 bp, Artificial Sequence
  Synthetic
gcctgtccugaatgccattuagat

SEQ ID NO: 22051 - DNA, 20 bp, Artificial Sequence
  Synthetic
cattccaugggctggagguc

SEQ ID NO: 22052 - DNA, 20 bp, Artificial Sequence
  Synthetic
gttttguggcaccgcttcuc

SEQ ID NO: 22053 - DNA, 25 bp, Artificial Sequence
  Synthetic
agagagaucaatgcacucccaaaaa

SEQ ID NO: 22054 - DNA, 20 bp, Artificial Sequence
  Synthetic
cctttgcgcuggacauggat

SEQ ID NO: 22055 - DNA, 26 bp, Artificial Sequence
  Synthetic
attagaggauacaaggttggctauct

SEQ ID NO: 22056 - DNA, 22 bp, Artificial Sequence
  Synthetic
ggcacacacutataggctccug

SEQ ID NO: 22057 - DNA, 19 bp, Artificial Sequence
  Synthetic
cugcatugcccacagcaaa

SEQ ID NO: 22058 - DNA, 22 bp, Artificial Sequence
  Synthetic
ccaccatttcugagcctcaugt

SEQ ID NO: 22059 - DNA, 24 bp, Artificial Sequence
  Synthetic
gaatgagttucctgcagtgttugg

SEQ ID NO: 22060 - DNA, 28 bp, Artificial Sequence
  Synthetic
ccattgcctuaaaatgttgcatttguct

SEQ ID NO: 22061 - DNA, 28 bp, Artificial Sequence
  Synthetic
acaaaggagagugattgattttctucct

SEQ ID NO: 22062 - DNA, 21 bp, Artificial Sequence
  Synthetic
ccaggagaaautgcccccuaa

SEQ ID NO: 22063 - DNA, 22 bp, Artificial Sequence
  Synthetic
acagtcugccaacatctcaguc

SEQ ID NO: 22064 - DNA, 23 bp, Artificial Sequence
  Synthetic
ggaggcacaaagcugtctgtaua

SEQ ID NO: 22065 - DNA, 20 bp, Artificial Sequence
  Synthetic
ccgtucacagaccucaaccg

SEQ ID NO: 22066 - DNA, 24 bp, Artificial Sequence
  Synthetic
ttgtttgtttccugtctggacuga

SEQ ID NO: 22067 - DNA, 29 bp, Artificial Sequence
  Synthetic
cttttgagagaacucattaccctgacaut

SEQ ID NO: 22068 - DNA, 25 bp, Artificial Sequence
  Synthetic
tctctcctttaaugcgaggaaacuc

SEQ ID NO: 22069 - DNA, 26 bp, Artificial Sequence
  Synthetic
gctctcactcugttgccattaaaugt

SEQ ID NO: 22070 - DNA, 20 bp, Artificial Sequence
  Synthetic
ggtgatuacgtctgggucga

SEQ ID NO: 22071 - DNA, 27 bp, Artificial Sequence
  Synthetic
ggaaauccgagacaaattacucaagga

SEQ ID NO: 22072 - DNA, 20 bp, Artificial Sequence
  Synthetic
ggccatcuccacgatctugt

SEQ ID NO: 22073 - DNA, 29 bp, Artificial Sequence
  Synthetic
ctgttctttgcuttttattttccuccagt

SEQ ID NO: 22074 - DNA, 17 bp, Artificial Sequence
  Synthetic
cttctcggugggcguca

SEQ ID NO: 22075 - DNA, 21 bp, Artificial Sequence
  Synthetic
ccgagatgaugaccacctuca

SEQ ID NO: 22076 - DNA, 17 bp, Artificial Sequence
  Synthetic
cttcccgcuggccctua

SEQ ID NO: 22077 - DNA, 24 bp, Artificial Sequence
  Synthetic
gcaucaactacccugacaagaagg

SEQ ID NO: 22078 - DNA, 21 bp, Artificial Sequence
  Synthetic
gtaatccgagaugtgcuccgt

SEQ ID NO: 22079 - DNA, 22 bp, Artificial Sequence
  Synthetic
ggaaggtgccuccaattcaugt

SEQ ID NO: 22080 - DNA, 28 bp, Artificial Sequence
  Synthetic
tcctattcaauggcaataacaaugacga

SEQ ID NO: 22081 - DNA, 28 bp, Artificial Sequence
  Synthetic
agtcatcaaaaccaucatcatccaucat

SEQ ID NO: 22082 - DNA, 25 bp, Artificial Sequence
  Synthetic
tagctcaacuccaacaatgattugt

SEQ ID NO: 22083 - DNA, 28 bp, Artificial Sequence
  Synthetic
agatatcaattcagucgctggtgtttua

SEQ ID NO: 22084 - DNA, 23 bp, Artificial Sequence
  Synthetic
aagacagttuccatcacggugaa

SEQ ID NO: 22085 - DNA, 25 bp, Artificial Sequence
  Synthetic
cttttctttttcucctgctctgcug

SEQ ID NO: 22086 - DNA, 18 bp, Artificial Sequence
  Synthetic
ggcccaggaugccactua

SEQ ID NO: 22087 - DNA, 20 bp, Artificial Sequence
  Synthetic
tctccgaugcctuccaacac

SEQ ID NO: 22088 - DNA, 19 bp, Artificial Sequence
  Synthetic
ggcuccaggaggaagccua

SEQ ID NO: 22089 - DNA, 19 bp, Artificial Sequence
  Synthetic
cacgaagggcuggatguca

SEQ ID NO: 22090 - DNA, 19 bp, Artificial Sequence
  Synthetic
tttgugccctguccccaat

SEQ ID NO: 22091 - DNA, 24 bp, Artificial Sequence
  Synthetic
gcaggaggagaaguagutcaauaa

SEQ ID NO: 22092 - DNA, 20 bp, Artificial Sequence
  Synthetic
attgaggguggcatggtcuc

SEQ ID NO: 22093 - DNA, 23 bp, Artificial Sequence
  Synthetic
gacagutccaatguagccaacct

SEQ ID NO: 22094 - DNA, 29 bp, Artificial Sequence
  Synthetic
gcaatgatctcttugtctttcttgaacut

SEQ ID NO: 22095 - DNA, 22 bp, Artificial Sequence
  Synthetic
gtgaaaucgaccagagctgugt

SEQ ID NO: 22096 - DNA, 22 bp, Artificial Sequence
  Synthetic
guaggauaggagggaccccaaa

SEQ ID NO: 22097 - DNA, 24 bp, Artificial Sequence
  Synthetic
cctcagtctgagucagtgtccaua

SEQ ID NO: 22098 - DNA, 26 bp, Artificial Sequence
  Synthetic
cccatcgaaugccttttctctttuat

SEQ ID NO: 22099 - DNA, 24 bp, Artificial Sequence
  Synthetic
catggtaggugacatcaucaagct

SEQ ID NO: 22100 - DNA, 20 bp, Artificial Sequence
  Synthetic
tgcugcccttctuccacaag

SEQ ID NO: 22101 - DNA, 20 bp, Artificial Sequence
  Synthetic
ccagctguagtcacgtuggg

SEQ ID NO: 22102 - DNA, 21 bp, Artificial Sequence
  Synthetic
tggcccuaaaggactcuccag

SEQ ID NO: 22103 - DNA, 20 bp, Artificial Sequence
  Synthetic
cacctguaggaggguggagt

SEQ ID NO: 22104 - DNA, 24 bp, Artificial Sequence
  Synthetic
aaatcaagcagucagttugcacaa

SEQ ID NO: 22105 - DNA, 21 bp, Artificial Sequence
  Synthetic
ccctaccacucctcacugcat

SEQ ID NO: 22106 - DNA, 24 bp, Artificial Sequence
  Synthetic
tgttatgggugaaactcugggaga

SEQ ID NO: 22107 - DNA, 24 bp, Artificial Sequence
  Synthetic
ccuggaagacaaacuacaagagca

SEQ ID NO: 22108 - DNA, 21 bp, Artificial Sequence
  Synthetic
gccctgutgccttttuaggac

SEQ ID NO: 22109 - DNA, 21 bp, Artificial Sequence
  Synthetic
tgagggagtuggaaggctcut

SEQ ID NO: 22110 - DNA, 23 bp, Artificial Sequence
  Synthetic
cacagtgtgugttcagagcagua

SEQ ID NO: 22111 - DNA, 20 bp, Artificial Sequence
  Synthetic
gtcagcggacuctggatuca

SEQ ID NO: 22112 - DNA, 29 bp, Artificial Sequence
  Synthetic
gacatgaautccttaatgaugggagaaga

SEQ ID NO: 22113 - DNA, 23 bp, Artificial Sequence
  Synthetic
gcatactcugtgatctccugcac

SEQ ID NO: 22114 - DNA, 24 bp, Artificial Sequence
  Synthetic
ccccctgtugtgttttccataugt

SEQ ID NO: 22115 - DNA, 23 bp, Artificial Sequence
  Synthetic
ctgtcattttcuggagcagctug

SEQ ID NO: 22116 - DNA, 21 bp, Artificial Sequence
  Synthetic
tcttaccugaccacccaucct

SEQ ID NO: 22117 - DNA, 20 bp, Artificial Sequence
  Synthetic
ggaccuggagtgcaaugaga

SEQ ID NO: 22118 - DNA, 25 bp, Artificial Sequence
  Synthetic
aggaaauacatgtguaagccacact

SEQ ID NO: 22119 - DNA, 24 bp, Artificial Sequence
  Synthetic
gcatggctguttttgtctcttuct

SEQ ID NO: 22120 - DNA, 22 bp, Artificial Sequence
  Synthetic
ctgccctggugcaactattgua

SEQ ID NO: 22121 - DNA, 28 bp, Artificial Sequence
  Synthetic
ttttaucttttagagttaugcccagcca

SEQ ID NO: 22122 - DNA, 21 bp, Artificial Sequence
  Synthetic
ccatcactcugggccacauac

SEQ ID NO: 22123 - DNA, 24 bp, Artificial Sequence
  Synthetic
tctcctgcuccttatgatcaugct

SEQ ID NO: 22124 - DNA, 21 bp, Artificial Sequence
  Synthetic
aacucacacaggccactuacc

SEQ ID NO: 22125 - DNA, 28 bp, Artificial Sequence
  Synthetic
gacucctaataggucaagagagagagac

SEQ ID NO: 22126 - DNA, 24 bp, Artificial Sequence
  Synthetic
tgttttatcuggctgttctuggct

SEQ ID NO: 22127 - DNA, 23 bp, Artificial Sequence
  Synthetic
aaccagaagcugacgctgaaaua

SEQ ID NO: 22128 - DNA, 26 bp, Artificial Sequence
  Synthetic
cattagtttctugggagtgtctgugt

SEQ ID NO: 22129 - DNA, 22 bp, Artificial Sequence
  Synthetic
tcagacuaagactgctguccct

SEQ ID NO: 22130 - DNA, 28 bp, Artificial Sequence
  Synthetic
aggtaagtttcugctccaaagttucaat

SEQ ID NO: 22131 - DNA, 21 bp, Artificial Sequence
  Synthetic
tttgctgtgguaggtggaugg

SEQ ID NO: 22132 - DNA, 23 bp, Artificial Sequence
  Synthetic
tcaatggcuccttcaaaccuaac

SEQ ID NO: 22133 - DNA, 28 bp, Artificial Sequence
  Synthetic
tggagaggtacucgatcataaagagtut

SEQ ID NO: 22134 - DNA, 28 bp, Artificial Sequence
  Synthetic
gttgaguaaaagccgaguattctaatut

SEQ ID NO: 22135 - DNA, 27 bp, Artificial Sequence
  Synthetic
tctcatcgagauattaagcgaaugcag

SEQ ID NO: 22136 - DNA, 28 bp, Artificial Sequence
  Synthetic
cacagctaaagugtccttaatggaatug

SEQ ID NO: 22137 - DNA, 25 bp, Artificial Sequence
  Synthetic
accagattcccuaacagatgaucgt

SEQ ID NO: 22138 - DNA, 24 bp, Artificial Sequence
  Synthetic
cccagtctacuatctggcctgtut

SEQ ID NO: 22139 - DNA, 22 bp, Artificial Sequence
  Synthetic
ctctgggucacccaaatucaga

SEQ ID NO: 22140 - DNA, 23 bp, Artificial Sequence
  Synthetic
acuttgactgcuccgagaagaac

SEQ ID NO: 22141 - DNA, 28 bp, Artificial Sequence
  Synthetic
gtgattcagaagauacagattcggauga

SEQ ID NO: 22142 - DNA, 26 bp, Artificial Sequence
  Synthetic
cctcttgcaaacauttcccagauaac

SEQ ID NO: 22143 - DNA, 27 bp, Artificial Sequence
  Synthetic
ttctggatgcagugctaaagaguaaaa

SEQ ID NO: 22144 - DNA, 27 bp, Artificial Sequence
  Synthetic
tggttttgatuccaaatgcacatucat

SEQ ID NO: 22145 - DNA, 24 bp, Artificial Sequence
  Synthetic
gcugcaaaaccaaagatucagaca

SEQ ID NO: 22146 - DNA, 23 bp, Artificial Sequence
  Synthetic
agacccagccutttctcttucag

SEQ ID NO: 22147 - DNA, 28 bp, Artificial Sequence
  Synthetic
cctttcaaaaccuatacccaagtcugat

SEQ ID NO: 22148 - DNA, 27 bp, Artificial Sequence
  Synthetic
ctcagttttacagucccgatcagatut

SEQ ID NO: 22149 - DNA, 24 bp, Artificial Sequence
  Synthetic
acgagagagutctgacucagaaga

SEQ ID NO: 22150 - DNA, 27 bp, Artificial Sequence
  Synthetic
gaaggtttcccuagatcctcactttut

SEQ ID NO: 22151 - DNA, 24 bp, Artificial Sequence
  Synthetic
tgaaggcauctttcttggtucaga

SEQ ID NO: 22152 - DNA, 28 bp, Artificial Sequence
  Synthetic
tgaggaaatatcugcttgctcatucaat

SEQ ID NO: 22153 - DNA, 22 bp, Artificial Sequence
  Synthetic
agcaccaguacccttaccagua

SEQ ID NO: 22154 - DNA, 23 bp, Artificial Sequence
  Synthetic
ccaattccacccutgacttuggt

SEQ ID NO: 22155 - DNA, 25 bp, Artificial Sequence
  Synthetic
cagaataggttuctcactgcactug

SEQ ID NO: 22156 - DNA, 19 bp, Artificial Sequence
  Synthetic
tgcacacugactggagcug

SEQ ID NO: 22157 - DNA, 18 bp, Artificial Sequence
  Synthetic
cgaccugcaggccauact

SEQ ID NO: 22158 - DNA, 20 bp, Artificial Sequence
  Synthetic
cacagggcauggaagtggua

SEQ ID NO: 22159 - DNA, 27 bp, Artificial Sequence
  Synthetic
cctgtctatacccaugtccttcctuag

SEQ ID NO: 22160 - DNA, 21 bp, Artificial Sequence
  Synthetic
acccuccagauagcaggaagt

SEQ ID NO: 22161 - DNA, 20 bp, Artificial Sequence
  Synthetic
gctgctccucaagtgcttug

SEQ ID NO: 22162 - DNA, 18 bp, Artificial Sequence
  Synthetic
cagcggaugacacccuca

SEQ ID NO: 22163 - DNA, 19 bp, Artificial Sequence
  Synthetic
gagtcaugccttgcccuct

SEQ ID NO: 22164 - DNA, 21 bp, Artificial Sequence
  Synthetic
tcagaggcugaggttguacca

SEQ ID NO: 22165 - DNA, 19 bp, Artificial Sequence
  Synthetic
agcuccagcccatcugaac

SEQ ID NO: 22166 - DNA, 19 bp, Artificial Sequence
  Synthetic
agcucgacacaccccatug

SEQ ID NO: 22167 - DNA, 26 bp, Artificial Sequence
  Synthetic
caatagtcttccugtccttccaucag

SEQ ID NO: 22168 - DNA, 29 bp, Artificial Sequence
  Synthetic
aaaatggccttgugatgtacagtaaaaug

SEQ ID NO: 22169 - DNA, 28 bp, Artificial Sequence
  Synthetic
gccaagcauacaacctagaaaatgttua

SEQ ID NO: 22170 - DNA, 26 bp, Artificial Sequence
  Synthetic
agcttugaggaagcatgtattucaca

SEQ ID NO: 22171 - DNA, 21 bp, Artificial Sequence
  Synthetic
guttgtagcucccccaccaaa

SEQ ID NO: 22172 - DNA, 19 bp, Artificial Sequence
  Synthetic
cagggugaagtggcugcat

SEQ ID NO: 22173 - DNA, 25 bp, Artificial Sequence
  Synthetic
gggttggttgutattacttagcuca

SEQ ID NO: 22174 - DNA, 21 bp, Artificial Sequence
  Synthetic
gggtcugaagctgagguagag

SEQ ID NO: 22175 - DNA, 26 bp, Artificial Sequence
  Synthetic
agaaaaccaautgttccucagaagga

SEQ ID NO: 22176 - DNA, 27 bp, Artificial Sequence
  Synthetic
gctctcauaaagcagaaugtcatttuc

SEQ ID NO: 22177 - DNA, 33 bp, Artificial Sequence
  Synthetic
gttaaaacagttaguaactatgaccacagttua

SEQ ID NO: 22178 - DNA, 22 bp, Artificial Sequence
  Synthetic
accttcagccacaugtcatugt

SEQ ID NO: 22179 - DNA, 26 bp, Artificial Sequence
  Synthetic
aagtctgcttucgtttcttacctuct

SEQ ID NO: 22180 - DNA, 21 bp, Artificial Sequence
  Synthetic
aaacctgacugagctgauggg

SEQ ID NO: 22181 - DNA, 27 bp, Artificial Sequence
  Synthetic
ccaggaauactttaagttaugcccaga

SEQ ID NO: 22182 - DNA, 28 bp, Artificial Sequence
  Synthetic
atagacgtaatcuccaacatggtacaug

SEQ ID NO: 22183 - DNA, 22 bp, Artificial Sequence
  Synthetic
gcatcccttuggtgagtaccut

SEQ ID NO: 22184 - DNA, 31 bp, Artificial Sequence
  Synthetic
agcacatatccucaaaataaaaatggcttug

SEQ ID NO: 22185 - DNA, 28 bp, Artificial Sequence
  Synthetic
ccacccctuacatttgacataatuagga

SEQ ID NO: 22186 - DNA, 26 bp, Artificial Sequence
  Synthetic
catgacaaagucctcaaccauagagt

SEQ ID NO: 22187 - DNA, 25 bp, Artificial Sequence
  Synthetic
ccatatttcugaggcttccctcuag

SEQ ID NO: 22188 - DNA, 21 bp, Artificial Sequence
  Synthetic
gaagtgugaggctgcctuact

SEQ ID NO: 22189 - DNA, 32 bp, Artificial Sequence
  Synthetic
tggaatgtaggttuataatgatgcacataucc

SEQ ID NO: 22190 - DNA, 22 bp, Artificial Sequence
  Synthetic
ggaactgagaugtccccagcua

SEQ ID NO: 22191 - DNA, 26 bp, Artificial Sequence
  Synthetic
caactcctgagauctgctctgtttua

SEQ ID NO: 22192 - DNA, 27 bp, Artificial Sequence
  Synthetic
ggaagaaatacautatgtgcaggcuca

SEQ ID NO: 22193 - DNA, 28 bp, Artificial Sequence
  Synthetic
aaccttttuaccatttgcctucaaagaa

SEQ ID NO: 22194 - DNA, 29 bp, Artificial Sequence
  Synthetic
acccaaaaatautccttcaagauagccat

SEQ ID NO: 22195 - DNA, 22 bp, Artificial Sequence
  Synthetic
agacugacaggtcctucacaca

SEQ ID NO: 22196 - DNA, 33 bp, Artificial Sequence
  Synthetic
actgacctuaaattatctactatuaccaaggaa

SEQ ID NO: 22197 - DNA, 27 bp, Artificial Sequence
  Synthetic
aaaaguattcatgcaauggccaaagat

SEQ ID NO: 22198 - DNA, 22 bp, Artificial Sequence
  Synthetic
caagaagctgcuccaggatcuc

SEQ ID NO: 22199 - DNA, 28 bp, Artificial Sequence
  Synthetic
aaaagttgctgtuttgaattagctcuac

SEQ ID NO: 22200 - DNA, 27 bp, Artificial Sequence
  Synthetic
ctgttggatttucatcaagtcaauggg

SEQ ID NO: 22201 - DNA, 26 bp, Artificial Sequence
  Synthetic
tctgtcactuggaatgttgaacatua

SEQ ID NO: 22202 - DNA, 23 bp, Artificial Sequence
  Synthetic
agaatggugcccatcaucaaagt

SEQ ID NO: 22203 - DNA, 21 bp, Artificial Sequence
  Synthetic
ccagcugaagacttggugaca

SEQ ID NO: 22204 - DNA, 25 bp, Artificial Sequence
  Synthetic
atctccgucgagaactgauagaact

SEQ ID NO: 22205 - DNA, 28 bp, Artificial Sequence
  Synthetic
cagaatacaauggattcagggttuacca

SEQ ID NO: 22206 - DNA, 21 bp, Artificial Sequence
  Synthetic
cgacagcatugcttcctccuc

SEQ ID NO: 22207 - DNA, 28 bp, Artificial Sequence
  Synthetic
aacacttcuacacatgtacttucccaaa

SEQ ID NO: 22208 - DNA, 20 bp, Artificial Sequence
  Synthetic
gctcctgccutttctgguca

SEQ ID NO: 22209 - DNA, 20 bp, Artificial Sequence
  Synthetic
ggagccautccaggtugaga

SEQ ID NO: 22210 - DNA, 17 bp, Artificial Sequence
  Synthetic
cgcagggccuggttuct

SEQ ID NO: 22211 - DNA, 20 bp, Artificial Sequence
  Synthetic
cacatccuggatgccctgua

SEQ ID NO: 22212 - DNA, 22 bp, Artificial Sequence
  Synthetic
agtgcaauctcactggucaagg

SEQ ID NO: 22213 - DNA, 24 bp, Artificial Sequence
  Synthetic
agagaataggccuttaccgucact

SEQ ID NO: 22214 - DNA, 22 bp, Artificial Sequence
  Synthetic
gagggacagaaggugagttcut

SEQ ID NO: 22215 - DNA, 26 bp, Artificial Sequence
  Synthetic
cactacacctauctggacacattugg

SEQ ID NO: 22216 - DNA, 24 bp, Artificial Sequence
  Synthetic
aggttguagccaacgatgtaaugg

SEQ ID NO: 22217 - DNA, 25 bp, Artificial Sequence
  Synthetic
tttattaccgggaugagatuggcaa

SEQ ID NO: 22218 - DNA, 24 bp, Artificial Sequence
  Synthetic
ctuccacagcaatatuaccccagt

SEQ ID NO: 22219 - DNA, 21 bp, Artificial Sequence
  Synthetic
ggtgcautctctgtugccaaa

SEQ ID NO: 22220 - DNA, 23 bp, Artificial Sequence
  Synthetic
tgaucccatatgaucccaaccct

SEQ ID NO: 22221 - DNA, 27 bp, Artificial Sequence
  Synthetic
guaaagggagaagaugaggaagagaac

SEQ ID NO: 22222 - DNA, 22 bp, Artificial Sequence
  Synthetic
gcttcacgucctcattgaucag

SEQ ID NO: 22223 - DNA, 17 bp, Artificial Sequence
  Synthetic
cctggcgcacugctcut

SEQ ID NO: 22224 - DNA, 26 bp, Artificial Sequence
  Synthetic
ccttcggcttuttcaacccttttuaa

SEQ ID NO: 22225 - DNA, 26 bp, Artificial Sequence
  Synthetic
agggacaacagutaagctttatggut

SEQ ID NO: 22226 - DNA, 30 bp, Artificial Sequence
  Synthetic
aatgaaagagagauggtgattgcatcuaat

SEQ ID NO: 22227 - DNA, 26 bp, Artificial Sequence
  Synthetic
tctggtacacagucatggttgattut

SEQ ID NO: 22228 - DNA, 23 bp, Artificial Sequence
  Synthetic
ttctcaacugccaatggactgut

SEQ ID NO: 22229 - DNA, 30 bp, Artificial Sequence
  Synthetic
tcacgtaggtugcacaaagaatttttatuc

SEQ ID NO: 22230 - DNA, 29 bp, Artificial Sequence
  Synthetic
aaaattttacauaggtggaatgaauggct

SEQ ID NO: 22231 - DNA, 30 bp, Artificial Sequence
  Synthetic
attgttccttcugaaatactttacctctut

SEQ ID NO: 22232 - DNA, 25 bp, Artificial Sequence
  Synthetic
ttttatggcagucaaaccttctcuc

SEQ ID NO: 22233 - DNA, 23 bp, Artificial Sequence
  Synthetic
ggcatgcucttcaatcacugaca

SEQ ID NO: 22234 - DNA, 28 bp, Artificial Sequence
  Synthetic
caaagaacagcucaaagcaatttcuaca

SEQ ID NO: 22235 - DNA, 27 bp, Artificial Sequence
  Synthetic
gtaaaaacaugctgagaucagccaaat

SEQ ID NO: 22236 - DNA, 25 bp, Artificial Sequence
  Synthetic
aatcaaaccugaacaggctauggaa

SEQ ID NO: 22237 - DNA, 32 bp, Artificial Sequence
  Synthetic
actagctgaattaaauactgagaaagtttguc

SEQ ID NO: 22238 - DNA, 24 bp, Artificial Sequence
  Synthetic
atgugggatgtattugaagcacct

SEQ ID NO: 22239 - DNA, 27 bp, Artificial Sequence
  Synthetic
tctcaaacacaaacuagagucacacac

SEQ ID NO: 22240 - DNA, 24 bp, Artificial Sequence
  Synthetic
gutgaatugggagaauccagacat

SEQ ID NO: 22241 - DNA, 26 bp, Artificial Sequence
  Synthetic
tggctttcaguagttttcatggtuca

SEQ ID NO: 22242 - DNA, 21 bp, Artificial Sequence
  Synthetic
tctcaagtuggcctgaaucac

SEQ ID NO: 22243 - DNA, 28 bp, Artificial Sequence
  Synthetic
cccaaaatgaagguagctacacagtauc

SEQ ID NO: 22244 - DNA, 30 bp, Artificial Sequence
  Synthetic
tgttttgacacaggauttcttaatagugat

SEQ ID NO: 22245 - DNA, 26 bp, Artificial Sequence
  Synthetic
autgtttctaauagagcagccagaac

SEQ ID NO: 22246 - DNA, 27 bp, Artificial Sequence
  Synthetic
cacaattaaacagcaugcattgaacug

SEQ ID NO: 22247 - DNA, 25 bp, Artificial Sequence
  Synthetic
ctaatgctgutcatggattgugcaa

SEQ ID NO: 22248 - DNA, 20 bp, Artificial Sequence
  Synthetic
gcacaacucggagaucagca

SEQ ID NO: 22249 - DNA, 23 bp, Artificial Sequence
  Synthetic
cttcatgagcgucttggtttucc

SEQ ID NO: 22250 - DNA, 22 bp, Artificial Sequence
  Synthetic
ctgcaguacaactccaugacca

SEQ ID NO: 22251 - DNA, 21 bp, Artificial Sequence
  Synthetic
agugggaggaagagguaacca

SEQ ID NO: 22252 - DNA, 22 bp, Artificial Sequence
  Synthetic
gggugcaaaagaggagaguaag

SEQ ID NO: 22253 - DNA, 20 bp, Artificial Sequence
  Synthetic
cggttttugcgtgagtgugg

SEQ ID NO: 22254 - DNA, 26 bp, Artificial Sequence
  Synthetic
gcaggaagttugcaaaagtcttuacc

SEQ ID NO: 22255 - DNA, 26 bp, Artificial Sequence
  Synthetic
aacaatggacautttgattgccaugt

SEQ ID NO: 22256 - DNA, 27 bp, Artificial Sequence
  Synthetic
aatttaggacagutgcaaacgugaaaa

SEQ ID NO: 22257 - DNA, 27 bp, Artificial Sequence
  Synthetic
cccttttuaaacaagaccacagagaug

SEQ ID NO: 22258 - DNA, 26 bp, Artificial Sequence
  Synthetic
gatcccaacuttccattttgtucaga

SEQ ID NO: 22259 - DNA, 30 bp, Artificial Sequence
  Synthetic
aatacagagccgaaucttttaaaauacaac

SEQ ID NO: 22260 - DNA, 22 bp, Artificial Sequence
  Synthetic
aagttcuccagtaaagcuggca

SEQ ID NO: 22261 - DNA, 22 bp, Artificial Sequence
  Synthetic
ggctgtguaaattgccttgugt

SEQ ID NO: 22262 - DNA, 27 bp, Artificial Sequence
  Synthetic
ccaggttcaatucaacatcatgggtua

SEQ ID NO: 22263 - DNA, 24 bp, Artificial Sequence
  Synthetic
ggtaccaccauggacacctauaag

SEQ ID NO: 22264 - DNA, 28 bp, Artificial Sequence
  Synthetic
gcagtgcaccaauattcaaaagaaucaa

SEQ ID NO: 22265 - DNA, 19 bp, Artificial Sequence
  Synthetic
ggcccagagagaugcaugg

SEQ ID NO: 22266 - DNA, 21 bp, Artificial Sequence
  Synthetic
ggcaaucctgaugaccgagat

SEQ ID NO: 22267 - DNA, 29 bp, Artificial Sequence
  Synthetic
acagagaagtttugaggaagtatgtgaug

SEQ ID NO: 22268 - DNA, 24 bp, Artificial Sequence
  Synthetic
gccttactauacgccacauaaccc

SEQ ID NO: 22269 - DNA, 28 bp, Artificial Sequence
  Synthetic
ttttggaaggaugaccttaggcttatut

SEQ ID NO: 22270 - DNA, 22 bp, Artificial Sequence
  Synthetic
tcccaatauaagcgacgtgcug

SEQ ID NO: 22271 - DNA, 25 bp, Artificial Sequence
  Synthetic
ttcagctcuggaactttgtctctut

SEQ ID NO: 22272 - DNA, 17 bp, Artificial Sequence
  Synthetic
cagtgcugtccggguca

SEQ ID NO: 22273 - DNA, 19 bp, Artificial Sequence
  Synthetic
gccaggugtggtuccagaa

SEQ ID NO: 22274 - DNA, 23 bp, Artificial Sequence
  Synthetic
aagacccttuccagctcttugag

SEQ ID NO: 22275 - DNA, 23 bp, Artificial Sequence
  Synthetic
ctcactttcugtctcctctguca

SEQ ID NO: 22276 - DNA, 29 bp, Artificial Sequence
  Synthetic
gcagaggaatugaggtaagaatatuccat

SEQ ID NO: 22277 - DNA, 22 bp, Artificial Sequence
  Synthetic
gtaguaaggaggccagttugga

SEQ ID NO: 22278 - DNA, 23 bp, Artificial Sequence
  Synthetic
ttttgtgacggucttggaaguga

SEQ ID NO: 22279 - DNA, 23 bp, Artificial Sequence
  Synthetic
ggaagagaagaagcutggtccug

SEQ ID NO: 22280 - DNA, 28 bp, Artificial Sequence
  Synthetic
ccaaactttauaagatcctggctaucct

SEQ ID NO: 22281 - DNA, 26 bp, Artificial Sequence
  Synthetic
cacaatcgttucccctgacttauaca

SEQ ID NO: 22282 - DNA, 21 bp, Artificial Sequence
  Synthetic
gctgctcgggauccatatgug

SEQ ID NO: 22283 - DNA, 22 bp, Artificial Sequence
  Synthetic
ggatatccugggaggtggguag

SEQ ID NO: 22284 - DNA, 24 bp, Artificial Sequence
  Synthetic
aguctcatatgttcugggacacga

SEQ ID NO: 22285 - DNA, 27 bp, Artificial Sequence
  Synthetic
atatcauccactcaataucaggaagcg

SEQ ID NO: 22286 - DNA, 22 bp, Artificial Sequence
  Synthetic
tgcctctctcucttgtcacgua

SEQ ID NO: 22287 - DNA, 25 bp, Artificial Sequence
  Synthetic
gcttgttcucattggctucaaagat

SEQ ID NO: 22288 - DNA, 18 bp, Artificial Sequence
  Synthetic
cccacaggucgggtctug

SEQ ID NO: 22289 - DNA, 24 bp, Artificial Sequence
  Synthetic
ccaggaaggagcacutacgtttua

SEQ ID NO: 22290 - DNA, 21 bp, Artificial Sequence
  Synthetic
gauagcttccugagccaccac

SEQ ID NO: 22291 - DNA, 26 bp, Artificial Sequence
  Synthetic
ctttccatttgugatgcctguaagat

SEQ ID NO: 22292 - DNA, 30 bp, Artificial Sequence
  Synthetic
atgataacucagaaggucttactttatugg

SEQ ID NO: 22293 - DNA, 21 bp, Artificial Sequence
  Synthetic
gtccacacuccactcacugaa

SEQ ID NO: 22294 - DNA, 29 bp, Artificial Sequence
  Synthetic
ggatctgaaaggutttctaacagtgtuct

SEQ ID NO: 22295 - DNA, 21 bp, Artificial Sequence
  Synthetic
ccatccgguacccactctuga

SEQ ID NO: 22296 - DNA, 23 bp, Artificial Sequence
  Synthetic
cgtgtggacucagacaatgcaua

SEQ ID NO: 22297 - DNA, 22 bp, Artificial Sequence
  Synthetic
caggcagaggaaugatguagcc

SEQ ID NO: 22298 - DNA, 20 bp, Artificial Sequence
  Synthetic
ctgguggaagacagctucct

SEQ ID NO: 22299 - DNA, 17 bp, Artificial Sequence
  Synthetic
gcccutggcugggaact

SEQ ID NO: 22300 - DNA, 22 bp, Artificial Sequence
  Synthetic
tctctgggcuccttcagaucaa

SEQ ID NO: 22301 - DNA, 24 bp, Artificial Sequence
  Synthetic
tgcatttucttgggcuacagaact

SEQ ID NO: 22302 - DNA, 25 bp, Artificial Sequence
  Synthetic
ggtgcagaaaaccacauctcacaua

SEQ ID NO: 22303 - DNA, 20 bp, Artificial Sequence
  Synthetic
catcacaggccucacucacc

SEQ ID NO: 22304 - DNA, 25 bp, Artificial Sequence
  Synthetic
tggcagctcugaacggtattuaaaa

SEQ ID NO: 22305 - DNA, 22 bp, Artificial Sequence
  Synthetic
ctgaaggaagcugaggaaccug

SEQ ID NO: 22306 - DNA, 22 bp, Artificial Sequence
  Synthetic
actgccagcagutgaugagaaa

SEQ ID NO: 22307 - DNA, 27 bp, Artificial Sequence
  Synthetic
tgcctcattacgutttagatgggatuc

SEQ ID NO: 22308 - DNA, 25 bp, Artificial Sequence
  Synthetic
gtcactgtguggcactagattucat

SEQ ID NO: 22309 - DNA, 24 bp, Artificial Sequence
  Synthetic
gtgtttgtgcugcctgtttaugag

SEQ ID NO: 22310 - DNA, 26 bp, Artificial Sequence
  Synthetic
aatgggacuggaggaagtacagaaua

SEQ ID NO: 22311 - DNA, 25 bp, Artificial Sequence
  Synthetic
gggtcttgttucctgcaaaaagtuc

SEQ ID NO: 22312 - DNA, 19 bp, Artificial Sequence
  Synthetic
ggucaacaagcugcgcaac

SEQ ID NO: 22313 - DNA, 23 bp, Artificial Sequence
  Synthetic
tgctgctgtucttgcttctguaa

SEQ ID NO: 22314 - DNA, 27 bp, Artificial Sequence
  Synthetic
ccataaggcucttactctcaaaucaca

SEQ ID NO: 22315 - DNA, 22 bp, Artificial Sequence
  Synthetic
aagcagctgutcttttggtugg

SEQ ID NO: 22316 - DNA, 27 bp, Artificial Sequence
  Synthetic
gtgcatgtttatutttccctctctuca

SEQ ID NO: 22317 - DNA, 26 bp, Artificial Sequence
  Synthetic
gtacattagacugcctatggtcgtua

SEQ ID NO: 22318 - DNA, 22 bp, Artificial Sequence
  Synthetic
aagttgccucactgggcuaaaa

SEQ ID NO: 22319 - DNA, 26 bp, Artificial Sequence
  Synthetic
tgatgagagaaaaucctggagaguca

SEQ ID NO: 22320 - DNA, 23 bp, Artificial Sequence
  Synthetic
gcctucacacacaaagcaguaaa

SEQ ID NO: 22321 - DNA, 19 bp, Artificial Sequence
  Synthetic
ggcatccaucgcaaagugg

SEQ ID NO: 22322 - DNA, 23 bp, Artificial Sequence
  Synthetic
tggccuggcagaaatagtgaaut

SEQ ID NO: 22323 - DNA, 25 bp, Artificial Sequence
  Synthetic
gaggctggcaaauagttagtaucca

SEQ ID NO: 22324 - DNA, 22 bp, Artificial Sequence
  Synthetic
tgattctcaucctggtguggga

SEQ ID NO: 22325 - DNA, 21 bp, Artificial Sequence
  Synthetic
ccuatcaguggccgcaaagag

SEQ ID NO: 22326 - DNA, 21 bp, Artificial Sequence
  Synthetic
cacacacacgutttcttuggg

SEQ ID NO: 22327 - DNA, 25 bp, Artificial Sequence
  Synthetic
caaactcatccacgucagagactut

SEQ ID NO: 22328 - DNA, 29 bp, Artificial Sequence
  Synthetic
ctcttatctttgcutaatgggtgtcguat

SEQ ID NO: 22329 - DNA, 21 bp, Artificial Sequence
  Synthetic
gctgcaugactggtccugaaa

SEQ ID NO: 22330 - DNA, 25 bp, Artificial Sequence
  Synthetic
ttacccugggcttttgaaucagaat

SEQ ID NO: 22331 - DNA, 24 bp, Artificial Sequence
  Synthetic
gtggtagacugagctuagacagag

SEQ ID NO: 22332 - DNA, 27 bp, Artificial Sequence
  Synthetic
acataatccataacuacagtgcagcuc

SEQ ID NO: 22333 - DNA, 27 bp, Artificial Sequence
  Synthetic
ggacacaagcagutctatcatggtuaa

SEQ ID NO: 22334 - DNA, 19 bp, Artificial Sequence
  Synthetic
ccaccaggauctcccucgt

SEQ ID NO: 22335 - DNA, 24 bp, Artificial Sequence
  Synthetic
tgggatttcugaggcacataguct

SEQ ID NO: 22336 - DNA, 24 bp, Artificial Sequence
  Synthetic
attgacttgcacutgggtgacaua

SEQ ID NO: 22337 - DNA, 24 bp, Artificial Sequence
  Synthetic
cccctguggtttcattauagccat

SEQ ID NO: 22338 - DNA, 23 bp, Artificial Sequence
  Synthetic
ggttcuccagagagctgtgttut

SEQ ID NO: 22339 - DNA, 24 bp, Artificial Sequence
  Synthetic
gcatttctagcuctgtgacacuca

SEQ ID NO: 22340 - DNA, 25 bp, Artificial Sequence
  Synthetic
tcatcagtatuggcttacgctucag

SEQ ID NO: 22341 - DNA, 29 bp, Artificial Sequence
  Synthetic
ccaaaatacatgttugtctcctttcacut

SEQ ID NO: 22342 - DNA, 28 bp, Artificial Sequence
  Synthetic
caaggaaactcutgcacaaatguacaat

SEQ ID NO: 22343 - DNA, 32 bp, Artificial Sequence
  Synthetic
gccacgaaattaacuaactctctacaataaua

SEQ ID NO: 22344 - DNA, 32 bp, Artificial Sequence
  Synthetic
atgaatctctagcucagtataatcccaaatug

SEQ ID NO: 22345 - DNA, 30 bp, Artificial Sequence
  Synthetic
agtattaaaaggaucttgtctaaacaucgt

SEQ ID NO: 22346 - DNA, 31 bp, Artificial Sequence
  Synthetic
ccataaaaatatutgaagaacagugccagac

SEQ ID NO: 22347 - DNA, 28 bp, Artificial Sequence
  Synthetic
gaggatttuggttatctcuagcacaaga

SEQ ID NO: 22348 - DNA, 22 bp, Artificial Sequence
  Synthetic
gatggctccugcactcttcaut

SEQ ID NO: 22349 - DNA, 22 bp, Artificial Sequence
  Synthetic
ttcagctttguttcggttgcug

SEQ ID NO: 22350 - DNA, 24 bp, Artificial Sequence
  Synthetic
cuacccagtataugcacagcagag

SEQ ID NO: 22351 - DNA, 25 bp, Artificial Sequence
  Synthetic
agaaagctcuagtcccauccaaaga

SEQ ID NO: 22352 - DNA, 19 bp, Artificial Sequence
  Synthetic
ctggctcuggttcgtccug

SEQ ID NO: 22353 - DNA, 20 bp, Artificial Sequence
  Synthetic
ggaatcctccugggctccut

SEQ ID NO: 22354 - DNA, 21 bp, Artificial Sequence
  Synthetic
cccctacccugcctcaacaua

SEQ ID NO: 22355 - DNA, 21 bp, Artificial Sequence
  Synthetic
gccctgacccutctccctauc

SEQ ID NO: 22356 - DNA, 23 bp, Artificial Sequence
  Synthetic
agtcacagatcutgaccagctug

SEQ ID NO: 22357 - DNA, 22 bp, Artificial Sequence
  Synthetic
atgaagggucttuccccacaat

SEQ ID NO: 22358 - DNA, 23 bp, Artificial Sequence
  Synthetic
tgtagtuggaggactcgatguct

SEQ ID NO: 22359 - DNA, 22 bp, Artificial Sequence
  Synthetic
gctctcctgugatgctccttua

SEQ ID NO: 22360 - DNA, 21 bp, Artificial Sequence
  Synthetic
caacaggtugaccacgtucag

SEQ ID NO: 22361 - DNA, 18 bp, Artificial Sequence
  Synthetic
ggagccuccatgacuggg

SEQ ID NO: 22362 - DNA, 20 bp, Artificial Sequence
  Synthetic
gatgugccagtctucaccca

SEQ ID NO: 22363 - DNA, 21 bp, Artificial Sequence
  Synthetic
tcatggccugctctcatcuct

SEQ ID NO: 22364 - DNA, 17 bp, Artificial Sequence
  Synthetic
aggcccagguctgcuca

SEQ ID NO: 22365 - DNA, 23 bp, Artificial Sequence
  Synthetic
tcctaacucagtgctctcuccat

SEQ ID NO: 22366 - DNA, 20 bp, Artificial Sequence
  Synthetic
gggagcgutgaaggaatugg

SEQ ID NO: 22367 - DNA, 20 bp, Artificial Sequence
  Synthetic
catccccagugccgagtuag

SEQ ID NO: 22368 - DNA, 24 bp, Artificial Sequence
  Synthetic
gttatactugcctctgcugagcat

SEQ ID NO: 22369 - DNA, 25 bp, Artificial Sequence
  Synthetic
ggcttttcuggtatcttugaggaca

SEQ ID NO: 22370 - DNA, 25 bp, Artificial Sequence
  Synthetic
gtgcaaaagtatuctcccgtgtcua

SEQ ID NO: 22371 - DNA, 21 bp, Artificial Sequence
  Synthetic
aatgtcuccagcaccttcgut

SEQ ID NO: 22372 - DNA, 18 bp, Artificial Sequence
  Synthetic
gcacgagcccaucagcut

SEQ ID NO: 22373 - DNA, 19 bp, Artificial Sequence
  Synthetic
ggcagagacggguatgugg

SEQ ID NO: 22374 - DNA, 19 bp, Artificial Sequence
  Synthetic
cctttucccgggugcagat

SEQ ID NO: 22375 - DNA, 18 bp, Artificial Sequence
  Synthetic
cgggucaggcctctcuca

SEQ ID NO: 22376 - DNA, 21 bp, Artificial Sequence
  Synthetic
tcgcgagaucttcagggtcua

SEQ ID NO: 22377 - DNA, 24 bp, Artificial Sequence
  Synthetic
gtccatguccatcgaatctuccat

SEQ ID NO: 22378 - DNA, 30 bp, Artificial Sequence
  Synthetic
aaataggtggaacucaaaagttgaaguagt

SEQ ID NO: 22379 - DNA, 25 bp, Artificial Sequence
  Synthetic
cgttggctguacagacatttucaaa

SEQ ID NO: 22380 - DNA, 33 bp, Artificial Sequence
  Synthetic
gtctcagtttttagaguatttactatcagtgut

SEQ ID NO: 22381 - DNA, 28 bp, Artificial Sequence
  Synthetic
agaccgcttuccagatatactuaagagt

SEQ ID NO: 22382 - DNA, 28 bp, Artificial Sequence
  Synthetic
aaaactccuaaaacaccaaaaggaccua

SEQ ID NO: 22383 - DNA, 21 bp, Artificial Sequence
  Synthetic
ccagacacgugcaattugagg

SEQ ID NO: 22384 - DNA, 28 bp, Artificial Sequence
  Synthetic
tttattgatgtcuatgaagtgttguggt

SEQ ID NO: 22385 - DNA, 30 bp, Artificial Sequence
  Synthetic
ctgutacagaaatgaaauaagacggaaaat

SEQ ID NO: 22386 - DNA, 27 bp, Artificial Sequence
  Synthetic
atttttctgagccacutaatgggtgua

SEQ ID NO: 22387 - DNA, 30 bp, Artificial Sequence
  Synthetic
tcagcagacccauttaaatactctacatug

SEQ ID NO: 22388 - DNA, 26 bp, Artificial Sequence
  Synthetic
gaggagatcuttgaggaaacucagac

SEQ ID NO: 22389 - DNA, 22 bp, Artificial Sequence
  Synthetic
agctaauggcaagaauggcgat

SEQ ID NO: 22390 - DNA, 30 bp, Artificial Sequence
  Synthetic
catacattgctttutcagaaggctaauagg

SEQ ID NO: 22391 - DNA, 25 bp, Artificial Sequence
  Synthetic
cgtctcttgaautttgcccagauga

SEQ ID NO: 22392 - DNA, 26 bp, Artificial Sequence
  Synthetic
agcttctgattucatctccctttucc

SEQ ID NO: 22393 - DNA, 22 bp, Artificial Sequence
  Synthetic
tctttgaccccutgggaacauc

SEQ ID NO: 22394 - DNA, 25 bp, Artificial Sequence
  Synthetic
ggatatatctgauacgcaggccuct

SEQ ID NO: 22395 - DNA, 24 bp, Artificial Sequence
  Synthetic
gcaagcccaauaaagagucaccat

SEQ ID NO: 22396 - DNA, 25 bp, Artificial Sequence
  Synthetic
aaagtattcuaggtttgcugccaca

SEQ ID NO: 22397 - DNA, 25 bp, Artificial Sequence
  Synthetic
gtgaacaagaguagatgcctucaga

SEQ ID NO: 22398 - DNA, 25 bp, Artificial Sequence
  Synthetic
tctccttuggccagcatttcuaaaa

SEQ ID NO: 22399 - DNA, 27 bp, Artificial Sequence
  Synthetic
catcctcaccuaaggatctguaagaga

SEQ ID NO: 22400 - DNA, 25 bp, Artificial Sequence
  Synthetic
aatucagagaaaaagggagauggca

SEQ ID NO: 22401 - DNA, 23 bp, Artificial Sequence
  Synthetic
gcctaguaacacagtcugaacga

SEQ ID NO: 22402 - DNA, 31 bp, Artificial Sequence
  Synthetic
cctggtaaaatttcugaaaaaggactctcut

SEQ ID NO: 22403 - DNA, 22 bp, Artificial Sequence
  Synthetic
catgcgctuacgaggtttagug

SEQ ID NO: 22404 - DNA, 24 bp, Artificial Sequence
  Synthetic
tcccatcuggttactttugggagt

SEQ ID NO: 22405 - DNA, 21 bp, Artificial Sequence
  Synthetic
cttggcttccuaaggcgttuc

SEQ ID NO: 22406 - DNA, 21 bp, Artificial Sequence
  Synthetic
cccttggcucagtcagaacut

SEQ ID NO: 22407 - DNA, 23 bp, Artificial Sequence
  Synthetic
tgcucaaatacugagaccccaac

SEQ ID NO: 22408 - DNA, 26 bp, Artificial Sequence
  Synthetic
gattttggacaugtgtgttaguagcc

SEQ ID NO: 22409 - DNA, 29 bp, Artificial Sequence
  Synthetic
tctcttttgacgagucatcattttucact

SEQ ID NO: 22410 - DNA, 26 bp, Artificial Sequence
  Synthetic
agaattgtgaaaaautgggtgagcug

SEQ ID NO: 22411 - DNA, 26 bp, Artificial Sequence
  Synthetic
gaggaagaccgutcgatatctactut

SEQ ID NO: 22412 - DNA, 25 bp, Artificial Sequence
  Synthetic
tcttttgcttguccctgatttucct

SEQ ID NO: 22413 - DNA, 30 bp, Artificial Sequence
  Synthetic
ggtaaagtgatuagggcagatgatactaut

SEQ ID NO: 22414 - DNA, 27 bp, Artificial Sequence
  Synthetic
cctgaacautgatatcccugaaggaaa

SEQ ID NO: 22415 - DNA, 27 bp, Artificial Sequence
  Synthetic
tgtatcugagaggtcucaagaaacaga

SEQ ID NO: 22416 - DNA, 23 bp, Artificial Sequence
  Synthetic
ttgaagtgacutgtgctgtcugt

SEQ ID NO: 22417 - DNA, 22 bp, Artificial Sequence
  Synthetic
gtcccccaagautttctccuca

SEQ ID NO: 22418 - DNA, 26 bp, Artificial Sequence
  Synthetic
tgtatacattuggataccagtgucct

SEQ ID NO: 22419 - DNA, 27 bp, Artificial Sequence
  Synthetic
gtgatatcatgutcttgagcauagcga

SEQ ID NO: 22420 - DNA, 26 bp, Artificial Sequence
  Synthetic
aattaatctgttcucttgggagtugg

SEQ ID NO: 22421 - DNA, 23 bp, Artificial Sequence
  Synthetic
gctccacattugcaaacagtcut

SEQ ID NO: 22422 - DNA, 21 bp, Artificial Sequence
  Synthetic
catagcctuggcccatgugat

SEQ ID NO: 22423 - DNA, 23 bp, Artificial Sequence
  Synthetic
gatgctgctuacaaaaggagcug

SEQ ID NO: 22424 - DNA, 22 bp, Artificial Sequence
  Synthetic
gacttgucagaggccattgcua

SEQ ID NO: 22425 - DNA, 20 bp, Artificial Sequence
  Synthetic
gccuctggcuggaaaccaag

SEQ ID NO: 22426 - DNA, 24 bp, Artificial Sequence
  Synthetic
ctcautactagcagucccaaaccc

SEQ ID NO: 22427 - DNA, 24 bp, Artificial Sequence
  Synthetic
acaggcctcagugctttttcttua

SEQ ID NO: 22428 - DNA, 21 bp, Artificial Sequence
  Synthetic
ccaggccagacutctttcuca

SEQ ID NO: 22429 - DNA, 19 bp, Artificial Sequence
  Synthetic
cctccgaccauctgctucg

SEQ ID NO: 22430 - DNA, 22 bp, Artificial Sequence
  Synthetic
guctctuggaagagggcaagac

SEQ ID NO: 22431 - DNA, 27 bp, Artificial Sequence
  Synthetic
agcttgtttgtucatgtgacattgaut

SEQ ID NO: 22432 - DNA, 19 bp, Artificial Sequence
  Synthetic
cutcccccucagggaaagg

SEQ ID NO: 22433 - DNA, 26 bp, Artificial Sequence
  Synthetic
actaugcacaaugagaggatttugag

SEQ ID NO: 22434 - DNA, 22 bp, Artificial Sequence
  Synthetic
ccagtgauggaagcaauggaaa

SEQ ID NO: 22435 - DNA, 21 bp, Artificial Sequence
  Synthetic
ctttgaggcuctgcagctuag

SEQ ID NO: 22436 - DNA, 19 bp, Artificial Sequence
  Synthetic
cgtguggccccaaggaaua

SEQ ID NO: 22437 - DNA, 21 bp, Artificial Sequence
  Synthetic
catcccttggaugtgccagut

SEQ ID NO: 22438 - DNA, 17 bp, Artificial Sequence
  Synthetic
cucagagccuggcccaa

SEQ ID NO: 22439 - DNA, 17 bp, Artificial Sequence
  Synthetic
cttcucgcccccuccag

SEQ ID NO: 22440 - DNA, 25 bp, Artificial Sequence
  Synthetic
gctttaatacgcaugtcagaaaguc

SEQ ID NO: 22441 - DNA, 23 bp, Artificial Sequence
  Synthetic
gtgggccacgauttctacttcut

SEQ ID NO: 22442 - DNA, 18 bp, Artificial Sequence
  Synthetic
cccaggcauagcctucgg

SEQ ID NO: 22443 - DNA, 17 bp, Artificial Sequence
  Synthetic
cgtgcaggucgtugcag

SEQ ID NO: 22444 - DNA, 17 bp, Artificial Sequence
  Synthetic
gcacgggcgugcttuag

SEQ ID NO: 22445 - DNA, 18 bp, Artificial Sequence
  Synthetic
ccccacccacucatccug

SEQ ID NO: 22446 - DNA, 23 bp, Artificial Sequence
  Synthetic
cgacaucaaggacgaaaacaucc

SEQ ID NO: 22447 - DNA, 17 bp, Artificial Sequence
  Synthetic
agtcaccugggcagcuc

SEQ ID NO: 22448 - DNA, 21 bp, Artificial Sequence
  Synthetic
gcccugagaccatcagauagg

SEQ ID NO: 22449 - DNA, 22 bp, Artificial Sequence
  Synthetic
ccagaaaggcugctatttgcug

SEQ ID NO: 22450 - DNA, 18 bp, Artificial Sequence
  Synthetic
ccagcgguagcagugagt

SEQ ID NO: 22451 - DNA, 18 bp, Artificial Sequence
  Synthetic
cacagccugagcttuggg

SEQ ID NO: 22452 - DNA, 21 bp, Artificial Sequence
  Synthetic
agccaggutaagggucagagt

SEQ ID NO: 22453 - DNA, 23 bp, Artificial Sequence
  Synthetic
tcugtggattacauccggaggat

SEQ ID NO: 22454 - DNA, 19 bp, Artificial Sequence
  Synthetic
cctgtgagcuctcgctuct

SEQ ID NO: 22455 - DNA, 22 bp, Artificial Sequence
  Synthetic
ggatactcaugggtctcccuca

SEQ ID NO: 22456 - DNA, 22 bp, Artificial Sequence
  Synthetic
gggcagcaaacutgttcccaua

SEQ ID NO: 22457 - DNA, 20 bp, Artificial Sequence
  Synthetic
ccctagagcccutgccttut

SEQ ID NO: 22458 - DNA, 26 bp, Artificial Sequence
  Synthetic
ccaagattagaaaucaggaacgtugc

SEQ ID NO: 22459 - DNA, 27 bp, Artificial Sequence
  Synthetic
agtggatatggagaugggtctgatuaa

SEQ ID NO: 22460 - DNA, 28 bp, Artificial Sequence
  Synthetic
ctggcataaugtcatctgaatucaaaca

SEQ ID NO: 22461 - DNA, 29 bp, Artificial Sequence
  Synthetic
atgtgtaaagtuggtgttgctataatuct

SEQ ID NO: 22462 - DNA, 27 bp, Artificial Sequence
  Synthetic
gcacatagttuaacacatcaaggtugg

SEQ ID NO: 22463 - DNA, 28 bp, Artificial Sequence
  Synthetic
ggaaaaatgttgutggagaaactacugt

SEQ ID NO: 22464 - DNA, 29 bp, Artificial Sequence
  Synthetic
tttaattatcttgugtgctttaccugcac

SEQ ID NO: 22465 - DNA, 28 bp, Artificial Sequence
  Synthetic
tgaccttgtagaccugtgtgtagataut

SEQ ID NO: 22466 - DNA, 27 bp, Artificial Sequence
  Synthetic
agtcaagcggacutaaaacttctuacc

SEQ ID NO: 22467 - DNA, 29 bp, Artificial Sequence
  Synthetic
tctgctatactgautcctgacttgtttut

SEQ ID NO: 22468 - DNA, 24 bp, Artificial Sequence
  Synthetic
tcagccaacuctttgtcttcgtut

SEQ ID NO: 22469 - DNA, 29 bp, Artificial Sequence
  Synthetic
cacttcaaatgcacugttaacatttccua

SEQ ID NO: 22470 - DNA, 27 bp, Artificial Sequence
  Synthetic
caaacactacugcaggatccatuaaat

SEQ ID NO: 22471 - DNA, 23 bp, Artificial Sequence
  Synthetic
ctctggcgutcagtcacuaagaa

SEQ ID NO: 22472 - DNA, 24 bp, Artificial Sequence
  Synthetic
tggaagtgaggugctattttcucc

SEQ ID NO: 22473 - DNA, 24 bp, Artificial Sequence
  Synthetic
ccatgutaaaacttcaugcagcca

SEQ ID NO: 22474 - DNA, 23 bp, Artificial Sequence
  Synthetic
ccacagugacaggatgactcuct

SEQ ID NO: 22475 - DNA, 28 bp, Artificial Sequence
  Synthetic
gttaaagguacagtgagtttacuaggca

SEQ ID NO: 22476 - DNA, 27 bp, Artificial Sequence
  Synthetic
caauattctgctugagaaacccacaac

SEQ ID NO: 22477 - DNA, 30 bp, Artificial Sequence
  Synthetic
agctcttattgaagauttacaaccatttuc

SEQ ID NO: 22478 - DNA, 24 bp, Artificial Sequence
  Synthetic
ccctaaatugggagaacaagcuga

SEQ ID NO: 22479 - DNA, 24 bp, Artificial Sequence
  Synthetic
acagcacacagauttaucaggcaa

SEQ ID NO: 22480 - DNA, 25 bp, Artificial Sequence
  Synthetic
gccattgcuccacttaactcaaaut

SEQ ID NO: 22481 - DNA, 25 bp, Artificial Sequence
  Synthetic
agtcgcttgtautggacagaagtut

SEQ ID NO: 22482 - DNA, 30 bp, Artificial Sequence
  Synthetic
agtgtcatatgcaaauacttcacttcctut

SEQ ID NO: 22483 - DNA, 27 bp, Artificial Sequence
  Synthetic
gtttgctacacagcugataatgagaug

SEQ ID NO: 22484 - DNA, 28 bp, Artificial Sequence
  Synthetic
gccatttacacugtaacataucccagaa

SEQ ID NO: 22485 - DNA, 24 bp, Artificial Sequence
  Synthetic
caatgtcacuccctcagtgatguc

SEQ ID NO: 22486 - DNA, 24 bp, Artificial Sequence
  Synthetic
tcgaagugacagagatgtttuggg

SEQ ID NO: 22487 - DNA, 27 bp, Artificial Sequence
  Synthetic
tttagtucttggctagugaacaacact

SEQ ID NO: 22488 - DNA, 30 bp, Artificial Sequence
  Synthetic
ttcttgagttgtgauaatcctaaagccaut

SEQ ID NO: 22489 - DNA, 25 bp, Artificial Sequence
  Synthetic
accacuccagaaacacacactaaut

SEQ ID NO: 22490 - DNA, 25 bp, Artificial Sequence
  Synthetic
gucaccttttucccagaaaaccaag

SEQ ID NO: 22491 - DNA, 22 bp, Artificial Sequence
  Synthetic
cccacgugaagctattggugaa

SEQ ID NO: 22492 - DNA, 31 bp, Artificial Sequence
  Synthetic
ccctattcttttgautcattgaatgatgugg

SEQ ID NO: 22493 - DNA, 23 bp, Artificial Sequence
  Synthetic
cttugguccaggagagttctuat

SEQ ID NO: 22494 - DNA, 22 bp, Artificial Sequence
  Synthetic
cacctcauaggtccagttcugc

SEQ ID NO: 22495 - DNA, 23 bp, Artificial Sequence
  Synthetic
ggtagcggauattacugcccaat

SEQ ID NO: 22496 - DNA, 25 bp, Artificial Sequence
  Synthetic
gcaaaacutttcacaucagcaaagg

SEQ ID NO: 22497 - DNA, 24 bp, Artificial Sequence
  Synthetic
cgtattgtggagagutgcacgtua

SEQ ID NO: 22498 - DNA, 28 bp, Artificial Sequence
  Synthetic
tcactattccuctttaacttcucggact

SEQ ID NO: 22499 - DNA, 21 bp, Artificial Sequence
  Synthetic
cucataugggcgaagaaggct

SEQ ID NO: 22500 - DNA, 23 bp, Artificial Sequence
  Synthetic
gccatgctggutacattttccuc

SEQ ID NO: 22501 - DNA, 22 bp, Artificial Sequence
  Synthetic
cctcaatucccaggtggaccua

SEQ ID NO: 22502 - DNA, 22 bp, Artificial Sequence
  Synthetic
tgagguacaaaggcagccttuc

SEQ ID NO: 22503 - DNA, 22 bp, Artificial Sequence
  Synthetic
tgctcccttugcttcttccaut

SEQ ID NO: 22504 - DNA, 29 bp, Artificial Sequence
  Synthetic
tgtgataaaatcugatcattgtccctuca

SEQ ID NO: 22505 - DNA, 28 bp, Artificial Sequence
  Synthetic
ggtgtttactaccuccttcttcattuca

SEQ ID NO: 22506 - DNA, 26 bp, Artificial Sequence
  Synthetic
gaggagtcgtautaaagtcaggcuaa

SEQ ID NO: 22507 - DNA, 24 bp, Artificial Sequence
  Synthetic
gtcttctggagutctctcccguat

SEQ ID NO: 22508 - DNA, 21 bp, Artificial Sequence
  Synthetic
tgtucagcacgcucaaggaaa

SEQ ID NO: 22509 - DNA, 19 bp, Artificial Sequence
  Synthetic
ggguaccctaugcccacca

SEQ ID NO: 22510 - DNA, 23 bp, Artificial Sequence
  Synthetic
ctgcccaggaaugctacagauac

SEQ ID NO: 22511 - DNA, 27 bp, Artificial Sequence
  Synthetic
aaaaccctgatguttcagtgtctagut

SEQ ID NO: 22512 - DNA, 26 bp, Artificial Sequence
  Synthetic
tgaguacaagaaauggcaggaaaaca

SEQ ID NO: 22513 - DNA, 24 bp, Artificial Sequence
  Synthetic
ggtgutcacagacaugaagaaggg

SEQ ID NO: 22514 - DNA, 21 bp, Artificial Sequence
  Synthetic
gtgagaccacugccaugaagt

SEQ ID NO: 22515 - DNA, 20 bp, Artificial Sequence
  Synthetic
gggatccaagugccttgugt

SEQ ID NO: 22516 - DNA, 19 bp, Artificial Sequence
  Synthetic
ctguctcaagcugcacgga

SEQ ID NO: 22517 - DNA, 20 bp, Artificial Sequence
  Synthetic
gccgctgugttaggaaguca

SEQ ID NO: 22518 - DNA, 18 bp, Artificial Sequence
  Synthetic
cagcgaggagcucugcat

SEQ ID NO: 22519 - DNA, 19 bp, Artificial Sequence
  Synthetic
cagtagccgutgcactugg

SEQ ID NO: 22520 - DNA, 22 bp, Artificial Sequence
  Synthetic
cgtgagtctcutcatgcctcug

SEQ ID NO: 22521 - DNA, 23 bp, Artificial Sequence
  Synthetic
gctctcacccutgtcttctgtut

SEQ ID NO: 22522 - DNA, 24 bp, Artificial Sequence
  Synthetic
gtcagataucgagtcccagttucc

SEQ ID NO: 22523 - DNA, 30 bp, Artificial Sequence
  Synthetic
ggttgtaaaauacaagctcatuaccacaaa

SEQ ID NO: 22524 - DNA, 20 bp, Artificial Sequence
  Synthetic
gttttggtucctgcccugaa

SEQ ID NO: 22525 - DNA, 21 bp, Artificial Sequence
  Synthetic
ccggcagagauacttcucgga

SEQ ID NO: 22526 - DNA, 22 bp, Artificial Sequence
  Synthetic
acatcgctugcacactgaguag

SEQ ID NO: 22527 - DNA, 21 bp, Artificial Sequence
  Synthetic
gtgagggtuccgacaactcut

SEQ ID NO: 22528 - DNA, 21 bp, Artificial Sequence
  Synthetic
gggactguggcatgcaactua

SEQ ID NO: 22529 - DNA, 31 bp, Artificial Sequence
  Synthetic
catcttggatttgtuctgatgatcatttcug

SEQ ID NO: 22530 - DNA, 17 bp, Artificial Sequence
  Synthetic
gtgtccucgccggtuca

SEQ ID NO: 22531 - DNA, 19 bp, Artificial Sequence
  Synthetic
ccagagacugaggcagugt

SEQ ID NO: 22532 - DNA, 20 bp, Artificial Sequence
  Synthetic
cccucgagucccagacagaa

SEQ ID NO: 22533 - DNA, 21 bp, Artificial Sequence
  Synthetic
tcaaaatgcggguctctgucc

SEQ ID NO: 22534 - DNA, 21 bp, Artificial Sequence
  Synthetic
cttcagcagcucaaacuggga

SEQ ID NO: 22535 - DNA, 18 bp, Artificial Sequence
  Synthetic
gactccucgcggtgtgut

SEQ ID NO: 22536 - DNA, 19 bp, Artificial Sequence
  Synthetic
tggtccauctcccccaugt

SEQ ID NO: 22537 - DNA, 21 bp, Artificial Sequence
  Synthetic
agctgccautctgacgucaaa

SEQ ID NO: 22538 - DNA, 22 bp, Artificial Sequence
  Synthetic
gggagtcugggaatgaacacua

SEQ ID NO: 22539 - DNA, 32 bp, Artificial Sequence
  Synthetic
acctgggatttauaataaccaaactgaaugag

SEQ ID NO: 22540 - DNA, 29 bp, Artificial Sequence
  Synthetic
ttagctaaagaacucatagaaaaguccag

SEQ ID NO: 22541 - DNA, 30 bp, Artificial Sequence
  Synthetic
gaaattctttccagutctgacatttgucaa

SEQ ID NO: 22542 - DNA, 20 bp, Artificial Sequence
  Synthetic
ccgtgtcugggatgcugaac

SEQ ID NO: 22543 - DNA, 20 bp, Artificial Sequence
  Synthetic
ctgacaaaggcguccugaga

SEQ ID NO: 22544 - DNA, 30 bp, Artificial Sequence
  Synthetic
gctttagaagctguttgtacactgtattut

SEQ ID NO: 22545 - DNA, 27 bp, Artificial Sequence
  Synthetic
ttgttggcagtuttaaagacctcttug

SEQ ID NO: 22546 - DNA, 31 bp, Artificial Sequence
  Synthetic
gataaagaaaaactguctgtctgttgaacuc

SEQ ID NO: 22547 - DNA, 28 bp, Artificial Sequence
  Synthetic
cgtatttctaauccctttcactcuggaa

SEQ ID NO: 22548 - DNA, 23 bp, Artificial Sequence
  Synthetic
tccaagctgautggtgcaactua

SEQ ID NO: 22549 - DNA, 23 bp, Artificial Sequence
  Synthetic
ccttgcgtuggatgttgtaacut

SEQ ID NO: 22550 - DNA, 25 bp, Artificial Sequence
  Synthetic
tttttgcattucccaagacagtgut

SEQ ID NO: 22551 - DNA, 28 bp, Artificial Sequence
  Synthetic
aagcttaaggacuatggagtggatctua

SEQ ID NO: 22552 - DNA, 18 bp, Artificial Sequence
  Synthetic
gccgugggtcucaaagag

SEQ ID NO: 22553 - DNA, 19 bp, Artificial Sequence
  Synthetic
ccuggagggaacttuccca

SEQ ID NO: 22554 - DNA, 27 bp, Artificial Sequence
  Synthetic
cttttctttcagcutcttgccttcaut

SEQ ID NO: 22555 - DNA, 27 bp, Artificial Sequence
  Synthetic
aaattgcattcucgattttgtctuggt

SEQ ID NO: 22556 - DNA, 23 bp, Artificial Sequence
  Synthetic
tcatctgtuccaaacgcacugat

SEQ ID NO: 22557 - DNA, 21 bp, Artificial Sequence
  Synthetic
gactttctcucctgcccucac

SEQ ID NO: 22558 - DNA, 18 bp, Artificial Sequence
  Synthetic
gcgcuacaacgtgugcct

SEQ ID NO: 22559 - DNA, 18 bp, Artificial Sequence
  Synthetic
atctuaccgcggcaccuc

SEQ ID NO: 22560 - DNA, 19 bp, Artificial Sequence
  Synthetic
gcauccagugccagaaccc

SEQ ID NO: 22561 - DNA, 19 bp, Artificial Sequence
  Synthetic
gctctctucccacgtucca

SEQ ID NO: 22562 - DNA, 20 bp, Artificial Sequence
  Synthetic
tgtggtccucacctaugcct

SEQ ID NO: 22563 - DNA, 20 bp, Artificial Sequence
  Synthetic
tcccgtucctaccagucact

SEQ ID NO: 22564 - DNA, 19 bp, Artificial Sequence
  Synthetic
gggcttgguaacgtccugt

SEQ ID NO: 22565 - DNA, 18 bp, Artificial Sequence
  Synthetic
ctccaugcccctcacuca

SEQ ID NO: 22566 - DNA, 21 bp, Artificial Sequence
  Synthetic
gcagagugacgaugagccaaa

SEQ ID NO: 22567 - DNA, 18 bp, Artificial Sequence
  Synthetic
cggcuccgguagaggagg

SEQ ID NO: 22568 - DNA, 19 bp, Artificial Sequence
  Synthetic
cuccccagagcugcagaag

SEQ ID NO: 22569 - DNA, 18 bp, Artificial Sequence
  Synthetic
gcagcugaggcagucgag

SEQ ID NO: 22570 - DNA, 21 bp, Artificial Sequence
  Synthetic
ggatgcagacucggacttcug

SEQ ID NO: 22571 - DNA, 20 bp, Artificial Sequence
  Synthetic
agucagcccacaggttcuct

SEQ ID NO: 22572 - DNA, 24 bp, Artificial Sequence
  Synthetic
ttttccuggtttgauacaggccat

SEQ ID NO: 22573 - DNA, 23 bp, Artificial Sequence
  Synthetic
ggtgacgacuccggagaaatauc

SEQ ID NO: 22574 - DNA, 23 bp, Artificial Sequence
  Synthetic
aacagctgcuaacaacaaacguc

SEQ ID NO: 22575 - DNA, 29 bp, Artificial Sequence
  Synthetic
cattactuaaagcagaaguaaacaacuct

SEQ ID NO: 22576 - DNA, 21 bp, Artificial Sequence
  Synthetic
tctgctaatgutgagcgccut

SEQ ID NO: 22577 - DNA, 29 bp, Artificial Sequence
  Synthetic
ggcatcagaaugtcatcagtaaauacaca

SEQ ID NO: 22578 - DNA, 30 bp, Artificial Sequence
  Synthetic
agttactaatttcuttccagttgtugcaga

SEQ ID NO: 22579 - DNA, 27 bp, Artificial Sequence
  Synthetic
acatctaggutacctgagaaucacgaa

SEQ ID NO: 22580 - DNA, 27 bp, Artificial Sequence
  Synthetic
tggacaaattgcutggagaacttcaua

SEQ ID NO: 22581 - DNA, 24 bp, Artificial Sequence
  Synthetic
tgaggagcuatgtgttcatucacc

SEQ ID NO: 22582 - DNA, 30 bp, Artificial Sequence
  Synthetic
ctaaattttgtttcugttagctgctaugat

SEQ ID NO: 22583 - DNA, 27 bp, Artificial Sequence
  Synthetic
agctcattcaauctctttcgaactuca

SEQ ID NO: 22584 - DNA, 28 bp, Artificial Sequence
  Synthetic
gggcgaacagutaattctaattgugaaa

SEQ ID NO: 22585 - DNA, 29 bp, Artificial Sequence
  Synthetic
aactttuaaaggaaagagcacacaugaac

SEQ ID NO: 22586 - DNA, 31 bp, Artificial Sequence
  Synthetic
ctaaggtatgaautggataatgtctugaggt

SEQ ID NO: 22587 - DNA, 27 bp, Artificial Sequence
  Synthetic
ttgaattttgctuggtgtcttcttcug

SEQ ID NO: 22588 - DNA, 26 bp, Artificial Sequence
  Synthetic
agagagagcuaaaacaatugcaggaa

SEQ ID NO: 22589 - DNA, 31 bp, Artificial Sequence
  Synthetic
agtactttcagtugacctaaggtttuaaaca

SEQ ID NO: 22590 - DNA, 23 bp, Artificial Sequence
  Synthetic
tgaagctctgauggctgaacauc

SEQ ID NO: 22591 - DNA, 28 bp, Artificial Sequence
  Synthetic
ggcaggtgacauttttagaaaagtgaut

SEQ ID NO: 22592 - DNA, 22 bp, Artificial Sequence
  Synthetic
caautgcccttttucggcagat

SEQ ID NO: 22593 - DNA, 29 bp, Artificial Sequence
  Synthetic
attgatttgttctugccattgttcttuct

SEQ ID NO: 22594 - DNA, 23 bp, Artificial Sequence
  Synthetic
cuaaatgaacttaugcgccagca

SEQ ID NO: 22595 - DNA, 26 bp, Artificial Sequence
  Synthetic
agagattuacaggctgtgtuggaaag

SEQ ID NO: 22596 - DNA, 22 bp, Artificial Sequence
  Synthetic
gcagutcctctatuggagcaga

SEQ ID NO: 22597 - DNA, 21 bp, Artificial Sequence
  Synthetic
atcacaaacgucctcccuagt

SEQ ID NO: 22598 - DNA, 29 bp, Artificial Sequence
  Synthetic
tcccaagtcaaaaaguaagaagaggaaut

SEQ ID NO: 22599 - DNA, 25 bp, Artificial Sequence
  Synthetic
cctgcacauctagccttacugaaac

SEQ ID NO: 22600 - DNA, 33 bp, Artificial Sequence
  Synthetic
gataatttaaagcugagagtaatgatacuagct

SEQ ID NO: 22601 - DNA, 24 bp, Artificial Sequence
  Synthetic
tcgcaaagcutcaaacauggaaaa

SEQ ID NO: 22602 - DNA, 27 bp, Artificial Sequence
  Synthetic
agtatccagacauatttcugagagcca

SEQ ID NO: 22603 - DNA, 27 bp, Artificial Sequence
  Synthetic
cagcttacaucatcagtaguagcaagg

SEQ ID NO: 22604 - DNA, 33 bp, Artificial Sequence
  Synthetic
aataggctttgtuaggctaatgtattttcttut

SEQ ID NO: 22605 - DNA, 26 bp, Artificial Sequence
  Synthetic
gctgctgaguatcaattcuaggacat

SEQ ID NO: 22606 - DNA, 30 bp, Artificial Sequence
  Synthetic
agtgttgttcaaugaattggctttcttuaa

SEQ ID NO: 22607 - DNA, 26 bp, Artificial Sequence
  Synthetic
acgtuatttacctcttuggcacaaga

SEQ ID NO: 22608 - DNA, 25 bp, Artificial Sequence
  Synthetic
tttgtcuaaagctgaaacucaggct

SEQ ID NO: 22609 - DNA, 28 bp, Artificial Sequence
  Synthetic
tgttcattttctucagtagcttcagugt

SEQ ID NO: 22610 - DNA, 27 bp, Artificial Sequence
  Synthetic
gacagatgaccaaaauaactgtccugt

SEQ ID NO: 22611 - DNA, 23 bp, Artificial Sequence
  Synthetic
aggcacuaagggttccattucag

SEQ ID NO: 22612 - DNA, 28 bp, Artificial Sequence
  Synthetic
agttgaagattuaccactgaaacugaca

SEQ ID NO: 22613 - DNA, 30 bp, Artificial Sequence
  Synthetic
cttagatctgccuttggaatgaaaatuaaa

SEQ ID NO: 22614 - DNA, 21 bp, Artificial Sequence
  Synthetic
ggugggaguccagagtataug

SEQ ID NO: 22615 - DNA, 24 bp, Artificial Sequence
  Synthetic
gggagaaaugaccacacctaucaa

SEQ ID NO: 22616 - DNA, 31 bp, Artificial Sequence
  Synthetic
gattatagggaggaucauttaaaggtaugaa

SEQ ID NO: 22617 - DNA, 23 bp, Artificial Sequence
  Synthetic
gctagggtuggatcctcagatug

SEQ ID NO: 22618 - DNA, 24 bp, Artificial Sequence
  Synthetic
tgcaaagtgttugtgaatggctut

SEQ ID NO: 22619 - DNA, 25 bp, Artificial Sequence
  Synthetic
acaatcaagagcutctgaaggucaa

SEQ ID NO: 22620 - DNA, 24 bp, Artificial Sequence
  Synthetic
ggccaagugacgtttaaauccaag

SEQ ID NO: 22621 - DNA, 25 bp, Artificial Sequence
  Synthetic
ctccugagaaaauccacaagtguaa

SEQ ID NO: 22622 - DNA, 22 bp, Artificial Sequence
  Synthetic
tgucacacagtuggcaaggaaa

SEQ ID NO: 22623 - DNA, 23 bp, Artificial Sequence
  Synthetic
tccaacaagaaggccuggttuag

SEQ ID NO: 22624 - DNA, 22 bp, Artificial Sequence
  Synthetic
tgttgtgtcuccctcctgctua

SEQ ID NO: 22625 - DNA, 23 bp, Artificial Sequence
  Synthetic
ccacttgtttuccagtgcacuct

SEQ ID NO: 22626 - DNA, 24 bp, Artificial Sequence
  Synthetic
gttgcatcaugggactctgtguat

SEQ ID NO: 22627 - DNA, 25 bp, Artificial Sequence
  Synthetic
cccccaccaguctctacaatauaac

SEQ ID NO: 22628 - DNA, 27 bp, Artificial Sequence
  Synthetic
ctucagagaggaagaaaugacaaaagc

SEQ ID NO: 22629 - DNA, 25 bp, Artificial Sequence
  Synthetic
tttagaaucgccagccacttaugaa

SEQ ID NO: 22630 - DNA, 22 bp, Artificial Sequence
  Synthetic
gagatgcauactgctgugggaa

SEQ ID NO: 22631 - DNA, 28 bp, Artificial Sequence
  Synthetic
gagaaaacagccutatattgactcugct

SEQ ID NO: 22632 - DNA, 23 bp, Artificial Sequence
  Synthetic
gcaaaagacgccuggtctauagg

SEQ ID NO: 22633 - DNA, 22 bp, Artificial Sequence
  Synthetic
tcttcuccctttcuagggccat

SEQ ID NO: 22634 - DNA, 23 bp, Artificial Sequence
  Synthetic
gattacccaucattcctggcuga

SEQ ID NO: 22635 - DNA, 21 bp, Artificial Sequence
  Synthetic
acugggcaggttatugccaaa

SEQ ID NO: 22636 - DNA, 29 bp, Artificial Sequence
  Synthetic
atccttgatggauacagattaguacacct

SEQ ID NO: 22637 - DNA, 26 bp, Artificial Sequence
  Synthetic
gaaauaacccccaaactugagagact

SEQ ID NO: 22638 - DNA, 22 bp, Artificial Sequence
  Synthetic
atccgacaaagagcuggcuaag

SEQ ID NO: 22639 - DNA, 22 bp, Artificial Sequence
  Synthetic
ggaaacaaaugaccccaaccug

SEQ ID NO: 22640 - DNA, 27 bp, Artificial Sequence
  Synthetic
cattgagggagcugttggtataacuat

SEQ ID NO: 22641 - DNA, 21 bp, Artificial Sequence
  Synthetic
ctttcaccaaggcaucgcaug

SEQ ID NO: 22642 - DNA, 21 bp, Artificial Sequence
  Synthetic
ttccccatcguttgtccaguc

SEQ ID NO: 22643 - DNA, 26 bp, Artificial Sequence
  Synthetic
ttcttttaaggugaagaggccatauc

SEQ ID NO: 22644 - DNA, 23 bp, Artificial Sequence
  Synthetic
ggacacagautctccttcaugct

SEQ ID NO: 22645 - DNA, 27 bp, Artificial Sequence
  Synthetic
gatcaacatguaggtataatgccugct

SEQ ID NO: 22646 - DNA, 27 bp, Artificial Sequence
  Synthetic
tttcatatttcugatgagcttccuggt

SEQ ID NO: 22647 - DNA, 27 bp, Artificial Sequence
  Synthetic
gtaaaactggautacttttgcctugct

SEQ ID NO: 22648 - DNA, 30 bp, Artificial Sequence
  Synthetic
agtgtggattcuccttaaattatatucacc

SEQ ID NO: 22649 - DNA, 19 bp, Artificial Sequence
  Synthetic
tcuacagggcagggtguca

SEQ ID NO: 22650 - DNA, 28 bp, Artificial Sequence
  Synthetic
gcacatttgucaggtttgaagtuaaagt

SEQ ID NO: 22651 - DNA, 26 bp, Artificial Sequence
  Synthetic
tcutctttuaagcccuaaaaggaaca

SEQ ID NO: 22652 - DNA, 25 bp, Artificial Sequence
  Synthetic
caccataauggaccaaagtgcaaut

SEQ ID NO: 22653 - DNA, 25 bp, Artificial Sequence
  Synthetic
gcaggaaaactuccacacatcatug

SEQ ID NO: 22654 - DNA, 29 bp, Artificial Sequence
  Synthetic
cctgttagcatuctaagcttctatguact

SEQ ID NO: 22655 - DNA, 28 bp, Artificial Sequence
  Synthetic
tgaaagtucaaaaacaggaggaagaugt

SEQ ID NO: 22656 - DNA, 27 bp, Artificial Sequence
  Synthetic
gcaggttgugtttgttcuaaaagagaa

SEQ ID NO: 22657 - DNA, 29 bp, Artificial Sequence
  Synthetic
tggttacttagcugtgttcattttctugt

SEQ ID NO: 22658 - DNA, 29 bp, Artificial Sequence
  Synthetic
aacaatagtacgguaatgaagaagcttua

SEQ ID NO: 22659 - DNA, 20 bp, Artificial Sequence
  Synthetic
gccttucacaaggcgtguca

SEQ ID NO: 22660 - DNA, 32 bp, Artificial Sequence
  Synthetic
aaagaataattctauacctttggagcataucc

SEQ ID NO: 22661 - DNA, 32 bp, Artificial Sequence
  Synthetic
gttgataacagaagagaaugaagaagaacaua

SEQ ID NO: 22662 - DNA, 30 bp, Artificial Sequence
  Synthetic
tcaatgctatcatauaagtgacatcttgut

SEQ ID NO: 22663 - DNA, 30 bp, Artificial Sequence
  Synthetic
gacgtccaattguaaagccagaatatttua

SEQ ID NO: 22664 - DNA, 21 bp, Artificial Sequence
  Synthetic
tggcugaaacaaagctgucca

SEQ ID NO: 22665 - DNA, 32 bp, Artificial Sequence
  Synthetic
attctaagtatgguacctttgttaaugaggaa

SEQ ID NO: 22666 - DNA, 22 bp, Artificial Sequence
  Synthetic
cagtcgcuaccgggaaaauagg

SEQ ID NO: 22667 - DNA, 18 bp, Artificial Sequence
  Synthetic
gtcuagcagccccggtua

SEQ ID NO: 22668 - DNA, 22 bp, Artificial Sequence
  Synthetic
gcttctcccaguctttgtgcug

SEQ ID NO: 22669 - DNA, 28 bp, Artificial Sequence
  Synthetic
aacagtgtattaacutgggatcttgcut

SEQ ID NO: 22670 - DNA, 29 bp, Artificial Sequence
  Synthetic
gtcagcatuaacagcataagaaatatgug

SEQ ID NO: 22671 - DNA, 22 bp, Artificial Sequence
  Synthetic
cagugacgccgaggactuaaaa

SEQ ID NO: 22672 - DNA, 23 bp, Artificial Sequence
  Synthetic
actcttcugcccattctctguct

SEQ ID NO: 22673 - DNA, 24 bp, Artificial Sequence
  Synthetic
gtgtgtttaugggttgtgtacuga

SEQ ID NO: 22674 - DNA, 23 bp, Artificial Sequence
  Synthetic
cctcaugccacaggtaugggaaa

SEQ ID NO: 22675 - DNA, 21 bp, Artificial Sequence
  Synthetic
gcatgaacagcugcttcugga

SEQ ID NO: 22676 - DNA, 23 bp, Artificial Sequence
  Synthetic
gutgatuagucagagaggaggag

SEQ ID NO: 22677 - DNA, 27 bp, Artificial Sequence
  Synthetic
ttcctcatgcaugttctctgtaagtut

SEQ ID NO: 22678 - DNA, 28 bp, Artificial Sequence
  Synthetic
cutcatuggaaaaauagagagaacacag

SEQ ID NO: 22679 - DNA, 19 bp, Artificial Sequence
  Synthetic
tcctctcugctgccacuca

SEQ ID NO: 22680 - DNA, 23 bp, Artificial Sequence
  Synthetic
gatctgtcccauctccctuaggt

SEQ ID NO: 22681 - DNA, 21 bp, Artificial Sequence
  Synthetic
agccccaucgagctactttuc

SEQ ID NO: 22682 - DNA, 23 bp, Artificial Sequence
  Synthetic
atggtctcuagaggcatctccut

SEQ ID NO: 22683 - DNA, 31 bp, Artificial Sequence
  Synthetic
gcaaaagacccaaaacuatatccatagauga

SEQ ID NO: 22684 - DNA, 33 bp, Artificial Sequence
  Synthetic
ggtcactctttauactacatttaaggtucaaaa

SEQ ID NO: 22685 - DNA, 28 bp, Artificial Sequence
  Synthetic
ctggagtcttcaaugtatcagaactugt

SEQ ID NO: 22686 - DNA, 21 bp, Artificial Sequence
  Synthetic
tgaugtggcuggacacaaagt

SEQ ID NO: 22687 - DNA, 19 bp, Artificial Sequence
  Synthetic
gagaaucgactgccugcga

SEQ ID NO: 22688 - DNA, 21 bp, Artificial Sequence
  Synthetic
tgtgcggaggutaacucaagc

SEQ ID NO: 22689 - DNA, 23 bp, Artificial Sequence
  Synthetic
aaagtgcgttutaaggcgaaguc

SEQ ID NO: 22690 - DNA, 25 bp, Artificial Sequence
  Synthetic
ttttaaaagcagucctggcaaaugg

SEQ ID NO: 22691 - DNA, 28 bp, Artificial Sequence
  Synthetic
gctgaataaauctcttgcugaacaaaga

SEQ ID NO: 22692 - DNA, 30 bp, Artificial Sequence
  Synthetic
agaatccacatgacutgaaatcacttacut

SEQ ID NO: 22693 - DNA, 26 bp, Artificial Sequence
  Synthetic
tcatgaaggatgugaacagatgcaut

SEQ ID NO: 22694 - DNA, 24 bp, Artificial Sequence
  Synthetic
cagagtcactuccactttcacuca

SEQ ID NO: 22695 - DNA, 26 bp, Artificial Sequence
  Synthetic
gaugaagaggaaggaactguacaaca

SEQ ID NO: 22696 - DNA, 24 bp, Artificial Sequence
  Synthetic
tccaggcttuctaattctgctucc

SEQ ID NO: 22697 - DNA, 29 bp, Artificial Sequence
  Synthetic
agtgttaagtataauggacctgagaguca

SEQ ID NO: 22698 - DNA, 31 bp, Artificial Sequence
  Synthetic
gcgagctaattugtcttctttctcttuaagt

SEQ ID NO: 22699 - DNA, 22 bp, Artificial Sequence
  Synthetic
gcgtaaatgccuctacccauct

SEQ ID NO: 22700 - DNA, 22 bp, Artificial Sequence
  Synthetic
cgaacctcaugcacattcucaa

SEQ ID NO: 22701 - DNA, 29 bp, Artificial Sequence
  Synthetic
ctctattatcaaacaaaugtgccacctuc

SEQ ID NO: 22702 - DNA, 32 bp, Artificial Sequence
  Synthetic
tgaatgaatttctcaucttttgtagtccguat

SEQ ID NO: 22703 - DNA, 27 bp, Artificial Sequence
  Synthetic
acactgtctcaagauttatcgcacaut

SEQ ID NO: 22704 - DNA, 22 bp, Artificial Sequence
  Synthetic
gctgggaagugattgatguggt

SEQ ID NO: 22705 - DNA, 24 bp, Artificial Sequence
  Synthetic
gctgacatucctctttguaacgct

SEQ ID NO: 22706 - DNA, 21 bp, Artificial Sequence
  Synthetic
cccutgtggtgtuccaaggag

SEQ ID NO: 22707 - DNA, 21 bp, Artificial Sequence
  Synthetic
gcugcaaagcaacgacugaag

SEQ ID NO: 22708 - DNA, 31 bp, Artificial Sequence
  Synthetic
cggtaaataaaaaccugtagaaagtcucgaa

SEQ ID NO: 22709 - DNA, 27 bp, Artificial Sequence
  Synthetic
ctgautttctgatcatucggacaagac

SEQ ID NO: 22710 - DNA, 21 bp, Artificial Sequence
  Synthetic
tcctgaggugtgcgcauaaaa

SEQ ID NO: 22711 - DNA, 22 bp, Artificial Sequence
  Synthetic
tcgcccaccuctgaaaaaguac

SEQ ID NO: 22712 - DNA, 29 bp, Artificial Sequence
  Synthetic
agagaattcgacucttcttcagagaugat

SEQ ID NO: 22713 - DNA, 22 bp, Artificial Sequence
  Synthetic
gctgttggaaccucctgtttug

SEQ ID NO: 22714 - DNA, 22 bp, Artificial Sequence
  Synthetic
cctccccaucccagatgauaga

SEQ ID NO: 22715 - DNA, 27 bp, Artificial Sequence
  Synthetic
agaaagacacaacaugaacctgtgaua

SEQ ID NO: 22716 - DNA, 25 bp, Artificial Sequence
  Synthetic
tctgattcuactgagcatuccacct

SEQ ID NO: 22717 - DNA, 24 bp, Artificial Sequence
  Synthetic
tggaaaagtgutacgcttccuaca

SEQ ID NO: 22718 - DNA, 25 bp, Artificial Sequence
  Synthetic
gatgtctuctccacttucagacaca

SEQ ID NO: 22719 - DNA, 19 bp, Artificial Sequence
  Synthetic
gagctugcagccccttuac

SEQ ID NO: 22720 - DNA, 22 bp, Artificial Sequence
  Synthetic
ggccaccuccagatgaatctuc

SEQ ID NO: 22721 - DNA, 21 bp, Artificial Sequence
  Synthetic
gctggtaggguaagggagcua

SEQ ID NO: 22722 - DNA, 19 bp, Artificial Sequence
  Synthetic
ggguagctgauggcccaag

SEQ ID NO: 22723 - DNA, 22 bp, Artificial Sequence
  Synthetic
ttctctcuccacccaccauaca

SEQ ID NO: 22724 - DNA, 18 bp, Artificial Sequence
  Synthetic
cgtgcaucacgaggcgua

SEQ ID NO: 22725 - DNA, 21 bp, Artificial Sequence
  Synthetic
gacttccuccggaagcagaug

SEQ ID NO: 22726 - DNA, 31 bp, Artificial Sequence
  Synthetic
tttttaaaagttccucttacctatgctguga

SEQ ID NO: 22727 - DNA, 22 bp, Artificial Sequence
  Synthetic
ggttgtctgugcatagctggut

SEQ ID NO: 22728 - DNA, 23 bp, Artificial Sequence
  Synthetic
cctgacaccutgatgagcaagut

SEQ ID NO: 22729 - DNA, 22 bp, Artificial Sequence
  Synthetic
gtgcttcucctatgtgacuggt

SEQ ID NO: 22730 - DNA, 22 bp, Artificial Sequence
  Synthetic
ctccttcttgutctgggctcuc

SEQ ID NO: 22731 - DNA, 28 bp, Artificial Sequence
  Synthetic
caacgaagcacuaatggtcaaacaauac

SEQ ID NO: 22732 - DNA, 24 bp, Artificial Sequence
  Synthetic
gcttgctucaatttgttgtgucca

SEQ ID NO: 22733 - DNA, 26 bp, Artificial Sequence
  Synthetic
cccgaaaaatacutcgacaaactucc

SEQ ID NO: 22734 - DNA, 29 bp, Artificial Sequence
  Synthetic
ccagagattuaggaagaggaaauggaaat

SEQ ID NO: 22735 - DNA, 27 bp, Artificial Sequence
  Synthetic
cctcagucacaacaaaautaaatcuca

SEQ ID NO: 22736 - DNA, 28 bp, Artificial Sequence
  Synthetic
gtcatagtcttcaucccactgataagut

SEQ ID NO: 22737 - DNA, 28 bp, Artificial Sequence
  Synthetic
agcgtattctgaguttactcactttcuc

SEQ ID NO: 22738 - DNA, 18 bp, Artificial Sequence
  Synthetic
cagaagccgucacagugg

SEQ ID NO: 22739 - DNA, 28 bp, Artificial Sequence
  Synthetic
cagagacgctuttgaaatttctacugaa

SEQ ID NO: 22740 - DNA, 20 bp, Artificial Sequence
  Synthetic
tgtggctuccacgatcacut

SEQ ID NO: 22741 - DNA, 17 bp, Artificial Sequence
  Synthetic
tggtccgcutcgccaug

SEQ ID NO: 22742 - DNA, 19 bp, Artificial Sequence
  Synthetic
cauccaggacgggugcaaa

SEQ ID NO: 22743 - DNA, 24 bp, Artificial Sequence
  Synthetic
gcutgtaacattuaggacagagct

SEQ ID NO: 22744 - DNA, 21 bp, Artificial Sequence
  Synthetic
cgaugtactgcucccagaaga

SEQ ID NO: 22745 - DNA, 22 bp, Artificial Sequence
  Synthetic
ccctttctaccucaacggctug

SEQ ID NO: 22746 - DNA, 18 bp, Artificial Sequence
  Synthetic
ctgucaagcagccuccac

SEQ ID NO: 22747 - DNA, 22 bp, Artificial Sequence
  Synthetic
tggatcagacgauggagtccut

SEQ ID NO: 22748 - DNA, 31 bp, Artificial Sequence
  Synthetic
ttgaattgtgcagcaauaaagtcatattcuc

SEQ ID NO: 22749 - DNA, 22 bp, Artificial Sequence
  Synthetic
ctgaccttgugcctcttctgut

SEQ ID NO: 22750 - DNA, 22 bp, Artificial Sequence
  Synthetic
ggacaguggactgcatgguaat

SEQ ID NO: 22751 - DNA, 23 bp, Artificial Sequence
  Synthetic
gcaacatgttucccctccttuca

SEQ ID NO: 22752 - DNA, 22 bp, Artificial Sequence
  Synthetic
gatuaacgcggccaugaagaag

SEQ ID NO: 22753 - DNA, 20 bp, Artificial Sequence
  Synthetic
atgtccagugcagctcucag

SEQ ID NO: 22754 - DNA, 19 bp, Artificial Sequence
  Synthetic
agcatggcaucgagcgtua

SEQ ID NO: 22755 - DNA, 22 bp, Artificial Sequence
  Synthetic
gttcaucagagtgucgcacaga

SEQ ID NO: 22756 - DNA, 24 bp, Artificial Sequence
  Synthetic
guggctttugaggaaaggaagaag

SEQ ID NO: 22757 - DNA, 26 bp, Artificial Sequence
  Synthetic
cttgttttgaauggtggatgtcaugg

SEQ ID NO: 22758 - DNA, 25 bp, Artificial Sequence
  Synthetic
ctgagtccuagagaagucacagaca

SEQ ID NO: 22759 - DNA, 27 bp, Artificial Sequence
  Synthetic
catggcctcutctttttaacttugaca

SEQ ID NO: 22760 - DNA, 22 bp, Artificial Sequence
  Synthetic
gtggtcaggacautagcaccut

SEQ ID NO: 22761 - DNA, 32 bp, Artificial Sequence
  Synthetic
gtttgcagtgautttgctattctaatuaaacc

SEQ ID NO: 22762 - DNA, 22 bp, Artificial Sequence
  Synthetic
ctcctccucctccgtcttuaca

SEQ ID NO: 22763 - DNA, 18 bp, Artificial Sequence
  Synthetic
gagggccauggaacugct

SEQ ID NO: 22764 - DNA, 24 bp, Artificial Sequence
  Synthetic
ccttttctctguccctgcagauat

SEQ ID NO: 22765 - DNA, 22 bp, Artificial Sequence
  Synthetic
ccatggtcagcutggtgtaguc

SEQ ID NO: 22766 - DNA, 23 bp, Artificial Sequence
  Synthetic
cctccatguacttcaagcagucc

SEQ ID NO: 22767 - DNA, 17 bp, Artificial Sequence
  Synthetic
cttcaucggcgggucca

SEQ ID NO: 22768 - DNA, 18 bp, Artificial Sequence
  Synthetic
gctugagagccacccgua

SEQ ID NO: 22769 - DNA, 17 bp, Artificial Sequence
  Synthetic
acgacgagcucctgcug

SEQ ID NO: 22770 - DNA, 21 bp, Artificial Sequence
  Synthetic
agacgucgaaaccgatgucag

SEQ ID NO: 22771 - DNA, 27 bp, Artificial Sequence
  Synthetic
gaactagaaaaatucaccatcccaaug

SEQ ID NO: 22772 - DNA, 31 bp, Artificial Sequence
  Synthetic
gatcagggtctcuatttatggctactaguaa

SEQ ID NO: 22773 - DNA, 28 bp, Artificial Sequence
  Synthetic
aatggatgcacugaattgctaaaugaag

SEQ ID NO: 22774 - DNA, 21 bp, Artificial Sequence
  Synthetic
gcaatggacutgtcctgcauc

SEQ ID NO: 22775 - DNA, 22 bp, Artificial Sequence
  Synthetic
gttttggcaagguggtgctuac

SEQ ID NO: 22776 - DNA, 23 bp, Artificial Sequence
  Synthetic
ttcctggacacccuacctttcua

SEQ ID NO: 22777 - DNA, 25 bp, Artificial Sequence
  Synthetic
aaaguctttgctttcuacaggagct

SEQ ID NO: 22778 - DNA, 24 bp, Artificial Sequence
  Synthetic
cagaactcugcttgagaacuacca

SEQ ID NO: 22779 - DNA, 26 bp, Artificial Sequence
  Synthetic
cttcacgagutatcatcaggucaact

SEQ ID NO: 22780 - DNA, 21 bp, Artificial Sequence
  Synthetic
gggactuccctaacagcaugg

SEQ ID NO: 22781 - DNA, 26 bp, Artificial Sequence
  Synthetic
ccaataaaactuagcgcagaaacgua

SEQ ID NO: 22782 - DNA, 28 bp, Artificial Sequence
  Synthetic
tttggttggaagaccugttcatattuct

SEQ ID NO: 22783 - DNA, 26 bp, Artificial Sequence
  Synthetic
agatttccatutgatttcgguggact

SEQ ID NO: 22784 - DNA, 26 bp, Artificial Sequence
  Synthetic
caggaggaugaaggagaagatgacua

SEQ ID NO: 22785 - DNA, 28 bp, Artificial Sequence
  Synthetic
gaguagagaaaagagaccucaagaacag

SEQ ID NO: 22786 - DNA, 25 bp, Artificial Sequence
  Synthetic
gaatctttgacucccctgaggaaut

SEQ ID NO: 22787 - DNA, 30 bp, Artificial Sequence
  Synthetic
ggatcatcuccgggtttattttgaauaaga

SEQ ID NO: 22788 - DNA, 30 bp, Artificial Sequence
  Synthetic
ttgagataccttgugtattcagtaattucc

SEQ ID NO: 22789 - DNA, 25 bp, Artificial Sequence
  Synthetic
gcctcctgcauctttcaaaagctua

SEQ ID NO: 22790 - DNA, 26 bp, Artificial Sequence
  Synthetic
ggaacagguagcatctaaggaauaga

SEQ ID NO: 22791 - DNA, 27 bp, Artificial Sequence
  Synthetic
cctctgacaggaugatctgactcauaa

SEQ ID NO: 22792 - DNA, 25 bp, Artificial Sequence
  Synthetic
gtgggatcugagaaaaatugcacat

SEQ ID NO: 22793 - DNA, 25 bp, Artificial Sequence
  Synthetic
gctcaccatucctcaatgtaacuga

SEQ ID NO: 22794 - DNA, 23 bp, Artificial Sequence
  Synthetic
gggaatcutggctacuggaggat

SEQ ID NO: 22795 - DNA, 30 bp, Artificial Sequence
  Synthetic
gaaagaagactauttctgcactaacuacca

SEQ ID NO: 22796 - DNA, 22 bp, Artificial Sequence
  Synthetic
cccacagaaacuggatgctuct

SEQ ID NO: 22797 - DNA, 21 bp, Artificial Sequence
  Synthetic
ccagtgaccguagcagaugac

SEQ ID NO: 22798 - DNA, 25 bp, Artificial Sequence
  Synthetic
agaatcttcuagcaggctcttcuga

SEQ ID NO: 22799 - DNA, 20 bp, Artificial Sequence
  Synthetic
gcugagtgguccagaagcag

SEQ ID NO: 22800 - DNA, 28 bp, Artificial Sequence
  Synthetic
gaagctatgacutgcagttttuaaacct

SEQ ID NO: 22801 - DNA, 27 bp, Artificial Sequence
  Synthetic
ctacttucagaaaaacacccucaggaa

SEQ ID NO: 22802 - DNA, 25 bp, Artificial Sequence
  Synthetic
gtugaggaagucagagaacaaaaug

SEQ ID NO: 22803 - DNA, 27 bp, Artificial Sequence
  Synthetic
aaagagguagcaattgttacaugagct

SEQ ID NO: 22804 - DNA, 25 bp, Artificial Sequence
  Synthetic
aacaaucgggaaatcaucaaccaac

SEQ ID NO: 22805 - DNA, 27 bp, Artificial Sequence
  Synthetic
cccatatttatugagtgcaagtccuct

SEQ ID NO: 22806 - DNA, 28 bp, Artificial Sequence
  Synthetic
agtgaaaattactuagcttttgggctug

SEQ ID NO: 22807 - DNA, 22 bp, Artificial Sequence
  Synthetic
cttcactcuccagagacuggga

SEQ ID NO: 22808 - DNA, 20 bp, Artificial Sequence
  Synthetic
ctugccacgaaaaccgugaa

SEQ ID NO: 22809 - DNA, 25 bp, Artificial Sequence
  Synthetic
ctgtgacucagacagctcataauca

SEQ ID NO: 22810 - DNA, 21 bp, Artificial Sequence
  Synthetic
acaggcugagcuacagggaat

SEQ ID NO: 22811 - DNA, 22 bp, Artificial Sequence
  Synthetic
gggttgaagucacagctgttuc

SEQ ID NO: 22812 - DNA, 25 bp, Artificial Sequence
  Synthetic
caaaccttctuatgaggccatucct

SEQ ID NO: 22813 - DNA, 23 bp, Artificial Sequence
  Synthetic
ggaaagagcagutccagaaggug

SEQ ID NO: 22814 - DNA, 21 bp, Artificial Sequence
  Synthetic
tgtgacaucctcugcaaccac

SEQ ID NO: 22815 - DNA, 27 bp, Artificial Sequence
  Synthetic
cttccaaaugaaaaactagtctugcca

SEQ ID NO: 22816 - DNA, 24 bp, Artificial Sequence
  Synthetic
cacttcuagaggagcaacagucag

SEQ ID NO: 22817 - DNA, 25 bp, Artificial Sequence
  Synthetic
ctctgcagaaagugctacaagacua

SEQ ID NO: 22818 - DNA, 21 bp, Artificial Sequence
  Synthetic
ctgccagtuctagctcagcut

SEQ ID NO: 22819 - DNA, 19 bp, Artificial Sequence
  Synthetic
gctgtgcuaccagtcugct

SEQ ID NO: 22820 - DNA, 23 bp, Artificial Sequence
  Synthetic
ccagtagcuccagttccttcuca

SEQ ID NO: 22821 - DNA, 22 bp, Artificial Sequence
  Synthetic
cugagguaccaccaaagacaga

SEQ ID NO: 22822 - DNA, 22 bp, Artificial Sequence
  Synthetic
ggaggaaaacccagucaggaug

SEQ ID NO: 22823 - DNA, 26 bp, Artificial Sequence
  Synthetic
gtcactgaagcuttgataacacccua

SEQ ID NO: 22824 - DNA, 19 bp, Artificial Sequence
  Synthetic
gtgccagcautcggtucag

SEQ ID NO: 22825 - DNA, 20 bp, Artificial Sequence
  Synthetic
agtacaggccccuagtgcut

SEQ ID NO: 22826 - DNA, 23 bp, Artificial Sequence
  Synthetic
aatctgagucctgaccttugcac

SEQ ID NO: 22827 - DNA, 20 bp, Artificial Sequence
  Synthetic
ggaucgaaaggcctgcugac

SEQ ID NO: 22828 - DNA, 21 bp, Artificial Sequence
  Synthetic
ccagucggagacgttggaaug

SEQ ID NO: 22829 - DNA, 19 bp, Artificial Sequence
  Synthetic
acagctacucctcgccugt

SEQ ID NO: 22830 - DNA, 20 bp, Artificial Sequence
  Synthetic
gctctccacucaggaagcuc

SEQ ID NO: 22831 - DNA, 22 bp, Artificial Sequence
  Synthetic
acutacagaugcagcagcagaa

SEQ ID NO: 22832 - DNA, 23 bp, Artificial Sequence
  Synthetic
cgcattgaccautcaaactggug

SEQ ID NO: 22833 - DNA, 17 bp, Artificial Sequence
  Synthetic
ccggcuggccttugaga

SEQ ID NO: 22834 - DNA, 17 bp, Artificial Sequence
  Synthetic
cttgccguccugggact

SEQ ID NO: 22835 - DNA, 18 bp, Artificial Sequence
  Synthetic
ctaccugggcagccucaa

SEQ ID NO: 22836 - DNA, 20 bp, Artificial Sequence
  Synthetic
gattcagcccucacgtcucc

SEQ ID NO: 22837 - DNA, 23 bp, Artificial Sequence
  Synthetic
cctaccccauctgcttcttucac

SEQ ID NO: 22838 - DNA, 21 bp, Artificial Sequence
  Synthetic
cctaccuggaagacacctugt

SEQ ID NO: 22839 - DNA, 20 bp, Artificial Sequence
  Synthetic
gctacucacgctctgaugcc

SEQ ID NO: 22840 - DNA, 18 bp, Artificial Sequence
  Synthetic
ccatgcagucggcgucaa

SEQ ID NO: 22841 - DNA, 21 bp, Artificial Sequence
  Synthetic
ggctctgcucactccctcuat

SEQ ID NO: 22842 - DNA, 21 bp, Artificial Sequence
  Synthetic
actutgaagcccucagggaac

SEQ ID NO: 22843 - DNA, 17 bp, Artificial Sequence
  Synthetic
gcgcagcugcactucat

SEQ ID NO: 22844 - DNA, 19 bp, Artificial Sequence
  Synthetic
gatcatcugctggccgugt

SEQ ID NO: 22845 - DNA, 19 bp, Artificial Sequence
  Synthetic
actgugcggagcatguacc

SEQ ID NO: 22846 - DNA, 17 bp, Artificial Sequence
  Synthetic
cgcacgcguggttgtug

SEQ ID NO: 22847 - DNA, 19 bp, Artificial Sequence
  Synthetic
ggctctugtgccacaucct

SEQ ID NO: 22848 - DNA, 17 bp, Artificial Sequence
  Synthetic
ctgcaccccugcaccua

SEQ ID NO: 22849 - DNA, 19 bp, Artificial Sequence
  Synthetic
cactgcccugctctuaccc

SEQ ID NO: 22850 - DNA, 17 bp, Artificial Sequence
  Synthetic
ctgcccuggccauggat

SEQ ID NO: 22851 - DNA, 17 bp, Artificial Sequence
  Synthetic
gacgagugcctcuccca

SEQ ID NO: 22852 - DNA, 19 bp, Artificial Sequence
  Synthetic
gggtgguagacaggugagg

SEQ ID NO: 22853 - DNA, 17 bp, Artificial Sequence
  Synthetic
cccaguaccgcugcgag

SEQ ID NO: 22854 - DNA, 17 bp, Artificial Sequence
  Synthetic
gutccctuccacggcct

SEQ ID NO: 22855 - DNA, 20 bp, Artificial Sequence
  Synthetic
catcaacgagugtgccagug

SEQ ID NO: 22856 - DNA, 17 bp, Artificial Sequence
  Synthetic
cgccgugggtgttcugg

SEQ ID NO: 22857 - DNA, 19 bp, Artificial Sequence
  Synthetic
agaggcacugtaggugggt

SEQ ID NO: 22858 - DNA, 20 bp, Artificial Sequence
  Synthetic
ggcccuctgcacugagaaac

SEQ ID NO: 22859 - DNA, 22 bp, Artificial Sequence
  Synthetic
gtgggaccaacugtgacaucaa

SEQ ID NO: 22860 - DNA, 18 bp, Artificial Sequence
  Synthetic
gagcacagugcagucagc

SEQ ID NO: 22861 - DNA, 17 bp, Artificial Sequence
  Synthetic
acacgugccacccctuc

SEQ ID NO: 22862 - DNA, 21 bp, Artificial Sequence
  Synthetic
ccttgucagtttcacugccct

SEQ ID NO: 22863 - DNA, 19 bp, Artificial Sequence
  Synthetic
gccaguacgatguggacga

SEQ ID NO: 22864 - DNA, 17 bp, Artificial Sequence
  Synthetic
ccctgtgcuggcaccua

SEQ ID NO: 22865 - DNA, 21 bp, Artificial Sequence
  Synthetic
atcagcaaccccuguaacgag

SEQ ID NO: 22866 - DNA, 24 bp, Artificial Sequence
  Synthetic
tgtgagtgcaguttagtaaguggg

SEQ ID NO: 22867 - DNA, 26 bp, Artificial Sequence
  Synthetic
aauatcgacgattguccaggaaacaa

SEQ ID NO: 22868 - DNA, 20 bp, Artificial Sequence
  Synthetic
gccacacucgttgacaucct

SEQ ID NO: 22869 - DNA, 21 bp, Artificial Sequence
  Synthetic
cctcttguccccttgtcucca

SEQ ID NO: 22870 - DNA, 19 bp, Artificial Sequence
  Synthetic
ggcuctgcccucgacaaag

SEQ ID NO: 22871 - DNA, 23 bp, Artificial Sequence
  Synthetic
tgagactgaccuctcttctccug

SEQ ID NO: 22872 - DNA, 26 bp, Artificial Sequence
  Synthetic
cagtaauagagaacccctttugaggt

SEQ ID NO: 22873 - DNA, 22 bp, Artificial Sequence
  Synthetic
gctcaaaucagccctgtgucaa

SEQ ID NO: 22874 - DNA, 30 bp, Artificial Sequence
  Synthetic
tcacaatttggcutttgttttagaugaagt

SEQ ID NO: 22875 - DNA, 23 bp, Artificial Sequence
  Synthetic
gctucaaagagcaggacagtuga

SEQ ID NO: 22876 - DNA, 30 bp, Artificial Sequence
  Synthetic
ctttctactgcatutgacattccttgttut

SEQ ID NO: 22877 - DNA, 22 bp, Artificial Sequence
  Synthetic
gtgctggguatgtaaggagcut

SEQ ID NO: 22878 - DNA, 24 bp, Artificial Sequence
  Synthetic
gcttcctgaucaagatgagaugga

SEQ ID NO: 22879 - DNA, 25 bp, Artificial Sequence
  Synthetic
agtctugacaagccaatcatucaca

SEQ ID NO: 22880 - DNA, 24 bp, Artificial Sequence
  Synthetic
ggctctgtauaagtggcttcugaa

SEQ ID NO: 22881 - DNA, 29 bp, Artificial Sequence
  Synthetic
gcctttggtgcuttagtttgttctatuac

SEQ ID NO: 22882 - DNA, 24 bp, Artificial Sequence
  Synthetic
agataagttgguctcatgccucct

SEQ ID NO: 22883 - DNA, 25 bp, Artificial Sequence
  Synthetic
caactutaagctgcauacaggcaaa

SEQ ID NO: 22884 - DNA, 24 bp, Artificial Sequence
  Synthetic
tgtgggtgtcuctttacagatgug

SEQ ID NO: 22885 - DNA, 28 bp, Artificial Sequence
  Synthetic
tgctttacuagttcaaaatuaggcagga

SEQ ID NO: 22886 - DNA, 23 bp, Artificial Sequence
  Synthetic
ccaagggagucaacaaaaaugug

SEQ ID NO: 22887 - DNA, 21 bp, Artificial Sequence
  Synthetic
ccagctctugtcagaaggcut

SEQ ID NO: 22888 - DNA, 26 bp, Artificial Sequence
  Synthetic
cagaaaatgatucggttccaaugcaa

SEQ ID NO: 22889 - DNA, 28 bp, Artificial Sequence
  Synthetic
gtagggatattgaucttggaatccucaa

SEQ ID NO: 22890 - DNA, 25 bp, Artificial Sequence
  Synthetic
gagttgggtucacgagtagaatcuc

SEQ ID NO: 22891 - DNA, 22 bp, Artificial Sequence
  Synthetic
guaggagacguagacccaccaa

SEQ ID NO: 22892 - DNA, 27 bp, Artificial Sequence
  Synthetic
ccaaggagagguctttggtactattut

SEQ ID NO: 22893 - DNA, 25 bp, Artificial Sequence
  Synthetic
caagtccataugagacagtgcttug

SEQ ID NO: 22894 - DNA, 22 bp, Artificial Sequence
  Synthetic
ggtauagcccaactctcucagg

SEQ ID NO: 22895 - DNA, 25 bp, Artificial Sequence
  Synthetic
agtcgguagcaaagtggtauaggaa

SEQ ID NO: 22896 - DNA, 28 bp, Artificial Sequence
  Synthetic
ggaatugaacccacatactgtugaaaat

SEQ ID NO: 22897 - DNA, 28 bp, Artificial Sequence
  Synthetic
ggacattagcacuaaaatctccttucac

SEQ ID NO: 22898 - DNA, 26 bp, Artificial Sequence
  Synthetic
cactgcaaaccauaaaaacgctauga

SEQ ID NO: 22899 - DNA, 25 bp, Artificial Sequence
  Synthetic
gtgtgaagaatguggaatggaacug

SEQ ID NO: 22900 - DNA, 26 bp, Artificial Sequence
  Synthetic
gcagagaacagccaguttgcttaaua

SEQ ID NO: 22901 - DNA, 25 bp, Artificial Sequence
  Synthetic
ccgtgttgcaugaactttgttttuc

SEQ ID NO: 22902 - DNA, 28 bp, Artificial Sequence
  Synthetic
tcttgacaatugttccaatgattugcat

SEQ ID NO: 22903 - DNA, 26 bp, Artificial Sequence
  Synthetic
caacatcttccucaatttgggtaugg

SEQ ID NO: 22904 - DNA, 25 bp, Artificial Sequence
  Synthetic
gacaaaauccaccccaucaagagat

SEQ ID NO: 22905 - DNA, 26 bp, Artificial Sequence
  Synthetic
tcatgtggacaaaautgcccaaaaut

SEQ ID NO: 22906 - DNA, 24 bp, Artificial Sequence
  Synthetic
caatcagaaagcccauccttugac

SEQ ID NO: 22907 - DNA, 26 bp, Artificial Sequence
  Synthetic
gtaagggtguttcatgagagauacca

SEQ ID NO: 22908 - DNA, 25 bp, Artificial Sequence
  Synthetic
tgcaattctguaaagctttggguct

SEQ ID NO: 22909 - DNA, 27 bp, Artificial Sequence
  Synthetic
tgatttuaacagggaagcgtattucct

SEQ ID NO: 22910 - DNA, 28 bp, Artificial Sequence
  Synthetic
caggtttuaagaagaagcagtgaugaag

SEQ ID NO: 22911 - DNA, 21 bp, Artificial Sequence
  Synthetic
ccatuggaagagggaugccat

SEQ ID NO: 22912 - DNA, 26 bp, Artificial Sequence
  Synthetic
accttaaacacaugaaggtgcgatua

SEQ ID NO: 22913 - DNA, 25 bp, Artificial Sequence
  Synthetic
tgattttgguaagctacuggagcat

SEQ ID NO: 22914 - DNA, 28 bp, Artificial Sequence
  Synthetic
ccatgtgctaccuctttataagcttuca

SEQ ID NO: 22915 - DNA, 21 bp, Artificial Sequence
  Synthetic
gcccucttcttuccagaacgg

SEQ ID NO: 22916 - DNA, 28 bp, Artificial Sequence
  Synthetic
agtgaaaucgaaccccautttatctuaa

SEQ ID NO: 22917 - DNA, 22 bp, Artificial Sequence
  Synthetic
tcattcttcaguggagctggug

SEQ ID NO: 22918 - DNA, 22 bp, Artificial Sequence
  Synthetic
cctcaagaccutgcctcttcuc

SEQ ID NO: 22919 - DNA, 23 bp, Artificial Sequence
  Synthetic
gcatccaaaaagaugtgcucact

SEQ ID NO: 22920 - DNA, 21 bp, Artificial Sequence
  Synthetic
caggcagcuaatgaaggucca

SEQ ID NO: 22921 - DNA, 22 bp, Artificial Sequence
  Synthetic
gcaacgtgugtgagagcauaag

SEQ ID NO: 22922 - DNA, 18 bp, Artificial Sequence
  Synthetic
ccccacuccggtttccug

SEQ ID NO: 22923 - DNA, 21 bp, Artificial Sequence
  Synthetic
tgtgatcaggcucccaaguct

SEQ ID NO: 22924 - DNA, 17 bp, Artificial Sequence
  Synthetic
gcugagccauggcacac

SEQ ID NO: 22925 - DNA, 17 bp, Artificial Sequence
  Synthetic
gcacgugctgcuggaca

SEQ ID NO: 22926 - DNA, 19 bp, Artificial Sequence
  Synthetic
ctcgacagucaggcagucc

SEQ ID NO: 22927 - DNA, 23 bp, Artificial Sequence
  Synthetic
gcctaccucaggcttatcuccaa

SEQ ID NO: 22928 - DNA, 21 bp, Artificial Sequence
  Synthetic
cacagacacaugcacatugct

SEQ ID NO: 22929 - DNA, 18 bp, Artificial Sequence
  Synthetic
cugccagcgccatguaac

SEQ ID NO: 22930 - DNA, 21 bp, Artificial Sequence
  Synthetic
cctcccccutctacttuagcc

SEQ ID NO: 22931 - DNA, 17 bp, Artificial Sequence
  Synthetic
ggacccaggugcuccat

SEQ ID NO: 22932 - DNA, 18 bp, Artificial Sequence
  Synthetic
aggcgccuacactuacgg

SEQ ID NO: 22933 - DNA, 22 bp, Artificial Sequence
  Synthetic
ccaaggccaugttcacgttgua

SEQ ID NO: 22934 - DNA, 18 bp, Artificial Sequence
  Synthetic
caagcgaaccgcauccuc

SEQ ID NO: 22935 - DNA, 19 bp, Artificial Sequence
  Synthetic
gaccacggcugcagatuct

SEQ ID NO: 22936 - DNA, 26 bp, Artificial Sequence
  Synthetic
guctaaaattcugggaagcagaacct

SEQ ID NO: 22937 - DNA, 17 bp, Artificial Sequence
  Synthetic
gcucgggcagacaggug

SEQ ID NO: 22938 - DNA, 18 bp, Artificial Sequence
  Synthetic
tgctggagggugggcuaa

SEQ ID NO: 22939 - DNA, 19 bp, Artificial Sequence
  Synthetic
cagactgugggcaugagca

SEQ ID NO: 22940 - DNA, 20 bp, Artificial Sequence
  Synthetic
catgggaggugctcauggaa

SEQ ID NO: 22941 - DNA, 22 bp, Artificial Sequence
  Synthetic
agccgcacuatactcagaucca

SEQ ID NO: 22942 - DNA, 26 bp, Artificial Sequence
  Synthetic
ctatgaggaugatgagaatggauggc

SEQ ID NO: 22943 - DNA, 22 bp, Artificial Sequence
  Synthetic
acagggtgucagtgagtcctua

SEQ ID NO: 22944 - DNA, 18 bp, Artificial Sequence
  Synthetic
cttcucccagccctucgg

SEQ ID NO: 22945 - DNA, 22 bp, Artificial Sequence
  Synthetic
tcctccacagcutctctuacct

SEQ ID NO: 22946 - DNA, 20 bp, Artificial Sequence
  Synthetic
cccgtagcucgagaguacaa

SEQ ID NO: 22947 - DNA, 19 bp, Artificial Sequence
  Synthetic
caggcccuctgttgccuac

SEQ ID NO: 22948 - DNA, 19 bp, Artificial Sequence
  Synthetic
gctctgcuggatcggcaug

SEQ ID NO: 22949 - DNA, 21 bp, Artificial Sequence
  Synthetic
cccccttagucaggtgagaug

SEQ ID NO: 22950 - DNA, 22 bp, Artificial Sequence
  Synthetic
ccccgactutgcagtcctuaat

SEQ ID NO: 22951 - DNA, 20 bp, Artificial Sequence
  Synthetic
tgtccttcucaggccctuca

SEQ ID NO: 22952 - DNA, 17 bp, Artificial Sequence
  Synthetic
ctgcgcagccugguaga

SEQ ID NO: 22953 - DNA, 19 bp, Artificial Sequence
  Synthetic
catggtuagggcatgugct

SEQ ID NO: 22954 - DNA, 18 bp, Artificial Sequence
  Synthetic
ccagccucaggtgcacug

SEQ ID NO: 22955 - DNA, 21 bp, Artificial Sequence
  Synthetic
tcctccccutcccaugagaat

SEQ ID NO: 22956 - DNA, 29 bp, Artificial Sequence
  Synthetic
caagagagtgttuttcctaaggtaatuga

SEQ ID NO: 22957 - DNA, 23 bp, Artificial Sequence
  Synthetic
cccaguttctctctucagacgaa

SEQ ID NO: 22958 - DNA, 20 bp, Artificial Sequence
  Synthetic
ggguggccatuaacacacaa

SEQ ID NO: 22959 - DNA, 21 bp, Artificial Sequence
  Synthetic
ccacctugcatgggtacucac

SEQ ID NO: 22960 - DNA, 21 bp, Artificial Sequence
  Synthetic
gggcaactuagtggtgtcgut

SEQ ID NO: 22961 - DNA, 18 bp, Artificial Sequence
  Synthetic
cutgtuccagcccaggga

SEQ ID NO: 22962 - DNA, 21 bp, Artificial Sequence
  Synthetic
catggccaucacgtttgtcuc

SEQ ID NO: 22963 - DNA, 22 bp, Artificial Sequence
  Synthetic
ggugggcaaggaagtctaugaa

SEQ ID NO: 22964 - DNA, 21 bp, Artificial Sequence
  Synthetic
gttcgacaguccgctacacua

SEQ ID NO: 22965 - DNA, 18 bp, Artificial Sequence
  Synthetic
ctgcgcagucttccucac

SEQ ID NO: 22966 - DNA, 22 bp, Artificial Sequence
  Synthetic
gcagauaggactggguaaggct

SEQ ID NO: 22967 - DNA, 24 bp, Artificial Sequence
  Synthetic
tgagtctgcaucatcctcctgaua

SEQ ID NO: 22968 - DNA, 22 bp, Artificial Sequence
  Synthetic
guccagguaaacaagcccagat

SEQ ID NO: 22969 - DNA, 25 bp, Artificial Sequence
  Synthetic
ttttggaaacuatgcacttgugcag

SEQ ID NO: 22970 - DNA, 21 bp, Artificial Sequence
  Synthetic
ggttcaacggcutctcacuca

SEQ ID NO: 22971 - DNA, 23 bp, Artificial Sequence
  Synthetic
gtgctgagggcucttaacuacac

SEQ ID NO: 22972 - DNA, 21 bp, Artificial Sequence
  Synthetic
ctggcuccgcttcaattugac

SEQ ID NO: 22973 - DNA, 20 bp, Artificial Sequence
  Synthetic
ggaaacgcuccctggctauc

SEQ ID NO: 22974 - DNA, 22 bp, Artificial Sequence
  Synthetic
ggtaggaggcagugaguaggaa

SEQ ID NO: 22975 - DNA, 27 bp, Artificial Sequence
  Synthetic
gaagaggaaguctcctuaacccaaaaa

SEQ ID NO: 22976 - DNA, 27 bp, Artificial Sequence
  Synthetic
gtaagtctccugatgcttcttuaaccc

SEQ ID NO: 22977 - DNA, 26 bp, Artificial Sequence
  Synthetic
acaaagaaagccagaugaagacauga

SEQ ID NO: 22978 - DNA, 24 bp, Artificial Sequence
  Synthetic
tgacagactttucacgagggacua

SEQ ID NO: 22979 - DNA, 21 bp, Artificial Sequence
  Synthetic
gtacucccagagcagcatcut

SEQ ID NO: 22980 - DNA, 27 bp, Artificial Sequence
  Synthetic
gacctgatccuatgcaatggagauaaa

SEQ ID NO: 22981 - DNA, 23 bp, Artificial Sequence
  Synthetic
accatgtuagaagagagcaugcc

SEQ ID NO: 22982 - DNA, 27 bp, Artificial Sequence
  Synthetic
ggagcagtctucaacttctttgtacua

SEQ ID NO: 22983 - DNA, 22 bp, Artificial Sequence
  Synthetic
gcaagatugcaaaggcagguat

SEQ ID NO: 22984 - DNA, 30 bp, Artificial Sequence
  Synthetic
agctacagaagcauacatctaaacacatut

SEQ ID NO: 22985 - DNA, 23 bp, Artificial Sequence
  Synthetic
gugcatauccggaggaaagaagt

SEQ ID NO: 22986 - DNA, 28 bp, Artificial Sequence
  Synthetic
ccauatgttgaatatcugcaacaagcaa

SEQ ID NO: 22987 - DNA, 26 bp, Artificial Sequence
  Synthetic
gaagcagugaagaaacgtctttucat

SEQ ID NO: 22988 - DNA, 29 bp, Artificial Sequence
  Synthetic
acgatuaauaggagaaaagagattgcuat

SEQ ID NO: 22989 - DNA, 22 bp, Artificial Sequence
  Synthetic
tgcaccatuggactccagttut

SEQ ID NO: 22990 - DNA, 28 bp, Artificial Sequence
  Synthetic
acattctgcacautcagtttctcttuct

SEQ ID NO: 22991 - DNA, 23 bp, Artificial Sequence
  Synthetic
tgttcuccagcagcacatcaaua

SEQ ID NO: 22992 - DNA, 24 bp, Artificial Sequence
  Synthetic
agtcaagctgugtcacttccuaga

SEQ ID NO: 22993 - DNA, 28 bp, Artificial Sequence
  Synthetic
tacaatccacucattcttttgtctucct

SEQ ID NO: 22994 - DNA, 21 bp, Artificial Sequence
  Synthetic
gtcccagugctggtgtttgua

SEQ ID NO: 22995 - DNA, 29 bp, Artificial Sequence
  Synthetic
gagattcgtuacggaaactatuacaggat

SEQ ID NO: 22996 - DNA, 18 bp, Artificial Sequence
  Synthetic
cctgtugcgctggaagug

SEQ ID NO: 22997 - DNA, 22 bp, Artificial Sequence
  Synthetic
gttttcccuccctucaggaact

SEQ ID NO: 22998 - DNA, 24 bp, Artificial Sequence
  Synthetic
ccagatgtgcugccaaaaggatua

SEQ ID NO: 22999 - DNA, 21 bp, Artificial Sequence
  Synthetic
gatgcuagtgccauagcccaa

SEQ ID NO: 23000 - DNA, 24 bp, Artificial Sequence
  Synthetic
gaatttucaaagaggccuccagua

SEQ ID NO: 23001 - DNA, 27 bp, Artificial Sequence
  Synthetic
aatgccttttcauttggtcatctuacg

SEQ ID NO: 23002 - DNA, 24 bp, Artificial Sequence
  Synthetic
tgctcagugtgacatcatucagac

SEQ ID NO: 23003 - DNA, 28 bp, Artificial Sequence
  Synthetic
ggctcttttgguttctatggattcauca

SEQ ID NO: 23004 - DNA, 26 bp, Artificial Sequence
  Synthetic
ctcataccugagcattgactgacuat

SEQ ID NO: 23005 - DNA, 24 bp, Artificial Sequence
  Synthetic
gcagtctcugctctttgttttugt

SEQ ID NO: 23006 - DNA, 21 bp, Artificial Sequence
  Synthetic
aggcacugagagggacaguag

SEQ ID NO: 23007 - DNA, 21 bp, Artificial Sequence
  Synthetic
ggtgcaggcuagtaucgcaag

SEQ ID NO: 23008 - DNA, 20 bp, Artificial Sequence
  Synthetic
ctgttugcgcccttcatguc

SEQ ID NO: 23009 - DNA, 23 bp, Artificial Sequence
  Synthetic
ttgactuacaaggtccacucagc

SEQ ID NO: 23010 - DNA, 23 bp, Artificial Sequence
  Synthetic
ggatagcaggucttcagatgugg

SEQ ID NO: 23011 - DNA, 22 bp, Artificial Sequence
  Synthetic
gctcatttgutcccactuccct

SEQ ID NO: 23012 - DNA, 22 bp, Artificial Sequence
  Synthetic
gatgttgatgauctgcgtggug

SEQ ID NO: 23013 - DNA, 21 bp, Artificial Sequence
  Synthetic
cccaagguagaatcccuggag

SEQ ID NO: 23014 - DNA, 23 bp, Artificial Sequence
  Synthetic
agtggaauaggagtgaggugagt

SEQ ID NO: 23015 - DNA, 21 bp, Artificial Sequence
  Synthetic
aaaacaaagagcugcgagcug

SEQ ID NO: 23016 - DNA, 21 bp, Artificial Sequence
  Synthetic
gcttatagugctcagcugcct

SEQ ID NO: 23017 - DNA, 21 bp, Artificial Sequence
  Synthetic
cagaccagcuttcctgagugg

SEQ ID NO: 23018 - DNA, 21 bp, Artificial Sequence
  Synthetic
cttgacctuggcaccctcaua

SEQ ID NO: 23019 - DNA, 23 bp, Artificial Sequence
  Synthetic
agtttcuggaagtggagtuggac

SEQ ID NO: 23020 - DNA, 19 bp, Artificial Sequence
  Synthetic
tgcuggcagaggtgctuag

SEQ ID NO: 23021 - DNA, 17 bp, Artificial Sequence
  Synthetic
ccucacaggcugagcgt

SEQ ID NO: 23022 - DNA, 20 bp, Artificial Sequence
  Synthetic
cctggcgautcaggauggac

SEQ ID NO: 23023 - DNA, 21 bp, Artificial Sequence
  Synthetic
ctuccgcaccaagguacaaga

SEQ ID NO: 23024 - DNA, 21 bp, Artificial Sequence
  Synthetic
ccagatgcgugctcctttuct

SEQ ID NO: 23025 - DNA, 19 bp, Artificial Sequence
  Synthetic
gcucatgcccugacggaaa

SEQ ID NO: 23026 - DNA, 17 bp, Artificial Sequence
  Synthetic
gcagccgutccagcuca

SEQ ID NO: 23027 - DNA, 20 bp, Artificial Sequence
  Synthetic
gttagucaaggagccugcga

SEQ ID NO: 23028 - DNA, 20 bp, Artificial Sequence
  Synthetic
cgggcctuctcacattccuc

SEQ ID NO: 23029 - DNA, 21 bp, Artificial Sequence
  Synthetic
tgtgagcagcucgucaaagaa

SEQ ID NO: 23030 - DNA, 21 bp, Artificial Sequence
  Synthetic
cctgcgcutctcctctucaag

SEQ ID NO: 23031 - DNA, 21 bp, Artificial Sequence
  Synthetic
gttgcagagcuagagtugcag

SEQ ID NO: 23032 - DNA, 20 bp, Artificial Sequence
  Synthetic
gcctagtugcctcctgctuc

SEQ ID NO: 23033 - DNA, 20 bp, Artificial Sequence
  Synthetic
gcuagcacagacccuccaac

SEQ ID NO: 23034 - DNA, 22 bp, Artificial Sequence
  Synthetic
tcagtcuccagcatctcuaccc

SEQ ID NO: 23035 - DNA, 23 bp, Artificial Sequence
  Synthetic
ttcctccattuccagaggaguct

SEQ ID NO: 23036 - DNA, 21 bp, Artificial Sequence
  Synthetic
tgcttctcuagccactccuga

SEQ ID NO: 23037 - DNA, 20 bp, Artificial Sequence
  Synthetic
agcgttgacuctgggtgaug

SEQ ID NO: 23038 - DNA, 22 bp, Artificial Sequence
  Synthetic
cttctcatucagcagggcuagg

SEQ ID NO: 23039 - DNA, 22 bp, Artificial Sequence
  Synthetic
ccccttgugcacatagttcugt

SEQ ID NO: 23040 - DNA, 21 bp, Artificial Sequence
  Synthetic
ggaagcgaauctccctctugg

SEQ ID NO: 23041 - DNA, 27 bp, Artificial Sequence
  Synthetic
agttctcaaautgcataaaggugcaaa

SEQ ID NO: 23042 - DNA, 23 bp, Artificial Sequence
  Synthetic
gctgaggaagcagcutcttcaua

SEQ ID NO: 23043 - DNA, 28 bp, Artificial Sequence
  Synthetic
ctctggtcctaauacttgctcttttuct

SEQ ID NO: 23044 - DNA, 31 bp, Artificial Sequence
  Synthetic
tcatattcctuccaaatcaaacacatuacca

SEQ ID NO: 23045 - DNA, 25 bp, Artificial Sequence
  Synthetic
cctgtaaugacgcaaccaacctuaa

SEQ ID NO: 23046 - DNA, 29 bp, Artificial Sequence
  Synthetic
aactgttagtctaucaggagcttttucaa

SEQ ID NO: 23047 - DNA, 26 bp, Artificial Sequence
  Synthetic
atgtaaattggagucaaccaggugaa

SEQ ID NO: 23048 - DNA, 21 bp, Artificial Sequence
  Synthetic
gctaggugggagttuggcaac

SEQ ID NO: 23049 - DNA, 25 bp, Artificial Sequence
  Synthetic
ggagaaaagguaaagaccuccttua

SEQ ID NO: 23050 - DNA, 29 bp, Artificial Sequence
  Synthetic
ggtacttuaccaacaaacatttcaugagt

SEQ ID NO: 23051 - DNA, 23 bp, Artificial Sequence
  Synthetic
tgtagatgcugttgatgaugcca

SEQ ID NO: 23052 - DNA, 29 bp, Artificial Sequence
  Synthetic
caaaggtaacctuaacttctactccuacc

SEQ ID NO: 23053 - DNA, 26 bp, Artificial Sequence
  Synthetic
gccuaaaagaactugcaaagaaacct

SEQ ID NO: 23054 - DNA, 22 bp, Artificial Sequence
  Synthetic
tcactctggcuttttggccuac

SEQ ID NO: 23055 - DNA, 28 bp, Artificial Sequence
  Synthetic
accagtggccuaattatcatgaaatuct

SEQ ID NO: 23056 - DNA, 28 bp, Artificial Sequence
  Synthetic
tttagccagcuttaagtaacaacucagt

SEQ ID NO: 23057 - DNA, 25 bp, Artificial Sequence
  Synthetic
actgttugcagcatacaaugaagga

SEQ ID NO: 23058 - DNA, 29 bp, Artificial Sequence
  Synthetic
tggtacagttttuaggagtttttctgugt

SEQ ID NO: 23059 - DNA, 27 bp, Artificial Sequence
  Synthetic
gcaacttggtuctctgttttaguagaa

SEQ ID NO: 23060 - DNA, 26 bp, Artificial Sequence
  Synthetic
gcttacctcatutccatacaccauca

SEQ ID NO: 23061 - DNA, 31 bp, Artificial Sequence
  Synthetic
ttttattgcagacutaattcagugcacaaat

SEQ ID NO: 23062 - DNA, 27 bp, Artificial Sequence
  Synthetic
ggtttacagguctacaattctagcugt

SEQ ID NO: 23063 - DNA, 25 bp, Artificial Sequence
  Synthetic
cactctctctguggaaggctttuag

SEQ ID NO: 23064 - DNA, 20 bp, Artificial Sequence
  Synthetic
gcagtccugcctttgtguga

SEQ ID NO: 23065 - DNA, 21 bp, Artificial Sequence
  Synthetic
gtatgtgccccaugaagcugt

SEQ ID NO: 23066 - DNA, 25 bp, Artificial Sequence
  Synthetic
acatacactcucacactatcccuga

SEQ ID NO: 23067 - DNA, 20 bp, Artificial Sequence
  Synthetic
cgtgugaaggagccagugaa

SEQ ID NO: 23068 - DNA, 24 bp, Artificial Sequence
  Synthetic
cagcatttccucttccctgtttuc

SEQ ID NO: 23069 - DNA, 18 bp, Artificial Sequence
  Synthetic
gggugggaagaccccuca

SEQ ID NO: 23070 - DNA, 22 bp, Artificial Sequence
  Synthetic
ggttgtcagugttttgctccug

SEQ ID NO: 23071 - DNA, 27 bp, Artificial Sequence
  Synthetic
agcaaacaaacugagcagacaactaua

SEQ ID NO: 23072 - DNA, 29 bp, Artificial Sequence
  Synthetic
aaccttcctgtuaacaaatgaaacaugac

SEQ ID NO: 23073 - DNA, 27 bp, Artificial Sequence
  Synthetic
gtgaatgatacacaugcacttccttut

SEQ ID NO: 23074 - DNA, 28 bp, Artificial Sequence
  Synthetic
gaacaaauaaccacgaaaauacagcaga

SEQ ID NO: 23075 - DNA, 28 bp, Artificial Sequence
  Synthetic
atttctaaaaagautcctcagcugacct

SEQ ID NO: 23076 - DNA, 26 bp, Artificial Sequence
  Synthetic
gtttgatuttctgcatcugacaggag

SEQ ID NO: 23077 - DNA, 29 bp, Artificial Sequence
  Synthetic
ggaagctgagaugctattaacactgauaa

SEQ ID NO: 23078 - DNA, 23 bp, Artificial Sequence
  Synthetic
tgattggaagccacautcctcug

SEQ ID NO: 23079 - DNA, 22 bp, Artificial Sequence
  Synthetic
tcattgucctgggcugagaaag

SEQ ID NO: 23080 - DNA, 23 bp, Artificial Sequence
  Synthetic
tcaggcctaagautaacccccut

SEQ ID NO: 23081 - DNA, 24 bp, Artificial Sequence
  Synthetic
ccatccccucctttcctttcauag

SEQ ID NO: 23082 - DNA, 21 bp, Artificial Sequence
  Synthetic
aacagugagaagcgctgugat

SEQ ID NO: 23083 - DNA, 21 bp, Artificial Sequence
  Synthetic
gagggacgcaugcctttcuat

SEQ ID NO: 23084 - DNA, 20 bp, Artificial Sequence
  Synthetic
gggtcaacutgcagcagtuc

SEQ ID NO: 23085 - DNA, 29 bp, Artificial Sequence
  Synthetic
tgtcccctcuaggtatttatttcucaaca

SEQ ID NO: 23086 - DNA, 23 bp, Artificial Sequence
  Synthetic
attuggcccaaagacctcuagaa

SEQ ID NO: 23087 - DNA, 20 bp, Artificial Sequence
  Synthetic
tggtgguagtggaugacgga

SEQ ID NO: 23088 - DNA, 21 bp, Artificial Sequence
  Synthetic
caggcuggacaaagagguagt

SEQ ID NO: 23089 - DNA, 20 bp, Artificial Sequence
  Synthetic
ggaaagccuggaaggugacg

SEQ ID NO: 23090 - DNA, 23 bp, Artificial Sequence
  Synthetic
cacucataattggucagggcaga

SEQ ID NO: 23091 - DNA, 26 bp, Artificial Sequence
  Synthetic
tgaattggtcaugtcacaagcaaaug

SEQ ID NO: 23092 - DNA, 23 bp, Artificial Sequence
  Synthetic
gguctggaacaaugcccaagaaa

SEQ ID NO: 23093 - DNA, 23 bp, Artificial Sequence
  Synthetic
cttcggcaggutacaggagtuac

SEQ ID NO: 23094 - DNA, 27 bp, Artificial Sequence
  Synthetic
tttcctttaugaaggttcacagtucca

SEQ ID NO: 23095 - DNA, 27 bp, Artificial Sequence
  Synthetic
gaatctgacagugatgaatcaguacca

SEQ ID NO: 23096 - DNA, 20 bp, Artificial Sequence
  Synthetic
atgtugacgaggaccgacug

SEQ ID NO: 23097 - DNA, 24 bp, Artificial Sequence
  Synthetic
actctgccucctaaacagcaatut

SEQ ID NO: 23098 - DNA, 26 bp, Artificial Sequence
  Synthetic
ggtccttuagaaccattcttagcuga

SEQ ID NO: 23099 - DNA, 24 bp, Artificial Sequence
  Synthetic
gctctgaaagaaguacttgtugcc

SEQ ID NO: 23100 - DNA, 22 bp, Artificial Sequence
  Synthetic
gtaaguggaaggagtcacugct

SEQ ID NO: 23101 - DNA, 26 bp, Artificial Sequence
  Synthetic
tctcuaaaaagacccuagcaactcua

SEQ ID NO: 23102 - DNA, 18 bp, Artificial Sequence
  Synthetic
ggagggugggatccccut

SEQ ID NO: 23103 - DNA, 21 bp, Artificial Sequence
  Synthetic
agcaacuccagucaccagaga

SEQ ID NO: 23104 - DNA, 21 bp, Artificial Sequence
  Synthetic
gggtaccugggcttcctttug

SEQ ID NO: 23105 - DNA, 22 bp, Artificial Sequence
  Synthetic
ctccctcccuaaaaggagguct

SEQ ID NO: 23106 - DNA, 17 bp, Artificial Sequence
  Synthetic
ggttgtgggugccccut

SEQ ID NO: 23107 - DNA, 17 bp, Artificial Sequence
  Synthetic
agcugcgactccuccct

SEQ ID NO: 23108 - DNA, 20 bp, Artificial Sequence
  Synthetic
gggauggagtagcuggacct

SEQ ID NO: 23109 - DNA, 18 bp, Artificial Sequence
  Synthetic
gcutccccaucccccaaa

SEQ ID NO: 23110 - DNA, 21 bp, Artificial Sequence
  Synthetic
gtcgtggcuggtgagtcttua

SEQ ID NO: 23111 - DNA, 22 bp, Artificial Sequence
  Synthetic
gggttagugtgtctccucagac

SEQ ID NO: 23112 - DNA, 28 bp, Artificial Sequence
  Synthetic
tgtaggaaccaaggguaaagtaguaaga

SEQ ID NO: 23113 - DNA, 24 bp, Artificial Sequence
  Synthetic
catttccttuggaaagtgcugacc

SEQ ID NO: 23114 - DNA, 22 bp, Artificial Sequence
  Synthetic
gctgccuggactaacggtaaua

SEQ ID NO: 23115 - DNA, 24 bp, Artificial Sequence
  Synthetic
cctcaaaaauctccccagtucagt

SEQ ID NO: 23116 - DNA, 22 bp, Artificial Sequence
  Synthetic
ggcattugggccacuaaaggat

SEQ ID NO: 23117 - DNA, 23 bp, Artificial Sequence
  Synthetic
tgacaaagguccctctaccauct

SEQ ID NO: 23118 - DNA, 22 bp, Artificial Sequence
  Synthetic
ccgcaguctttugagaagaggt

SEQ ID NO: 23119 - DNA, 21 bp, Artificial Sequence
  Synthetic
tcgctucccctcaagucaaag

SEQ ID NO: 23120 - DNA, 22 bp, Artificial Sequence
  Synthetic
agcuaagggagcugaagaggaa

SEQ ID NO: 23121 - DNA, 22 bp, Artificial Sequence
  Synthetic
ctctggaacagcccuaccttug

SEQ ID NO: 23122 - DNA, 22 bp, Artificial Sequence
  Synthetic
gcaaggaggguagggaaaccua

SEQ ID NO: 23123 - DNA, 27 bp, Artificial Sequence
  Synthetic
ggcaagtgaatguatcccaatcaatut

SEQ ID NO: 23124 - DNA, 22 bp, Artificial Sequence
  Synthetic
ggagaaatutgccacttuggct

SEQ ID NO: 23125 - DNA, 24 bp, Artificial Sequence
  Synthetic
cagcagactutgtggtcacuaaaa

SEQ ID NO: 23126 - DNA, 31 bp, Artificial Sequence
  Synthetic
tgattctttgacagaucttgtggaacatuat

SEQ ID NO: 23127 - DNA, 29 bp, Artificial Sequence
  Synthetic
ctgtctacctcugtatgtttgcaaaatuc

SEQ ID NO: 23128 - DNA, 25 bp, Artificial Sequence
  Synthetic
caaacutctcuacagccgaaaagag

SEQ ID NO: 23129 - DNA, 24 bp, Artificial Sequence
  Synthetic
aggtgcuaggaatcaaaatcucca

SEQ ID NO: 23130 - DNA, 26 bp, Artificial Sequence
  Synthetic
ggtggttatuaagcaagactugaaca

SEQ ID NO: 23131 - DNA, 20 bp, Artificial Sequence
  Synthetic
cgttccuaacacgcaugacg

SEQ ID NO: 23132 - DNA, 23 bp, Artificial Sequence
  Synthetic
ttttgagtcugaaacccccauga

SEQ ID NO: 23133 - DNA, 23 bp, Artificial Sequence
  Synthetic
aaacagaaacugtcgcttctugc

SEQ ID NO: 23134 - DNA, 22 bp, Artificial Sequence
  Synthetic
gtaagctuaaacagcgtgguct

SEQ ID NO: 23135 - DNA, 26 bp, Artificial Sequence
  Synthetic
catctgaaacutttctgctgtugcat

SEQ ID NO: 23136 - DNA, 17 bp, Artificial Sequence
  Synthetic
cgcugcccacggagaug

SEQ ID NO: 23137 - DNA, 19 bp, Artificial Sequence
  Synthetic
ccggucctggugaaagacg

SEQ ID NO: 23138 - DNA, 18 bp, Artificial Sequence
  Synthetic
gccttcuggacggctcuc

SEQ ID NO: 23139 - DNA, 21 bp, Artificial Sequence
  Synthetic
guaccaggacaccaugaggaa

SEQ ID NO: 23140 - DNA, 18 bp, Artificial Sequence
  Synthetic
gccctccaugcccactut

SEQ ID NO: 23141 - DNA, 20 bp, Artificial Sequence
  Synthetic
ccttcccccuctccctttut

SEQ ID NO: 23142 - DNA, 23 bp, Artificial Sequence
  Synthetic
tgttttctgucgctgttcaguca

SEQ ID NO: 23143 - DNA, 31 bp, Artificial Sequence
  Synthetic
actgaaggttuaagaagagttacagaaaugg

SEQ ID NO: 23144 - DNA, 25 bp, Artificial Sequence
  Synthetic
catctgtcugccatggtaagaaaug

SEQ ID NO: 23145 - DNA, 25 bp, Artificial Sequence
  Synthetic
tgacatgagggugaagtgtacuact

SEQ ID NO: 23146 - DNA, 24 bp, Artificial Sequence
  Synthetic
agctgctcauccagttttactugt

SEQ ID NO: 23147 - DNA, 29 bp, Artificial Sequence
  Synthetic
acaactcaagtguttttgtttctgttuca

SEQ ID NO: 23148 - DNA, 24 bp, Artificial Sequence
  Synthetic
catcagatgauccaacttguccca

SEQ ID NO: 23149 - DNA, 24 bp, Artificial Sequence
  Synthetic
ttgggtaaacaugacacctgtcuc

SEQ ID NO: 23150 - DNA, 30 bp, Artificial Sequence
  Synthetic
tggtgtgtattguatacgatgatgguaaag

SEQ ID NO: 23151 - DNA, 25 bp, Artificial Sequence
  Synthetic
cgatcuctctgactuccagcaaaaa

SEQ ID NO: 23152 - DNA, 22 bp, Artificial Sequence
  Synthetic
aaaaagctgucaggtggcuaca

SEQ ID NO: 23153 - DNA, 27 bp, Artificial Sequence
  Synthetic
gaaaugctaugucagaaggaaaaagag

SEQ ID NO: 23154 - DNA, 30 bp, Artificial Sequence
  Synthetic
aattttcctgtugaagcttttcagatucat

SEQ ID NO: 23155 - DNA, 27 bp, Artificial Sequence
  Synthetic
tggcattgaauactcatcctttuggaa

SEQ ID NO: 23156 - DNA, 21 bp, Artificial Sequence
  Synthetic
gctcttccugaaggcagucat

SEQ ID NO: 23157 - DNA, 25 bp, Artificial Sequence
  Synthetic
actgtgaucgagcttcugaaaagaa

SEQ ID NO: 23158 - DNA, 26 bp, Artificial Sequence
  Synthetic
tgtttgtuccgcagtattuccaaaaa

SEQ ID NO: 23159 - DNA, 22 bp, Artificial Sequence
  Synthetic
cttaagccugcagagagcucat

SEQ ID NO: 23160 - DNA, 23 bp, Artificial Sequence
  Synthetic
gacatcatttccugcctttccug

SEQ ID NO: 23161 - DNA, 25 bp, Artificial Sequence
  Synthetic
tgtctgaccagauacttgagcugaa

SEQ ID NO: 23162 - DNA, 25 bp, Artificial Sequence
  Synthetic
tttcacacctcucagtgactttcug

SEQ ID NO: 23163 - DNA, 24 bp, Artificial Sequence
  Synthetic
agtgcaugggaaaatggttttugt

SEQ ID NO: 23164 - DNA, 25 bp, Artificial Sequence
  Synthetic
tcaagcttcacutgcagttgtttut

SEQ ID NO: 23165 - DNA, 24 bp, Artificial Sequence
  Synthetic
aacaugaagcaaaggcaugagaac

SEQ ID NO: 23166 - DNA, 30 bp, Artificial Sequence
  Synthetic
gaaccacgttuctaaaaacaagaguaaagg

SEQ ID NO: 23167 - DNA, 22 bp, Artificial Sequence
  Synthetic
aauatcgugcacaaggcagagt

SEQ ID NO: 23168 - DNA, 30 bp, Artificial Sequence
  Synthetic
gtttaccttttcugctaacacatttuccaa

SEQ ID NO: 23169 - DNA, 25 bp, Artificial Sequence
  Synthetic
tccccauacttgtucaggaaaacag

SEQ ID NO: 23170 - DNA, 22 bp, Artificial Sequence
  Synthetic
ccttgtccagauctgaccguag

SEQ ID NO: 23171 - DNA, 23 bp, Artificial Sequence
  Synthetic
tgcutctgtattgaugcaagcca

SEQ ID NO: 23172 - DNA, 25 bp, Artificial Sequence
  Synthetic
ggtgtccaguattctcuccacagat

SEQ ID NO: 23173 - DNA, 23 bp, Artificial Sequence
  Synthetic
cctggaaucaagctaggctuact

SEQ ID NO: 23174 - DNA, 20 bp, Artificial Sequence
  Synthetic
ggtgaccaucacgggtgauc

SEQ ID NO: 23175 - DNA, 23 bp, Artificial Sequence
  Synthetic
tcctttggaaaccgugcaacaua

SEQ ID NO: 23176 - DNA, 26 bp, Artificial Sequence
  Synthetic
gcagagaagagaagugagtgacctua

SEQ ID NO: 23177 - DNA, 29 bp, Artificial Sequence
  Synthetic
tgcattcttagagcugtggaaattactut

SEQ ID NO: 23178 - DNA, 25 bp, Artificial Sequence
  Synthetic
gattttccgaugaaagccugaaacc

SEQ ID NO: 23179 - DNA, 22 bp, Artificial Sequence
  Synthetic
gactggttcugagagccttgut

SEQ ID NO: 23180 - DNA, 29 bp, Artificial Sequence
  Synthetic
tgattctucaaaacaggcttagaaatugg

SEQ ID NO: 23181 - DNA, 22 bp, Artificial Sequence
  Synthetic
gagattgcaggguctggtgtua

SEQ ID NO: 23182 - DNA, 23 bp, Artificial Sequence
  Synthetic
tccugcaaagggucacatattut

SEQ ID NO: 23183 - DNA, 21 bp, Artificial Sequence
  Synthetic
ggaggctuccgaggaacaaug

SEQ ID NO: 23184 - DNA, 21 bp, Artificial Sequence
  Synthetic
aaaaauaggccgaggccauga

SEQ ID NO: 23185 - DNA, 22 bp, Artificial Sequence
  Synthetic
ggagaatugggaagccagtgut

SEQ ID NO: 23186 - DNA, 25 bp, Artificial Sequence
  Synthetic
gggcaatgguacggatcttauaaaa

SEQ ID NO: 23187 - DNA, 26 bp, Artificial Sequence
  Synthetic
gcctgatttuccttcgattttctuac

SEQ ID NO: 23188 - DNA, 23 bp, Artificial Sequence
  Synthetic
accugtgaagaaguggacagaga

SEQ ID NO: 23189 - DNA, 22 bp, Artificial Sequence
  Synthetic
tgaagtgcuagaacccaugcag

SEQ ID NO: 23190 - DNA, 21 bp, Artificial Sequence
  Synthetic
cgtgggcccaguaaacaatua

SEQ ID NO: 23191 - DNA, 26 bp, Artificial Sequence
  Synthetic
ggatgttatcaagaguggctgtagug

SEQ ID NO: 23192 - DNA, 28 bp, Artificial Sequence
  Synthetic
caagcctcuaaaagtcaactatcucaga

SEQ ID NO: 23193 - DNA, 28 bp, Artificial Sequence
  Synthetic
gcccatttccautaagtgaaaacuaacc

SEQ ID NO: 23194 - DNA, 24 bp, Artificial Sequence
  Synthetic
ccaactgcccagauatcagactug

SEQ ID NO: 23195 - DNA, 30 bp, Artificial Sequence
  Synthetic
tgttaacatagtuacctcagaaaagaagut

SEQ ID NO: 23196 - DNA, 28 bp, Artificial Sequence
  Synthetic
tgagtcuaagaaagtcttgcuggaaaag

SEQ ID NO: 23197 - DNA, 24 bp, Artificial Sequence
  Synthetic
cgtcgtgaugccttgaatgagaut

SEQ ID NO: 23198 - DNA, 19 bp, Artificial Sequence
  Synthetic
cgctcccaaaguccgagut

SEQ ID NO: 23199 - DNA, 18 bp, Artificial Sequence
  Synthetic
gttgcugggcugacggat

SEQ ID NO: 23200 - DNA, 21 bp, Artificial Sequence
  Synthetic
ctttgcagcaguccatugacc

SEQ ID NO: 23201 - DNA, 25 bp, Artificial Sequence
  Synthetic
tttctcacttgcugtgtcttctuca

SEQ ID NO: 23202 - DNA, 22 bp, Artificial Sequence
  Synthetic
cgauggacctcugggagaaaga

SEQ ID NO: 23203 - DNA, 22 bp, Artificial Sequence
  Synthetic
cctaugacccccacccagauag

SEQ ID NO: 23204 - DNA, 27 bp, Artificial Sequence
  Synthetic
agatgtttuccccacctgttaatagug

SEQ ID NO: 23205 - DNA, 29 bp, Artificial Sequence
  Synthetic
tutctactaaaatgtaucacaccaccaaa

SEQ ID NO: 23206 - DNA, 22 bp, Artificial Sequence
  Synthetic
aggttugggtcagtaucagcag

SEQ ID NO: 23207 - DNA, 27 bp, Artificial Sequence
  Synthetic
aatgaatagtatgcugtcccaggttut

SEQ ID NO: 23208 - DNA, 28 bp, Artificial Sequence
  Synthetic
aattttaagguatatgcaccauccccaa

SEQ ID NO: 23209 - DNA, 27 bp, Artificial Sequence
  Synthetic
gcagtagtattuggcaattgtttggua

SEQ ID NO: 23210 - DNA, 19 bp, Artificial Sequence
  Synthetic
agctttcaucgcggcagua

SEQ ID NO: 23211 - DNA, 21 bp, Artificial Sequence
  Synthetic
gggtcacugaaaguccacaaa

SEQ ID NO: 23212 - DNA, 26 bp, Artificial Sequence
  Synthetic
aatctaacagaugccagcaauaacca

SEQ ID NO: 23213 - DNA, 20 bp, Artificial Sequence
  Synthetic
aggcaaacuggtggaagguc

SEQ ID NO: 23214 - DNA, 30 bp, Artificial Sequence
  Synthetic
atgagtctcgucttttattttatcttucct

SEQ ID NO: 23215 - DNA, 26 bp, Artificial Sequence
  Synthetic
ggaggattcaucatctgacttcaugt

SEQ ID NO: 23216 - DNA, 28 bp, Artificial Sequence
  Synthetic
ccccaaacaaaacuccttattcttcauc

SEQ ID NO: 23217 - DNA, 24 bp, Artificial Sequence
  Synthetic
aacagaaatguctgcccatcugaa

SEQ ID NO: 23218 - DNA, 18 bp, Artificial Sequence
  Synthetic
ggtccauggagccugcac

SEQ ID NO: 23219 - DNA, 22 bp, Artificial Sequence
  Synthetic
agcttaaccccaucatccccua

SEQ ID NO: 23220 - DNA, 21 bp, Artificial Sequence
  Synthetic
cgacttctggugctttgagug

SEQ ID NO: 23221 - DNA, 24 bp, Artificial Sequence
  Synthetic
gagcagaagaugttgttggtctug

SEQ ID NO: 23222 - DNA, 17 bp, Artificial Sequence
  Synthetic
cggtucacgcgcagaug

SEQ ID NO: 23223 - DNA, 18 bp, Artificial Sequence
  Synthetic
ctcgtagucgcgctggua

SEQ ID NO: 23224 - DNA, 21 bp, Artificial Sequence
  Synthetic
cccaggucaggatgtccctua

SEQ ID NO: 23225 - DNA, 23 bp, Artificial Sequence
  Synthetic
ttcagaccucaaacccatcucac

SEQ ID NO: 23226 - DNA, 24 bp, Artificial Sequence
  Synthetic
gtcatcaagauggagtcugaggag

SEQ ID NO: 23227 - DNA, 19 bp, Artificial Sequence
  Synthetic
ggutgctgtugggcaggaa

SEQ ID NO: 23228 - DNA, 23 bp, Artificial Sequence
  Synthetic
gggaatttuccagtgaggcatug

SEQ ID NO: 23229 - DNA, 26 bp, Artificial Sequence
  Synthetic
tcutggacatuccagaaaagagacag

SEQ ID NO: 23230 - DNA, 20 bp, Artificial Sequence
  Synthetic
gctugcaccctcaatugcat

SEQ ID NO: 23231 - DNA, 18 bp, Artificial Sequence
  Synthetic
gctgaugccccttugcag

SEQ ID NO: 23232 - DNA, 22 bp, Artificial Sequence
  Synthetic
ctctcaaguccaagtgcctcug

SEQ ID NO: 23233 - DNA, 22 bp, Artificial Sequence
  Synthetic
tgttggcugcaaggtuacaaga

SEQ ID NO: 23234 - DNA, 20 bp, Artificial Sequence
  Synthetic
ggacgagaaccutgcugacc

SEQ ID NO: 23235 - DNA, 25 bp, Artificial Sequence
  Synthetic
gcacttctutttgggacucagagac

SEQ ID NO: 23236 - DNA, 24 bp, Artificial Sequence
  Synthetic
ccttctucagcatctacuccaagg

SEQ ID NO: 23237 - DNA, 22 bp, Artificial Sequence
  Synthetic
cacagccugttaatgtccucca

SEQ ID NO: 23238 - DNA, 19 bp, Artificial Sequence
  Synthetic
tggcccuacacaacgugag

SEQ ID NO: 23239 - DNA, 22 bp, Artificial Sequence
  Synthetic
ccutcaaagtaggugcccagag

SEQ ID NO: 23240 - DNA, 22 bp, Artificial Sequence
  Synthetic
aggauggaaggagttgugaggt

SEQ ID NO: 23241 - DNA, 27 bp, Artificial Sequence
  Synthetic
agatctacaaaaucctccatgcttugg

SEQ ID NO: 23242 - DNA, 23 bp, Artificial Sequence
  Synthetic
cgaagctccauacatcactcuct

SEQ ID NO: 23243 - DNA, 25 bp, Artificial Sequence
  Synthetic
agataacactcautctggccatcug

SEQ ID NO: 23244 - DNA, 19 bp, Artificial Sequence
  Synthetic
caagggtucggtgggacug

SEQ ID NO: 23245 - DNA, 23 bp, Artificial Sequence
  Synthetic
cagcatgagcacautgtcaagut

SEQ ID NO: 23246 - DNA, 17 bp, Artificial Sequence
  Synthetic
gggcacuggtggcucat

SEQ ID NO: 23247 - DNA, 21 bp, Artificial Sequence
  Synthetic
gcaaaggacgucatggcttut

SEQ ID NO: 23248 - DNA, 21 bp, Artificial Sequence
  Synthetic
ccccaugacgccctugaaaat

SEQ ID NO: 23249 - DNA, 24 bp, Artificial Sequence
  Synthetic
ctctctgttuctggttccucacag

SEQ ID NO: 23250 - DNA, 20 bp, Artificial Sequence
  Synthetic
gaucttggacucccgcagag

SEQ ID NO: 23251 - DNA, 19 bp, Artificial Sequence
  Synthetic
gcaggcutctccctugaca

SEQ ID NO: 23252 - DNA, 21 bp, Artificial Sequence
  Synthetic
tgauccagagccatugcaagt

SEQ ID NO: 23253 - DNA, 23 bp, Artificial Sequence
  Synthetic
agagcttccuttgggtaguaagt

SEQ ID NO: 23254 - DNA, 21 bp, Artificial Sequence
  Synthetic
cccaagaguacctgccatgug

SEQ ID NO: 23255 - DNA, 27 bp, Artificial Sequence
  Synthetic
tgctgatcctcuttttctctctgtcua

SEQ ID NO: 23256 - DNA, 23 bp, Artificial Sequence
  Synthetic
cagtcttgcugcagacacaatut

SEQ ID NO: 23257 - DNA, 22 bp, Artificial Sequence
  Synthetic
ttagaagcagcgaucggagaug

SEQ ID NO: 23258 - DNA, 18 bp, Artificial Sequence
  Synthetic
ggaugcgagccaggtuct

SEQ ID NO: 23259 - DNA, 18 bp, Artificial Sequence
  Synthetic
ccgcgagagcutcgacug

SEQ ID NO: 23260 - DNA, 17 bp, Artificial Sequence
  Synthetic
gcgugcgaacggaaugt

SEQ ID NO: 23261 - DNA, 17 bp, Artificial Sequence
  Synthetic
gguggcagccgacaaug

SEQ ID NO: 23262 - DNA, 27 bp, Artificial Sequence
  Synthetic
gcataccttgucaacttcgatgttcut

SEQ ID NO: 23263 - DNA, 27 bp, Artificial Sequence
  Synthetic
gcagtccatauagacagaatagtucac

SEQ ID NO: 23264 - DNA, 25 bp, Artificial Sequence
  Synthetic
gcuaacattgaccuggaaaagagca

SEQ ID NO: 23265 - DNA, 20 bp, Artificial Sequence
  Synthetic
ggttgcgccutcctccauag

SEQ ID NO: 23266 - DNA, 23 bp, Artificial Sequence
  Synthetic
gctgaagccugttcttggtctut

SEQ ID NO: 23267 - DNA, 21 bp, Artificial Sequence
  Synthetic
cttgtagcuctccgacucgaa

SEQ ID NO: 23268 - DNA, 17 bp, Artificial Sequence
  Synthetic
caggcugttccgcucct

SEQ ID NO: 23269 - DNA, 18 bp, Artificial Sequence
  Synthetic
ggtgagugtccugccaca

SEQ ID NO: 23270 - DNA, 24 bp, Artificial Sequence
  Synthetic
cauctttttguccagccagcaaat

SEQ ID NO: 23271 - DNA, 21 bp, Artificial Sequence
  Synthetic
ctgugcagcagcaatctugac

SEQ ID NO: 23272 - DNA, 21 bp, Artificial Sequence
  Synthetic
gtggucccagccagtcatuac

SEQ ID NO: 23273 - DNA, 30 bp, Artificial Sequence
  Synthetic
gttggaagaatgugatcagcttatttatut

SEQ ID NO: 23274 - DNA, 21 bp, Artificial Sequence
  Synthetic
cagaaagggucccactgcuac

SEQ ID NO: 23275 - DNA, 24 bp, Artificial Sequence
  Synthetic
gttactcctcacaucaccccatut

SEQ ID NO: 23276 - DNA, 27 bp, Artificial Sequence
  Synthetic
catccagagctutccaaagagaaacua

SEQ ID NO: 23277 - DNA, 21 bp, Artificial Sequence
  Synthetic
actcgagugccacttuaacag

SEQ ID NO: 23278 - DNA, 21 bp, Artificial Sequence
  Synthetic
gggtggtaugtggttttgcug

SEQ ID NO: 23279 - DNA, 19 bp, Artificial Sequence
  Synthetic
tggcccucaaggctccuat

SEQ ID NO: 23280 - DNA, 22 bp, Artificial Sequence
  Synthetic
tcaaagggcuccactggtttut

SEQ ID NO: 23281 - DNA, 21 bp, Artificial Sequence
  Synthetic
tgatgcttucacggctccaut

SEQ ID NO: 23282 - DNA, 22 bp, Artificial Sequence
  Synthetic
ggcaacugccttccuagacaag

SEQ ID NO: 23283 - DNA, 24 bp, Artificial Sequence
  Synthetic
ccaatgaggaaacugaccaaagug

SEQ ID NO: 23284 - DNA, 30 bp, Artificial Sequence
  Synthetic
gttgacttagaauctcactttccugaagat

SEQ ID NO: 23285 - DNA, 30 bp, Artificial Sequence
  Synthetic
agaggcaaatattucatgttctctaaauga

SEQ ID NO: 23286 - DNA, 23 bp, Artificial Sequence
  Synthetic
gccctggugaaattaggtctuct

SEQ ID NO: 23287 - DNA, 30 bp, Artificial Sequence
  Synthetic
actgaaataagaacucaccttttaagtcut

SEQ ID NO: 23288 - DNA, 24 bp, Artificial Sequence
  Synthetic
ccatctccagggutaaaggacuca

SEQ ID NO: 23289 - DNA, 32 bp, Artificial Sequence
  Synthetic
cctcctcagaaccuaaaaataaaatatgtgut

SEQ ID NO: 23290 - DNA, 24 bp, Artificial Sequence
  Synthetic
ccagcaaaggcaucatcaaagtuc

SEQ ID NO: 23291 - DNA, 18 bp, Artificial Sequence
  Synthetic
gactccugccacucagca

SEQ ID NO: 23292 - DNA, 21 bp, Artificial Sequence
  Synthetic
cctgtggtcuctgagagcugt

SEQ ID NO: 23293 - DNA, 31 bp, Artificial Sequence
  Synthetic
tgtgtgttaataacutagcactgttucagat

SEQ ID NO: 23294 - DNA, 23 bp, Artificial Sequence
  Synthetic
gtattuccagcatcccugaacca

SEQ ID NO: 23295 - DNA, 22 bp, Artificial Sequence
  Synthetic
ggcagaagccucccttaaucat

SEQ ID NO: 23296 - DNA, 23 bp, Artificial Sequence
  Synthetic
cctccctatccutccctgttgut

SEQ ID NO: 23297 - DNA, 22 bp, Artificial Sequence
  Synthetic
aattctgtgtgugggaccagut

SEQ ID NO: 23298 - DNA, 21 bp, Artificial Sequence
  Synthetic
cagcctugccccttcaaacua

SEQ ID NO: 23299 - DNA, 28 bp, Artificial Sequence
  Synthetic
ccaagatctuaggcagaatgaacaatuc

SEQ ID NO: 23300 - DNA, 19 bp, Artificial Sequence
  Synthetic
tcatgguggcaggcagtuc

SEQ ID NO: 23301 - DNA, 20 bp, Artificial Sequence
  Synthetic
tcaatgtgcucacggaugct

SEQ ID NO: 23302 - DNA, 20 bp, Artificial Sequence
  Synthetic
gtcacucgggcttauggact

SEQ ID NO: 23303 - DNA, 24 bp, Artificial Sequence
  Synthetic
ggagctcttagugtgcactttcug

SEQ ID NO: 23304 - DNA, 21 bp, Artificial Sequence
  Synthetic
ccccaaacaggccaugtatuc

SEQ ID NO: 23305 - DNA, 23 bp, Artificial Sequence
  Synthetic
cctctgagcuacagcttcatuca

SEQ ID NO: 23306 - DNA, 21 bp, Artificial Sequence
  Synthetic
ggcccagagcuctttgttuga

SEQ ID NO: 23307 - DNA, 23 bp, Artificial Sequence
  Synthetic
acctcautccttcttuggagcag

SEQ ID NO: 23308 - DNA, 20 bp, Artificial Sequence
  Synthetic
cgagacucaccacctuggac

SEQ ID NO: 23309 - DNA, 24 bp, Artificial Sequence
  Synthetic
ccaagaaccucgcatagtcauact

SEQ ID NO: 23310 - DNA, 23 bp, Artificial Sequence
  Synthetic
tttgtccauacatttgcctcucc

SEQ ID NO: 23311 - DNA, 17 bp, Artificial Sequence
  Synthetic
cucagcccagccuagca

SEQ ID NO: 23312 - DNA, 20 bp, Artificial Sequence
  Synthetic
ccggcaautcatggauccag

SEQ ID NO: 23313 - DNA, 20 bp, Artificial Sequence
  Synthetic
cccctcugatgtgtcuccaa

SEQ ID NO: 23314 - DNA, 26 bp, Artificial Sequence
  Synthetic
cttcttcaggaacuccaaguaacagg

SEQ ID NO: 23315 - DNA, 22 bp, Artificial Sequence
  Synthetic
gcaaaggacagcacugttcuct

SEQ ID NO: 23316 - DNA, 26 bp, Artificial Sequence
  Synthetic
caagaagaaaacggcautttgagugt

SEQ ID NO: 23317 - DNA, 24 bp, Artificial Sequence
  Synthetic
cacctttcctugcctctttccuag

SEQ ID NO: 23318 - DNA, 19 bp, Artificial Sequence
  Synthetic
cucccagagaucccagtug

SEQ ID NO: 23319 - DNA, 27 bp, Artificial Sequence
  Synthetic
ctctgattccucactgattgctctuag

SEQ ID NO: 23320 - DNA, 21 bp, Artificial Sequence
  Synthetic
ctcauggaagccagccccuca

SEQ ID NO: 23321 - DNA, 23 bp, Artificial Sequence
  Synthetic
ctcctggccccugtcatcttcug

SEQ ID NO: 23322 - DNA, 21 bp, Artificial Sequence
  Synthetic
cccttccaauggatccacuca

SEQ ID NO: 23323 - DNA, 22 bp, Artificial Sequence
  Synthetic
tcatgctggauccccactttuc

SEQ ID NO: 23324 - DNA, 19 bp, Artificial Sequence
  Synthetic
cctctuccatgggcuccag

SEQ ID NO: 23325 - DNA, 20 bp, Artificial Sequence
  Synthetic
ctggcaggutagcagugaga

SEQ ID NO: 23326 - DNA, 20 bp, Artificial Sequence
  Synthetic
ccaugagcagccaaauggga

SEQ ID NO: 23327 - DNA, 24 bp, Artificial Sequence
  Synthetic
gcagccauacaagcaaauacttug

SEQ ID NO: 23328 - DNA, 20 bp, Artificial Sequence
  Synthetic
cgagucctctugcagcagaa

SEQ ID NO: 23329 - DNA, 21 bp, Artificial Sequence
  Synthetic
cctcuccccacaaccaguaag

SEQ ID NO: 23330 - DNA, 23 bp, Artificial Sequence
  Synthetic
tctggagugccccataaggauag

SEQ ID NO: 23331 - DNA, 20 bp, Artificial Sequence
  Synthetic
tcccagtgutctctccucga

SEQ ID NO: 23332 - DNA, 22 bp, Artificial Sequence
  Synthetic
ggagcagaaacaccuccctuaa

SEQ ID NO: 23333 - DNA, 21 bp, Artificial Sequence
  Synthetic
gacucgacagctctuccacag

SEQ ID NO: 23334 - DNA, 23 bp, Artificial Sequence
  Synthetic
ctgaagcuacactgactggugac

SEQ ID NO: 23335 - DNA, 22 bp, Artificial Sequence
  Synthetic
tggtaacuggcaccatctcuct

SEQ ID NO: 23336 - DNA, 20 bp, Artificial Sequence
  Synthetic
agcagcuggaggcttcttuc

SEQ ID NO: 23337 - DNA, 27 bp, Artificial Sequence
  Synthetic
aggctattttccuctttctctcttugc

SEQ ID NO: 23338 - DNA, 20 bp, Artificial Sequence
  Synthetic
gctccctcuccgctactcuc

SEQ ID NO: 23339 - DNA, 24 bp, Artificial Sequence
  Synthetic
gctggattcacucttcactcuaca

SEQ ID NO: 23340 - DNA, 20 bp, Artificial Sequence
  Synthetic
gctgcccucgtctcctcuag

SEQ ID NO: 23341 - DNA, 22 bp, Artificial Sequence
  Synthetic
cattcuggacgaaacccaguga

SEQ ID NO: 23342 - DNA, 22 bp, Artificial Sequence
  Synthetic
tccacuaagggaaagtcugggt

SEQ ID NO: 23343 - DNA, 20 bp, Artificial Sequence
  Synthetic
cccaggatgugggagtctuc

SEQ ID NO: 23344 - DNA, 22 bp, Artificial Sequence
  Synthetic
gtgtacucagacgtgatgugct

SEQ ID NO: 23345 - DNA, 21 bp, Artificial Sequence
  Synthetic
tgaggcagccuccttacugaa

SEQ ID NO: 23346 - DNA, 21 bp, Artificial Sequence
  Synthetic
tgcctgcucacaagaccatuc

SEQ ID NO: 23347 - DNA, 21 bp, Artificial Sequence
  Synthetic
gcatgagtcuagaggcgcauc

SEQ ID NO: 23348 - DNA, 17 bp, Artificial Sequence
  Synthetic
acacugggagccugcac

SEQ ID NO: 23349 - DNA, 17 bp, Artificial Sequence
  Synthetic
ggccuggacccatucca

SEQ ID NO: 23350 - DNA, 29 bp, Artificial Sequence
  Synthetic
tgattggtagcagaaagugaaactaacut

SEQ ID NO: 23351 - DNA, 30 bp, Artificial Sequence
  Synthetic
agcctgcctacutaagatcaatttactuac

SEQ ID NO: 23352 - DNA, 32 bp, Artificial Sequence
  Synthetic
cagaagacaatgutgatgttcatgatauagaa

SEQ ID NO: 23353 - DNA, 26 bp, Artificial Sequence
  Synthetic
tcatgatactaguttttgacccagug

SEQ ID NO: 23354 - DNA, 27 bp, Artificial Sequence
  Synthetic
gctacatctggaauagaagaaactuca

SEQ ID NO: 23355 - DNA, 26 bp, Artificial Sequence
  Synthetic
ctttacacagttugacacaggcaaut

SEQ ID NO: 23356 - DNA, 26 bp, Artificial Sequence
  Synthetic
agagcatacaacucacgtaatttugt

SEQ ID NO: 23357 - DNA, 27 bp, Artificial Sequence
  Synthetic
caaacauatttcgaagtucaaccgagt

SEQ ID NO: 23358 - DNA, 24 bp, Artificial Sequence
  Synthetic
ccutgcagaauccaagaaaacagg

SEQ ID NO: 23359 - DNA, 24 bp, Artificial Sequence
  Synthetic
cattttccccutacctccatugct

SEQ ID NO: 23360 - DNA, 32 bp, Artificial Sequence
  Synthetic
gaaacattttgggagautaggtatatgtacut

SEQ ID NO: 23361 - DNA, 27 bp, Artificial Sequence
  Synthetic
accataaaacctutggaagtgtaagut

SEQ ID NO: 23362 - DNA, 27 bp, Artificial Sequence
  Synthetic
ggaaataccagucaaatgtccauggat

SEQ ID NO: 23363 - DNA, 27 bp, Artificial Sequence
  Synthetic
tcatucagaaaacaaauagagcacaua

SEQ ID NO: 23364 - DNA, 27 bp, Artificial Sequence
  Synthetic
gtgcagtaactugatttgctgttguat

SEQ ID NO: 23365 - DNA, 22 bp, Artificial Sequence
  Synthetic
aagaggcutccaaatugagggt

SEQ ID NO: 23366 - DNA, 23 bp, Artificial Sequence
  Synthetic
caattctggccuggcaacctaua

SEQ ID NO: 23367 - DNA, 26 bp, Artificial Sequence
  Synthetic
cattaaggauaacagccgauccauaa

SEQ ID NO: 23368 - DNA, 30 bp, Artificial Sequence
  Synthetic
acaaaccatagcuataatgaagaactugct

SEQ ID NO: 23369 - DNA, 32 bp, Artificial Sequence
  Synthetic
gaggtttttcttauctcttaaaatgtttcugc

SEQ ID NO: 23370 - DNA, 30 bp, Artificial Sequence
  Synthetic
agaacttgaaagatucatggtctctaaaut

SEQ ID NO: 23371 - DNA, 25 bp, Artificial Sequence
  Synthetic
aattccacaccauctccttctucag

SEQ ID NO: 23372 - DNA, 26 bp, Artificial Sequence
  Synthetic
cacagaattugacacactugcagaaa

SEQ ID NO: 23373 - DNA, 24 bp, Artificial Sequence
  Synthetic
tcttccccgcutactctaaucact

SEQ ID NO: 23374 - DNA, 23 bp, Artificial Sequence
  Synthetic
aggutagaaccaucagagagcct

SEQ ID NO: 23375 - DNA, 25 bp, Artificial Sequence
  Synthetic
tggtataaacaguggcacacactuc

SEQ ID NO: 23376 - DNA, 22 bp, Artificial Sequence
  Synthetic
tgcagtaggaagugccatgtuc

SEQ ID NO: 23377 - DNA, 30 bp, Artificial Sequence
  Synthetic
aataattcaccuttgacattaactucaagc

SEQ ID NO: 23378 - DNA, 27 bp, Artificial Sequence
  Synthetic
tgtgtagtgcuaaatgtgaactgcuaa

SEQ ID NO: 23379 - DNA, 20 bp, Artificial Sequence
  Synthetic
gctcuggaggacccagguat

SEQ ID NO: 23380 - DNA, 28 bp, Artificial Sequence
  Synthetic
tgtcattttccutaggttcaaaacuggt

SEQ ID NO: 23381 - DNA, 29 bp, Artificial Sequence
  Synthetic
agagaaagtctgtuttaaagcgattgcua

SEQ ID NO: 23382 - DNA, 19 bp, Artificial Sequence
  Synthetic
tctccactucaccccguca

SEQ ID NO: 23383 - DNA, 26 bp, Artificial Sequence
  Synthetic
aactggtuctcatctacuaggcagat

SEQ ID NO: 23384 - DNA, 28 bp, Artificial Sequence
  Synthetic
acaacttcattugtgttttctccuaggt

SEQ ID NO: 23385 - DNA, 25 bp, Artificial Sequence
  Synthetic
ggtgttgtuggcagggatacauaaa

SEQ ID NO: 23386 - DNA, 25 bp, Artificial Sequence
  Synthetic
gcauaatgatgaugccaaacgacaa

SEQ ID NO: 23387 - DNA, 32 bp, Artificial Sequence
  Synthetic
gtgcacaaaggagauactagataaatattuga

SEQ ID NO: 23388 - DNA, 27 bp, Artificial Sequence
  Synthetic
caagacatgctuatctccaactccuac

SEQ ID NO: 23389 - DNA, 21 bp, Artificial Sequence
  Synthetic
gcggaccugtggctacuaaga

SEQ ID NO: 23390 - DNA, 22 bp, Artificial Sequence
  Synthetic
gttaccgggacaggucattcuc

SEQ ID NO: 23391 - DNA, 32 bp, Artificial Sequence
  Synthetic
acttagtttcttaucattttggcttctauacc

SEQ ID NO: 23392 - DNA, 30 bp, Artificial Sequence
  Synthetic
gacacttacaacagucaagttctgauagaa

SEQ ID NO: 23393 - DNA, 28 bp, Artificial Sequence
  Synthetic
aaagtaacatucaacactgauacccaaa

SEQ ID NO: 23394 - DNA, 32 bp, Artificial Sequence
  Synthetic
tctttaatagaguccagaggaagtatttaugg

SEQ ID NO: 23395 - DNA, 23 bp, Artificial Sequence
  Synthetic
aaaggtguccaaccaaugcaaag

SEQ ID NO: 23396 - DNA, 27 bp, Artificial Sequence
  Synthetic
gcagcctaaaacauagaaagtcactuc

SEQ ID NO: 23397 - DNA, 32 bp, Artificial Sequence
  Synthetic
atgtaattataggagaguaaatccactuacct

SEQ ID NO: 23398 - DNA, 28 bp, Artificial Sequence
  Synthetic
tgataucagauacaaaggctccuaaaag

SEQ ID NO: 23399 - DNA, 25 bp, Artificial Sequence
  Synthetic
gactttcatgtacuctcccacctua

SEQ ID NO: 23400 - DNA, 27 bp, Artificial Sequence
  Synthetic
cacagatgagtutgatcaacgaatuct

SEQ ID NO: 23401 - DNA, 27 bp, Artificial Sequence
  Synthetic
gguaagcatttaactuaaagacaggca

SEQ ID NO: 23402 - DNA, 30 bp, Artificial Sequence
  Synthetic
taattucctattttccatuacagcaaacac

SEQ ID NO: 23403 - DNA, 21 bp, Artificial Sequence
  Synthetic
agugcaggaggguaaggagat

SEQ ID NO: 23404 - DNA, 28 bp, Artificial Sequence
  Synthetic
ggcagttucaaacgtaatagcatuaaga

SEQ ID NO: 23405 - DNA, 27 bp, Artificial Sequence
  Synthetic
caaaccggaugggttcattauaaaaca

SEQ ID NO: 23406 - DNA, 27 bp, Artificial Sequence
  Synthetic
tgtttaccttugcaggatgtaagtugt

SEQ ID NO: 23407 - DNA, 28 bp, Artificial Sequence
  Synthetic
accatatggctgutactaggttcaaaut

SEQ ID NO: 23408 - DNA, 21 bp, Artificial Sequence
  Synthetic
ctcaaacucaggccaggaguc

SEQ ID NO: 23409 - DNA, 25 bp, Artificial Sequence
  Synthetic
acacataccaacucgaaacttccut

SEQ ID NO: 23410 - DNA, 29 bp, Artificial Sequence
  Synthetic
ccacttccugaaaaagaagaaaaggatuc

SEQ ID NO: 23411 - DNA, 28 bp, Artificial Sequence
  Synthetic
ctccattctcutcacttgtcctuaaaca

SEQ ID NO: 23412 - DNA, 25 bp, Artificial Sequence
  Synthetic
acataacuaacagggccgagaagua

SEQ ID NO: 23413 - DNA, 24 bp, Artificial Sequence
  Synthetic
aggagggugttaagacatttuccc

SEQ ID NO: 23414 - DNA, 28 bp, Artificial Sequence
  Synthetic
ctctctctcggacacutataaagtcauc

SEQ ID NO: 23415 - DNA, 23 bp, Artificial Sequence
  Synthetic
agtaacctuccgcttttcuccaa

SEQ ID NO: 23416 - DNA, 31 bp, Artificial Sequence
  Synthetic
atcatacatgtcttuctctttcagttcctut

SEQ ID NO: 23417 - DNA, 26 bp, Artificial Sequence
  Synthetic
agttagugtactttgtucacagaggg

SEQ ID NO: 23418 - DNA, 26 bp, Artificial Sequence
  Synthetic
gttttcttgagcagucgaggaguaaa

SEQ ID NO: 23419 - DNA, 25 bp, Artificial Sequence
  Synthetic
agggatutcgttacaaugaacagca

SEQ ID NO: 23420 - DNA, 22 bp, Artificial Sequence
  Synthetic
tcagcctcgcuctctaaaguca

SEQ ID NO: 23421 - DNA, 23 bp, Artificial Sequence
  Synthetic
gaaagcctgugtttccagtgtut

SEQ ID NO: 23422 - DNA, 24 bp, Artificial Sequence
  Synthetic
ctgcttgttuccaaactgtcctug

SEQ ID NO: 23423 - DNA, 23 bp, Artificial Sequence
  Synthetic
acagtgaagagagugggaatuct

SEQ ID NO: 23424 - DNA, 29 bp, Artificial Sequence
  Synthetic
gcataatctttagauccagcacacactua

SEQ ID NO: 23425 - DNA, 21 bp, Artificial Sequence
  Synthetic
ttttgatgacugggacuggca

SEQ ID NO: 23426 - DNA, 24 bp, Artificial Sequence
  Synthetic
agcatcttgautctgagtcuccct

SEQ ID NO: 23427 - DNA, 24 bp, Artificial Sequence
  Synthetic
ctgcttagcugccaaatatgtuca

SEQ ID NO: 23428 - DNA, 22 bp, Artificial Sequence
  Synthetic
gacgtggaugcctgactuaaca

SEQ ID NO: 23429 - DNA, 30 bp, Artificial Sequence
  Synthetic
tggtttcctaauttactcttttgtaugact

SEQ ID NO: 23430 - DNA, 21 bp, Artificial Sequence
  Synthetic
ctgagggagcgguggauaaac

SEQ ID NO: 23431 - DNA, 22 bp, Artificial Sequence
  Synthetic
tcgtggcauttcatctctugct

SEQ ID NO: 23432 - DNA, 21 bp, Artificial Sequence
  Synthetic
cccactctucccctgaaacug

SEQ ID NO: 23433 - DNA, 23 bp, Artificial Sequence
  Synthetic
cggtcatuggagaaaaggaagug

SEQ ID NO: 23434 - DNA, 24 bp, Artificial Sequence
  Synthetic
gggaguctatcttctucaggaggt

SEQ ID NO: 23435 - DNA, 23 bp, Artificial Sequence
  Synthetic
agcttccatuccattgagaacug

SEQ ID NO: 23436 - DNA, 27 bp, Artificial Sequence
  Synthetic
caccagaacaucaacgaatttccuaag

SEQ ID NO: 23437 - DNA, 31 bp, Artificial Sequence
  Synthetic
tccttctcaggaaautttctgatattugcat

SEQ ID NO: 23438 - DNA, 24 bp, Artificial Sequence
  Synthetic
cttcgagaatgugagctctacguc

SEQ ID NO: 23439 - DNA, 21 bp, Artificial Sequence
  Synthetic
tcaccucatcatcuccccaca

SEQ ID NO: 23440 - DNA, 30 bp, Artificial Sequence
  Synthetic
ctaagctuaatgtttgaaatucacggaaga

SEQ ID NO: 23441 - DNA, 24 bp, Artificial Sequence
  Synthetic
tctcccguaacaatattgcaugct

SEQ ID NO: 23442 - DNA, 25 bp, Artificial Sequence
  Synthetic
cutgctttgatttauggaacaccga

SEQ ID NO: 23443 - DNA, 23 bp, Artificial Sequence
  Synthetic
cacactcucaaacaccatgguct

SEQ ID NO: 23444 - DNA, 27 bp, Artificial Sequence
  Synthetic
gtttgagagtgugtgtttgtttagcut

SEQ ID NO: 23445 - DNA, 31 bp, Artificial Sequence
  Synthetic
agaaaccatgtattuattgtgagggaatuca

SEQ ID NO: 23446 - DNA, 17 bp, Artificial Sequence
  Synthetic
cggtcggugcacuccag

SEQ ID NO: 23447 - DNA, 24 bp, Artificial Sequence
  Synthetic
cccacctgaguaagacttctucat

SEQ ID NO: 23448 - DNA, 20 bp, Artificial Sequence
  Synthetic
gucgagacacccaacuccac

SEQ ID NO: 23449 - DNA, 21 bp, Artificial Sequence
  Synthetic
gttggcutagggaguccacat

SEQ ID NO: 23450 - DNA, 17 bp, Artificial Sequence
  Synthetic
ccaagguccccgaggug

SEQ ID NO: 23451 - DNA, 22 bp, Artificial Sequence
  Synthetic
caggcuctgaattcuccaaggt

SEQ ID NO: 23452 - DNA, 18 bp, Artificial Sequence
  Synthetic
gaccugaagugcccccat

SEQ ID NO: 23453 - DNA, 23 bp, Artificial Sequence
  Synthetic
cagtctcctuactttgcctcgua

SEQ ID NO: 23454 - DNA, 22 bp, Artificial Sequence
  Synthetic
cctgttccgcuctaactccuct

SEQ ID NO: 23455 - DNA, 20 bp, Artificial Sequence
  Synthetic
ggccttcucgttccgtgaug

SEQ ID NO: 23456 - DNA, 20 bp, Artificial Sequence
  Synthetic
gtcttccguctcccctcuga

SEQ ID NO: 23457 - DNA, 17 bp, Artificial Sequence
  Synthetic
cccccgcuagtgcucct

SEQ ID NO: 23458 - DNA, 22 bp, Artificial Sequence
  Synthetic
gcccatctcuctccctcctuat

SEQ ID NO: 23459 - DNA, 22 bp, Artificial Sequence
  Synthetic
ctgggaacaacaucctagugga

SEQ ID NO: 23460 - DNA, 20 bp, Artificial Sequence
  Synthetic
ggacgcacaugcagaacauc

SEQ ID NO: 23461 - DNA, 19 bp, Artificial Sequence
  Synthetic
gcaggguggcgtctacauc

SEQ ID NO: 23462 - DNA, 18 bp, Artificial Sequence
  Synthetic
ccucgaggccauccaagc

SEQ ID NO: 23463 - DNA, 18 bp, Artificial Sequence
  Synthetic
accctgccgcuctcctua

SEQ ID NO: 23464 - DNA, 23 bp, Artificial Sequence
  Synthetic
cggaaccccugccatttgtauat

SEQ ID NO: 23465 - DNA, 20 bp, Artificial Sequence
  Synthetic
agtctccuaaacgcgccaut

SEQ ID NO: 23466 - DNA, 22 bp, Artificial Sequence
  Synthetic
ccagcattucctgtttcacugc

SEQ ID NO: 23467 - DNA, 22 bp, Artificial Sequence
  Synthetic
gaacttctugaagccccucagt

SEQ ID NO: 23468 - DNA, 20 bp, Artificial Sequence
  Synthetic
agagggugcccttcaatguc

SEQ ID NO: 23469 - DNA, 26 bp, Artificial Sequence
  Synthetic
gcaaggattutaagcatattgucggt

SEQ ID NO: 23470 - DNA, 24 bp, Artificial Sequence
  Synthetic
cctgtgtgaucatatggtggaugg

SEQ ID NO: 23471 - DNA, 21 bp, Artificial Sequence
  Synthetic
cggccgtcucctccatacuaa

SEQ ID NO: 23472 - DNA, 19 bp, Artificial Sequence
  Synthetic
gcacagcgcgaugctctua

SEQ ID NO: 23473 - DNA, 26 bp, Artificial Sequence
  Synthetic
cgatggcttuccgatatgagtcttuc

SEQ ID NO: 23474 - DNA, 19 bp, Artificial Sequence
  Synthetic
cagauctctuccgcagcct

SEQ ID NO: 23475 - DNA, 23 bp, Artificial Sequence
  Synthetic
tcuaacaccacuacagagacgua

SEQ ID NO: 23476 - DNA, 20 bp, Artificial Sequence
  Synthetic
tgctccucagacatccucgt

SEQ ID NO: 23477 - DNA, 24 bp, Artificial Sequence
  Synthetic
ctgcagcaaagaccautttgauga

SEQ ID NO: 23478 - DNA, 27 bp, Artificial Sequence
  Synthetic
ctacttactcgugctgaccaaaaacua

SEQ ID NO: 23479 - DNA, 24 bp, Artificial Sequence
  Synthetic
cacacgautgatgtttcugcagag

SEQ ID NO: 23480 - DNA, 21 bp, Artificial Sequence
  Synthetic
ggtgcuggagaaauggcagaa

SEQ ID NO: 23481 - DNA, 20 bp, Artificial Sequence
  Synthetic
cuatgaccugcagcaccaca

SEQ ID NO: 23482 - DNA, 23 bp, Artificial Sequence
  Synthetic
cagactugcaacctttcctugaa

SEQ ID NO: 23483 - DNA, 17 bp, Artificial Sequence
  Synthetic
gttucggagcccugcct

SEQ ID NO: 23484 - DNA, 22 bp, Artificial Sequence
  Synthetic
gagtgguaacgcaatcacgtut

SEQ ID NO: 23485 - DNA, 25 bp, Artificial Sequence
  Synthetic
cccaccttcucagaactttctgtut

SEQ ID NO: 23486 - DNA, 23 bp, Artificial Sequence
  Synthetic
tttctgccttugtacagcctcut

SEQ ID NO: 23487 - DNA, 19 bp, Artificial Sequence
  Synthetic
ctggagagcgucctggtug

SEQ ID NO: 23488 - DNA, 26 bp, Artificial Sequence
  Synthetic
ctcacaaacccucttcttatcauccc

SEQ ID NO: 23489 - DNA, 21 bp, Artificial Sequence
  Synthetic
cacagctccuccagatagucc

SEQ ID NO: 23490 - DNA, 21 bp, Artificial Sequence
  Synthetic
ctgtggucctgcacuaggaaa

SEQ ID NO: 23491 - DNA, 26 bp, Artificial Sequence
  Synthetic
gatggtcaggautctggaaaagtuct

SEQ ID NO: 23492 - DNA, 21 bp, Artificial Sequence
  Synthetic
catctcttcucccgtcuccct

SEQ ID NO: 23493 - DNA, 20 bp, Artificial Sequence
  Synthetic
gctcucggttccuaggagca

SEQ ID NO: 23494 - DNA, 22 bp, Artificial Sequence
  Synthetic
caccatccaccugtcttctgut

SEQ ID NO: 23495 - DNA, 24 bp, Artificial Sequence
  Synthetic
ggctctcaaucacttccttcucag

SEQ ID NO: 23496 - DNA, 31 bp, Artificial Sequence
  Synthetic
ctttctgcagcttucatgatgtaaaagatua

SEQ ID NO: 23497 - DNA, 28 bp, Artificial Sequence
  Synthetic
caaaagaaatucagggaagagagagtuc

SEQ ID NO: 23498 - DNA, 20 bp, Artificial Sequence
  Synthetic
cctaagucaccagccacuca

SEQ ID NO: 23499 - DNA, 19 bp, Artificial Sequence
  Synthetic
gctuccgcaccagguacac

SEQ ID NO: 23500 - DNA, 19 bp, Artificial Sequence
  Synthetic
aagccagcagucagccuac

SEQ ID NO: 23501 - DNA, 27 bp, Artificial Sequence
  Synthetic
cctccaaauactgagacttugaacaca

SEQ ID NO: 23502 - DNA, 19 bp, Artificial Sequence
  Synthetic
acccaggugacaagcucac

SEQ ID NO: 23503 - DNA, 24 bp, Artificial Sequence
  Synthetic
ggtcatcuagaccccaacactuac

SEQ ID NO: 23504 - DNA, 21 bp, Artificial Sequence
  Synthetic
ggagagacguggtgacatgug

SEQ ID NO: 23505 - DNA, 24 bp, Artificial Sequence
  Synthetic
gaagcgaaagcaggutcttaacug

SEQ ID NO: 23506 - DNA, 23 bp, Artificial Sequence
  Synthetic
gcagccaguctcaaagtctguaa

SEQ ID NO: 23507 - DNA, 21 bp, Artificial Sequence
  Synthetic
cttgcuggacgttcuggaact

SEQ ID NO: 23508 - DNA, 21 bp, Artificial Sequence
  Synthetic
gcactgacutggatcuggaca

SEQ ID NO: 23509 - DNA, 18 bp, Artificial Sequence
  Synthetic
gguggctcgugcacaaac

SEQ ID NO: 23510 - DNA, 23 bp, Artificial Sequence
  Synthetic
tgtcatcugctggaaatguccac

SEQ ID NO: 23511 - DNA, 24 bp, Artificial Sequence
  Synthetic
caggatcagguttatcgggaucac

SEQ ID NO: 23512 - DNA, 24 bp, Artificial Sequence
  Synthetic
gtctgcucataagtcugaacagct

SEQ ID NO: 23513 - DNA, 24 bp, Artificial Sequence
  Synthetic
ccuaaaacgauggaagagcaaaug

SEQ ID NO: 23514 - DNA, 27 bp, Artificial Sequence
  Synthetic
agtgaaattctucctgaaatggcauct

SEQ ID NO: 23515 - DNA, 31 bp, Artificial Sequence
  Synthetic
aaagtcatccaaagauagctgaggaaauaat

SEQ ID NO: 23516 - DNA, 28 bp, Artificial Sequence
  Synthetic
tcacctaatcgagagugaagaaacaaug

SEQ ID NO: 23517 - DNA, 25 bp, Artificial Sequence
  Synthetic
cctcaguatcctaacuacccacagg

SEQ ID NO: 23518 - DNA, 28 bp, Artificial Sequence
  Synthetic
gggatatataugtgtatgtgtgugaagg

SEQ ID NO: 23519 - DNA, 27 bp, Artificial Sequence
  Synthetic
ttcctgtctctugtcgaattgatguag

SEQ ID NO: 23520 - DNA, 28 bp, Artificial Sequence
  Synthetic
tcaaaggctaauagagcactctagucaa

SEQ ID NO: 23521 - DNA, 27 bp, Artificial Sequence
  Synthetic
ccagtacagaaucagatgacaaugagt

SEQ ID NO: 23522 - DNA, 23 bp, Artificial Sequence
  Synthetic
ccatcugaaggcatgttgugaga

SEQ ID NO: 23523 - DNA, 28 bp, Artificial Sequence
  Synthetic
ccctatgcatcuttcgtatattagtcug

SEQ ID NO: 23524 - DNA, 19 bp, Artificial Sequence
  Synthetic
agtgatcuccccctugcct

SEQ ID NO: 23525 - DNA, 18 bp, Artificial Sequence
  Synthetic
cgcatucccgaggtggut

SEQ ID NO: 23526 - DNA, 27 bp, Artificial Sequence
  Synthetic
gctataactacaaauggagctcaucct

SEQ ID NO: 23527 - DNA, 30 bp, Artificial Sequence
  Synthetic
gcacaaattaaatuaccctgtagtagctug

SEQ ID NO: 23528 - DNA, 26 bp, Artificial Sequence
  Synthetic
acattcaatucaaaccatccagcauc

SEQ ID NO: 23529 - DNA, 28 bp, Artificial Sequence
  Synthetic
tgctgactacauctgattctagaacuca

SEQ ID NO: 23530 - DNA, 22 bp, Artificial Sequence
  Synthetic
acctggacuggaagtaggacug

SEQ ID NO: 23531 - DNA, 26 bp, Artificial Sequence
  Synthetic
gccctuacaacaaaaacaagagctua

SEQ ID NO: 23532 - DNA, 30 bp, Artificial Sequence
  Synthetic
tgtacagagutactactuagacagagaagc

SEQ ID NO: 23533 - DNA, 24 bp, Artificial Sequence
  Synthetic
ttccattcctuccacccagattuc

SEQ ID NO: 23534 - DNA, 25 bp, Artificial Sequence
  Synthetic
tgttgatgaccutcgtcgcttaugc

SEQ ID NO: 23535 - DNA, 27 bp, Artificial Sequence
  Synthetic
gtctgcaatcggcauggtatgaaguac

SEQ ID NO: 23536 - DNA, 25 bp, Artificial Sequence
  Synthetic
catcgacuccaccgaggtcatcuac

SEQ ID NO: 23537 - DNA, 21 bp, Artificial Sequence
  Synthetic
gatctugacggccctccugca

SEQ ID NO: 23538 - DNA, 25 bp, Artificial Sequence
  Synthetic
gtatatggtgauggagtactgcgug

SEQ ID NO: 23539 - DNA, 19 bp, Artificial Sequence
  Synthetic
agugtggccucacggaaag

SEQ ID NO: 23540 - DNA, 21 bp, Artificial Sequence
  Synthetic
tcttcccucccctcgaaauga

SEQ ID NO: 23541 - DNA, 18 bp, Artificial Sequence
  Synthetic
agagggaugaggcuccca

SEQ ID NO: 23542 - DNA, 21 bp, Artificial Sequence
  Synthetic
cgugtgtaugaacggcacaga

SEQ ID NO: 23543 - DNA, 18 bp, Artificial Sequence
  Synthetic
ccagccucactgctgcut

SEQ ID NO: 23544 - DNA, 21 bp, Artificial Sequence
  Synthetic
gggagcugaaagcaccatcug

SEQ ID NO: 23545 - DNA, 23 bp, Artificial Sequence
  Synthetic
cacctcacauctttctccuccct

SEQ ID NO: 23546 - DNA, 17 bp, Artificial Sequence
  Synthetic
cccacugaccucgcact

SEQ ID NO: 23547 - DNA, 23 bp, Artificial Sequence
  Synthetic
gacaucaacgaggccttuaagga

SEQ ID NO: 23548 - DNA, 20 bp, Artificial Sequence
  Synthetic
cccaacuggaaccaggaguc

SEQ ID NO: 23549 - DNA, 19 bp, Artificial Sequence
  Synthetic
gcaccagccucaugcacaa

SEQ ID NO: 23550 - DNA, 20 bp, Artificial Sequence
  Synthetic
ccaaacccucacagaccuca

SEQ ID NO: 23551 - DNA, 17 bp, Artificial Sequence
  Synthetic
ccugaccgcccatcuct

SEQ ID NO: 23552 - DNA, 17 bp, Artificial Sequence
  Synthetic
ccctgcccugggtccua

SEQ ID NO: 23553 - DNA, 18 bp, Artificial Sequence
  Synthetic
cagccgagcuctggaguc

SEQ ID NO: 23554 - DNA, 17 bp, Artificial Sequence
  Synthetic
ggcacugccacugacga

SEQ ID NO: 23555 - DNA, 19 bp, Artificial Sequence
  Synthetic
gccggttcucaccccttut

SEQ ID NO: 23556 - DNA, 19 bp, Artificial Sequence
  Synthetic
cccacguctgcacatcugt

SEQ ID NO: 23557 - DNA, 20 bp, Artificial Sequence
  Synthetic
tctcauccccaccccatcuc

SEQ ID NO: 23558 - DNA, 20 bp, Artificial Sequence
  Synthetic
tgaacuguggaggcaaaggg

SEQ ID NO: 23559 - DNA, 19 bp, Artificial Sequence
  Synthetic
cuggccccaggagaaugaa

SEQ ID NO: 23560 - DNA, 18 bp, Artificial Sequence
  Synthetic
ggcagcacugaggucgag

SEQ ID NO: 23561 - DNA, 18 bp, Artificial Sequence
  Synthetic
cugcccgaccgtttugag

SEQ ID NO: 23562 - DNA, 21 bp, Artificial Sequence
  Synthetic
tggactccucgaacttcucca

SEQ ID NO: 23563 - DNA, 20 bp, Artificial Sequence
  Synthetic
gctactggugtgacccaugt

SEQ ID NO: 23564 - DNA, 17 bp, Artificial Sequence
  Synthetic
gggttgggcugcaggua

SEQ ID NO: 23565 - DNA, 18 bp, Artificial Sequence
  Synthetic
ggtcttgugtgcctuggg

SEQ ID NO: 23566 - DNA, 19 bp, Artificial Sequence
  Synthetic
cucagcaggauaccccauc

SEQ ID NO: 23567 - DNA, 17 bp, Artificial Sequence
  Synthetic
ctgccugcagcccuagt

SEQ ID NO: 23568 - DNA, 17 bp, Artificial Sequence
  Synthetic
gccaguggcccgtctuc

SEQ ID NO: 23569 - DNA, 22 bp, Artificial Sequence
  Synthetic
tgtaggccaugatctgagcuct

SEQ ID NO: 23570 - DNA, 17 bp, Artificial Sequence
  Synthetic
tggccccutgccttcuc

SEQ ID NO: 23571 - DNA, 17 bp, Artificial Sequence
  Synthetic
gggtcugcggtggcauc

SEQ ID NO: 23572 - DNA, 26 bp, Artificial Sequence
  Synthetic
gaattcaggaacutgaaaacctuccc

SEQ ID NO: 23573 - DNA, 20 bp, Artificial Sequence
  Synthetic
agcagcagugttggugacaa

SEQ ID NO: 23574 - DNA, 24 bp, Artificial Sequence
  Synthetic
ggaataucacagatccgucacagg

SEQ ID NO: 23575 - DNA, 21 bp, Artificial Sequence
  Synthetic
atguagaagagcgcacgucaa

SEQ ID NO: 23576 - DNA, 22 bp, Artificial Sequence
  Synthetic
cctcagtgucacacgaaugact

SEQ ID NO: 23577 - DNA, 19 bp, Artificial Sequence
  Synthetic
ctcaccccgggutcatcuc

SEQ ID NO: 23578 - DNA, 22 bp, Artificial Sequence
  Synthetic
ccagcacautgtcacagauagg

SEQ ID NO: 23579 - DNA, 23 bp, Artificial Sequence
  Synthetic
cttgtccacuctctcagugacag

SEQ ID NO: 23580 - DNA, 22 bp, Artificial Sequence
  Synthetic
gcacagugagccattgaugaga

SEQ ID NO: 23581 - DNA, 24 bp, Artificial Sequence
  Synthetic
gtaguaagagaggaaaccucagug

SEQ ID NO: 23582 - DNA, 20 bp, Artificial Sequence
  Synthetic
gaacaagctucccgagcuct

SEQ ID NO: 23583 - DNA, 19 bp, Artificial Sequence
  Synthetic
caccuggaaccgucagcat

SEQ ID NO: 23584 - DNA, 20 bp, Artificial Sequence
  Synthetic
tccctcucatctgcctucca

SEQ ID NO: 23585 - DNA, 20 bp, Artificial Sequence
  Synthetic
gccuaggagcucagcagaca

SEQ ID NO: 23586 - DNA, 21 bp, Artificial Sequence
  Synthetic
ccactcuacccctgaggucac

SEQ ID NO: 23587 - DNA, 25 bp, Artificial Sequence
  Synthetic
tgagcaggaagaugaagtacucaga

SEQ ID NO: 23588 - DNA, 17 bp, Artificial Sequence
  Synthetic
gaacgaggugcgtgugc

SEQ ID NO: 23589 - DNA, 22 bp, Artificial Sequence
  Synthetic
tggaggacutctggucgaacat

SEQ ID NO: 23590 - DNA, 18 bp, Artificial Sequence
  Synthetic
cgagcucccctcguggat

SEQ ID NO: 23591 - DNA, 19 bp, Artificial Sequence
  Synthetic
tgggcctcuccagcatgua

SEQ ID NO: 23592 - DNA, 21 bp, Artificial Sequence
  Synthetic
ggtccugaggtaagaccugct

SEQ ID NO: 23593 - DNA, 21 bp, Artificial Sequence
  Synthetic
cctccaggutgaaggtctgug

SEQ ID NO: 23594 - DNA, 22 bp, Artificial Sequence
  Synthetic
ccagagcucaaggctgtcttuc

SEQ ID NO: 23595 - DNA, 22 bp, Artificial Sequence
  Synthetic
cctcactgucatcgtcacucac

SEQ ID NO: 23596 - DNA, 18 bp, Artificial Sequence
  Synthetic
gcacccugggaggcuaua

SEQ ID NO: 23597 - DNA, 24 bp, Artificial Sequence
  Synthetic
cattttcttcutgatggccuccat

SEQ ID NO: 23598 - DNA, 22 bp, Artificial Sequence
  Synthetic
gtggctggccugatacttctua

SEQ ID NO: 23599 - DNA, 18 bp, Artificial Sequence
  Synthetic
gtggccagucgttccuga

SEQ ID NO: 23600 - DNA, 17 bp, Artificial Sequence
  Synthetic
ggctcagcugggcctut

SEQ ID NO: 23601 - DNA, 17 bp, Artificial Sequence
  Synthetic
cagccucgctcagucct

SEQ ID NO: 23602 - DNA, 26 bp, Artificial Sequence
  Synthetic
ctttccccauactcttaatccucacc

SEQ ID NO: 23603 - DNA, 27 bp, Artificial Sequence
  Synthetic
tctgttggaacaagacucttctgttut

SEQ ID NO: 23604 - DNA, 20 bp, Artificial Sequence
  Synthetic
tgtcagaacucacgcgtguc

SEQ ID NO: 23605 - DNA, 22 bp, Artificial Sequence
  Synthetic
gctcactucgggtccttucaac

SEQ ID NO: 23606 - DNA, 20 bp, Artificial Sequence
  Synthetic
agtcctuacgggccatcuca

SEQ ID NO: 23607 - DNA, 21 bp, Artificial Sequence
  Synthetic
ccttcacagcacuggacacuc

SEQ ID NO: 23608 - DNA, 22 bp, Artificial Sequence
  Synthetic
cactgttccuctcctctcccua

SEQ ID NO: 23609 - DNA, 20 bp, Artificial Sequence
  Synthetic
gcgccaggacutgtctucag

SEQ ID NO: 23610 - DNA, 21 bp, Artificial Sequence
  Synthetic
ctggagguggaacuagcacat

SEQ ID NO: 23611 - DNA, 26 bp, Artificial Sequence
  Synthetic
gttcctcccaucaaactctctgtuac

SEQ ID NO: 23612 - DNA, 25 bp, Artificial Sequence
  Synthetic
acatcatctcuaacctggactgugt

SEQ ID NO: 23613 - DNA, 20 bp, Artificial Sequence
  Synthetic
ctcctcacucaccagctguc

SEQ ID NO: 23614 - DNA, 22 bp, Artificial Sequence
  Synthetic
ccacaatcauccccaaggtcut

SEQ ID NO: 23615 - DNA, 21 bp, Artificial Sequence
  Synthetic
cctctagcauccctcctcucc

SEQ ID NO: 23616 - DNA, 22 bp, Artificial Sequence
  Synthetic
agagagggcuctggttctgaut

SEQ ID NO: 23617 - DNA, 21 bp, Artificial Sequence
  Synthetic
tcuccccaaagagggactugt

SEQ ID NO: 23618 - DNA, 20 bp, Artificial Sequence
  Synthetic
ccagtcccuccccttgagut

SEQ ID NO: 23619 - DNA, 17 bp, Artificial Sequence
  Synthetic
acuccugcacccccaga

SEQ ID NO: 23620 - DNA, 19 bp, Artificial Sequence
  Synthetic
gggagcauttgggagcuga

SEQ ID NO: 23621 - DNA, 19 bp, Artificial Sequence
  Synthetic
ggcgttucccaccccauag

SEQ ID NO: 23622 - DNA, 22 bp, Artificial Sequence
  Synthetic
agctgcacugttttctgggaut

SEQ ID NO: 23623 - DNA, 24 bp, Artificial Sequence
  Synthetic
cctacagautgaagaggucggaag

SEQ ID NO: 23624 - DNA, 22 bp, Artificial Sequence
  Synthetic
tctcctttccuccctccttcug

SEQ ID NO: 23625 - DNA, 20 bp, Artificial Sequence
  Synthetic
actcacucctcagccuggat

SEQ ID NO: 23626 - DNA, 20 bp, Artificial Sequence
  Synthetic
acaagauccgcaagcuggac

SEQ ID NO: 23627 - DNA, 20 bp, Artificial Sequence
  Synthetic
gagtctgcagcugaggctut

SEQ ID NO: 23628 - DNA, 21 bp, Artificial Sequence
  Synthetic
catgaagaagcugaggcauga

SEQ ID NO: 23629 - DNA, 17 bp, Artificial Sequence
  Synthetic
ctgcccugtccggagug

SEQ ID NO: 23630 - DNA, 21 bp, Artificial Sequence
  Synthetic
ggtcaugacaggaggucagag

SEQ ID NO: 23631 - DNA, 21 bp, Artificial Sequence
  Synthetic
cctttgtggugagctcaguca

SEQ ID NO: 23632 - DNA, 19 bp, Artificial Sequence
  Synthetic
gacctcaugtgccagugct

SEQ ID NO: 23633 - DNA, 18 bp, Artificial Sequence
  Synthetic
cgcctgugcctagaggut

SEQ ID NO: 23634 - DNA, 21 bp, Artificial Sequence
  Synthetic
actctgggcuaacgctttgug

SEQ ID NO: 23635 - DNA, 28 bp, Artificial Sequence
  Synthetic
actctgtaccttutcctcttttcgttut

SEQ ID NO: 23636 - DNA, 28 bp, Artificial Sequence
  Synthetic
tgttaactgtgtautcatgttcccctut

SEQ ID NO: 23637 - DNA, 25 bp, Artificial Sequence
  Synthetic
gaaaactcccacutccaaacucaag

SEQ ID NO: 23638 - DNA, 20 bp, Artificial Sequence
  Synthetic
gucatgaagcugagccccaa

SEQ ID NO: 23639 - DNA, 28 bp, Artificial Sequence
  Synthetic
actaggatatuaacacatgggcuacagt

SEQ ID NO: 23640 - DNA, 27 bp, Artificial Sequence
  Synthetic
ggauaaccauaaagagaggattgcuaa

SEQ ID NO: 23641 - DNA, 23 bp, Artificial Sequence
  Synthetic
cccttttuggcccataggaugaa

SEQ ID NO: 23642 - DNA, 23 bp, Artificial Sequence
  Synthetic
ccggaaccaguaucgagaagact

SEQ ID NO: 23643 - DNA, 24 bp, Artificial Sequence
  Synthetic
gcagaaacuccctttgttaagcuc

SEQ ID NO: 23644 - DNA, 26 bp, Artificial Sequence
  Synthetic
gtgttcactttuggtgtacaaacuga

SEQ ID NO: 23645 - DNA, 28 bp, Artificial Sequence
  Synthetic
ctctgatggutacaaagaatugcaacag

SEQ ID NO: 23646 - DNA, 25 bp, Artificial Sequence
  Synthetic
ccgagaggaaaauaaacagatugcc

SEQ ID NO: 23647 - DNA, 22 bp, Artificial Sequence
  Synthetic
ggaacccccuccacctttctua

SEQ ID NO: 23648 - DNA, 19 bp, Artificial Sequence
  Synthetic
cgcgacugcggataaugag

SEQ ID NO: 23649 - DNA, 21 bp, Artificial Sequence
  Synthetic
caccttcuggatggtttgcug

SEQ ID NO: 23650 - DNA, 17 bp, Artificial Sequence
  Synthetic
cagggccugcactcuca

SEQ ID NO: 23651 - DNA, 17 bp, Artificial Sequence
  Synthetic
gccttgguggcctcgua

SEQ ID NO: 23652 - DNA, 17 bp, Artificial Sequence
  Synthetic
ggccacgucgcacuaca

SEQ ID NO: 23653 - DNA, 17 bp, Artificial Sequence
  Synthetic
ccgggcgutacctugct

SEQ ID NO: 23654 - DNA, 20 bp, Artificial Sequence
  Synthetic
ctcacggtucctggtgtcut

SEQ ID NO: 23655 - DNA, 22 bp, Artificial Sequence
  Synthetic
gcttgcctgutcatagccguag

SEQ ID NO: 23656 - DNA, 17 bp, Artificial Sequence
  Synthetic
cggcgcuatgggctcug

SEQ ID NO: 23657 - DNA, 22 bp, Artificial Sequence
  Synthetic
gcttcttguccttcttggugga

SEQ ID NO: 23658 - DNA, 17 bp, Artificial Sequence
  Synthetic
cggugcaccaccccauc

SEQ ID NO: 23659 - DNA, 21 bp, Artificial Sequence
  Synthetic
cagcagacggagacutgagua

SEQ ID NO: 23660 - DNA, 18 bp, Artificial Sequence
  Synthetic
ccuccgacgccaagugag

SEQ ID NO: 23661 - DNA, 20 bp, Artificial Sequence
  Synthetic
gaugctggaauccccaccat

SEQ ID NO: 23662 - DNA, 20 bp, Artificial Sequence
  Synthetic
tgacttgcagacucggctug

SEQ ID NO: 23663 - DNA, 18 bp, Artificial Sequence
  Synthetic
gtcgggcugttgcttcug

SEQ ID NO: 23664 - DNA, 28 bp, Artificial Sequence
  Synthetic
ggcgggtgcautgtagttattatttuaa

SEQ ID NO: 23665 - DNA, 25 bp, Artificial Sequence
  Synthetic
gtttccacagcaacugcctttuaat

SEQ ID NO: 23666 - DNA, 21 bp, Artificial Sequence
  Synthetic
aaactgggcuttgtagcguct

SEQ ID NO: 23667 - DNA, 28 bp, Artificial Sequence
  Synthetic
tccgttttugcaaccaaacaagtaauaa

SEQ ID NO: 23668 - DNA, 18 bp, Artificial Sequence
  Synthetic
cggcagguaggtgtggua

SEQ ID NO: 23669 - DNA, 17 bp, Artificial Sequence
  Synthetic
ctgcccuccatcuccga

SEQ ID NO: 23670 - DNA, 24 bp, Artificial Sequence
  Synthetic
aattacagacccacautctgccut

SEQ ID NO: 23671 - DNA, 21 bp, Artificial Sequence
  Synthetic
cacagcacccuggagatgtua

SEQ ID NO: 23672 - DNA, 20 bp, Artificial Sequence
  Synthetic
gtaccagccccaaguggaug

SEQ ID NO: 23673 - DNA, 28 bp, Artificial Sequence
  Synthetic
aacctcattcugttttgttctctaucgt

SEQ ID NO: 23674 - DNA, 19 bp, Artificial Sequence
  Synthetic
ccgggccaguacctugaaa

SEQ ID NO: 23675 - DNA, 17 bp, Artificial Sequence
  Synthetic
gcagcauggtggaggug

SEQ ID NO: 23676 - DNA, 23 bp, Artificial Sequence
  Synthetic
gctgccauttcatuacaggcaaa

SEQ ID NO: 23677 - DNA, 22 bp, Artificial Sequence
  Synthetic
catttucaggaggaagcgaugg

SEQ ID NO: 23678 - DNA, 22 bp, Artificial Sequence
  Synthetic
gaggaaucggagaacacaguca

SEQ ID NO: 23679 - DNA, 26 bp, Artificial Sequence
  Synthetic
cgaagaacaatauctggtggctgaua

SEQ ID NO: 23680 - DNA, 17 bp, Artificial Sequence
  Synthetic
gcccugcagtcctgugt

SEQ ID NO: 23681 - DNA, 28 bp, Artificial Sequence
  Synthetic
ctcactgtgutttctcttctugaaacag

SEQ ID NO: 23682 - DNA, 19 bp, Artificial Sequence
  Synthetic
cgtggacgutctggacgug

SEQ ID NO: 23683 - DNA, 21 bp, Artificial Sequence
  Synthetic
cactggccucctgtttgucat

SEQ ID NO: 23684 - DNA, 24 bp, Artificial Sequence
  Synthetic
tctcgtgtttcugctgtctgtuac

SEQ ID NO: 23685 - DNA, 25 bp, Artificial Sequence
  Synthetic
aggtgtactcauctcagaggaaguc

SEQ ID NO: 23686 - DNA, 22 bp, Artificial Sequence
  Synthetic
gaccccggguttatuacaggaa

SEQ ID NO: 23687 - DNA, 21 bp, Artificial Sequence
  Synthetic
gtgcatccggcucagtacuac

SEQ ID NO: 23688 - DNA, 17 bp, Artificial Sequence
  Synthetic
ccttccaguggccccut

SEQ ID NO: 23689 - DNA, 19 bp, Artificial Sequence
  Synthetic
tctcagcaggccucacuca

SEQ ID NO: 23690 - DNA, 21 bp, Artificial Sequence
  Synthetic
gggacttguctggccucaaat

SEQ ID NO: 23691 - DNA, 20 bp, Artificial Sequence
  Synthetic
ccaccaguctgcatgtucac

SEQ ID NO: 23692 - DNA, 17 bp, Artificial Sequence
  Synthetic
ggcgcaugcaggagaug

SEQ ID NO: 23693 - DNA, 17 bp, Artificial Sequence
  Synthetic
cuccgggucgggaacag

SEQ ID NO: 23694 - DNA, 19 bp, Artificial Sequence
  Synthetic
gtggtgcugcgaccctuat

SEQ ID NO: 23695 - DNA, 27 bp, Artificial Sequence
  Synthetic
ccatgtgacgaugcaactattttctuc

SEQ ID NO: 23696 - DNA, 24 bp, Artificial Sequence
  Synthetic
ctcctatactgacugggaggacut

SEQ ID NO: 23697 - DNA, 22 bp, Artificial Sequence
  Synthetic
aaggttcucttcttgtcucggc

SEQ ID NO: 23698 - DNA, 25 bp, Artificial Sequence
  Synthetic
ggagaugtttggctucaaagaagaa

SEQ ID NO: 23699 - DNA, 20 bp, Artificial Sequence
  Synthetic
acaaacgucagcgggtucaa

SEQ ID NO: 23700 - DNA, 27 bp, Artificial Sequence
  Synthetic
ctgaggattcuccatctatagcuggaa

SEQ ID NO: 23701 - DNA, 23 bp, Artificial Sequence
  Synthetic
tcttcttctccauctcagcguct

SEQ ID NO: 23702 - DNA, 17 bp, Artificial Sequence
  Synthetic
accatgguggcccugag

SEQ ID NO: 23703 - DNA, 22 bp, Artificial Sequence
  Synthetic
tgggttgcutcctctugagaga

SEQ ID NO: 23704 - DNA, 21 bp, Artificial Sequence
  Synthetic
gcacaggaggaagugccaaua

SEQ ID NO: 23705 - DNA, 26 bp, Artificial Sequence
  Synthetic
ctcctcttcagcautctcaggauaaa

SEQ ID NO: 23706 - DNA, 31 bp, Artificial Sequence
  Synthetic
ggcaaacaataccaaauttacttcatgtgua

SEQ ID NO: 23707 - DNA, 21 bp, Artificial Sequence
  Synthetic
ccaacaaugaatgggccucac

SEQ ID NO: 23708 - DNA, 22 bp, Artificial Sequence
  Synthetic
gctgtcggacugaaactgtgut

SEQ ID NO: 23709 - DNA, 30 bp, Artificial Sequence
  Synthetic
tcagtaatgaaaaucaggauctcaactuac

SEQ ID NO: 23710 - DNA, 22 bp, Artificial Sequence
  Synthetic
gatcccacutcagcuaagagca

SEQ ID NO: 23711 - DNA, 20 bp, Artificial Sequence
  Synthetic
cgaatcgcugtggcctugat

SEQ ID NO: 23712 - DNA, 23 bp, Artificial Sequence
  Synthetic
cagtagtguccttctgtgctugt

SEQ ID NO: 23713 - DNA, 22 bp, Artificial Sequence
  Synthetic
aagacaggcugtcaccaaugag

SEQ ID NO: 23714 - DNA, 25 bp, Artificial Sequence
  Synthetic
tggcattgttgauatcacaggguat

SEQ ID NO: 23715 - DNA, 24 bp, Artificial Sequence
  Synthetic
agagagtaccugggaacaaccuac

SEQ ID NO: 23716 - DNA, 22 bp, Artificial Sequence
  Synthetic
aauctctcagcuacagaaccca

SEQ ID NO: 23717 - DNA, 27 bp, Artificial Sequence
  Synthetic
tctttagtagaucctgaggtugaccag

SEQ ID NO: 23718 - DNA, 22 bp, Artificial Sequence
  Synthetic
agaaagagccautggcactcug

SEQ ID NO: 23719 - DNA, 21 bp, Artificial Sequence
  Synthetic
tggcctcaucgctctcctaua

SEQ ID NO: 23720 - DNA, 21 bp, Artificial Sequence
  Synthetic
gctgtgctucttcaggtgguc

SEQ ID NO: 23721 - DNA, 26 bp, Artificial Sequence
  Synthetic
acatcatcccautttcttttcugcct

SEQ ID NO: 23722 - DNA, 21 bp, Artificial Sequence
  Synthetic
aaagtcccaugatggcagguc

SEQ ID NO: 23723 - DNA, 20 bp, Artificial Sequence
  Synthetic
tgatuagcccgggcagagua

SEQ ID NO: 23724 - DNA, 21 bp, Artificial Sequence
  Synthetic
acagcttgugccggtuaagat

SEQ ID NO: 23725 - DNA, 21 bp, Artificial Sequence
  Synthetic
ggctacaucgaccttccucct

SEQ ID NO: 23726 - DNA, 17 bp, Artificial Sequence
  Synthetic
cgguccaccccagguaa

SEQ ID NO: 23727 - DNA, 18 bp, Artificial Sequence
  Synthetic
cctgggaccucggactug

SEQ ID NO: 23728 - DNA, 17 bp, Artificial Sequence
  Synthetic
gcgcugaacaccgacuc

SEQ ID NO: 23729 - DNA, 21 bp, Artificial Sequence
  Synthetic
cauaccaggugagcagacaca

SEQ ID NO: 23730 - DNA, 20 bp, Artificial Sequence
  Synthetic
ccctaggcuccaagggtcuc

SEQ ID NO: 23731 - DNA, 22 bp, Artificial Sequence
  Synthetic
cacatgcugacgaggtcttuct

SEQ ID NO: 23732 - DNA, 18 bp, Artificial Sequence
  Synthetic
gagccuacgcaccuggac

SEQ ID NO: 23733 - DNA, 17 bp, Artificial Sequence
  Synthetic
tcucccggcgcctcaua

SEQ ID NO: 23734 - DNA, 21 bp, Artificial Sequence
  Synthetic
gggcgaggautccattuacct

SEQ ID NO: 23735 - DNA, 20 bp, Artificial Sequence
  Synthetic
agctcacucagcctttuggt

SEQ ID NO: 23736 - DNA, 26 bp, Artificial Sequence
  Synthetic
gagtgggaaaagaugaaattcucgga

SEQ ID NO: 23737 - DNA, 22 bp, Artificial Sequence
  Synthetic
gcaggaaaagggaugctcaugt

SEQ ID NO: 23738 - DNA, 21 bp, Artificial Sequence
  Synthetic
gatucgaagggagugccagaa

SEQ ID NO: 23739 - DNA, 23 bp, Artificial Sequence
  Synthetic
ggttgttcccaaaucgtttccuc

SEQ ID NO: 23740 - DNA, 28 bp, Artificial Sequence
  Synthetic
ccacatacttcuctaagaaagaguggaa

SEQ ID NO: 23741 - DNA, 22 bp, Artificial Sequence
  Synthetic
gcaggaaaagggaugctcaugt

SEQ ID NO: 23742 - DNA, 22 bp, Artificial Sequence
  Synthetic
gaagggagugtcagaagcauct

SEQ ID NO: 23743 - DNA, 24 bp, Artificial Sequence
  Synthetic
gccagagaagutgttcccaaauca

SEQ ID NO: 23744 - DNA, 28 bp, Artificial Sequence
  Synthetic
ccttcgatgatautgccaaatacttcuc

SEQ ID NO: 23745 - DNA, 20 bp, Artificial Sequence
  Synthetic
gtccccagacutgtctgcut

SEQ ID NO: 23746 - DNA, 26 bp, Artificial Sequence
  Synthetic
gcagaggaagaaaauggttugaagga

SEQ ID NO: 23747 - DNA, 26 bp, Artificial Sequence
  Synthetic
ggttgttcccgaautctttcctctua

SEQ ID NO: 23748 - DNA, 18 bp, Artificial Sequence
  Synthetic
ctgcuggcctuggagaca

SEQ ID NO: 23749 - DNA, 18 bp, Artificial Sequence
  Synthetic
cugggagacccctuccac

SEQ ID NO: 23750 - DNA, 24 bp, Artificial Sequence
  Synthetic
ccaccaccauctcctctttucaaa

SEQ ID NO: 23751 - DNA, 24 bp, Artificial Sequence
  Synthetic
gattatauccgcaagcugcagaag

SEQ ID NO: 23752 - DNA, 21 bp, Artificial Sequence
  Synthetic
gggccaagacccuatcaccua

SEQ ID NO: 23753 - DNA, 20 bp, Artificial Sequence
  Synthetic
ggtggttcuctgccctcuct

SEQ ID NO: 23754 - DNA, 17 bp, Artificial Sequence
  Synthetic
gcagtggcugggcacut

SEQ ID NO: 23755 - DNA, 21 bp, Artificial Sequence
  Synthetic
gacccaucuggagaacccaac

SEQ ID NO: 23756 - DNA, 17 bp, Artificial Sequence
  Synthetic
cctgtucccgacgcuca

SEQ ID NO: 23757 - DNA, 23 bp, Artificial Sequence
  Synthetic
ctacactctcugcatcgtctuct

SEQ ID NO: 23758 - DNA, 17 bp, Artificial Sequence
  Synthetic
agaucaggccccuggga

SEQ ID NO: 23759 - DNA, 18 bp, Artificial Sequence
  Synthetic
agctcgggauggcguaga

SEQ ID NO: 23760 - DNA, 21 bp, Artificial Sequence
  Synthetic
gggatgaguggaaggttcuct

SEQ ID NO: 23761 - DNA, 27 bp, Artificial Sequence
  Synthetic
cctcacttuccaactattctccaucac

SEQ ID NO: 23762 - DNA, 20 bp, Artificial Sequence
  Synthetic
gaaaagcagcugggctugag

SEQ ID NO: 23763 - DNA, 25 bp, Artificial Sequence
  Synthetic
ccctcccaccuttcatgtgtaauaa

SEQ ID NO: 23764 - DNA, 23 bp, Artificial Sequence
  Synthetic
ggctatttcucttgcaggucaga

SEQ ID NO: 23765 - DNA, 17 bp, Artificial Sequence
  Synthetic
cgggucaccccacacug

SEQ ID NO: 23766 - DNA, 22 bp, Artificial Sequence
  Synthetic
gaagccguctttttgugggaaa

SEQ ID NO: 23767 - DNA, 22 bp, Artificial Sequence
  Synthetic
cctcaaaagccaacagutgcuc

SEQ ID NO: 23768 - DNA, 22 bp, Artificial Sequence
  Synthetic
atcctgagcccuagctaatuca

SEQ ID NO: 23769 - DNA, 22 bp, Artificial Sequence
  Synthetic
gcttctcuggaagtccctctuc

SEQ ID NO: 23770 - DNA, 26 bp, Artificial Sequence
  Synthetic
aggaattagatccuctttgctttcug

SEQ ID NO: 23771 - DNA, 23 bp, Artificial Sequence
  Synthetic
cgtttttgcaccucttggttgug

SEQ ID NO: 23772 - DNA, 24 bp, Artificial Sequence
  Synthetic
tgtcttactuagcccagaggtcut

SEQ ID NO: 23773 - DNA, 23 bp, Artificial Sequence
  Synthetic
catggcaccuctgttgtttaugc

SEQ ID NO: 23774 - DNA, 22 bp, Artificial Sequence
  Synthetic
gagcugaattugccccaaacaa

SEQ ID NO: 23775 - DNA, 22 bp, Artificial Sequence
  Synthetic
ccuagagtaguacaggcagggt

SEQ ID NO: 23776 - DNA, 27 bp, Artificial Sequence
  Synthetic
gcttaaaaggcuaaatggagtccaguc

SEQ ID NO: 23777 - DNA, 22 bp, Artificial Sequence
  Synthetic
atggagtugacctggcaaugat

SEQ ID NO: 23778 - DNA, 22 bp, Artificial Sequence
  Synthetic
cgccgtcuttctttgctugaaa

SEQ ID NO: 23779 - DNA, 22 bp, Artificial Sequence
  Synthetic
ctctccaatcuccctgtgctuc

SEQ ID NO: 23780 - DNA, 21 bp, Artificial Sequence
  Synthetic
gcggcgauacagctcatagug

SEQ ID NO: 23781 - DNA, 29 bp, Artificial Sequence
  Synthetic
ttcaacatacttucaataccccaaaucct

SEQ ID NO: 23782 - DNA, 25 bp, Artificial Sequence
  Synthetic
acttugcacaagagatcaguaagag

SEQ ID NO: 23783 - DNA, 21 bp, Artificial Sequence
  Synthetic
acaccuaccatgacucccgaa

SEQ ID NO: 23784 - DNA, 27 bp, Artificial Sequence
  Synthetic
ttggaggtcauaggtattagacuggag

SEQ ID NO: 23785 - DNA, 24 bp, Artificial Sequence
  Synthetic
tgctttucaggagagacaggttug

SEQ ID NO: 23786 - DNA, 23 bp, Artificial Sequence
  Synthetic
cttaccaccuggcgagctatauc

SEQ ID NO: 23787 - DNA, 17 bp, Artificial Sequence
  Synthetic
gucgcgcccgaagtgua

SEQ ID NO: 23788 - DNA, 21 bp, Artificial Sequence
  Synthetic
gacttgcgaagutcccacuct

SEQ ID NO: 23789 - DNA, 22 bp, Artificial Sequence
  Synthetic
acttgctuaggccattgaggug

SEQ ID NO: 23790 - DNA, 20 bp, Artificial Sequence
  Synthetic
tgtccguccctctcttcuca

SEQ ID NO: 23791 - DNA, 19 bp, Artificial Sequence
  Synthetic
ctcccccgggutcactuac

SEQ ID NO: 23792 - DNA, 20 bp, Artificial Sequence
  Synthetic
tggccguggaggagacaaua

SEQ ID NO: 23793 - DNA, 17 bp, Artificial Sequence
  Synthetic
ggtggtuccgccaggug

SEQ ID NO: 23794 - DNA, 19 bp, Artificial Sequence
  Synthetic
cgaggacagugccatgucg

SEQ ID NO: 23795 - DNA, 20 bp, Artificial Sequence
  Synthetic
actctcggagcucgaaguct

SEQ ID NO: 23796 - DNA, 19 bp, Artificial Sequence
  Synthetic
tgactcccgcutcgcttuc

SEQ ID NO: 23797 - DNA, 22 bp, Artificial Sequence
  Synthetic
acatggtgaggutctggtcauc

SEQ ID NO: 23798 - DNA, 19 bp, Artificial Sequence
  Synthetic
ctcaccaccaccucgtuct

SEQ ID NO: 23799 - DNA, 18 bp, Artificial Sequence
  Synthetic
gctugagctccucagcca

SEQ ID NO: 23800 - DNA, 18 bp, Artificial Sequence
  Synthetic
ccaacggcauccgtcucc

SEQ ID NO: 23801 - DNA, 22 bp, Artificial Sequence
  Synthetic
tggatatgcutgtgctgctuga

SEQ ID NO: 23802 - DNA, 20 bp, Artificial Sequence
  Synthetic
ccucctcccucaacaagcac

SEQ ID NO: 23803 - DNA, 22 bp, Artificial Sequence
  Synthetic
agggaaaguactcgtugaagcc

SEQ ID NO: 23804 - DNA, 17 bp, Artificial Sequence
  Synthetic
tcuccgccgucagcaac

SEQ ID NO: 23805 - DNA, 18 bp, Artificial Sequence
  Synthetic
gtcacugccguccgacat

SEQ ID NO: 23806 - DNA, 23 bp, Artificial Sequence
  Synthetic
tccatugccgagaagtacttugg

SEQ ID NO: 23807 - DNA, 20 bp, Artificial Sequence
  Synthetic
gcctugaccagcaagttgug

SEQ ID NO: 23808 - DNA, 18 bp, Artificial Sequence
  Synthetic
gctggaccugagcaucgg

SEQ ID NO: 23809 - DNA, 17 bp, Artificial Sequence
  Synthetic
agggctuggcgtagugg

SEQ ID NO: 23810 - DNA, 23 bp, Artificial Sequence
  Synthetic
acagatgucagccauagagacca

SEQ ID NO: 23811 - DNA, 20 bp, Artificial Sequence
  Synthetic
gtgtatcgcuccttgcccut

SEQ ID NO: 23812 - DNA, 17 bp, Artificial Sequence
  Synthetic
gggccugcacugaggag

SEQ ID NO: 23813 - DNA, 19 bp, Artificial Sequence
  Synthetic
ggtccaggutggtctgcug

SEQ ID NO: 23814 - DNA, 22 bp, Artificial Sequence
  Synthetic
cagtcaatcucctcctgcauca

SEQ ID NO: 23815 - DNA, 20 bp, Artificial Sequence
  Synthetic
ggtgtcaucctgcgactucc

SEQ ID NO: 23816 - DNA, 20 bp, Artificial Sequence
  Synthetic
gaugccgactttugggaagg

SEQ ID NO: 23817 - DNA, 18 bp, Artificial Sequence
  Synthetic
ggctcuggcgggtaccua

SEQ ID NO: 23818 - DNA, 28 bp, Artificial Sequence
  Synthetic
tttccaattttctgutcaatccacacug

SEQ ID NO: 23819 - DNA, 26 bp, Artificial Sequence
  Synthetic
cutccagatuaaccaggacgaagaag

SEQ ID NO: 23820 - DNA, 21 bp, Artificial Sequence
  Synthetic
gctcctutcgatggucaccac

SEQ ID NO: 23821 - DNA, 26 bp, Artificial Sequence
  Synthetic
tgttgagacagaugaacttgtcacut

SEQ ID NO: 23822 - DNA, 27 bp, Artificial Sequence
  Synthetic
acaugctgtattcauggaaaaccaaga

SEQ ID NO: 23823 - DNA, 28 bp, Artificial Sequence
  Synthetic
caacctauaaggagaagaaagctucagt

SEQ ID NO: 23824 - DNA, 27 bp, Artificial Sequence
  Synthetic
gcttgagttucaatttctctuaaagca

SEQ ID NO: 23825 - DNA, 23 bp, Artificial Sequence
  Synthetic
gcctctctuttctccccauacag

SEQ ID NO: 23826 - DNA, 26 bp, Artificial Sequence
  Synthetic
ccttattgaggtuggtgtcaatccut

SEQ ID NO: 23827 - DNA, 20 bp, Artificial Sequence
  Synthetic
ggcaggacugattccggaua

SEQ ID NO: 23828 - DNA, 17 bp, Artificial Sequence
  Synthetic
ctccgccaagggutgug

SEQ ID NO: 23829 - DNA, 18 bp, Artificial Sequence
  Synthetic
cggctagugggtccucag

SEQ ID NO: 23830 - DNA, 22 bp, Artificial Sequence
  Synthetic
gctgcgtcuccaagattcttug

SEQ ID NO: 23831 - DNA, 20 bp, Artificial Sequence
  Synthetic
cctggugccacgaggtagua

SEQ ID NO: 23832 - DNA, 18 bp, Artificial Sequence
  Synthetic
ccctctccuccggctgua

SEQ ID NO: 23833 - DNA, 24 bp, Artificial Sequence
  Synthetic
gtatatgtcugggtagtgggucct

SEQ ID NO: 23834 - DNA, 23 bp, Artificial Sequence
  Synthetic
cacttgctuaggacctctctugg

SEQ ID NO: 23835 - DNA, 22 bp, Artificial Sequence
  Synthetic
cagagtagcuggagaagctgug

SEQ ID NO: 23836 - DNA, 17 bp, Artificial Sequence
  Synthetic
ccggcuacagcguggac

SEQ ID NO: 23837 - DNA, 24 bp, Artificial Sequence
  Synthetic
guagctctccauaaacaagcagga

SEQ ID NO: 23838 - DNA, 23 bp, Artificial Sequence
  Synthetic
ttttgtttgggccutcgtacuct

SEQ ID NO: 23839 - DNA, 22 bp, Artificial Sequence
  Synthetic
caatagcgtacugagcgcttug

SEQ ID NO: 23840 - DNA, 25 bp, Artificial Sequence
  Synthetic
ttacaacuccaccaggatactacuc

SEQ ID NO: 23841 - DNA, 25 bp, Artificial Sequence
  Synthetic
gctgtgggtauagtgcaggtataut

SEQ ID NO: 23842 - DNA, 25 bp, Artificial Sequence
  Synthetic
ttgttcccttugctgtttttccaut

SEQ ID NO: 23843 - DNA, 26 bp, Artificial Sequence
  Synthetic
gcaagtatttuctggtatgcatucac

SEQ ID NO: 23844 - DNA, 25 bp, Artificial Sequence
  Synthetic
gctaaaggctucttccaacagtuca

SEQ ID NO: 23845 - DNA, 22 bp, Artificial Sequence
  Synthetic
aagccgaacuggatgauacacc

SEQ ID NO: 23846 - DNA, 17 bp, Artificial Sequence
  Synthetic
ccccuggtgatgcugct

SEQ ID NO: 23847 - DNA, 17 bp, Artificial Sequence
  Synthetic
gtccggguggucccaaa

SEQ ID NO: 23848 - DNA, 25 bp, Artificial Sequence
  Synthetic
gttcacattugcaaaggaacucact

SEQ ID NO: 23849 - DNA, 28 bp, Artificial Sequence
  Synthetic
cgaaaaugaacgagaaugagatctugat

SEQ ID NO: 23850 - DNA, 22 bp, Artificial Sequence
  Synthetic
gaaacuaccgctcaaatuggca

SEQ ID NO: 23851 - DNA, 25 bp, Artificial Sequence
  Synthetic
ggtcagaagacgacutatcagagut

SEQ ID NO: 23852 - DNA, 20 bp, Artificial Sequence
  Synthetic
cgaagcccagcucucaaaag

SEQ ID NO: 23853 - DNA, 20 bp, Artificial Sequence
  Synthetic
tgacctuggtgtgucccaga

SEQ ID NO: 23854 - DNA, 29 bp, Artificial Sequence
  Synthetic
gacagagaauggaaaagauaaggaacaga

SEQ ID NO: 23855 - DNA, 24 bp, Artificial Sequence
  Synthetic
ccgaaaaggcutctcagaaucagt

SEQ ID NO: 23856 - DNA, 25 bp, Artificial Sequence
  Synthetic
gagtcttucccagagagauccaaaa

SEQ ID NO: 23857 - DNA, 20 bp, Artificial Sequence
  Synthetic
cagcttguctcggctcucag

SEQ ID NO: 23858 - DNA, 24 bp, Artificial Sequence
  Synthetic
gttucgttccatttuccagcacat

SEQ ID NO: 23859 - DNA, 26 bp, Artificial Sequence
  Synthetic
tcattcatccutcttctaagtgugga

SEQ ID NO: 23860 - DNA, 25 bp, Artificial Sequence
  Synthetic
gatggttgagutgacagctcugaat

SEQ ID NO: 23861 - DNA, 29 bp, Artificial Sequence
  Synthetic
gatttacctcgttuaagatctctctccut

SEQ ID NO: 23862 - DNA, 26 bp, Artificial Sequence
  Synthetic
aguacacugaagagauagaggaaaga

SEQ ID NO: 23863 - DNA, 22 bp, Artificial Sequence
  Synthetic
aggagcaagggucucagagaaa

SEQ ID NO: 23864 - DNA, 21 bp, Artificial Sequence
  Synthetic
gccggutcatgtuccggaaat

SEQ ID NO: 23865 - DNA, 19 bp, Artificial Sequence
  Synthetic
ggcaggaaucccgucaagg

SEQ ID NO: 23866 - DNA, 26 bp, Artificial Sequence
  Synthetic
catgctattcauctgctttagcgtut

SEQ ID NO: 23867 - DNA, 23 bp, Artificial Sequence
  Synthetic
aacctuaaaccaagtccugcagt

SEQ ID NO: 23868 - DNA, 27 bp, Artificial Sequence
  Synthetic
gggaggttccucttcatcttcactaut

SEQ ID NO: 23869 - DNA, 24 bp, Artificial Sequence
  Synthetic
gacccatucagccttctccataut

SEQ ID NO: 23870 - DNA, 28 bp, Artificial Sequence
  Synthetic
gcttcttagttgcutaagagttgcatua

SEQ ID NO: 23871 - DNA, 23 bp, Artificial Sequence
  Synthetic
agccgtcuaccaaagcagtaaut

SEQ ID NO: 23872 - DNA, 19 bp, Artificial Sequence
  Synthetic
ttacuggcaccccctgtug

SEQ ID NO: 23873 - DNA, 27 bp, Artificial Sequence
  Synthetic
acattatatatccutcccagcagcuct

SEQ ID NO: 23874 - DNA, 23 bp, Artificial Sequence
  Synthetic
tgaaatuacctgtgcucacagca

SEQ ID NO: 23875 - DNA, 21 bp, Artificial Sequence
  Synthetic
tgatgcccugttccccuaaga

SEQ ID NO: 23876 - DNA, 23 bp, Artificial Sequence
  Synthetic
gcgatggtucaatattgctgugg

SEQ ID NO: 23877 - DNA, 23 bp, Artificial Sequence
  Synthetic
agtcugaagccctucaaaagcat

SEQ ID NO: 23878 - DNA, 28 bp, Artificial Sequence
  Synthetic
gcctagaattaagugtggagggtctuat

SEQ ID NO: 23879 - DNA, 24 bp, Artificial Sequence
  Synthetic
acccccauaccaggaacagtatua

SEQ ID NO: 23880 - DNA, 28 bp, Artificial Sequence
  Synthetic
gacttaggtcuctaaccacaaaagugaa

SEQ ID NO: 23881 - DNA, 25 bp, Artificial Sequence
  Synthetic
gatgccaatacaugatcacgacuct

SEQ ID NO: 23882 - DNA, 22 bp, Artificial Sequence
  Synthetic
ctgcucaagtttctugccagag

SEQ ID NO: 23883 - DNA, 28 bp, Artificial Sequence
  Synthetic
ctgctttcccuaagagttcatatcacut

SEQ ID NO: 23884 - DNA, 22 bp, Artificial Sequence
  Synthetic
cgtgagcacuggtccattttua

SEQ ID NO: 23885 - DNA, 23 bp, Artificial Sequence
  Synthetic
tgactgagaagaccauccgacut

SEQ ID NO: 23886 - DNA, 26 bp, Artificial Sequence
  Synthetic
gagactguagaagagagagcaatugg

SEQ ID NO: 23887 - DNA, 19 bp, Artificial Sequence
  Synthetic
cttcattgutgcgggucgt

SEQ ID NO: 23888 - DNA, 24 bp, Artificial Sequence
  Synthetic
gtagccgcutgcatagttauagct

SEQ ID NO: 23889 - DNA, 28 bp, Artificial Sequence
  Synthetic
ctcgcttatctucagagtcttgtatucc

SEQ ID NO: 23890 - DNA, 22 bp, Artificial Sequence
  Synthetic
ccgcuccccttuagacaaagat

SEQ ID NO: 23891 - DNA, 23 bp, Artificial Sequence
  Synthetic
gguagtctctgtaucccaaagca

SEQ ID NO: 23892 - DNA, 28 bp, Artificial Sequence
  Synthetic
gctttggagtcaucacagaagtagauat

SEQ ID NO: 23893 - DNA, 31 bp, Artificial Sequence
  Synthetic
tgtagctttaccauaaccaattttgauagga

SEQ ID NO: 23894 - DNA, 23 bp, Artificial Sequence
  Synthetic
acatcgtuaccagcagcagtauc

SEQ ID NO: 23895 - DNA, 25 bp, Artificial Sequence
  Synthetic
cccaatcagagucaggataaagguc

SEQ ID NO: 23896 - DNA, 24 bp, Artificial Sequence
  Synthetic
gatcgtuacaacagcgacaaugat

SEQ ID NO: 23897 - DNA, 22 bp, Artificial Sequence
  Synthetic
ggtgctucctatctcgtucagc

SEQ ID NO: 23898 - DNA, 22 bp, Artificial Sequence
  Synthetic
ctcaagatcacucagcgtcucc

SEQ ID NO: 23899 - DNA, 24 bp, Artificial Sequence
  Synthetic
tgagtagaaguggcagtgtcugat

SEQ ID NO: 23900 - DNA, 24 bp, Artificial Sequence
  Synthetic
tgagaagagggccutaatgaccut

SEQ ID NO: 23901 - DNA, 27 bp, Artificial Sequence
  Synthetic
cactataaccacuataacagggucagc

SEQ ID NO: 23902 - DNA, 29 bp, Artificial Sequence
  Synthetic
tggatcacatcuctaccagagttaaucaa

SEQ ID NO: 23903 - DNA, 23 bp, Artificial Sequence
  Synthetic
tgugattugccaacaaggacagt

SEQ ID NO: 23904 - DNA, 27 bp, Artificial Sequence
  Synthetic
gtaaagatgauccgacaagugagagac

SEQ ID NO: 23905 - DNA, 21 bp, Artificial Sequence
  Synthetic
gggaaaagcgcacugacaauc

SEQ ID NO: 23906 - DNA, 22 bp, Artificial Sequence
  Synthetic
ggtcacauctgaccagucagaa

SEQ ID NO: 23907 - DNA, 24 bp, Artificial Sequence
  Synthetic
gttatgcttccucaaatgctgcug

SEQ ID NO: 23908 - DNA, 23 bp, Artificial Sequence
  Synthetic
ggatgagcuggaaagtcacaaug

SEQ ID NO: 23909 - DNA, 23 bp, Artificial Sequence
  Synthetic
atggaggtgaaugagacccagua

SEQ ID NO: 23910 - DNA, 22 bp, Artificial Sequence
  Synthetic
ggtgtcggaaacauacgtguga

SEQ ID NO: 23911 - DNA, 22 bp, Artificial Sequence
  Synthetic
agtaccatgccuactagccucc

SEQ ID NO: 23912 - DNA, 23 bp, Artificial Sequence
  Synthetic
agctguaaggagaaacgggaaug

SEQ ID NO: 23913 - DNA, 27 bp, Artificial Sequence
  Synthetic
gtcaataatguggaggcaactctttug

SEQ ID NO: 23914 - DNA, 29 bp, Artificial Sequence
  Synthetic
ttcaagtgactcutctcatgttcttuacc

SEQ ID NO: 23915 - DNA, 18 bp, Artificial Sequence
  Synthetic
cgctacucacgggcugat

SEQ ID NO: 23916 - DNA, 19 bp, Artificial Sequence
  Synthetic
cagcgauggtgtccuacgg

SEQ ID NO: 23917 - DNA, 25 bp, Artificial Sequence
  Synthetic
caccttctgautagcagtttcuggt

SEQ ID NO: 23918 - DNA, 20 bp, Artificial Sequence
  Synthetic
acgacgctugtgattgctug

SEQ ID NO: 23919 - DNA, 23 bp, Artificial Sequence
  Synthetic
cctctatctccutgctgttgcug

SEQ ID NO: 23920 - DNA, 26 bp, Artificial Sequence
  Synthetic
tgctatatgtcaaagugctaggctuc

SEQ ID NO: 23921 - DNA, 23 bp, Artificial Sequence
  Synthetic
gggaactcauggtgtaccccuat

SEQ ID NO: 23922 - DNA, 26 bp, Artificial Sequence
  Synthetic
acgagaaacugaagtgtgttagugac

SEQ ID NO: 23923 - DNA, 23 bp, Artificial Sequence
  Synthetic
cccacttcccugctgggattaua

SEQ ID NO: 23924 - DNA, 20 bp, Artificial Sequence
  Synthetic
ctacuggcacagcctgacuc

SEQ ID NO: 23925 - DNA, 28 bp, Artificial Sequence
  Synthetic
gccatttttattucctcactgattucca

SEQ ID NO: 23926 - DNA, 26 bp, Artificial Sequence
  Synthetic
acaggtagtcatuggtgagctgtaua

SEQ ID NO: 23927 - DNA, 23 bp, Artificial Sequence
  Synthetic
cattgccttaauggtggtcagug

SEQ ID NO: 23928 - DNA, 23 bp, Artificial Sequence
  Synthetic
gttgtacaatcucctgggagguc

SEQ ID NO: 23929 - DNA, 22 bp, Artificial Sequence
  Synthetic
cctgggctauactgggagcuac

SEQ ID NO: 23930 - DNA, 24 bp, Artificial Sequence
  Synthetic
ctgagtgaaugggaaggaagucaa

SEQ ID NO: 23931 - DNA, 22 bp, Artificial Sequence
  Synthetic
tgggtttcacuggatccttcug

SEQ ID NO: 23932 - DNA, 28 bp, Artificial Sequence
  Synthetic
ggagaaagtatucactccatccauacag

SEQ ID NO: 23933 - DNA, 22 bp, Artificial Sequence
  Synthetic
cccccagcaugacttagtucag

SEQ ID NO: 23934 - DNA, 22 bp, Artificial Sequence
  Synthetic
agcagcattcucacaagggtut

SEQ ID NO: 23935 - DNA, 26 bp, Artificial Sequence
  Synthetic
tcaggacttutgacttgaatucagag

SEQ ID NO: 23936 - DNA, 22 bp, Artificial Sequence
  Synthetic
ctccattcuggcatggatucga

SEQ ID NO: 23937 - DNA, 26 bp, Artificial Sequence
  Synthetic
cttcaccaagucctgtatttcacuct

SEQ ID NO: 23938 - DNA, 22 bp, Artificial Sequence
  Synthetic
ggccttgcaguaaaaggagcut

SEQ ID NO: 23939 - DNA, 22 bp, Artificial Sequence
  Synthetic
tccgttgggutttctctuccag

SEQ ID NO: 23940 - DNA, 24 bp, Artificial Sequence
  Synthetic
ggacagggacaaucaccctattut

SEQ ID NO: 23941 - DNA, 27 bp, Artificial Sequence
  Synthetic
tgccagattgauattgatgactgtucc

SEQ ID NO: 23942 - DNA, 23 bp, Artificial Sequence
  Synthetic
gaagttcagaacaguccctccuc

SEQ ID NO: 23943 - DNA, 21 bp, Artificial Sequence
  Synthetic
ggttaugcaggacctcgtugt

SEQ ID NO: 23944 - DNA, 25 bp, Artificial Sequence
  Synthetic
tgtttctagauccgtccttctgcua

SEQ ID NO: 23945 - DNA, 21 bp, Artificial Sequence
  Synthetic
gtgtatgtgucaacggcugga

SEQ ID NO: 23946 - DNA, 24 bp, Artificial Sequence
  Synthetic
ctccattcugacacctgtggtuag

SEQ ID NO: 23947 - DNA, 28 bp, Artificial Sequence
  Synthetic
catgaagcggguctattctaauaaccat

SEQ ID NO: 23948 - DNA, 22 bp, Artificial Sequence
  Synthetic
cattugcaggagaactggtugg

SEQ ID NO: 23949 - DNA, 22 bp, Artificial Sequence
  Synthetic
gggccatcucctatttctgugg

SEQ ID NO: 23950 - DNA, 25 bp, Artificial Sequence
  Synthetic
ctcgatgutgacaatatucccccaa

SEQ ID NO: 23951 - DNA, 25 bp, Artificial Sequence
  Synthetic
aatctcgugctttcttgatuggact

SEQ ID NO: 23952 - DNA, 19 bp, Artificial Sequence
  Synthetic
gcccgauactcaccaugcg

SEQ ID NO: 23953 - DNA, 19 bp, Artificial Sequence
  Synthetic
ccccuccccatgtggauct

SEQ ID NO: 23954 - DNA, 24 bp, Artificial Sequence
  Synthetic
cctgatcacutctcatcugaagca

SEQ ID NO: 23955 - DNA, 23 bp, Artificial Sequence
  Synthetic
gcacaacugagcatcugaagaac

SEQ ID NO: 23956 - DNA, 22 bp, Artificial Sequence
  Synthetic
gcacctaaagcutcaggtguga

SEQ ID NO: 23957 - DNA, 21 bp, Artificial Sequence
  Synthetic
gccatgtcautggccacatug

SEQ ID NO: 23958 - DNA, 19 bp, Artificial Sequence
  Synthetic
gtgctggcugggaagtuct

SEQ ID NO: 23959 - DNA, 18 bp, Artificial Sequence
  Synthetic
guggcagagguacgagct

SEQ ID NO: 23960 - DNA, 26 bp, Artificial Sequence
  Synthetic
cttgccaataucccttcctcttguaa

SEQ ID NO: 23961 - DNA, 23 bp, Artificial Sequence
  Synthetic
gcattucagggaggaacgtctut

SEQ ID NO: 23962 - DNA, 22 bp, Artificial Sequence
  Synthetic
ttgtcttcccugaggactcugt

SEQ ID NO: 23963 - DNA, 28 bp, Artificial Sequence
  Synthetic
tgagagataacgaaugggaaactttuga

SEQ ID NO: 23964 - DNA, 23 bp, Artificial Sequence
  Synthetic
ccagatacacuccctttcugagg

SEQ ID NO: 23965 - DNA, 21 bp, Artificial Sequence
  Synthetic
tggaagccgacucttccuact

SEQ ID NO: 23966 - DNA, 25 bp, Artificial Sequence
  Synthetic
cagagaaagaggagaugaagctuct

SEQ ID NO: 23967 - DNA, 23 bp, Artificial Sequence
  Synthetic
ccatcaucaaccagtgcatcuca

SEQ ID NO: 23968 - DNA, 18 bp, Artificial Sequence
  Synthetic
gugagggaccgagcaucc

SEQ ID NO: 23969 - DNA, 22 bp, Artificial Sequence
  Synthetic
ccttggctuacttggctttucc

SEQ ID NO: 23970 - DNA, 29 bp, Artificial Sequence
  Synthetic
agataacaaataccuctcccttctcguat

SEQ ID NO: 23971 - DNA, 24 bp, Artificial Sequence
  Synthetic
cagaagcccccauaactccauaag

SEQ ID NO: 23972 - DNA, 23 bp, Artificial Sequence
  Synthetic
gctgggccutcagatctttgaug

SEQ ID NO: 23973 - DNA, 18 bp, Artificial Sequence
  Synthetic
cugtgctcugagcaggga

SEQ ID NO: 23974 - DNA, 28 bp, Artificial Sequence
  Synthetic
cataactctgtattuctccagctcgtua

SEQ ID NO: 23975 - DNA, 21 bp, Artificial Sequence
  Synthetic
agtcagcguttagccuaccag

SEQ ID NO: 23976 - DNA, 29 bp, Artificial Sequence
  Synthetic
ctctggagtaaguttactattccctucct

SEQ ID NO: 23977 - DNA, 23 bp, Artificial Sequence
  Synthetic
ggtgatggtugagactgtgguaa

SEQ ID NO: 23978 - DNA, 21 bp, Artificial Sequence
  Synthetic
gggacacugaggagaatccug

SEQ ID NO: 23979 - DNA, 22 bp, Artificial Sequence
  Synthetic
tttttccccuccttctccgaug

SEQ ID NO: 23980 - DNA, 20 bp, Artificial Sequence
  Synthetic
ggaagucccagacccugaca

SEQ ID NO: 23981 - DNA, 28 bp, Artificial Sequence
  Synthetic
catctgtgaagggaaucacttttcttut

SEQ ID NO: 23982 - DNA, 22 bp, Artificial Sequence
  Synthetic
cttacctctcuggatgggcaug

SEQ ID NO: 23983 - DNA, 22 bp, Artificial Sequence
  Synthetic
tctcactgugccatttgcguat

SEQ ID NO: 23984 - DNA, 30 bp, Artificial Sequence
  Synthetic
gagatcttctttaauctgtatgttccuggt

SEQ ID NO: 23985 - DNA, 24 bp, Artificial Sequence
  Synthetic
acatggcagacautgtttcctcut

SEQ ID NO: 23986 - DNA, 30 bp, Artificial Sequence
  Synthetic
ctcaaatguaaaaaggaaatggaaucagca

SEQ ID NO: 23987 - DNA, 21 bp, Artificial Sequence
  Synthetic
gcccugcgccaatattuagga

SEQ ID NO: 23988 - DNA, 26 bp, Artificial Sequence
  Synthetic
cccaatcugaagagtcctaauccaag

SEQ ID NO: 23989 - DNA, 23 bp, Artificial Sequence
  Synthetic
gaaaccaaauttagccgtuggca

SEQ ID NO: 23990 - DNA, 26 bp, Artificial Sequence
  Synthetic
gaataatccauagcatagugggcgaa

SEQ ID NO: 23991 - DNA, 27 bp, Artificial Sequence
  Synthetic
cgagataacucagacaaaaccctugaa

SEQ ID NO: 23992 - DNA, 23 bp, Artificial Sequence
  Synthetic
gcaaagucagcattuagggcaat

SEQ ID NO: 23993 - DNA, 20 bp, Artificial Sequence
  Synthetic
gaagcuccagagggtgguac

SEQ ID NO: 23994 - DNA, 27 bp, Artificial Sequence
  Synthetic
gctagtcugacaatatccatttugaca

SEQ ID NO: 23995 - DNA, 29 bp, Artificial Sequence
  Synthetic
ctcaaaagcaagauggtacaatucagaac

SEQ ID NO: 23996 - DNA, 24 bp, Artificial Sequence
  Synthetic
cagaggccagcuagctataaucag

SEQ ID NO: 23997 - DNA, 25 bp, Artificial Sequence
  Synthetic
ccttaacagguctttgaaaccccut

SEQ ID NO: 23998 - DNA, 23 bp, Artificial Sequence
  Synthetic
ctcttccuccatgctttcuccat

SEQ ID NO: 23999 - DNA, 24 bp, Artificial Sequence
  Synthetic
gaagccattugtaaggtaccucga

SEQ ID NO: 24000 - DNA, 24 bp, Artificial Sequence
  Synthetic
ccgatacauactggcaaugcagaa

SEQ ID NO: 24001 - DNA, 24 bp, Artificial Sequence
  Synthetic
gtgtgcttucatgcttgaucgaat

SEQ ID NO: 24002 - DNA, 22 bp, Artificial Sequence
  Synthetic
gtgcttcuggatgtacugacca

SEQ ID NO: 24003 - DNA, 28 bp, Artificial Sequence
  Synthetic
ccttacttutcctttgctucaggagaat

SEQ ID NO: 24004 - DNA, 22 bp, Artificial Sequence
  Synthetic
gctctccacutcaacctucagc

SEQ ID NO: 24005 - DNA, 20 bp, Artificial Sequence
  Synthetic
ggugagaggctguggaccaa

SEQ ID NO: 24006 - DNA, 26 bp, Artificial Sequence
  Synthetic
ggcatcactatuccatagtactgcut

SEQ ID NO: 24007 - DNA, 24 bp, Artificial Sequence
  Synthetic
gatcuggagaagtggugaaaaggt

SEQ ID NO: 24008 - DNA, 20 bp, Artificial Sequence
  Synthetic
gcagctgcutcttcctccuc

SEQ ID NO: 24009 - DNA, 18 bp, Artificial Sequence
  Synthetic
gactttggcugctgcugt

SEQ ID NO: 24010 - DNA, 25 bp, Artificial Sequence
  Synthetic
ctcctctttggugcatttcagttua

SEQ ID NO: 24011 - DNA, 25 bp, Artificial Sequence
  Synthetic
gatgtaatagcucacttctguggct

SEQ ID NO: 24012 - DNA, 23 bp, Artificial Sequence
  Synthetic
agccccacuctactgtcagauag

SEQ ID NO: 24013 - DNA, 26 bp, Artificial Sequence
  Synthetic
atctgcttcugaaactcttcactcug

SEQ ID NO: 24014 - DNA, 21 bp, Artificial Sequence
  Synthetic
gcctgagccucaagagactug

SEQ ID NO: 24015 - DNA, 29 bp, Artificial Sequence
  Synthetic
tctctacatataggutcaattcacgtcua

SEQ ID NO: 24016 - DNA, 24 bp, Artificial Sequence
  Synthetic
ctgcaatgugcttagcttcttuga

SEQ ID NO: 24017 - DNA, 22 bp, Artificial Sequence
  Synthetic
cagttcugagacccttggagug

SEQ ID NO: 24018 - DNA, 20 bp, Artificial Sequence
  Synthetic
agaacctggaucttgcgcut

SEQ ID NO: 24019 - DNA, 18 bp, Artificial Sequence
  Synthetic
ggcgggutggtgagtucc

SEQ ID NO: 24020 - DNA, 27 bp, Artificial Sequence
  Synthetic
ttcagcatctgcauctttttcttgaug

SEQ ID NO: 24021 - DNA, 25 bp, Artificial Sequence
  Synthetic
ggtggagcuatgagcacagauaaag

SEQ ID NO: 24022 - DNA, 21 bp, Artificial Sequence
  Synthetic
ctcaatcugccccctccaaut

SEQ ID NO: 24023 - DNA, 21 bp, Artificial Sequence
  Synthetic
ctccuacagccgacucaaacc

SEQ ID NO: 24024 - DNA, 23 bp, Artificial Sequence
  Synthetic
cctgatacuaagcccuccagact

SEQ ID NO: 24025 - DNA, 22 bp, Artificial Sequence
  Synthetic
cgtcttcttccugcgtgatcug

SEQ ID NO: 24026 - DNA, 23 bp, Artificial Sequence
  Synthetic
gccctcagutggtgtgttttuct

SEQ ID NO: 24027 - DNA, 28 bp, Artificial Sequence
  Synthetic
tcaaagatggucacttgtgctttctuaa

SEQ ID NO: 24028 - DNA, 23 bp, Artificial Sequence
  Synthetic
ggacagcguttctcagaatucca

SEQ ID NO: 24029 - DNA, 22 bp, Artificial Sequence
  Synthetic
ctgggagcaaucagtuccagag

SEQ ID NO: 24030 - DNA, 17 bp, Artificial Sequence
  Synthetic
cagcutggcuggcacag

SEQ ID NO: 24031 - DNA, 18 bp, Artificial Sequence
  Synthetic
gcaggtgguggaggcuat

SEQ ID NO: 24032 - DNA, 19 bp, Artificial Sequence
  Synthetic
agtgaggucgggtcacuca

SEQ ID NO: 24033 - DNA, 21 bp, Artificial Sequence
  Synthetic
acacacacacutggtgctcut

SEQ ID NO: 24034 - DNA, 20 bp, Artificial Sequence
  Synthetic
ccaagcuggctaaagcucct

SEQ ID NO: 24035 - DNA, 19 bp, Artificial Sequence
  Synthetic
cccagcacgucacgttcut

SEQ ID NO: 24036 - DNA, 25 bp, Artificial Sequence
  Synthetic
cttcatctucactgagttccuggag

SEQ ID NO: 24037 - DNA, 20 bp, Artificial Sequence
  Synthetic
tccaugaaggcagccaugat

SEQ ID NO: 24038 - DNA, 20 bp, Artificial Sequence
  Synthetic
gcggctgugtctcctctcua

SEQ ID NO: 24039 - DNA, 20 bp, Artificial Sequence
  Synthetic
ctcgatgaugtggcctugga

SEQ ID NO: 24040 - DNA, 17 bp, Artificial Sequence
  Synthetic
gtcccugccgctuccat

SEQ ID NO: 24041 - DNA, 24 bp, Artificial Sequence
  Synthetic
gccgcatauactcaaagaccauga

SEQ ID NO: 24042 - DNA, 18 bp, Artificial Sequence
  Synthetic
gtgtaccuggcgggtcug

SEQ ID NO: 24043 - DNA, 26 bp, Artificial Sequence
  Synthetic
acggtaatagucggtgctgtagauat

SEQ ID NO: 24044 - DNA, 17 bp, Artificial Sequence
  Synthetic
gguggccccaggcaauc

SEQ ID NO: 24045 - DNA, 20 bp, Artificial Sequence
  Synthetic
gtgcacauccttgatgcugt

SEQ ID NO: 24046 - DNA, 24 bp, Artificial Sequence
  Synthetic
gagatggagcggutctggaauaag

SEQ ID NO: 24047 - DNA, 25 bp, Artificial Sequence
  Synthetic
caaccttcagaacuttcacccacua

SEQ ID NO: 24048 - DNA, 21 bp, Artificial Sequence
  Synthetic
ttgtgaaguccctgtgtcugg

SEQ ID NO: 24049 - DNA, 24 bp, Artificial Sequence
  Synthetic
cccactcccutcacagagaaaaug

SEQ ID NO: 24050 - DNA, 27 bp, Artificial Sequence
  Synthetic
tcacccatcttuctgtttgtcattcut

SEQ ID NO: 24051 - DNA, 27 bp, Artificial Sequence
  Synthetic
cccttttccacuattatggtcuaccag

SEQ ID NO: 24052 - DNA, 23 bp, Artificial Sequence
  Synthetic
tcggcagttugatcttgagaguc

SEQ ID NO: 24053 - DNA, 28 bp, Artificial Sequence
  Synthetic
ggccaaagaaaaugctaaaatgtuggaa

SEQ ID NO: 24054 - DNA, 20 bp, Artificial Sequence
  Synthetic
ggaccctcaaugacggtgut

SEQ ID NO: 24055 - DNA, 21 bp, Artificial Sequence
  Synthetic
ctgaactugcggtggatgaug

SEQ ID NO: 24056 - DNA, 26 bp, Artificial Sequence
  Synthetic
tcttctgcaaugtttctgaaggauga

SEQ ID NO: 24057 - DNA, 28 bp, Artificial Sequence
  Synthetic
tggcttcctctugaaatttacctatgut

SEQ ID NO: 24058 - DNA, 21 bp, Artificial Sequence
  Synthetic
ctgcctgaugatgatcugcct

SEQ ID NO: 24059 - DNA, 22 bp, Artificial Sequence
  Synthetic
gctgcgaguccatcactgtauc

SEQ ID NO: 24060 - DNA, 20 bp, Artificial Sequence
  Synthetic
cccccuctttctuccccact

SEQ ID NO: 24061 - DNA, 17 bp, Artificial Sequence
  Synthetic
tgccgcuccagaacgug

SEQ ID NO: 24062 - DNA, 23 bp, Artificial Sequence
  Synthetic
tgtcttugagcggacacactauc

SEQ ID NO: 24063 - DNA, 29 bp, Artificial Sequence
  Synthetic
gtttttaaacagutttcagagatgugcct

SEQ ID NO: 24064 - DNA, 22 bp, Artificial Sequence
  Synthetic
cacagactugcagctttgugaa

SEQ ID NO: 24065 - DNA, 21 bp, Artificial Sequence
  Synthetic
ttggcctucagtctcaggtug

SEQ ID NO: 24066 - DNA, 22 bp, Artificial Sequence
  Synthetic
tgtgcuggaagttttcuacgct

SEQ ID NO: 24067 - DNA, 20 bp, Artificial Sequence
  Synthetic
tggccccauccctgtttaug

SEQ ID NO: 24068 - DNA, 18 bp, Artificial Sequence
  Synthetic
cuccacccacuggccaat

SEQ ID NO: 24069 - DNA, 19 bp, Artificial Sequence
  Synthetic
catgcctgucccacagugt

SEQ ID NO: 24070 - DNA, 19 bp, Artificial Sequence
  Synthetic
cgcccacgaaauccgtgua

SEQ ID NO: 24071 - DNA, 19 bp, Artificial Sequence
  Synthetic
cttggcttuccggaaccug

SEQ ID NO: 24072 - DNA, 21 bp, Artificial Sequence
  Synthetic
gcccccaagacugatcaugaa

SEQ ID NO: 24073 - DNA, 19 bp, Artificial Sequence
  Synthetic
gctggcacugctcatccug

SEQ ID NO: 24074 - DNA, 20 bp, Artificial Sequence
  Synthetic
caccuccaggccaaaggtua

SEQ ID NO: 24075 - DNA, 19 bp, Artificial Sequence
  Synthetic
ttctggagugccugaacgg

SEQ ID NO: 24076 - DNA, 28 bp, Artificial Sequence
  Synthetic
ttgaaatttgguggatctatgtctucgt

SEQ ID NO: 24077 - DNA, 27 bp, Artificial Sequence
  Synthetic
tccttgactacutgatgagatgtcuga

SEQ ID NO: 24078 - DNA, 28 bp, Artificial Sequence
  Synthetic
agcagatggcutaaagtacatctttugt

SEQ ID NO: 24079 - DNA, 26 bp, Artificial Sequence
  Synthetic
ggtgaattagcaucctgcagtuaaag

SEQ ID NO: 24080 - DNA, 20 bp, Artificial Sequence
  Synthetic
acctcggccuccagctatua

SEQ ID NO: 24081 - DNA, 31 bp, Artificial Sequence
  Synthetic
ctggatataattagutttaagggcagaguca

SEQ ID NO: 24082 - DNA, 30 bp, Artificial Sequence
  Synthetic
caacctttcatcaugggaattcatatcauc

SEQ ID NO: 24083 - DNA, 25 bp, Artificial Sequence
  Synthetic
agaatttctgcuttctagccaucaa

SEQ ID NO: 24084 - DNA, 22 bp, Artificial Sequence
  Synthetic
gcacagutcatgtcuccaagga

SEQ ID NO: 24085 - DNA, 31 bp, Artificial Sequence
  Synthetic
gttactgggatgtutgaataagatcggtuat

SEQ ID NO: 24086 - DNA, 26 bp, Artificial Sequence
  Synthetic
tgacagacttucagatggagacagua

SEQ ID NO: 24087 - DNA, 22 bp, Artificial Sequence
  Synthetic
gagtuagcagaggcagagtugg

SEQ ID NO: 24088 - DNA, 25 bp, Artificial Sequence
  Synthetic
agcctggaugatgtaaaggugaaag

SEQ ID NO: 24089 - DNA, 27 bp, Artificial Sequence
  Synthetic
actaagaaugaccattctgugaagcaa

SEQ ID NO: 24090 - DNA, 26 bp, Artificial Sequence
  Synthetic
ggcgatcagautccatggacaaauaa

SEQ ID NO: 24091 - DNA, 28 bp, Artificial Sequence
  Synthetic
cacaaaataccacugtagactgaaaugt

SEQ ID NO: 24092 - DNA, 30 bp, Artificial Sequence
  Synthetic
atgtatuatcagagagattuccaccacaac

SEQ ID NO: 24093 - DNA, 22 bp, Artificial Sequence
  Synthetic
cctuggaaagggcuagggagat

SEQ ID NO: 24094 - DNA, 23 bp, Artificial Sequence
  Synthetic
ctgctcctgutggcatcaataug

SEQ ID NO: 24095 - DNA, 24 bp, Artificial Sequence
  Synthetic
agatcagcucacagaccattucaa

SEQ ID NO: 24096 - DNA, 22 bp, Artificial Sequence
  Synthetic
ttcuaccagcccgtttucacaa

SEQ ID NO: 24097 - DNA, 21 bp, Artificial Sequence
  Synthetic
ccttccuacctgctccuggat

SEQ ID NO: 24098 - DNA, 28 bp, Artificial Sequence
  Synthetic
tcatgatcagtggaugtaatctggatug

SEQ ID NO: 24099 - DNA, 23 bp, Artificial Sequence
  Synthetic
ggccatcatugggttcatgtuct

SEQ ID NO: 24100 - DNA, 23 bp, Artificial Sequence
  Synthetic
gtgtgaacttuccagaacccuga

SEQ ID NO: 24101 - DNA, 26 bp, Artificial Sequence
  Synthetic
gggtactactugaagtggaaacucac

SEQ ID NO: 24102 - DNA, 25 bp, Artificial Sequence
  Synthetic
tccttcagcagcuactgactgaaua

SEQ ID NO: 24103 - DNA, 21 bp, Artificial Sequence
  Synthetic
tgctccaaaugctacgaccug

SEQ ID NO: 24104 - DNA, 20 bp, Artificial Sequence
  Synthetic
actcagcaagcuggagtugg

SEQ ID NO: 24105 - DNA, 21 bp, Artificial Sequence
  Synthetic
gcattgaugcccttcaccuca

SEQ ID NO: 24106 - DNA, 18 bp, Artificial Sequence
  Synthetic
ccacaccutccgccugac

SEQ ID NO: 24107 - DNA, 19 bp, Artificial Sequence
  Synthetic
cccugacccctuccaacac

SEQ ID NO: 24108 - DNA, 21 bp, Artificial Sequence
  Synthetic
gctgctcugtgagtcaaugct

SEQ ID NO: 24109 - DNA, 21 bp, Artificial Sequence
  Synthetic
gtgagucagcttggagucagt

SEQ ID NO: 24110 - DNA, 23 bp, Artificial Sequence
  Synthetic
accagaggcugctttctctctua

SEQ ID NO: 24111 - DNA, 22 bp, Artificial Sequence
  Synthetic
caaggtgguggagaagatuggg

SEQ ID NO: 24112 - DNA, 20 bp, Artificial Sequence
  Synthetic
ctgaccacaccgcgutctua

SEQ ID NO: 24113 - DNA, 21 bp, Artificial Sequence
  Synthetic
catcgcatcucatgccctuct

SEQ ID NO: 24114 - DNA, 30 bp, Artificial Sequence
  Synthetic
tgtcattttctccuttttctttgagcaaut

SEQ ID NO: 24115 - DNA, 28 bp, Artificial Sequence
  Synthetic
gctcaacttgcautaattcgggatauac

SEQ ID NO: 24116 - DNA, 24 bp, Artificial Sequence
  Synthetic
ggtgacaagggutgtaccataucc

SEQ ID NO: 24117 - DNA, 21 bp, Artificial Sequence
  Synthetic
ggcaucaccagaacacucagt

SEQ ID NO: 24118 - DNA, 22 bp, Artificial Sequence
  Synthetic
agaggatgcugctgaaggaauc

SEQ ID NO: 24119 - DNA, 26 bp, Artificial Sequence
  Synthetic
gaaaatgacaagcuggttgagacuac

SEQ ID NO: 24120 - DNA, 22 bp, Artificial Sequence
  Synthetic
gatgugaccgggaataucagga

SEQ ID NO: 24121 - DNA, 23 bp, Artificial Sequence
  Synthetic
cagaactgcagcugattccatut

SEQ ID NO: 24122 - DNA, 26 bp, Artificial Sequence
  Synthetic
attgggagaaatucacctgtctctuc

SEQ ID NO: 24123 - DNA, 28 bp, Artificial Sequence
  Synthetic
ggagtaagucgagaagtatttgactuca

SEQ ID NO: 24124 - DNA, 28 bp, Artificial Sequence
  Synthetic
tcctttcaagttcucagatcatcactuc

SEQ ID NO: 24125 - DNA, 22 bp, Artificial Sequence
  Synthetic
aacatgtguccagaccctttuc

SEQ ID NO: 24126 - DNA, 26 bp, Artificial Sequence
  Synthetic
gccacatacttuctcagaaacctuca

SEQ ID NO: 24127 - DNA, 23 bp, Artificial Sequence
  Synthetic
cuagcctttaucaggaccaagcc

SEQ ID NO: 24128 - DNA, 26 bp, Artificial Sequence
  Synthetic
agtatcagaucacaagatggctcuca

SEQ ID NO: 24129 - DNA, 30 bp, Artificial Sequence
  Synthetic
aaatatgtgaacagcutcatgagtaaauca

SEQ ID NO: 24130 - DNA, 30 bp, Artificial Sequence
  Synthetic
cgacatcattacaauctgaaatgccuaaag

SEQ ID NO: 24131 - DNA, 30 bp, Artificial Sequence
  Synthetic
tgtaataatacttggcutttatctggtgut

SEQ ID NO: 24132 - DNA, 27 bp, Artificial Sequence
  Synthetic
caccagataaguattggtgacttuggt

SEQ ID NO: 24133 - DNA, 24 bp, Artificial Sequence
  Synthetic
ccgtctgagagutctcccatgaua

SEQ ID NO: 24134 - DNA, 29 bp, Artificial Sequence
  Synthetic
aacctgtgaaaautttagtgccugaaaaa

SEQ ID NO: 24135 - DNA, 30 bp, Artificial Sequence
  Synthetic
agtaaatcauaagctgtaactttuccagat

SEQ ID NO: 24136 - DNA, 27 bp, Artificial Sequence
  Synthetic
tcacaaatgucactaaaagauggcaga

SEQ ID NO: 24137 - DNA, 25 bp, Artificial Sequence
  Synthetic
tttgggacugaaggagttcaucaag

SEQ ID NO: 24138 - DNA, 28 bp, Artificial Sequence
  Synthetic
aagccctgctauttaaaagacttctuga

SEQ ID NO: 24139 - DNA, 23 bp, Artificial Sequence
  Synthetic
cattcccaaccutctacctucga

SEQ ID NO: 24140 - DNA, 32 bp, Artificial Sequence
  Synthetic
gaaaattacttggaaauagaaggaatggcuaa

SEQ ID NO: 24141 - DNA, 28 bp, Artificial Sequence
  Synthetic
ctttgcgagguctacattcataaactuc

SEQ ID NO: 24142 - DNA, 25 bp, Artificial Sequence
  Synthetic
gugaaaaagaggaaaagguaaggug

SEQ ID NO: 24143 - DNA, 23 bp, Artificial Sequence
  Synthetic
tccaacacguggtactttuccat

SEQ ID NO: 24144 - DNA, 24 bp, Artificial Sequence
  Synthetic
atttcccaaccucagaatgcauga

SEQ ID NO: 24145 - DNA, 25 bp, Artificial Sequence
  Synthetic
gagaagtugaaggcagaaagcauac

SEQ ID NO: 24146 - DNA, 22 bp, Artificial Sequence
  Synthetic
cugacatccaucaaaggcacac

SEQ ID NO: 24147 - DNA, 22 bp, Artificial Sequence
  Synthetic
gctgaccagcugaaagatgcut

SEQ ID NO: 24148 - DNA, 21 bp, Artificial Sequence
  Synthetic
ctacccccagaacutcagguc

SEQ ID NO: 24149 - DNA, 23 bp, Artificial Sequence
  Synthetic
cagtcacuagcctggtcattuca

SEQ ID NO: 24150 - DNA, 27 bp, Artificial Sequence
  Synthetic
gggatctacuaccttagactuacacac

SEQ ID NO: 24151 - DNA, 24 bp, Artificial Sequence
  Synthetic
gcagaagucaggatuacacagcaa

SEQ ID NO: 24152 - DNA, 24 bp, Artificial Sequence
  Synthetic
ccttcacatugcccttactctcut

SEQ ID NO: 24153 - DNA, 28 bp, Artificial Sequence
  Synthetic
aacaatgcaaaagcacutcttatccuac

SEQ ID NO: 24154 - DNA, 22 bp, Artificial Sequence
  Synthetic
ccttttacuccagcttgcugac

SEQ ID NO: 24155 - DNA, 23 bp, Artificial Sequence
  Synthetic
gagcctgaccuatgcaacaagua

SEQ ID NO: 24156 - DNA, 22 bp, Artificial Sequence
  Synthetic
cagactcctuccttctcccuca

SEQ ID NO: 24157 - DNA, 20 bp, Artificial Sequence
  Synthetic
caaccuctggcugagacagt

SEQ ID NO: 24158 - DNA, 22 bp, Artificial Sequence
  Synthetic
gtctatugggacagcttgguca

SEQ ID NO: 24159 - DNA, 24 bp, Artificial Sequence
  Synthetic
cagtcctagugtctgacucagaga

SEQ ID NO: 24160 - DNA, 23 bp, Artificial Sequence
  Synthetic
cctgttccatugggtctccatut

SEQ ID NO: 24161 - DNA, 22 bp, Artificial Sequence
  Synthetic
caaagcagaugcttcaggaugg

SEQ ID NO: 24162 - DNA, 27 bp, Artificial Sequence
  Synthetic
tgaatccttttaccucctgttctcuca

SEQ ID NO: 24163 - DNA, 23 bp, Artificial Sequence
  Synthetic
gaaacgagacgauggttcuaggg

SEQ ID NO: 24164 - DNA, 21 bp, Artificial Sequence
  Synthetic
gctuggagacaaggatccugt

SEQ ID NO: 24165 - DNA, 19 bp, Artificial Sequence
  Synthetic
caacatugcgccggauacc

SEQ ID NO: 24166 - DNA, 21 bp, Artificial Sequence
  Synthetic
gggaaucagtcacugccacac

SEQ ID NO: 24167 - DNA, 26 bp, Artificial Sequence
  Synthetic
agaauaagaaagagcuggcaaccaaa

SEQ ID NO: 24168 - DNA, 25 bp, Artificial Sequence
  Synthetic
tgtcgaacgugttcaaaaggattug

SEQ ID NO: 24169 - DNA, 21 bp, Artificial Sequence
  Synthetic
ccctgttuctggtctucgcag

SEQ ID NO: 24170 - DNA, 22 bp, Artificial Sequence
  Synthetic
tgctataggugggtggacagua

SEQ ID NO: 24171 - DNA, 20 bp, Artificial Sequence
  Synthetic
ccagactgautacgcgcuct

SEQ ID NO: 24172 - DNA, 22 bp, Artificial Sequence
  Synthetic
gctttggtguacagtgctugga

SEQ ID NO: 24173 - DNA, 22 bp, Artificial Sequence
  Synthetic
ggtggcugatgaactttugcac

SEQ ID NO: 24174 - DNA, 21 bp, Artificial Sequence
  Synthetic
gggccagtucctccctaguat

SEQ ID NO: 24175 - DNA, 28 bp, Artificial Sequence
  Synthetic
accagauttaccacuaaagaggaaacag

SEQ ID NO: 24176 - DNA, 27 bp, Artificial Sequence
  Synthetic
atgtttgtttugattcctagtguccct

SEQ ID NO: 24177 - DNA, 17 bp, Artificial Sequence
  Synthetic
gcgcacutgctggguga

SEQ ID NO: 24178 - DNA, 21 bp, Artificial Sequence
  Synthetic
gcacggugtttcgaucacaga

SEQ ID NO: 24179 - DNA, 21 bp, Artificial Sequence
  Synthetic
tgcccgccugttctctuaaag

SEQ ID NO: 24180 - DNA, 18 bp, Artificial Sequence
  Synthetic
cgctgaggcccuccctua

SEQ ID NO: 24181 - DNA, 25 bp, Artificial Sequence
  Synthetic
tggatataattuccgagcgaagcug

SEQ ID NO: 24182 - DNA, 17 bp, Artificial Sequence
  Synthetic
cggacagggcuggctug

SEQ ID NO: 24183 - DNA, 18 bp, Artificial Sequence
  Synthetic
cccuggagccccugaaga

SEQ ID NO: 24184 - DNA, 18 bp, Artificial Sequence
  Synthetic
ctgctgugcctgguggaa

SEQ ID NO: 24185 - DNA, 20 bp, Artificial Sequence
  Synthetic
cccacaaaaucccccucacc

SEQ ID NO: 24186 - DNA, 24 bp, Artificial Sequence
  Synthetic
cttcacagaautctcgacuccact

SEQ ID NO: 24187 - DNA, 18 bp, Artificial Sequence
  Synthetic
gtccccgcgugagctauc

SEQ ID NO: 24188 - DNA, 26 bp, Artificial Sequence
  Synthetic
gcatttttcauacacaggtccctcua

SEQ ID NO: 24189 - DNA, 19 bp, Artificial Sequence
  Synthetic
ccatctgcutcgggccuac

SEQ ID NO: 24190 - DNA, 25 bp, Artificial Sequence
  Synthetic
ttttccagtccucggaaatacagut

SEQ ID NO: 24191 - DNA, 23 bp, Artificial Sequence
  Synthetic
ctgactccutcccaagcugaaat

SEQ ID NO: 24192 - DNA, 21 bp, Artificial Sequence
  Synthetic
ggacagaggcugccatuacat

SEQ ID NO: 24193 - DNA, 27 bp, Artificial Sequence
  Synthetic
ctaaaccacagaaaaugaggagaccua

SEQ ID NO: 24194 - DNA, 21 bp, Artificial Sequence
  Synthetic
gactugacggactctgucgat

SEQ ID NO: 24195 - DNA, 25 bp, Artificial Sequence
  Synthetic
tttttgtcaauctgctgtgttuccc

SEQ ID NO: 24196 - DNA, 22 bp, Artificial Sequence
  Synthetic
caggttguccactgcattcuca

SEQ ID NO: 24197 - DNA, 21 bp, Artificial Sequence
  Synthetic
tggctgucacccataacctuc

SEQ ID NO: 24198 - DNA, 21 bp, Artificial Sequence
  Synthetic
gttcatgcugaggtctccuga

SEQ ID NO: 24199 - DNA, 22 bp, Artificial Sequence
  Synthetic
gctgctgatutcccctactugt

SEQ ID NO: 24200 - DNA, 21 bp, Artificial Sequence
  Synthetic
gtgcacccauacccaactuct

SEQ ID NO: 24201 - DNA, 25 bp, Artificial Sequence
  Synthetic
gcttcaagaccuccaggagttttuc

SEQ ID NO: 24202 - DNA, 17 bp, Artificial Sequence
  Synthetic
gtgugggcgaggcctua

SEQ ID NO: 24203 - DNA, 18 bp, Artificial Sequence
  Synthetic
agtacgaugccccaugcg

SEQ ID NO: 24204 - DNA, 22 bp, Artificial Sequence
  Synthetic
gagtggtguactagcggaucaa

SEQ ID NO: 24205 - DNA, 24 bp, Artificial Sequence
  Synthetic
cagttgagccaggguaacatcuag

SEQ ID NO: 24206 - DNA, 20 bp, Artificial Sequence
  Synthetic
cttttggaccucggctcauc

SEQ ID NO: 24207 - DNA, 27 bp, Artificial Sequence
  Synthetic
gggagaaaugaacagatctugaaagct

SEQ ID NO: 24208 - DNA, 23 bp, Artificial Sequence
  Synthetic
tggatgtccauatgtggcacaut

SEQ ID NO: 24209 - DNA, 26 bp, Artificial Sequence
  Synthetic
agagagagagaaguttctaccauccc

SEQ ID NO: 24210 - DNA, 21 bp, Artificial Sequence
  Synthetic
actagtcucaccagcccugac

SEQ ID NO: 24211 - DNA, 20 bp, Artificial Sequence
  Synthetic
tggaacccuttctgcgctut

SEQ ID NO: 24212 - DNA, 21 bp, Artificial Sequence
  Synthetic
tgugcaggacagcaatcucat

SEQ ID NO: 24213 - DNA, 22 bp, Artificial Sequence
  Synthetic
tgtgaatccccuctcccgauag

SEQ ID NO: 24214 - DNA, 25 bp, Artificial Sequence
  Synthetic
tgaaactctgugagattgctgtgut

SEQ ID NO: 24215 - DNA, 24 bp, Artificial Sequence
  Synthetic
gtggtcttccautacggagagauc

SEQ ID NO: 24216 - DNA, 26 bp, Artificial Sequence
  Synthetic
agactcagcuctacaataagccucat

SEQ ID NO: 24217 - DNA, 28 bp, Artificial Sequence
  Synthetic
ttttaattaccutgcatcctucacaagc

SEQ ID NO: 24218 - DNA, 23 bp, Artificial Sequence
  Synthetic
gagatcuccagtgataucgacca

SEQ ID NO: 24219 - DNA, 27 bp, Artificial Sequence
  Synthetic
tttgtctgtugtctttcctgucaagat

SEQ ID NO: 24220 - DNA, 18 bp, Artificial Sequence
  Synthetic
tcagggcugccagttucg

SEQ ID NO: 24221 - DNA, 21 bp, Artificial Sequence
  Synthetic
tcaucaaggaggccagcatug

SEQ ID NO: 24222 - DNA, 22 bp, Artificial Sequence
  Synthetic
cctgagtccucacagctgttug

SEQ ID NO: 24223 - DNA, 28 bp, Artificial Sequence
  Synthetic
gctagtacaaguccttgtagatctccug

SEQ ID NO: 24224 - DNA, 26 bp, Artificial Sequence
  Synthetic
tgtactcctuggttttgtgttucaca

SEQ ID NO: 24225 - DNA, 28 bp, Artificial Sequence
  Synthetic
cccctcatataauttctgctctgatugg

SEQ ID NO: 24226 - DNA, 19 bp, Artificial Sequence
  Synthetic
cgcccauacagctcctcut

SEQ ID NO: 24227 - DNA, 29 bp, Artificial Sequence
  Synthetic
tggttgtgacaaauaatctcttggatcug

SEQ ID NO: 24228 - DNA, 27 bp, Artificial Sequence
  Synthetic
ttaacuaacatcccaugaacagaccat

SEQ ID NO: 24229 - DNA, 29 bp, Artificial Sequence
  Synthetic
gcacagtcucaagcaaccatatattauca

SEQ ID NO: 24230 - DNA, 23 bp, Artificial Sequence
  Synthetic
ggttcugtagaatgucccaccaa

SEQ ID NO: 24231 - DNA, 22 bp, Artificial Sequence
  Synthetic
cgcatcatcccuttgctggtua

SEQ ID NO: 24232 - DNA, 29 bp, Artificial Sequence
  Synthetic
gagcttcttcgtutccttttctctttaut

SEQ ID NO: 24233 - DNA, 22 bp, Artificial Sequence
  Synthetic
ccacccutttccctuagcaact

SEQ ID NO: 24234 - DNA, 22 bp, Artificial Sequence
  Synthetic
gttttgtgccgutgctctctut

SEQ ID NO: 24235 - DNA, 25 bp, Artificial Sequence
  Synthetic
guagaggaagaggaagaatugcagt

SEQ ID NO: 24236 - DNA, 27 bp, Artificial Sequence
  Synthetic
ctagaatacccauctccttcacucaac

SEQ ID NO: 24237 - DNA, 22 bp, Artificial Sequence
  Synthetic
agacttuggaacactugcccat

SEQ ID NO: 24238 - DNA, 28 bp, Artificial Sequence
  Synthetic
atgcaaacttacugaatccttctuacga

SEQ ID NO: 24239 - DNA, 28 bp, Artificial Sequence
  Synthetic
tgacttcttucctatgctcttugaacag

SEQ ID NO: 24240 - DNA, 22 bp, Artificial Sequence
  Synthetic
gcatactcctucactcgagcut

SEQ ID NO: 24241 - DNA, 23 bp, Artificial Sequence
  Synthetic
tgttttcccuactgctccuaggt

SEQ ID NO: 24242 - DNA, 27 bp, Artificial Sequence
  Synthetic
agatcaaaguaacatggcatttuccct

SEQ ID NO: 24243 - DNA, 24 bp, Artificial Sequence
  Synthetic
ggugagctucaggacagaaagaaa

SEQ ID NO: 24244 - DNA, 26 bp, Artificial Sequence
  Synthetic
ctgttgatcccaautctcctcttcut

SEQ ID NO: 24245 - DNA, 21 bp, Artificial Sequence
  Synthetic
gcagaacaguatggugggaca

SEQ ID NO: 24246 - DNA, 25 bp, Artificial Sequence
  Synthetic
gaaggtatttuggctttcacggtut

SEQ ID NO: 24247 - DNA, 26 bp, Artificial Sequence
  Synthetic
tccggaaattucttttacacagucca

SEQ ID NO: 24248 - DNA, 24 bp, Artificial Sequence
  Synthetic
gagacggttucttggaatacugct

SEQ ID NO: 24249 - DNA, 28 bp, Artificial Sequence
  Synthetic
aagacagtgatggugtaacttatgcaut

SEQ ID NO: 24250 - DNA, 27 bp, Artificial Sequence
  Synthetic
cctgcatgcttuaaaaactctgaacut

SEQ ID NO: 24251 - DNA, 27 bp, Artificial Sequence
  Synthetic
gagttcaggtautgcttcatctctuca

SEQ ID NO: 24252 - DNA, 27 bp, Artificial Sequence
  Synthetic
gggttgctatcgutcaaagtacaguat

SEQ ID NO: 24253 - DNA, 23 bp, Artificial Sequence
  Synthetic
gagaaacagaaccuctggtguca

SEQ ID NO: 24254 - DNA, 28 bp, Artificial Sequence
  Synthetic
ctacctttugaacaaggtgtctguaaac

SEQ ID NO: 24255 - DNA, 27 bp, Artificial Sequence
  Synthetic
tgacagtagtgcutcccgttataaauc

SEQ ID NO: 24256 - DNA, 28 bp, Artificial Sequence
  Synthetic
aggtacgcctugagtatgtcttcttaua

SEQ ID NO: 24257 - DNA, 26 bp, Artificial Sequence
  Synthetic
ctattccaggucagaacgatctcaut

SEQ ID NO: 24258 - DNA, 27 bp, Artificial Sequence
  Synthetic
agaagtccguacagaatcttcaucaga

SEQ ID NO: 24259 - DNA, 28 bp, Artificial Sequence
  Synthetic
gggaaggaugaagaaattccagatagut

SEQ ID NO: 24260 - DNA, 28 bp, Artificial Sequence
  Synthetic
ggttctttcagagauctaactgcuacat

SEQ ID NO: 24261 - DNA, 22 bp, Artificial Sequence
  Synthetic
caagccacaacacuctcaucac

SEQ ID NO: 24262 - DNA, 28 bp, Artificial Sequence
  Synthetic
ggtttggagtaucactttgcttttcaut

SEQ ID NO: 24263 - DNA, 25 bp, Artificial Sequence
  Synthetic
cttcuagtcgattttugcccaaagg

SEQ ID NO: 24264 - DNA, 20 bp, Artificial Sequence
  Synthetic
cctccucattcaggaugcgt

SEQ ID NO: 24265 - DNA, 17 bp, Artificial Sequence
  Synthetic
gctggccugctctuccc

SEQ ID NO: 24266 - DNA, 19 bp, Artificial Sequence
  Synthetic
gccugagagccaccatgug

SEQ ID NO: 24267 - DNA, 20 bp, Artificial Sequence
  Synthetic
ccttucgcccagttccuact

SEQ ID NO: 24268 - DNA, 22 bp, Artificial Sequence
  Synthetic
atgacacaagcguggagaugat

SEQ ID NO: 24269 - DNA, 25 bp, Artificial Sequence
  Synthetic
gggtaauggagagacctagatagug

SEQ ID NO: 24270 - DNA, 20 bp, Artificial Sequence
  Synthetic
ctggacaagugtgugacggt

SEQ ID NO: 24271 - DNA, 21 bp, Artificial Sequence
  Synthetic
catcggcaucatagtggguca

SEQ ID NO: 24272 - DNA, 17 bp, Artificial Sequence
  Synthetic
gugagcagcuggagcct

SEQ ID NO: 24273 - DNA, 20 bp, Artificial Sequence
  Synthetic
tggcccagcutctacucact

SEQ ID NO: 24274 - DNA, 22 bp, Artificial Sequence
  Synthetic
acttcacucccctcaacacuca

SEQ ID NO: 24275 - DNA, 22 bp, Artificial Sequence
  Synthetic
gccttcagguctaactgctguc

SEQ ID NO: 24276 - DNA, 29 bp, Artificial Sequence
  Synthetic
aaaatggctactgauccacaactcttuat

SEQ ID NO: 24277 - DNA, 20 bp, Artificial Sequence
  Synthetic
ggcgcctucgagatttgaug

SEQ ID NO: 24278 - DNA, 18 bp, Artificial Sequence
  Synthetic
gugaagaagccgcugggt

SEQ ID NO: 24279 - DNA, 19 bp, Artificial Sequence
  Synthetic
caccatguggtcctgugct

SEQ ID NO: 24280 - DNA, 20 bp, Artificial Sequence
  Synthetic
acacccccutgctucgaaag

SEQ ID NO: 24281 - DNA, 24 bp, Artificial Sequence
  Synthetic
gtgagaugagggctgtgatuaagg

SEQ ID NO: 24282 - DNA, 24 bp, Artificial Sequence
  Synthetic
cttctttuccagcaaaggtgaugg

SEQ ID NO: 24283 - DNA, 24 bp, Artificial Sequence
  Synthetic
ttgcaggaagucacttctagtugt

SEQ ID NO: 24284 - DNA, 28 bp, Artificial Sequence
  Synthetic
aaaagcacaaauacctaccgagaauaca

SEQ ID NO: 24285 - DNA, 25 bp, Artificial Sequence
  Synthetic
cccaucttcatucacccagaagaaa

SEQ ID NO: 24286 - DNA, 31 bp, Artificial Sequence
  Synthetic
ttgttgctcttttuctaagtttgaatactut

SEQ ID NO: 24287 - DNA, 27 bp, Artificial Sequence
  Synthetic
acagtcgagcugaagacaatttuaact

SEQ ID NO: 24288 - DNA, 24 bp, Artificial Sequence
  Synthetic
cctagggaaugagtgagacttugg

SEQ ID NO: 24289 - DNA, 25 bp, Artificial Sequence
  Synthetic
cacctggcuacacgaaaatttcuag

SEQ ID NO: 24290 - DNA, 25 bp, Artificial Sequence
  Synthetic
gagaacaccuagaagacagtgcaut

SEQ ID NO: 24291 - DNA, 31 bp, Artificial Sequence
  Synthetic
cagctataucacaaaacauttgcataaugat

SEQ ID NO: 24292 - DNA, 27 bp, Artificial Sequence
  Synthetic
cgacggtagcgautattttcaacatuc

SEQ ID NO: 24293 - DNA, 29 bp, Artificial Sequence
  Synthetic
caatctttttgtgucagtcatgagtcauc

SEQ ID NO: 24294 - DNA, 25 bp, Artificial Sequence
  Synthetic
tcagatagtagucaggcaacucaga

SEQ ID NO: 24295 - DNA, 22 bp, Artificial Sequence
  Synthetic
aggaagaguggcatttctccua

SEQ ID NO: 24296 - DNA, 21 bp, Artificial Sequence
  Synthetic
cccgcaaaaugtgcctactuc

SEQ ID NO: 24297 - DNA, 30 bp, Artificial Sequence
  Synthetic
ttgaaaataatugagcataacauccgcaat

SEQ ID NO: 24298 - DNA, 27 bp, Artificial Sequence
  Synthetic
ggatcacacaucttacuagaacacact

SEQ ID NO: 24299 - DNA, 27 bp, Artificial Sequence
  Synthetic
gccatcuacaagcgagttctaaaatug

SEQ ID NO: 24300 - DNA, 28 bp, Artificial Sequence
  Synthetic
gtgatatgggcautttaatttgctggua

SEQ ID NO: 24301 - DNA, 30 bp, Artificial Sequence
  Synthetic
tcacttcctttauggatgtttcaaatccut

SEQ ID NO: 24302 - DNA, 22 bp, Artificial Sequence
  Synthetic
ctcttcaccaaggcugccttua

SEQ ID NO: 24303 - DNA, 27 bp, Artificial Sequence
  Synthetic
agaagagaagaaaauggttgtgtgugt

SEQ ID NO: 24304 - DNA, 28 bp, Artificial Sequence
  Synthetic
ccaggctcattauaagttttggcattut

SEQ ID NO: 24305 - DNA, 30 bp, Artificial Sequence
  Synthetic
aggttgtactgaugaactctcatuaaaagg

SEQ ID NO: 24306 - DNA, 22 bp, Artificial Sequence
  Synthetic
agagcccauccatcacaagtuc

SEQ ID NO: 24307 - DNA, 25 bp, Artificial Sequence
  Synthetic
gaatataaagccgcutgcaaacuct

SEQ ID NO: 24308 - DNA, 23 bp, Artificial Sequence
  Synthetic
cattccugccaacaaaaagcuca

SEQ ID NO: 24309 - DNA, 22 bp, Artificial Sequence
  Synthetic
ggaugaacaggguagacttcuc

SEQ ID NO: 24310 - DNA, 26 bp, Artificial Sequence
  Synthetic
ctttgctcucaacttttacggtaugt

SEQ ID NO: 24311 - DNA, 23 bp, Artificial Sequence
  Synthetic
ctccccaagutgagctttgauga

SEQ ID NO: 24312 - DNA, 27 bp, Artificial Sequence
  Synthetic
ttttacagatacugtggatgguaggga

SEQ ID NO: 24313 - DNA, 24 bp, Artificial Sequence
  Synthetic
tctgtuaagccaaacgctgacaua

SEQ ID NO: 24314 - DNA, 26 bp, Artificial Sequence
  Synthetic
ctctttgccacautaaacatgcctut

SEQ ID NO: 24315 - DNA, 22 bp, Artificial Sequence
  Synthetic
ccatactgtugaggctgcugag

SEQ ID NO: 24316 - DNA, 25 bp, Artificial Sequence
  Synthetic
acaaacttacacugcccaaactuct

SEQ ID NO: 24317 - DNA, 24 bp, Artificial Sequence
  Synthetic
gtcatggtacutccaggaagugaa

SEQ ID NO: 24318 - DNA, 19 bp, Artificial Sequence
  Synthetic
cugccacagcaaagugcag

SEQ ID NO: 24319 - DNA, 20 bp, Artificial Sequence
  Synthetic
tggcuggcaagcucaagaaa

SEQ ID NO: 24320 - DNA, 25 bp, Artificial Sequence
  Synthetic
attgcttgtaccuattgacggtcuc

SEQ ID NO: 24321 - DNA, 21 bp, Artificial Sequence
  Synthetic
aagccuggatgttgucacaca

SEQ ID NO: 24322 - DNA, 28 bp, Artificial Sequence
  Synthetic
tgtgctgttcuaccagatttttcttgua

SEQ ID NO: 24323 - DNA, 28 bp, Artificial Sequence
  Synthetic
ggttggaggcuatattttattcccauct

SEQ ID NO: 24324 - DNA, 25 bp, Artificial Sequence
  Synthetic
aaataaggagguggctgguagaaac

SEQ ID NO: 24325 - DNA, 21 bp, Artificial Sequence
  Synthetic
ggatcttggugcaggaaguct

SEQ ID NO: 24326 - DNA, 21 bp, Artificial Sequence
  Synthetic
gctggacuccacctgagctua

SEQ ID NO: 24327 - DNA, 23 bp, Artificial Sequence
  Synthetic
cuctccctauccaacgaagacac

SEQ ID NO: 24328 - DNA, 27 bp, Artificial Sequence
  Synthetic
ccttaattttgguttcacgtactucca

SEQ ID NO: 24329 - DNA, 30 bp, Artificial Sequence
  Synthetic
tctaaagcactuggttaattattgacucaa

SEQ ID NO: 24330 - DNA, 30 bp, Artificial Sequence
  Synthetic
atgtaaaactugcaaagaatcagaacaaug

SEQ ID NO: 24331 - DNA, 22 bp, Artificial Sequence
  Synthetic
ccucacggaggcattcuaaagt

SEQ ID NO: 24332 - DNA, 25 bp, Artificial Sequence
  Synthetic
tctacagagutccctgttugcaaaa

SEQ ID NO: 24333 - DNA, 28 bp, Artificial Sequence
  Synthetic
cgttcagaatattucttcggaagtccug

SEQ ID NO: 24334 - DNA, 31 bp, Artificial Sequence
  Synthetic
ctccaaataaugacaagcagaagtatacuct

SEQ ID NO: 24335 - DNA, 32 bp, Artificial Sequence
  Synthetic
cacacttttaaaatauacttgccctgatatuc

SEQ ID NO: 24336 - DNA, 29 bp, Artificial Sequence
  Synthetic
tgaatggagaaacauctacaaaatcccut

SEQ ID NO: 24337 - DNA, 30 bp, Artificial Sequence
  Synthetic
aataataagcaucagcatttgacttuacct

SEQ ID NO: 24338 - DNA, 22 bp, Artificial Sequence
  Synthetic
attcctgatcutcctcgtgcug

SEQ ID NO: 24339 - DNA, 28 bp, Artificial Sequence
  Synthetic
tcagcggtauaatcaggagttttuaaag

SEQ ID NO: 24340 - DNA, 23 bp, Artificial Sequence
  Synthetic
gcagtguggtaaagtucccagat

SEQ ID NO: 24341 - DNA, 32 bp, Artificial Sequence
  Synthetic
tccatagagaaaguatctacctaaauccacag

SEQ ID NO: 24342 - DNA, 23 bp, Artificial Sequence
  Synthetic
tcaacctttugaacagcaugcaa

SEQ ID NO: 24343 - DNA, 32 bp, Artificial Sequence
  Synthetic
tacttcatctcuagaattccattuaacagaca

SEQ ID NO: 24344 - DNA, 19 bp, Artificial Sequence
  Synthetic
cggccaugcagaaacugac

SEQ ID NO: 24345 - DNA, 25 bp, Artificial Sequence
  Synthetic
ccaaaagaaaaagugcccaatccut

SEQ ID NO: 24346 - DNA, 24 bp, Artificial Sequence
  Synthetic
tgtacagtacugaggttctcaugt

SEQ ID NO: 24347 - DNA, 22 bp, Artificial Sequence
  Synthetic
acagaaagcccugtagagcauc

SEQ ID NO: 24348 - DNA, 21 bp, Artificial Sequence
  Synthetic
tgatggcgugatccccaaaut

SEQ ID NO: 24349 - DNA, 24 bp, Artificial Sequence
  Synthetic
acaggttgccutactggttaccua

SEQ ID NO: 24350 - DNA, 23 bp, Artificial Sequence
  Synthetic
gccattgaccugtttacacgtuc

SEQ ID NO: 24351 - DNA, 30 bp, Artificial Sequence
  Synthetic
tttaaacagagaaaaccautacttguccat

SEQ ID NO: 24352 - DNA, 28 bp, Artificial Sequence
  Synthetic
agacctgaagguattaacatcattugct

SEQ ID NO: 24353 - DNA, 22 bp, Artificial Sequence
  Synthetic
catuccagagucaagcatcaut

SEQ ID NO: 24354 - DNA, 20 bp, Artificial Sequence
  Synthetic
gcccgcaugtacaacaugat

SEQ ID NO: 24355 - DNA, 19 bp, Artificial Sequence
  Synthetic
cattcaugggccgctugac

SEQ ID NO: 24356 - DNA, 26 bp, Artificial Sequence
  Synthetic
gaaggaguacccggautataaauacc

SEQ ID NO: 24357 - DNA, 18 bp, Artificial Sequence
  Synthetic
gtccaugcgctggtucac

SEQ ID NO: 24358 - DNA, 19 bp, Artificial Sequence
  Synthetic
gttcgguggtcaaguccga

SEQ ID NO: 24359 - DNA, 21 bp, Artificial Sequence
  Synthetic
gtgctgggacaugtgaaguct

SEQ ID NO: 24360 - DNA, 22 bp, Artificial Sequence
  Synthetic
acagcaaaugacagcugcaaaa

SEQ ID NO: 24361 - DNA, 20 bp, Artificial Sequence
  Synthetic
cacccuccccaggttttcuc

SEQ ID NO: 24362 - DNA, 22 bp, Artificial Sequence
  Synthetic
gcuagtcuccaagcgacgaaaa

SEQ ID NO: 24363 - DNA, 27 bp, Artificial Sequence
  Synthetic
agcaagaagccuctccttgaaaaauat

SEQ ID NO: 24364 - DNA, 29 bp, Artificial Sequence
  Synthetic
aattagaataagtacuggcgaaccatcuc

SEQ ID NO: 24365 - DNA, 28 bp, Artificial Sequence
  Synthetic
gaaagttgggaucgaacaaaagctatua

SEQ ID NO: 24366 - DNA, 27 bp, Artificial Sequence
  Synthetic
tctagtaguaccaagatgatgggaugg

SEQ ID NO: 24367 - DNA, 28 bp, Artificial Sequence
  Synthetic
cgtttgggacautgacaatgagtttuaa

SEQ ID NO: 24368 - DNA, 26 bp, Artificial Sequence
  Synthetic
cacatacttuagttcctccttuccca

SEQ ID NO: 24369 - DNA, 22 bp, Artificial Sequence
  Synthetic
gacttctuccgtgctactucca

SEQ ID NO: 24370 - DNA, 26 bp, Artificial Sequence
  Synthetic
caactcaggaaucctctcaatcagut

SEQ ID NO: 24371 - DNA, 23 bp, Artificial Sequence
  Synthetic
gaatgtgaggcucttgctctuag

SEQ ID NO: 24372 - DNA, 19 bp, Artificial Sequence
  Synthetic
gggcgguctttacctggut

SEQ ID NO: 24373 - DNA, 25 bp, Artificial Sequence
  Synthetic
ccctctgacuggaaaacagactcua

SEQ ID NO: 24374 - DNA, 29 bp, Artificial Sequence
  Synthetic
gaactcaaaacggugatttacucaagaaa

SEQ ID NO: 24375 - DNA, 26 bp, Artificial Sequence
  Synthetic
ggttgcaaatgcugaaagcttaaaug

SEQ ID NO: 24376 - DNA, 27 bp, Artificial Sequence
  Synthetic
atttagcacaccugaaaatagctacut

SEQ ID NO: 24377 - DNA, 28 bp, Artificial Sequence
  Synthetic
tgcgttgtatgutgaaaatcaattucgt

SEQ ID NO: 24378 - DNA, 28 bp, Artificial Sequence
  Synthetic
acattgaagttuggaatggtcattcuca

SEQ ID NO: 24379 - DNA, 28 bp, Artificial Sequence
  Synthetic
acttgctgtagaugaagaagaaaaugct

SEQ ID NO: 24380 - DNA, 20 bp, Artificial Sequence
  Synthetic
ctcctgcutgcgaaactugg

SEQ ID NO: 24381 - DNA, 22 bp, Artificial Sequence
  Synthetic
agtagaactugggccacccuaa

SEQ ID NO: 24382 - DNA, 23 bp, Artificial Sequence
  Synthetic
gctgagaaagcugaaggtcctua

SEQ ID NO: 24383 - DNA, 22 bp, Artificial Sequence
  Synthetic
gccagtggcutccagtauaacc

SEQ ID NO: 24384 - DNA, 22 bp, Artificial Sequence
  Synthetic
ctaggcuccagggttgtttcua

SEQ ID NO: 24385 - DNA, 25 bp, Artificial Sequence
  Synthetic
caaacaaggaacucagagaggacug

SEQ ID NO: 24386 - DNA, 29 bp, Artificial Sequence
  Synthetic
atacctaataucaataatgccagugggat

SEQ ID NO: 24387 - DNA, 24 bp, Artificial Sequence
  Synthetic
gcagaatcatcaucctccacgaug

SEQ ID NO: 24388 - DNA, 29 bp, Artificial Sequence
  Synthetic
tggatctagaaauggaagctctuaaaacc

SEQ ID NO: 24389 - DNA, 21 bp, Artificial Sequence
  Synthetic
ccattgcacgutttgagggua

SEQ ID NO: 24390 - DNA, 29 bp, Artificial Sequence
  Synthetic
atgaagtcaaacautttgttgtagaggug

SEQ ID NO: 24391 - DNA, 22 bp, Artificial Sequence
  Synthetic
ggcatactugggcagagagtut

SEQ ID NO: 24392 - DNA, 21 bp, Artificial Sequence
  Synthetic
tgatcaccauggctcaacugg

SEQ ID NO: 24393 - DNA, 26 bp, Artificial Sequence
  Synthetic
caagggagaaauattcugaccacgaa

SEQ ID NO: 24394 - DNA, 22 bp, Artificial Sequence
  Synthetic
ctctggtgcacugggacttugg

SEQ ID NO: 24395 - DNA, 28 bp, Artificial Sequence
  Synthetic
ggaaactcccaucttgagtcauaaggca

SEQ ID NO: 24396 - DNA, 24 bp, Artificial Sequence
  Synthetic
gagaacaggaagutggtagcucag

SEQ ID NO: 24397 - DNA, 27 bp, Artificial Sequence
  Synthetic
ccagcaagttuacaatgttcaaatgug

SEQ ID NO: 24398 - DNA, 22 bp, Artificial Sequence
  Synthetic
ggcacccugggtaagatttcuc

SEQ ID NO: 24399 - DNA, 30 bp, Artificial Sequence
  Synthetic
ctggatgtcggaauatttagaaacctctut

SEQ ID NO: 24400 - DNA, 22 bp, Artificial Sequence
  Synthetic
gggtgaugctattcagcuacag

SEQ ID NO: 24401 - DNA, 28 bp, Artificial Sequence
  Synthetic
gccaaagtcacagaucttcacaatttut

SEQ ID NO: 24402 - DNA, 32 bp, Artificial Sequence
  Synthetic
gcatgatggtggautctactttctacaauaag

SEQ ID NO: 24403 - DNA, 21 bp, Artificial Sequence
  Synthetic
cccuagacccacagactguga

SEQ ID NO: 24404 - DNA, 19 bp, Artificial Sequence
  Synthetic
cagagacugagcgcugaca

SEQ ID NO: 24405 - DNA, 21 bp, Artificial Sequence
  Synthetic
gggaaaatgggucctctccut

SEQ ID NO: 24406 - DNA, 20 bp, Artificial Sequence
  Synthetic
caacuagagggcagcctugt

SEQ ID NO: 24407 - DNA, 19 bp, Artificial Sequence
  Synthetic
ctctcaggcagugggctuc

SEQ ID NO: 24408 - DNA, 24 bp, Artificial Sequence
  Synthetic
cagtcaaccaaaugtctccgatut

SEQ ID NO: 24409 - DNA, 25 bp, Artificial Sequence
  Synthetic
ggtaattagcacutttcccctccug

SEQ ID NO: 24410 - DNA, 24 bp, Artificial Sequence
  Synthetic
cataccucagggcagatcaatucc

SEQ ID NO: 24411 - DNA, 28 bp, Artificial Sequence
  Synthetic
tgttgttgtagtugttctggtttcugaa

SEQ ID NO: 24412 - DNA, 22 bp, Artificial Sequence
  Synthetic
ggttccucagcttcctucagaa

SEQ ID NO: 24413 - DNA, 28 bp, Artificial Sequence
  Synthetic
tgcatacatgugtagatggatuaggact

SEQ ID NO: 24414 - DNA, 28 bp, Artificial Sequence
  Synthetic
cactatcugaaaccaggatggatugaat

SEQ ID NO: 24415 - DNA, 21 bp, Artificial Sequence
  Synthetic
cccccaggcaugttggaatut

SEQ ID NO: 24416 - DNA, 25 bp, Artificial Sequence
  Synthetic
gcttcagagacugagccatttucaa

SEQ ID NO: 24417 - DNA, 26 bp, Artificial Sequence
  Synthetic
gggtgaggaaaaguctggagtattuc

SEQ ID NO: 24418 - DNA, 26 bp, Artificial Sequence
  Synthetic
gtgcatgcaaaauacaggtttctugt

SEQ ID NO: 24419 - DNA, 25 bp, Artificial Sequence
  Synthetic
gcacctgugaagaagatcttgctut

SEQ ID NO: 24420 - DNA, 24 bp, Artificial Sequence
  Synthetic
cactcaaaagcaugctgctcuaag

SEQ ID NO: 24421 - DNA, 23 bp, Artificial Sequence
  Synthetic
ttttgttttcuggtggtgctgug

SEQ ID NO: 24422 - DNA, 21 bp, Artificial Sequence
  Synthetic
gauagccacacuccagcttua

SEQ ID NO: 24423 - DNA, 27 bp, Artificial Sequence
  Synthetic
gggaaatcauattgagtctugacaggt

SEQ ID NO: 24424 - DNA, 26 bp, Artificial Sequence
  Synthetic
ccataggcaguctaatgtacgaacut

SEQ ID NO: 24425 - DNA, 27 bp, Artificial Sequence
  Synthetic
aauggagaaaaggaaacttuaggagca

SEQ ID NO: 24426 - DNA, 28 bp, Artificial Sequence
  Synthetic
tgactctccaggautttctctcatcaua

SEQ ID NO: 24427 - DNA, 24 bp, Artificial Sequence
  Synthetic
ctctaucccacccucagaatatug

SEQ ID NO: 24428 - DNA, 24 bp, Artificial Sequence
  Synthetic
cttgcctttacucctgcatguaga

SEQ ID NO: 24429 - DNA, 21 bp, Artificial Sequence
  Synthetic
gtcctagcugccccaatguat

SEQ ID NO: 24430 - DNA, 20 bp, Artificial Sequence
  Synthetic
tttgctuggcgtagaccugt

SEQ ID NO: 24431 - DNA, 26 bp, Artificial Sequence
  Synthetic
ccttctguccaaacctuaaagaaacc

SEQ ID NO: 24432 - DNA, 28 bp, Artificial Sequence
  Synthetic
tgctatccatagcaaugaatttggtcut

SEQ ID NO: 24433 - DNA, 25 bp, Artificial Sequence
  Synthetic
cagcttaaactuccttgggatctug

SEQ ID NO: 24434 - DNA, 24 bp, Artificial Sequence
  Synthetic
gcagcttcacgutctgcctttaua

SEQ ID NO: 24435 - DNA, 20 bp, Artificial Sequence
  Synthetic
tgtcggcaagucttgacugg

SEQ ID NO: 24436 - DNA, 22 bp, Artificial Sequence
  Synthetic
cctguccacagaactttugcga

SEQ ID NO: 24437 - DNA, 27 bp, Artificial Sequence
  Synthetic
ggatccagaagcagaauaagagtugac

SEQ ID NO: 24438 - DNA, 27 bp, Artificial Sequence
  Synthetic
gauctgtataggtauccaagccaagac

SEQ ID NO: 24439 - DNA, 25 bp, Artificial Sequence
  Synthetic
gtctaatgguacaactgcugaaacc

SEQ ID NO: 24440 - DNA, 27 bp, Artificial Sequence
  Synthetic
cacacagctaaugggttatcaaagaug

SEQ ID NO: 24441 - DNA, 21 bp, Artificial Sequence
  Synthetic
caccctggacuagtgccaaug

SEQ ID NO: 24442 - DNA, 28 bp, Artificial Sequence
  Synthetic
agaaagaggaagagugtgaaaagtaugg

SEQ ID NO: 24443 - DNA, 21 bp, Artificial Sequence
  Synthetic
cauggtccttucggcaagaga

SEQ ID NO: 24444 - DNA, 23 bp, Artificial Sequence
  Synthetic
ggcctgaagaaautggctggtua

SEQ ID NO: 24445 - DNA, 23 bp, Artificial Sequence
  Synthetic
gtttucgaagaacctggugcaac

SEQ ID NO: 24446 - DNA, 32 bp, Artificial Sequence
  Synthetic
gcccaactgatguattctataaaataaatguc

SEQ ID NO: 24447 - DNA, 22 bp, Artificial Sequence
  Synthetic
tgctggaaugacaggattuggt

SEQ ID NO: 24448 - DNA, 30 bp, Artificial Sequence
  Synthetic
aaactctctttctuacagctctgataauac

SEQ ID NO: 24449 - DNA, 30 bp, Artificial Sequence
  Synthetic
aatgagagaaugttaaatgcucaaaaagca

SEQ ID NO: 24450 - DNA, 26 bp, Artificial Sequence
  Synthetic
tgggatugcgaacaactttttcttut

SEQ ID NO: 24451 - DNA, 30 bp, Artificial Sequence
  Synthetic
tctctgaaaatgaaguttctgtagcctuac

SEQ ID NO: 24452 - DNA, 29 bp, Artificial Sequence
  Synthetic
aatctttcuaggatcaagttgucaaagaa

SEQ ID NO: 24453 - DNA, 21 bp, Artificial Sequence
  Synthetic
acctgggaugtgcgggtauat

SEQ ID NO: 24454 - DNA, 22 bp, Artificial Sequence
  Synthetic
accgutcctgatguacccagat

SEQ ID NO: 24455 - DNA, 24 bp, Artificial Sequence
  Synthetic
caatttctcgauactcagcugcct

SEQ ID NO: 24456 - DNA, 27 bp, Artificial Sequence
  Synthetic
atgatgagaagacauggaatgtuggaa

SEQ ID NO: 24457 - DNA, 28 bp, Artificial Sequence
  Synthetic
gagatgttguaaagaaaagtttgcugga

SEQ ID NO: 24458 - DNA, 21 bp, Artificial Sequence
  Synthetic
gucaggagcagaaagctucca

SEQ ID NO: 24459 - DNA, 24 bp, Artificial Sequence
  Synthetic
gaagcagaggauagcttcctguag

SEQ ID NO: 24460 - DNA, 22 bp, Artificial Sequence
  Synthetic
acacacacugtgcacaattucc

SEQ ID NO: 24461 - DNA, 28 bp, Artificial Sequence
  Synthetic
caatgagggugacaacgactatatcauc

SEQ ID NO: 24462 - DNA, 23 bp, Artificial Sequence
  Synthetic
ccaaatgcaugagactccacuca

SEQ ID NO: 24463 - DNA, 24 bp, Artificial Sequence
  Synthetic
cctgtgtatcucttgtctctgcuc

SEQ ID NO: 24464 - DNA, 17 bp, Artificial Sequence
  Synthetic
gctgggugacccaccuc

SEQ ID NO: 24465 - DNA, 23 bp, Artificial Sequence
  Synthetic
gagtctccagugctaagcuacat

SEQ ID NO: 24466 - DNA, 24 bp, Artificial Sequence
  Synthetic
aggtaucccaaagattcaguccct

SEQ ID NO: 24467 - DNA, 20 bp, Artificial Sequence
  Synthetic
acggagaccuggtggacuac

SEQ ID NO: 24468 - DNA, 20 bp, Artificial Sequence
  Synthetic
tggagggcuccaaggacuac

SEQ ID NO: 24469 - DNA, 23 bp, Artificial Sequence
  Synthetic
gctaatggaucatctcugcacca

SEQ ID NO: 24470 - DNA, 26 bp, Artificial Sequence
  Synthetic
aattaggcaggautaaggtagggaut

SEQ ID NO: 24471 - DNA, 17 bp, Artificial Sequence
  Synthetic
gaucggccactgucggt

SEQ ID NO: 24472 - DNA, 17 bp, Artificial Sequence
  Synthetic
gggcgugctcaucacca

SEQ ID NO: 24473 - DNA, 20 bp, Artificial Sequence
  Synthetic
ctctgacagcugccttucct

SEQ ID NO: 24474 - DNA, 19 bp, Artificial Sequence
  Synthetic
ggtgtagguccccgaguct

SEQ ID NO: 24475 - DNA, 18 bp, Artificial Sequence
  Synthetic
ccggccccucctgattug

SEQ ID NO: 24476 - DNA, 23 bp, Artificial Sequence
  Synthetic
tggtggtttugcagatgtagcut

SEQ ID NO: 24477 - DNA, 22 bp, Artificial Sequence
  Synthetic
attccaugccgaguaacagacc

SEQ ID NO: 24478 - DNA, 18 bp, Artificial Sequence
  Synthetic
gcugaacccgagcagguc

SEQ ID NO: 24479 - DNA, 24 bp, Artificial Sequence
  Synthetic
ccctgtttccugatgtctgauacc

SEQ ID NO: 24480 - DNA, 22 bp, Artificial Sequence
  Synthetic
ggcaucgaccagatcctuaaca

SEQ ID NO: 24481 - DNA, 17 bp, Artificial Sequence
  Synthetic
gatcccgcguccucgaa

SEQ ID NO: 24482 - DNA, 21 bp, Artificial Sequence
  Synthetic
gcatgacgguactgtcccuct

SEQ ID NO: 24483 - DNA, 22 bp, Artificial Sequence
  Synthetic
tggagtcgtugaggctctttug

SEQ ID NO: 24484 - DNA, 22 bp, Artificial Sequence
  Synthetic
gccttctcucctacctaagugc

SEQ ID NO: 24485 - DNA, 17 bp, Artificial Sequence
  Synthetic
ggatucccgccccucac

SEQ ID NO: 24486 - DNA, 26 bp, Artificial Sequence
  Synthetic
cagtccaatuaaagtaacacuggcaa

SEQ ID NO: 24487 - DNA, 28 bp, Artificial Sequence
  Synthetic
cagtgacagaagauaaagaaccacttuc

SEQ ID NO: 24488 - DNA, 24 bp, Artificial Sequence
  Synthetic
agaagaugaagaggaggaggaugt

SEQ ID NO: 24489 - DNA, 27 bp, Artificial Sequence
  Synthetic
aagatacgtacucatgaacaagagcug

SEQ ID NO: 24490 - DNA, 25 bp, Artificial Sequence
  Synthetic
tcactgattttugtcccttggauac

SEQ ID NO: 24491 - DNA, 23 bp, Artificial Sequence
  Synthetic
gtctctccutttcctttcucccc

SEQ ID NO: 24492 - DNA, 23 bp, Artificial Sequence
  Synthetic
tggcaguggaggaagtctcttua

SEQ ID NO: 24493 - DNA, 26 bp, Artificial Sequence
  Synthetic
ggacaacattuatcaaacacgguagg

SEQ ID NO: 24494 - DNA, 22 bp, Artificial Sequence
  Synthetic
ctacaggattuggcctccauga

SEQ ID NO: 24495 - DNA, 22 bp, Artificial Sequence
  Synthetic
catagcaagugctguaggacca

SEQ ID NO: 24496 - DNA, 20 bp, Artificial Sequence
  Synthetic
gagtagacacggugcaguca

SEQ ID NO: 24497 - DNA, 25 bp, Artificial Sequence
  Synthetic
tgtttgtguctcctagugaaaaggg

SEQ ID NO: 24498 - DNA, 25 bp, Artificial Sequence
  Synthetic
gccacugaagtatgaagtuggagat

SEQ ID NO: 24499 - DNA, 28 bp, Artificial Sequence
  Synthetic
aggcaactgccuttaacatgtataauca

SEQ ID NO: 24500 - DNA, 23 bp, Artificial Sequence
  Synthetic
agtgttggacutgcagaacagua

SEQ ID NO: 24501 - DNA, 23 bp, Artificial Sequence
  Synthetic
gccagtgattucaaacagccaut

SEQ ID NO: 24502 - DNA, 28 bp, Artificial Sequence
  Synthetic
cactgcaaagaaagaauttgagactuca

SEQ ID NO: 24503 - DNA, 24 bp, Artificial Sequence
  Synthetic
ctcatcaccugctccaatauagca

SEQ ID NO: 24504 - DNA, 24 bp, Artificial Sequence
  Synthetic
agacgtctcaggutaatctctcug

SEQ ID NO: 24505 - DNA, 26 bp, Artificial Sequence
  Synthetic
ccctttatuaacgagttctcacugga

SEQ ID NO: 24506 - DNA, 26 bp, Artificial Sequence
  Synthetic
aacatgtttuatccgagtugaaggaa

SEQ ID NO: 24507 - DNA, 30 bp, Artificial Sequence
  Synthetic
caatgtactgaauttgtagtctggtucaat

SEQ ID NO: 24508 - DNA, 22 bp, Artificial Sequence
  Synthetic
gacctcccugcttctgguaaaa

SEQ ID NO: 24509 - DNA, 25 bp, Artificial Sequence
  Synthetic
gaagctgatucagttttctttugcg

SEQ ID NO: 24510 - DNA, 22 bp, Artificial Sequence
  Synthetic
gguggcagcgttuaaaccaaag

SEQ ID NO: 24511 - DNA, 24 bp, Artificial Sequence
  Synthetic
ctcaaguatgcttgcugaaggagt

SEQ ID NO: 24512 - DNA, 22 bp, Artificial Sequence
  Synthetic
cttttagcugtgcggucagaga

SEQ ID NO: 24513 - DNA, 23 bp, Artificial Sequence
  Synthetic
aaggaccagugaaagtttgcuga

SEQ ID NO: 24514 - DNA, 31 bp, Artificial Sequence
  Synthetic
ttgtgcccagttuctaaatcatctaatguaa

SEQ ID NO: 24515 - DNA, 22 bp, Artificial Sequence
  Synthetic
ccccttctugggcataaaucca

SEQ ID NO: 24516 - DNA, 22 bp, Artificial Sequence
  Synthetic
gcagccaagaugcagtguaaaa

SEQ ID NO: 24517 - DNA, 21 bp, Artificial Sequence
  Synthetic
gaaagagggaugtggcctcug

SEQ ID NO: 24518 - DNA, 30 bp, Artificial Sequence
  Synthetic
acctaatggttuagcatttggtagattcut

SEQ ID NO: 24519 - DNA, 27 bp, Artificial Sequence
  Synthetic
gacacactctucatggtaaaacttucc

SEQ ID NO: 24520 - DNA, 22 bp, Artificial Sequence
  Synthetic
ctgggtcaaagauccttgcauc

SEQ ID NO: 24521 - DNA, 28 bp, Artificial Sequence
  Synthetic
gaaatgattucttaccttcugagcacac

SEQ ID NO: 24522 - DNA, 24 bp, Artificial Sequence
  Synthetic
ccttgcagccutctagaggtttuc

SEQ ID NO: 24523 - DNA, 30 bp, Artificial Sequence
  Synthetic
gtgagtccacaaauagtcattagauccaaa

SEQ ID NO: 24524 - DNA, 24 bp, Artificial Sequence
  Synthetic
gtgaattgtcutctgctgactugt

SEQ ID NO: 24525 - DNA, 25 bp, Artificial Sequence
  Synthetic
gatgcatucagagtctaucccacag

SEQ ID NO: 24526 - DNA, 24 bp, Artificial Sequence
  Synthetic
atgaagaagaaugcagagcucgaa

SEQ ID NO: 24527 - DNA, 23 bp, Artificial Sequence
  Synthetic
gaactgcgutacatgccuacaaa

SEQ ID NO: 24528 - DNA, 27 bp, Artificial Sequence
  Synthetic
ctacaacctagaaugtcttgggaaugg

SEQ ID NO: 24529 - DNA, 28 bp, Artificial Sequence
  Synthetic
ttaaaatgtagacugccctaacactgut

SEQ ID NO: 24530 - DNA, 21 bp, Artificial Sequence
  Synthetic
cagcctccutctgtgagaugt

SEQ ID NO: 24531 - DNA, 20 bp, Artificial Sequence
  Synthetic
cccaggtuccagaggatugg

SEQ ID NO: 24532 - DNA, 21 bp, Artificial Sequence
  Synthetic
ggucagggaccaaaucccaat

SEQ ID NO: 24533 - DNA, 22 bp, Artificial Sequence
  Synthetic
ccagaggtcuttccagtggtug

SEQ ID NO: 24534 - DNA, 20 bp, Artificial Sequence
  Synthetic
ctgtgguccagacccttgua

SEQ ID NO: 24535 - DNA, 22 bp, Artificial Sequence
  Synthetic
atcttctcaucagcctgtggug

SEQ ID NO: 24536 - DNA, 20 bp, Artificial Sequence
  Synthetic
cagggccucttagccaaucc

SEQ ID NO: 24537 - DNA, 27 bp, Artificial Sequence
  Synthetic
tgtggttaccaacutcttttctucagt

SEQ ID NO: 24538 - DNA, 26 bp, Artificial Sequence
  Synthetic
aagtgtgcagaaucagaacagaagua

SEQ ID NO: 24539 - DNA, 29 bp, Artificial Sequence
  Synthetic
tgttgggataugaggaaagaataacagug

SEQ ID NO: 24540 - DNA, 20 bp, Artificial Sequence
  Synthetic
acactggucccccugagaaa

SEQ ID NO: 24541 - DNA, 25 bp, Artificial Sequence
  Synthetic
cgtctcagcucattgtctaatguca

SEQ ID NO: 24542 - DNA, 23 bp, Artificial Sequence
  Synthetic
cgcagctuacacatgttctugaa

SEQ ID NO: 24543 - DNA, 22 bp, Artificial Sequence
  Synthetic
tggtaagcutggatcucagggt

SEQ ID NO: 24544 - DNA, 18 bp, Artificial Sequence
  Synthetic
caaccccgucgaagcuca

SEQ ID NO: 24545 - DNA, 20 bp, Artificial Sequence
  Synthetic
gctuggagacctcucagcct

SEQ ID NO: 24546 - DNA, 18 bp, Artificial Sequence
  Synthetic
ctggcccaucaccuccac

SEQ ID NO: 24547 - DNA, 19 bp, Artificial Sequence
  Synthetic
aaggcuagtgggugggact

SEQ ID NO: 24548 - DNA, 23 bp, Artificial Sequence
  Synthetic
agtggaacugtcgaatggugaaa

SEQ ID NO: 24549 - DNA, 26 bp, Artificial Sequence
  Synthetic
ctgctcctacuagctactccatuaca

SEQ ID NO: 24550 - DNA, 24 bp, Artificial Sequence
  Synthetic
tgggatgcucttgtccaaaaucaa

SEQ ID NO: 24551 - DNA, 18 bp, Artificial Sequence
  Synthetic
cuccccacccaggagauc

SEQ ID NO: 24552 - DNA, 17 bp, Artificial Sequence
  Synthetic
cccgacucccgcccuaa

SEQ ID NO: 24553 - DNA, 20 bp, Artificial Sequence
  Synthetic
cgaaccaguccaggagccua

SEQ ID NO: 24554 - DNA, 26 bp, Artificial Sequence
  Synthetic
gttttctcttcuattcccttggcuca

SEQ ID NO: 24555 - DNA, 24 bp, Artificial Sequence
  Synthetic
gatgatctcutcgtcatgcucgaa

SEQ ID NO: 24556 - DNA, 18 bp, Artificial Sequence
  Synthetic
ccaccuccacagcctguc

SEQ ID NO: 24557 - DNA, 28 bp, Artificial Sequence
  Synthetic
tgtaaatgtugttcctgtaucaagcact

SEQ ID NO: 24558 - DNA, 21 bp, Artificial Sequence
  Synthetic
cagauccttctuggacaggct

SEQ ID NO: 24559 - DNA, 19 bp, Artificial Sequence
  Synthetic
ccagccaccauccccatuc

SEQ ID NO: 24560 - DNA, 22 bp, Artificial Sequence
  Synthetic
tggactttugcaggtccttcug

SEQ ID NO: 24561 - DNA, 22 bp, Artificial Sequence
  Synthetic
atttggccacucttcugagcat

SEQ ID NO: 24562 - DNA, 20 bp, Artificial Sequence
  Synthetic
ctcccuagaaccctugcaca

SEQ ID NO: 24563 - DNA, 25 bp, Artificial Sequence
  Synthetic
cccagatggacutttctctttucca

SEQ ID NO: 24564 - DNA, 19 bp, Artificial Sequence
  Synthetic
ccagaacaggcccuaccut

SEQ ID NO: 24565 - DNA, 23 bp, Artificial Sequence
  Synthetic
caacaggcugtcatgcatuacat

SEQ ID NO: 24566 - DNA, 25 bp, Artificial Sequence
  Synthetic
aacuctctattucccaaacaacgct

SEQ ID NO: 24567 - DNA, 26 bp, Artificial Sequence
  Synthetic
gaaccacaugcagacaaagatttcug

SEQ ID NO: 24568 - DNA, 26 bp, Artificial Sequence
  Synthetic
gtgcagcgaaaacuagaaaattcuga

SEQ ID NO: 24569 - DNA, 25 bp, Artificial Sequence
  Synthetic
cccgaccaaagaccuacttttcaua

SEQ ID NO: 24570 - DNA, 26 bp, Artificial Sequence
  Synthetic
tgattctgtcagcautactctgtguc

SEQ ID NO: 24571 - DNA, 29 bp, Artificial Sequence
  Synthetic
gactcgccagagacauctataaaaaugat

SEQ ID NO: 24572 - DNA, 24 bp, Artificial Sequence
  Synthetic
gttccaaguagacacagcctttug

SEQ ID NO: 24573 - DNA, 30 bp, Artificial Sequence
  Synthetic
atttcatgcaaacuagataactacctguaa

SEQ ID NO: 24574 - DNA, 28 bp, Artificial Sequence
  Synthetic
tccaggtcaatcuttgtagatatgguga

SEQ ID NO: 24575 - DNA, 25 bp, Artificial Sequence
  Synthetic
ggagccttuggagaagtgtaugaag

SEQ ID NO: 24576 - DNA, 24 bp, Artificial Sequence
  Synthetic
acttaccaaaggucagtgggatug

SEQ ID NO: 24577 - DNA, 23 bp, Artificial Sequence
  Synthetic
ctctgtgtgcutaggtagagcug

SEQ ID NO: 24578 - DNA, 29 bp, Artificial Sequence
  Synthetic
gtcauttacaagtacttugcaaacacaca

SEQ ID NO: 24579 - DNA, 25 bp, Artificial Sequence
  Synthetic
aggcatucccaaattacuagaaggg

SEQ ID NO: 24580 - DNA, 28 bp, Artificial Sequence
  Synthetic
gtgatattacagacauaagcaggaccut

SEQ ID NO: 24581 - DNA, 31 bp, Artificial Sequence
  Synthetic
cacttgctataagccuatacatttttgtgut

SEQ ID NO: 24582 - DNA, 22 bp, Artificial Sequence
  Synthetic
gcaggcaagaaccutttgguaa

SEQ ID NO: 24583 - DNA, 25 bp, Artificial Sequence
  Synthetic
gaatttccaaauggaaggctcacuc

SEQ ID NO: 24584 - DNA, 28 bp, Artificial Sequence
  Synthetic
caaatctcttttccuggtggtaaatgut

SEQ ID NO: 24585 - DNA, 30 bp, Artificial Sequence
  Synthetic
aattacaggaattucaggacagtatagcuc

SEQ ID NO: 24586 - DNA, 19 bp, Artificial Sequence
  Synthetic
gggccutcaccugggaaac

SEQ ID NO: 24587 - DNA, 25 bp, Artificial Sequence
  Synthetic
agcaggaaaaacccutgttagctua

SEQ ID NO: 24588 - DNA, 29 bp, Artificial Sequence
  Synthetic
tgtagtagaacatcuggtagccaaaatug

SEQ ID NO: 24589 - DNA, 24 bp, Artificial Sequence
  Synthetic
tccctcacagucattagcaauagt

SEQ ID NO: 24590 - DNA, 25 bp, Artificial Sequence
  Synthetic
agagtgaguccccttcagcataaua

SEQ ID NO: 24591 - DNA, 29 bp, Artificial Sequence
  Synthetic
cacctcataacucttcttgguaacaagat

SEQ ID NO: 24592 - DNA, 24 bp, Artificial Sequence
  Synthetic
gggactcaugccttcaagtugaaa

SEQ ID NO: 24593 - DNA, 24 bp, Artificial Sequence
  Synthetic
gguggaatttagguggaacaaacc

SEQ ID NO: 24594 - DNA, 22 bp, Artificial Sequence
  Synthetic
caaggcugacacagatgguaca

SEQ ID NO: 24595 - DNA, 27 bp, Artificial Sequence
  Synthetic
caagttttcaaaucctgtggaatgguc

SEQ ID NO: 24596 - DNA, 30 bp, Artificial Sequence
  Synthetic
tccatgcatuatcatttatgacugacaagt

SEQ ID NO: 24597 - DNA, 25 bp, Artificial Sequence
  Synthetic
ctcctgtautggttggtucaagaca

SEQ ID NO: 24598 - DNA, 22 bp, Artificial Sequence
  Synthetic
ccaactgaauccaccaccaugt

SEQ ID NO: 24599 - DNA, 24 bp, Artificial Sequence
  Synthetic
acttgaaagccautaacuggccat

SEQ ID NO: 24600 - DNA, 28 bp, Artificial Sequence
  Synthetic
gggtttaccugacacatttcctatauca

SEQ ID NO: 24601 - DNA, 28 bp, Artificial Sequence
  Synthetic
tttttacuaaacagctagugaaccacca

SEQ ID NO: 24602 - DNA, 22 bp, Artificial Sequence
  Synthetic
gccaagcagutcaaacctucct

SEQ ID NO: 24603 - DNA, 20 bp, Artificial Sequence
  Synthetic
gagcttucggtgctgttugg

SEQ ID NO: 24604 - DNA, 22 bp, Artificial Sequence
  Synthetic
tgtggctugattgcaaagucct

SEQ ID NO: 24605 - DNA, 24 bp, Artificial Sequence
  Synthetic
cctttggacugaatctcaugaggt

SEQ ID NO: 24606 - DNA, 27 bp, Artificial Sequence
  Synthetic
ctcaggtcagauacatcagacatgtug

SEQ ID NO: 24607 - DNA, 21 bp, Artificial Sequence
  Synthetic
aatgtgtgugcacttgcaugg

SEQ ID NO: 24608 - DNA, 27 bp, Artificial Sequence
  Synthetic
ctgatcagccutaagttauaacccaaa

SEQ ID NO: 24609 - DNA, 27 bp, Artificial Sequence
  Synthetic
cttgcacattttuctgctcattatguc

SEQ ID NO: 24610 - DNA, 27 bp, Artificial Sequence
  Synthetic
tccatcgtaatgucatattgtggctuc

SEQ ID NO: 24611 - DNA, 25 bp, Artificial Sequence
  Synthetic
caagagaauacggagagcccuagat

SEQ ID NO: 24612 - DNA, 30 bp, Artificial Sequence
  Synthetic
tcagttataacaagcugaatgctacatgut

SEQ ID NO: 24613 - DNA, 25 bp, Artificial Sequence
  Synthetic
ctatggatttcugtggtgcagtgua

SEQ ID NO: 24614 - DNA, 22 bp, Artificial Sequence
  Synthetic
gcaataugcggaaagctgugaa

SEQ ID NO: 24615 - DNA, 23 bp, Artificial Sequence
  Synthetic
atgagggcttugtggatgatcuc

SEQ ID NO: 24616 - DNA, 26 bp, Artificial Sequence
  Synthetic
gggagtacaggauacattcaagctut

SEQ ID NO: 24617 - DNA, 28 bp, Artificial Sequence
  Synthetic
aggatgtugcaaaggauaaatatgtgua

SEQ ID NO: 24618 - DNA, 23 bp, Artificial Sequence
  Synthetic
ccttagaaauccgagctgtucca

SEQ ID NO: 24619 - DNA, 17 bp, Artificial Sequence
  Synthetic
gccatggucccagccut

SEQ ID NO: 24620 - DNA, 29 bp, Artificial Sequence
  Synthetic
agctttctctcauggatgtaaaatgugaa

SEQ ID NO: 24621 - DNA, 23 bp, Artificial Sequence
  Synthetic
ggagttcagcuttgggagttugt

SEQ ID NO: 24622 - DNA, 22 bp, Artificial Sequence
  Synthetic
ggattttgugaacgtugccaca

SEQ ID NO: 24623 - DNA, 20 bp, Artificial Sequence
  Synthetic
aggcctcugctgtagtccut

SEQ ID NO: 24624 - DNA, 24 bp, Artificial Sequence
  Synthetic
ggtgaccccuatgtggtacuaact

SEQ ID NO: 24625 - DNA, 20 bp, Artificial Sequence
  Synthetic
aacauggtgctuccaagggt

SEQ ID NO: 24626 - DNA, 22 bp, Artificial Sequence
  Synthetic
cgcctgugatcatttuggcaat

SEQ ID NO: 24627 - DNA, 22 bp, Artificial Sequence
  Synthetic
gcaccatgaugactgacagcuc

SEQ ID NO: 24628 - DNA, 22 bp, Artificial Sequence
  Synthetic
tcaggctcutttctgggttucc

SEQ ID NO: 24629 - DNA, 21 bp, Artificial Sequence
  Synthetic
cgaugcaagtgcucaaacacc

SEQ ID NO: 24630 - DNA, 22 bp, Artificial Sequence
  Synthetic
gtctcctccugacacctgttug

SEQ ID NO: 24631 - DNA, 27 bp, Artificial Sequence
  Synthetic
gtcaatctgaaugtccttagugaaggg

SEQ ID NO: 24632 - DNA, 18 bp, Artificial Sequence
  Synthetic
ggugcacaggacgucact

SEQ ID NO: 24633 - DNA, 17 bp, Artificial Sequence
  Synthetic
gcgccccutctccacuc

SEQ ID NO: 24634 - DNA, 21 bp, Artificial Sequence
  Synthetic
agagucacccatcauccaagt

SEQ ID NO: 24635 - DNA, 22 bp, Artificial Sequence
  Synthetic
gattcagcuttgtggccucaag

SEQ ID NO: 24636 - DNA, 20 bp, Artificial Sequence
  Synthetic
ccgttugaagagagcucgca

SEQ ID NO: 24637 - DNA, 28 bp, Artificial Sequence
  Synthetic
tctttatagcttguccttgttctccuaa

SEQ ID NO: 24638 - DNA, 21 bp, Artificial Sequence
  Synthetic
aagguaccagggctgagauga

SEQ ID NO: 24639 - DNA, 29 bp, Artificial Sequence
  Synthetic
tctctttctaaagcauctgttttctcucc

SEQ ID NO: 24640 - DNA, 23 bp, Artificial Sequence
  Synthetic
cctgggtccuctttaaagtguca

SEQ ID NO: 24641 - DNA, 29 bp, Artificial Sequence
  Synthetic
gcctcatgaaagccuttatctttttacut

SEQ ID NO: 24642 - DNA, 23 bp, Artificial Sequence
  Synthetic
cuccccaaauaaagcagagtgua

SEQ ID NO: 24643 - DNA, 31 bp, Artificial Sequence
  Synthetic
gcaatgctaaccauctttaacatctatctut

SEQ ID NO: 24644 - DNA, 22 bp, Artificial Sequence
  Synthetic
gctgacagccaggcuttcttua

SEQ ID NO: 24645 - DNA, 21 bp, Artificial Sequence
  Synthetic
ccaggacgucgatgaacugat

SEQ ID NO: 24646 - DNA, 25 bp, Artificial Sequence
  Synthetic
gcatgctgguccactatgaagauat

SEQ ID NO: 24647 - DNA, 30 bp, Artificial Sequence
  Synthetic
atgtctgataatuaacattttctaccugca

SEQ ID NO: 24648 - DNA, 22 bp, Artificial Sequence
  Synthetic
agaggctgacaugtcctgagua

SEQ ID NO: 24649 - DNA, 27 bp, Artificial Sequence
  Synthetic
accaggaagauaccggatgtaaattuc

SEQ ID NO: 24650 - DNA, 22 bp, Artificial Sequence
  Synthetic
ctggaacucactgcctcttuct

SEQ ID NO: 24651 - DNA, 20 bp, Artificial Sequence
  Synthetic
gccucacagcccaaagacuc

SEQ ID NO: 24652 - DNA, 25 bp, Artificial Sequence
  Synthetic
ctgctgacugacatttagcttgtug

SEQ ID NO: 24653 - DNA, 32 bp, Artificial Sequence
  Synthetic
tgatatcaatgutactccagauaaaaggcaaa

SEQ ID NO: 24654 - DNA, 30 bp, Artificial Sequence
  Synthetic
aaaagctctcaggauaaaatgttcaatugt

SEQ ID NO: 24655 - DNA, 25 bp, Artificial Sequence
  Synthetic
gcaaagccucattccttttgtucag

SEQ ID NO: 24656 - DNA, 30 bp, Artificial Sequence
  Synthetic
tactcttgaaaaucaggautaatttacugt

SEQ ID NO: 24657 - DNA, 31 bp, Artificial Sequence
  Synthetic
actgatgtttgaucacaatgggaaaattauc

SEQ ID NO: 24658 - DNA, 26 bp, Artificial Sequence
  Synthetic
tttcttcttcuaccccacatccatug

SEQ ID NO: 24659 - DNA, 23 bp, Artificial Sequence
  Synthetic
aaaaactgauagcatggguccgt

SEQ ID NO: 24660 - DNA, 20 bp, Artificial Sequence
  Synthetic
gaaacagugccgucggaaac

SEQ ID NO: 24661 - DNA, 29 bp, Artificial Sequence
  Synthetic
gcttccgagaaautgatgagctaauaaaa

SEQ ID NO: 24662 - DNA, 28 bp, Artificial Sequence
  Synthetic
ttcagagaaaacugatttccatggcuat

SEQ ID NO: 24663 - DNA, 28 bp, Artificial Sequence
  Synthetic
tgaatccugaaacaaagagaccauacac

SEQ ID NO: 24664 - DNA, 17 bp, Artificial Sequence
  Synthetic
ggaggugacggcucagg

SEQ ID NO: 24665 - DNA, 21 bp, Artificial Sequence
  Synthetic
ctaaccaatguggccgtggua

SEQ ID NO: 24666 - DNA, 17 bp, Artificial Sequence
  Synthetic
gctgcguctgtggguca

SEQ ID NO: 24667 - DNA, 17 bp, Artificial Sequence
  Synthetic
gcagaggguacggcugg

SEQ ID NO: 24668 - DNA, 23 bp, Artificial Sequence
  Synthetic
agggaagggucatgaucagaagg

SEQ ID NO: 24669 - DNA, 27 bp, Artificial Sequence
  Synthetic
acgcattgacguagaagagaauaacag

SEQ ID NO: 24670 - DNA, 20 bp, Artificial Sequence
  Synthetic
ggccaguaacccaccttcug

SEQ ID NO: 24671 - DNA, 21 bp, Artificial Sequence
  Synthetic
gaagtagccucccacgaugag

SEQ ID NO: 24672 - DNA, 21 bp, Artificial Sequence
  Synthetic
acctgtcuacgttcccucact

SEQ ID NO: 24673 - DNA, 18 bp, Artificial Sequence
  Synthetic
ccaggugctcauggcgat

SEQ ID NO: 24674 - DNA, 24 bp, Artificial Sequence
  Synthetic
gggaagatgaauggcactgacuat

SEQ ID NO: 24675 - DNA, 21 bp, Artificial Sequence
  Synthetic
gagccaccaucttggugacat

SEQ ID NO: 24676 - DNA, 18 bp, Artificial Sequence
  Synthetic
cccugcccccaguaccat

SEQ ID NO: 24677 - DNA, 21 bp, Artificial Sequence
  Synthetic
ctgggcagaaauggatccuga

SEQ ID NO: 24678 - DNA, 30 bp, Artificial Sequence
  Synthetic
tggtgtagaaagugataaaagaguaaccaa

SEQ ID NO: 24679 - DNA, 22 bp, Artificial Sequence
  Synthetic
gctcugggacagacatcugact

SEQ ID NO: 24680 - DNA, 24 bp, Artificial Sequence
  Synthetic
aaacgattggaucagcacagtgua

SEQ ID NO: 24681 - DNA, 29 bp, Artificial Sequence
  Synthetic
ttgaggttugtgtaaagaaugagcaaaag

SEQ ID NO: 24682 - DNA, 27 bp, Artificial Sequence
  Synthetic
cattgataatugaaaccgcaacaugga

SEQ ID NO: 24683 - DNA, 31 bp, Artificial Sequence
  Synthetic
gctcctgctgtugtaacattctttttaauaa

SEQ ID NO: 24684 - DNA, 30 bp, Artificial Sequence
  Synthetic
gttactaatttcuttccagttgtugcagaa

SEQ ID NO: 24685 - DNA, 27 bp, Artificial Sequence
  Synthetic
acatctaggutacctgagaaucacgaa

SEQ ID NO: 24686 - DNA, 33 bp, Artificial Sequence
  Synthetic
atttttacttttuagttttcaatauccaagcca

SEQ ID NO: 24687 - DNA, 24 bp, Artificial Sequence
  Synthetic
cttctctgaucgacactccttugt

SEQ ID NO: 24688 - DNA, 31 bp, Artificial Sequence
  Synthetic
tcaggaagttaaaugaagttcgaaagagaut

SEQ ID NO: 24689 - DNA, 28 bp, Artificial Sequence
  Synthetic
gctcggaatttucatgctcagaatcaua

SEQ ID NO: 24690 - DNA, 28 bp, Artificial Sequence
  Synthetic
tgtgctcttucctttaaaagttacuggt

SEQ ID NO: 24691 - DNA, 26 bp, Artificial Sequence
  Synthetic
ctagataatgaagcuccactgacucc

SEQ ID NO: 24692 - DNA, 29 bp, Artificial Sequence
  Synthetic
ccagtgcatcaaauttggatgatttcuac

SEQ ID NO: 24693 - DNA, 26 bp, Artificial Sequence
  Synthetic
tgaaggccaaaagcutaacataccut

SEQ ID NO: 24694 - DNA, 29 bp, Artificial Sequence
  Synthetic
cactagagccutagtgccatattuaaagt

SEQ ID NO: 24695 - DNA, 25 bp, Artificial Sequence
  Synthetic
gggttgaaguaacagctggcataua

SEQ ID NO: 24696 - DNA, 29 bp, Artificial Sequence
  Synthetic
ctccagaatgacauctgttttatgtcuct

SEQ ID NO: 24697 - DNA, 22 bp, Artificial Sequence
  Synthetic
ggaactggcaucttgctctuct

SEQ ID NO: 24698 - DNA, 25 bp, Artificial Sequence
  Synthetic
ggtgtcagagcuctcttacguagaa

SEQ ID NO: 24699 - DNA, 28 bp, Artificial Sequence
  Synthetic
ctttcatagcaaautttacctgctgguc

SEQ ID NO: 24700 - DNA, 27 bp, Artificial Sequence
  Synthetic
ctccttctcccaguttattttgtccut

SEQ ID NO: 24701 - DNA, 26 bp, Artificial Sequence
  Synthetic
ggcaatagacaaautacgttgtucca

SEQ ID NO: 24702 - DNA, 22 bp, Artificial Sequence
  Synthetic
aaaactgccugaagaggaggug

SEQ ID NO: 24703 - DNA, 29 bp, Artificial Sequence
  Synthetic
gcgtcttctuccgtttgtatctaatugat

SEQ ID NO: 24704 - DNA, 28 bp, Artificial Sequence
  Synthetic
ttgagttacctguactgttacacaaugg

SEQ ID NO: 24705 - DNA, 25 bp, Artificial Sequence
  Synthetic
gcaaggttcacaugtgctagacaua

SEQ ID NO: 24706 - DNA, 28 bp, Artificial Sequence
  Synthetic
ggtcttttatguattccagaaacuggga

SEQ ID NO: 24707 - DNA, 28 bp, Artificial Sequence
  Synthetic
gtctcaagtagtcugtgtttagtagcug

SEQ ID NO: 24708 - DNA, 27 bp, Artificial Sequence
  Synthetic
tgagagccaugaaaaaggagaaaaugt

SEQ ID NO: 24709 - DNA, 33 bp, Artificial Sequence
  Synthetic
ctacaattcactaaucattatcagcttacauca

SEQ ID NO: 24710 - DNA, 20 bp, Artificial Sequence
  Synthetic
gcagcuggaccggcaaatua

SEQ ID NO: 24711 - DNA, 30 bp, Artificial Sequence
  Synthetic
cgttgaactttaucacaataaggtcttcug

SEQ ID NO: 24712 - DNA, 28 bp, Artificial Sequence
  Synthetic
ggaaaatagaagcaacuggagtgauaca

SEQ ID NO: 24713 - DNA, 26 bp, Artificial Sequence
  Synthetic
actacttttgcugaggtaaaatguga

SEQ ID NO: 24714 - DNA, 30 bp, Artificial Sequence
  Synthetic
tgaggatgaagaaauggaagaattugaaga

SEQ ID NO: 24715 - DNA, 22 bp, Artificial Sequence
  Synthetic
gctgatggaagugtgtcaguca

SEQ ID NO: 24716 - DNA, 24 bp, Artificial Sequence
  Synthetic
cctaacccttugccgttacgttua

SEQ ID NO: 24717 - DNA, 29 bp, Artificial Sequence
  Synthetic
catagtcattcacuaacactggagatuca

SEQ ID NO: 24718 - DNA, 32 bp, Artificial Sequence
  Synthetic
atttttaattttcatuccaaaggcagatcuaa

SEQ ID NO: 24719 - DNA, 28 bp, Artificial Sequence
  Synthetic
actcttaccaggutcttttagtgtcuca

SEQ ID NO: 24720 - DNA, 30 bp, Artificial Sequence
  Synthetic
aggcactaaaauaaaaatggtcatcuaggg

SEQ ID NO: 24721 - DNA, 24 bp, Artificial Sequence
  Synthetic
ccagcagtutaagcacaaguacca

SEQ ID NO: 24722 - DNA, 21 bp, Artificial Sequence
  Synthetic
ctccugcaccatcatcuaggg

SEQ ID NO: 24723 - DNA, 26 bp, Artificial Sequence
  Synthetic
ccugaaaaagaacagccatuaaaggg

SEQ ID NO: 24724 - DNA, 24 bp, Artificial Sequence
  Synthetic
gtcaaggaaauccactggttcugt

SEQ ID NO: 24725 - DNA, 20 bp, Artificial Sequence
  Synthetic
atguccggagacacatggug

SEQ ID NO: 24726 - DNA, 28 bp, Artificial Sequence
  Synthetic
ctttccggugaaacattttctcacaaua

SEQ ID NO: 24727 - DNA, 28 bp, Artificial Sequence
  Synthetic
ctgtgttagcauagtagtttagctucca

SEQ ID NO: 24728 - DNA, 24 bp, Artificial Sequence
  Synthetic
acaaatcaccaggaaugacagugg

SEQ ID NO: 24729 - DNA, 26 bp, Artificial Sequence
  Synthetic
ccttuttgctttctttuacgaccaca

SEQ ID NO: 24730 - DNA, 22 bp, Artificial Sequence
  Synthetic
aaagccgugataugaagccact

SEQ ID NO: 24731 - DNA, 19 bp, Artificial Sequence
  Synthetic
augtgtccauggcgaccaa

SEQ ID NO: 24732 - DNA, 23 bp, Artificial Sequence
  Synthetic
ggagaaaggacuggtgaaaggug

SEQ ID NO: 24733 - DNA, 22 bp, Artificial Sequence
  Synthetic
catggtggcucctagtggtaug

SEQ ID NO: 24734 - DNA, 27 bp, Artificial Sequence
  Synthetic
gttcacatuggaaacattgctgattug

SEQ ID NO: 24735 - DNA, 23 bp, Artificial Sequence
  Synthetic
gagggcagtuacttgggaaacut

SEQ ID NO: 24736 - DNA, 21 bp, Artificial Sequence
  Synthetic
gcagaccguggagtacctgua

SEQ ID NO: 24737 - DNA, 20 bp, Artificial Sequence
  Synthetic
ctgtatcuggcctugcggaa

SEQ ID NO: 24738 - DNA, 30 bp, Artificial Sequence
  Synthetic
gcataaaagtuaaaagcaaacagcacuaga

SEQ ID NO: 24739 - DNA, 21 bp, Artificial Sequence
  Synthetic
gctaccaccagugccaugaac

SEQ ID NO: 24740 - DNA, 28 bp, Artificial Sequence
  Synthetic
gcaatgtgatgucaagtggtaaattcug

SEQ ID NO: 24741 - DNA, 29 bp, Artificial Sequence
  Synthetic
tcattttacagacautgtcccuaaacact

SEQ ID NO: 24742 - DNA, 23 bp, Artificial Sequence
  Synthetic
ctggcaggauctgtcttactguc

SEQ ID NO: 24743 - DNA, 22 bp, Artificial Sequence
  Synthetic
agctccuggatcagaagugact

SEQ ID NO: 24744 - DNA, 20 bp, Artificial Sequence
  Synthetic
cagctcuctcactgcucacg

SEQ ID NO: 24745 - DNA, 24 bp, Artificial Sequence
  Synthetic
agatgggaagcutggacucaaaag

SEQ ID NO: 24746 - DNA, 21 bp, Artificial Sequence
  Synthetic
aaactgacugggtgggatucg

SEQ ID NO: 24747 - DNA, 23 bp, Artificial Sequence
  Synthetic
gcaaccacucctcagggtaguaa

SEQ ID NO: 24748 - DNA, 30 bp, Artificial Sequence
  Synthetic
gctgcttttgtaauatctcctcttaactug

SEQ ID NO: 24749 - DNA, 21 bp, Artificial Sequence
  Synthetic
cucttgttgcugcacaaacga

SEQ ID NO: 24750 - DNA, 29 bp, Artificial Sequence
  Synthetic
actagcatcctuacagtcttctaaauaga

SEQ ID NO: 24751 - DNA, 24 bp, Artificial Sequence
  Synthetic
gttcccaugaaggaaagaccagut

SEQ ID NO: 24752 - DNA, 24 bp, Artificial Sequence
  Synthetic
tgatccactucaaccaagacacug

SEQ ID NO: 24753 - DNA, 27 bp, Artificial Sequence
  Synthetic
agtgtatatagcaucttgcatgtuggg

SEQ ID NO: 24754 - DNA, 24 bp, Artificial Sequence
  Synthetic
atgtgctaccucaagcatcauagg

SEQ ID NO: 24755 - DNA, 25 bp, Artificial Sequence
  Synthetic
gtcactcugtccttgaaauagcact

SEQ ID NO: 24756 - DNA, 22 bp, Artificial Sequence
  Synthetic
acaaagaagcacucatguggct

SEQ ID NO: 24757 - DNA, 24 bp, Artificial Sequence
  Synthetic
ggatgggagaaaauacctcugacc

SEQ ID NO: 24758 - DNA, 28 bp, Artificial Sequence
  Synthetic
agcatgatgagcuattagatctgaucct

SEQ ID NO: 24759 - DNA, 27 bp, Artificial Sequence
  Synthetic
acttatgcatgauttaccatcttugct

SEQ ID NO: 24760 - DNA, 26 bp, Artificial Sequence
  Synthetic
tccatcctuggcctttttctaacaut

SEQ ID NO: 24761 - DNA, 28 bp, Artificial Sequence
  Synthetic
catgctgcagaaaagcuaagatcaaaua

SEQ ID NO: 24762 - DNA, 30 bp, Artificial Sequence
  Synthetic
tttttcagagacaugagagaagttaucaaa

SEQ ID NO: 24763 - DNA, 32 bp, Artificial Sequence
  Synthetic
gctttcaccaacuaaattgccaagtataaaua

SEQ ID NO: 24764 - DNA, 25 bp, Artificial Sequence
  Synthetic
gcgcttggcautagtttttcaucaa

SEQ ID NO: 24765 - DNA, 25 bp, Artificial Sequence
  Synthetic
cccctcagcauggtatagtcuaaca

SEQ ID NO: 24766 - DNA, 29 bp, Artificial Sequence
  Synthetic
tctgtgagttugttattcctgtaucaaca

SEQ ID NO: 24767 - DNA, 25 bp, Artificial Sequence
  Synthetic
agcataagaaautgagtuccgcagt

SEQ ID NO: 24768 - DNA, 32 bp, Artificial Sequence
  Synthetic
atacataatauacctttcaatttguggaggct

SEQ ID NO: 24769 - DNA, 30 bp, Artificial Sequence
  Synthetic
acatgttttcttcautgtagacaatatgug

SEQ ID NO: 24770 - DNA, 22 bp, Artificial Sequence
  Synthetic
cgggaaaagccautctgcatut

SEQ ID NO: 24771 - DNA, 25 bp, Artificial Sequence
  Synthetic
tctctgagaagugaatgtacugagt

SEQ ID NO: 24772 - DNA, 27 bp, Artificial Sequence
  Synthetic
gttaggttctcucttgctgaagtacug

SEQ ID NO: 24773 - DNA, 22 bp, Artificial Sequence
  Synthetic
ccatagagauaaccccucgcua

SEQ ID NO: 24774 - DNA, 20 bp, Artificial Sequence
  Synthetic
caagatgccucacctcgcut

SEQ ID NO: 24775 - DNA, 18 bp, Artificial Sequence
  Synthetic
cugcagaaggccgtguct

SEQ ID NO: 24776 - DNA, 23 bp, Artificial Sequence
  Synthetic
gttacctagugcaactgggtcug

SEQ ID NO: 24777 - DNA, 23 bp, Artificial Sequence
  Synthetic
cgtacuaaggcggtgucaagaag

SEQ ID NO: 24778 - DNA, 21 bp, Artificial Sequence
  Synthetic
caagcacccaaucccguaaga

SEQ ID NO: 24779 - DNA, 22 bp, Artificial Sequence
  Synthetic
tccaccucagcattaccgttug

SEQ ID NO: 24780 - DNA, 21 bp, Artificial Sequence
  Synthetic
gagtcaacaggugaggtggug

SEQ ID NO: 24781 - DNA, 22 bp, Artificial Sequence
  Synthetic
ccgtcctcucattcctgtcaut

SEQ ID NO: 24782 - DNA, 26 bp, Artificial Sequence
  Synthetic
ctgaaacucaaaagcctgaaaugact

SEQ ID NO: 24783 - DNA, 23 bp, Artificial Sequence
  Synthetic
tggatgugaagacgcaatcuagg

SEQ ID NO: 24784 - DNA, 28 bp, Artificial Sequence
  Synthetic
atttgtctgttccutaccttgacaauat

SEQ ID NO: 24785 - DNA, 23 bp, Artificial Sequence
  Synthetic
aggaaatuagcagagcgatuggt

SEQ ID NO: 24786 - DNA, 24 bp, Artificial Sequence
  Synthetic
gggaggatauctgattgttggaug

SEQ ID NO: 24787 - DNA, 23 bp, Artificial Sequence
  Synthetic
ggagcaauaaggtaaccagcuga

SEQ ID NO: 24788 - DNA, 26 bp, Artificial Sequence
  Synthetic
tctcctgtaggacutggttccataut

SEQ ID NO: 24789 - DNA, 29 bp, Artificial Sequence
  Synthetic
aaaattttcacaguaaggatcttcucaga

SEQ ID NO: 24790 - DNA, 28 bp, Artificial Sequence
  Synthetic
caagttctgauacattgaagacuccaga

SEQ ID NO: 24791 - DNA, 28 bp, Artificial Sequence
  Synthetic
tgttcaaaccatuggctttaaaacacut

SEQ ID NO: 24792 - DNA, 21 bp, Artificial Sequence
  Synthetic
gauccagacgccagacttugt

SEQ ID NO: 24793 - DNA, 21 bp, Artificial Sequence
  Synthetic
cutgccaaacugcgcaaagat

SEQ ID NO: 24794 - DNA, 26 bp, Artificial Sequence
  Synthetic
agtgagacagaugggagaatacauca

SEQ ID NO: 24795 - DNA, 20 bp, Artificial Sequence
  Synthetic
gagccccgucctgattgauc

SEQ ID NO: 24796 - DNA, 24 bp, Artificial Sequence
  Synthetic
tggttttatucgcttcctcaugct

SEQ ID NO: 24797 - DNA, 26 bp, Artificial Sequence
  Synthetic
ctcagauacggcgattcaaagtuagt

SEQ ID NO: 24798 - DNA, 33 bp, Artificial Sequence
  Synthetic
tcccttaaatttacauactcataagatcatgug

SEQ ID NO: 24799 - DNA, 28 bp, Artificial Sequence
  Synthetic
cgacttcaaaggauacatgctgagatua

SEQ ID NO: 24800 - DNA, 22 bp, Artificial Sequence
  Synthetic
cctcauacaggacactggctuc

SEQ ID NO: 24801 - DNA, 25 bp, Artificial Sequence
  Synthetic
tgaggaagacuctgatgtggatgut

SEQ ID NO: 24802 - DNA, 26 bp, Artificial Sequence
  Synthetic
acaatctccugagcagtcttagtgua

SEQ ID NO: 24803 - DNA, 26 bp, Artificial Sequence
  Synthetic
gtcaauccagtggattuagagaccat

SEQ ID NO: 24804 - DNA, 23 bp, Artificial Sequence
  Synthetic
cagatgctcuctgaactctuccc

SEQ ID NO: 24805 - DNA, 27 bp, Artificial Sequence
  Synthetic
acatgagagaucttccaaauacacacc

SEQ ID NO: 24806 - DNA, 23 bp, Artificial Sequence
  Synthetic
tcttctgtcauggcaacaggtut

SEQ ID NO: 24807 - DNA, 24 bp, Artificial Sequence
  Synthetic
ccaagaaaaugaaagagcgtccug

SEQ ID NO: 24808 - DNA, 25 bp, Artificial Sequence
  Synthetic
catactcttucccctcttcatcucg

SEQ ID NO: 24809 - DNA, 21 bp, Artificial Sequence
  Synthetic
ctacggcgaaugctactggua

SEQ ID NO: 24810 - DNA, 23 bp, Artificial Sequence
  Synthetic
gagcctgttcugttgacattgug

SEQ ID NO: 24811 - DNA, 21 bp, Artificial Sequence
  Synthetic
aggaacagaugcagacctucg

SEQ ID NO: 24812 - DNA, 23 bp, Artificial Sequence
  Synthetic
ggauttctcaccauagccagcat

SEQ ID NO: 24813 - DNA, 23 bp, Artificial Sequence
  Synthetic
tcaaactggugggtgcttaaguc

SEQ ID NO: 24814 - DNA, 32 bp, Artificial Sequence
  Synthetic
aaatatccactaautcccgaatataguaaccc

SEQ ID NO: 24815 - DNA, 23 bp, Artificial Sequence
  Synthetic
ctctctccaucctggccaatuac

SEQ ID NO: 24816 - DNA, 21 bp, Artificial Sequence
  Synthetic
ggcugagagagugcaccaaat

SEQ ID NO: 24817 - DNA, 29 bp, Artificial Sequence
  Synthetic
tggagggaatatuatccagcattcaatuc

SEQ ID NO: 24818 - DNA, 26 bp, Artificial Sequence
  Synthetic
ttggtactccauttttcccatugaca

SEQ ID NO: 24819 - DNA, 25 bp, Artificial Sequence
  Synthetic
gaggttctcaucattgggaucaagt

SEQ ID NO: 24820 - DNA, 32 bp, Artificial Sequence
  Synthetic
aagtttcctaaattccuccatcattctagaut

SEQ ID NO: 24821 - DNA, 23 bp, Artificial Sequence
  Synthetic
cagauaccaaaccaagaguggct

SEQ ID NO: 24822 - DNA, 24 bp, Artificial Sequence
  Synthetic
gacattctuccctgguccaaaaag

SEQ ID NO: 24823 - DNA, 23 bp, Artificial Sequence
  Synthetic
cccttccatuggctgggattaug

SEQ ID NO: 24824 - DNA, 30 bp, Artificial Sequence
  Synthetic
catcatagtcaucttcatcataauccgagt

SEQ ID NO: 24825 - DNA, 20 bp, Artificial Sequence
  Synthetic
ggcggugccttggtaaauga

SEQ ID NO: 24826 - DNA, 20 bp, Artificial Sequence
  Synthetic
agtcgcccggaagugatcua

SEQ ID NO: 24827 - DNA, 18 bp, Artificial Sequence
  Synthetic
gcgacgtugcgagacucc

SEQ ID NO: 24828 - DNA, 17 bp, Artificial Sequence
  Synthetic
gctgccugctguggaga

SEQ ID NO: 24829 - DNA, 27 bp, Artificial Sequence
  Synthetic
ctgtgatttgtugctttgattccucag

SEQ ID NO: 24830 - DNA, 21 bp, Artificial Sequence
  Synthetic
ctgctgtgugaacaagtcucc

SEQ ID NO: 24831 - DNA, 22 bp, Artificial Sequence
  Synthetic
tctcagggtcugacctgtctut

SEQ ID NO: 24832 - DNA, 21 bp, Artificial Sequence
  Synthetic
ccatcccuccaaauccccaac

SEQ ID NO: 24833 - DNA, 25 bp, Artificial Sequence
  Synthetic
gctgaatauaaacgccaaaauccca

SEQ ID NO: 24834 - DNA, 20 bp, Artificial Sequence
  Synthetic
tgtcccggaguttgcacauc

SEQ ID NO: 24835 - DNA, 25 bp, Artificial Sequence
  Synthetic
aacttttcccugtccattccaucaa

SEQ ID NO: 24836 - DNA, 27 bp, Artificial Sequence
  Synthetic
tggaaatctccugaaaacttgtgtcut

SEQ ID NO: 24837 - DNA, 31 bp, Artificial Sequence
  Synthetic
gtguggaccaaaataaacuaaaagaaccaat

SEQ ID NO: 24838 - DNA, 31 bp, Artificial Sequence
  Synthetic
tgttgtgtgacatucttagagtatgaagtut

SEQ ID NO: 24839 - DNA, 22 bp, Artificial Sequence
  Synthetic
agctcaaccuctgcaguaacag

SEQ ID NO: 24840 - DNA, 28 bp, Artificial Sequence
  Synthetic
gcttaguaaacacaccauaatcaatcut

SEQ ID NO: 24841 - DNA, 27 bp, Artificial Sequence
  Synthetic
caagactaucccaaatattccgaugca

SEQ ID NO: 24842 - DNA, 20 bp, Artificial Sequence
  Synthetic
ctctttgccuggctcuaggt

SEQ ID NO: 24843 - DNA, 22 bp, Artificial Sequence
  Synthetic
gagggatucgaaggtggaaguc

SEQ ID NO: 24844 - DNA, 18 bp, Artificial Sequence
  Synthetic
tgcuagggccagaaugcc

SEQ ID NO: 24845 - DNA, 17 bp, Artificial Sequence
  Synthetic
agccccaccuggacuca

SEQ ID NO: 24846 - DNA, 20 bp, Artificial Sequence
  Synthetic
cgagucggaggaaucagacc

SEQ ID NO: 24847 - DNA, 28 bp, Artificial Sequence
  Synthetic
agcaggtaaauggacaagaacactttua

SEQ ID NO: 24848 - DNA, 23 bp, Artificial Sequence
  Synthetic
gccagaggaaaugggttgtttut

SEQ ID NO: 24849 - DNA, 23 bp, Artificial Sequence
  Synthetic
cctcatcggaaucaagctcagug

SEQ ID NO: 24850 - DNA, 23 bp, Artificial Sequence
  Synthetic
caattgccuccacaaagtcugag

SEQ ID NO: 24851 - DNA, 28 bp, Artificial Sequence
  Synthetic
tgcaaagttctuctctctttccatugaa

SEQ ID NO: 24852 - DNA, 22 bp, Artificial Sequence
  Synthetic
gttugcaccaggagtttguagg

SEQ ID NO: 24853 - DNA, 21 bp, Artificial Sequence
  Synthetic
gtccttcuggctgcgagtuat

SEQ ID NO: 24854 - DNA, 27 bp, Artificial Sequence
  Synthetic
aagtagaagcaauctgatgaacuccaa

SEQ ID NO: 24855 - DNA, 22 bp, Artificial Sequence
  Synthetic
ctgtacgaaguggacactcuca

SEQ ID NO: 24856 - DNA, 23 bp, Artificial Sequence
  Synthetic
ataaguccacaggcugaaagagt

SEQ ID NO: 24857 - DNA, 25 bp, Artificial Sequence
  Synthetic
ctcattttucctgcaattcucagca

SEQ ID NO: 24858 - DNA, 22 bp, Artificial Sequence
  Synthetic
tgatguccccaaagctctctuc

SEQ ID NO: 24859 - DNA, 25 bp, Artificial Sequence
  Synthetic
tctaatgccaccaucctctgtttut

SEQ ID NO: 24860 - DNA, 23 bp, Artificial Sequence
  Synthetic
aggaaagcaccutttgaguggag

SEQ ID NO: 24861 - DNA, 22 bp, Artificial Sequence
  Synthetic
gtgtcaccugagatctgtgcug

SEQ ID NO: 24862 - DNA, 27 bp, Artificial Sequence
  Synthetic
ctgccagtgcauatactttctggauaa

SEQ ID NO: 24863 - DNA, 23 bp, Artificial Sequence
  Synthetic
gutctctcugaaacacacaagcc

SEQ ID NO: 24864 - DNA, 21 bp, Artificial Sequence
  Synthetic
aaagaagaggccaugcgtuag

SEQ ID NO: 24865 - DNA, 29 bp, Artificial Sequence
  Synthetic
tttgtgttacaaaucaggagagcttauca

SEQ ID NO: 24866 - DNA, 23 bp, Artificial Sequence
  Synthetic
gagagtcugaaatgcacctugga

SEQ ID NO: 24867 - DNA, 17 bp, Artificial Sequence
  Synthetic
gcagcggcugtaucggt

SEQ ID NO: 24868 - DNA, 29 bp, Artificial Sequence
  Synthetic
ggactcacaatuacaagcctgtttctaut

SEQ ID NO: 24869 - DNA, 23 bp, Artificial Sequence
  Synthetic
ctgatagcacgutcctcgagtut

SEQ ID NO: 24870 - DNA, 24 bp, Artificial Sequence
  Synthetic
aatacaccacggagaucaugaacc

SEQ ID NO: 24871 - DNA, 21 bp, Artificial Sequence
  Synthetic
tgcauttgguacacgcaggaa

SEQ ID NO: 24872 - DNA, 20 bp, Artificial Sequence
  Synthetic
cgttaugggacgaggcacug

SEQ ID NO: 24873 - DNA, 17 bp, Artificial Sequence
  Synthetic
ggcgagggcutgaagug

SEQ ID NO: 24874 - DNA, 17 bp, Artificial Sequence
  Synthetic
cctgcugggcgagaguc

SEQ ID NO: 24875 - DNA, 21 bp, Artificial Sequence
  Synthetic
gctcacctugaaaaagcccut

SEQ ID NO: 24876 - DNA, 30 bp, Artificial Sequence
  Synthetic
tgattgctcaacugtaatgtgtttttatuc

SEQ ID NO: 24877 - DNA, 21 bp, Artificial Sequence
  Synthetic
agacgaccuctcctcccttuc

SEQ ID NO: 24878 - DNA, 23 bp, Artificial Sequence
  Synthetic
gaagcaggauaatgctgctcuct

SEQ ID NO: 24879 - DNA, 23 bp, Artificial Sequence
  Synthetic
gggagaucagtaaaucccggaat

SEQ ID NO: 24880 - DNA, 26 bp, Artificial Sequence
  Synthetic
gacacagaccucaattagggatucaa

SEQ ID NO: 24881 - DNA, 23 bp, Artificial Sequence
  Synthetic
gtcccttacuctggtggtcttut

SEQ ID NO: 24882 - DNA, 23 bp, Artificial Sequence
  Synthetic
catgtgataccaaucaggccuct

SEQ ID NO: 24883 - DNA, 21 bp, Artificial Sequence
  Synthetic
gggatgagcutcctcagctug

SEQ ID NO: 24884 - DNA, 23 bp, Artificial Sequence
  Synthetic
tggacagacutttgcatgtucca

SEQ ID NO: 24885 - DNA, 19 bp, Artificial Sequence
  Synthetic
ggtaggccgcuctaccuga

SEQ ID NO: 24886 - DNA, 31 bp, Artificial Sequence
  Synthetic
ctatcattgtcaacauctcttttcattugct

SEQ ID NO: 24887 - DNA, 25 bp, Artificial Sequence
  Synthetic
gcgatcaattcugacctcttcugaa

SEQ ID NO: 24888 - DNA, 24 bp, Artificial Sequence
  Synthetic
tatagggaguttgggtgttaugga

SEQ ID NO: 24889 - DNA, 25 bp, Artificial Sequence
  Synthetic
acctgcaucagaatggtcaguaaac

SEQ ID NO: 24890 - DNA, 17 bp, Artificial Sequence
  Synthetic
gccggaaaugcgagguc

SEQ ID NO: 24891 - DNA, 19 bp, Artificial Sequence
  Synthetic
gcatccauctcgtcuccca

SEQ ID NO: 24892 - DNA, 27 bp, Artificial Sequence
  Synthetic
gtggcttgcagauttttcctacuaaaa

SEQ ID NO: 24893 - DNA, 26 bp, Artificial Sequence
  Synthetic
agaaugacttctugggaaggaaacac

SEQ ID NO: 24894 - DNA, 23 bp, Artificial Sequence
  Synthetic
gcaaaaacgcccauttgcctauc

SEQ ID NO: 24895 - DNA, 28 bp, Artificial Sequence
  Synthetic
gaagagttgcacauactttcactgttuc

SEQ ID NO: 24896 - DNA, 24 bp, Artificial Sequence
  Synthetic
aaaaagtcatuccttgtccuccgt

SEQ ID NO: 24897 - DNA, 21 bp, Artificial Sequence
  Synthetic
ccaauacctcacugagcaggt

SEQ ID NO: 24898 - DNA, 25 bp, Artificial Sequence
  Synthetic
cacggagagacagcaucattacuac

SEQ ID NO: 24899 - DNA, 28 bp, Artificial Sequence
  Synthetic
caatcagaaaagauttcaacaugggaca

SEQ ID NO: 24900 - DNA, 23 bp, Artificial Sequence
  Synthetic
gctcaggcccutaaattcactug

SEQ ID NO: 24901 - DNA, 29 bp, Artificial Sequence
  Synthetic
gagagactuaaccccaggattttgatuaa

SEQ ID NO: 24902 - DNA, 27 bp, Artificial Sequence
  Synthetic
tgttctccttuggttcttcatcttuga

SEQ ID NO: 24903 - DNA, 21 bp, Artificial Sequence
  Synthetic
gcuagggaggcttuagaaggg

SEQ ID NO: 24904 - DNA, 22 bp, Artificial Sequence
  Synthetic
ccattctcutctgccuccaagc

SEQ ID NO: 24905 - DNA, 23 bp, Artificial Sequence
  Synthetic
agggctgagguctaaagttguct

SEQ ID NO: 24906 - DNA, 26 bp, Artificial Sequence
  Synthetic
gtaagcacgauagcagtgacatuact

SEQ ID NO: 24907 - DNA, 22 bp, Artificial Sequence
  Synthetic
tgttcgcagcaucttcatcucc

SEQ ID NO: 24908 - DNA, 26 bp, Artificial Sequence
  Synthetic
gactgtttugatacatctucccccaa

SEQ ID NO: 24909 - DNA, 28 bp, Artificial Sequence
  Synthetic
tctagaacaucattcacatctuggacag

SEQ ID NO: 24910 - DNA, 22 bp, Artificial Sequence
  Synthetic
gcctccgauctttcagctccua

SEQ ID NO: 24911 - DNA, 28 bp, Artificial Sequence
  Synthetic
gttaaaagacugggaaggatgcaatuac

SEQ ID NO: 24912 - DNA, 23 bp, Artificial Sequence
  Synthetic
gaagtcagcucaacgtcatcugt

SEQ ID NO: 24913 - DNA, 23 bp, Artificial Sequence
  Synthetic
atttagcaaaaggugctgcaugg

SEQ ID NO: 24914 - DNA, 30 bp, Artificial Sequence
  Synthetic
tttgctggaattaauatggtgttctctcut

SEQ ID NO: 24915 - DNA, 25 bp, Artificial Sequence
  Synthetic
gaaacacacugcagtcagaacauac

SEQ ID NO: 24916 - DNA, 25 bp, Artificial Sequence
  Synthetic
ccauaattucagggauagccaagat

SEQ ID NO: 24917 - DNA, 26 bp, Artificial Sequence
  Synthetic
gggaagctaautgctagtaattugcc

SEQ ID NO: 24918 - DNA, 20 bp, Artificial Sequence
  Synthetic
gcatcuagcagcagaccugt

SEQ ID NO: 24919 - DNA, 24 bp, Artificial Sequence
  Synthetic
gtcctgaaaaacutcccagaguct

SEQ ID NO: 24920 - DNA, 25 bp, Artificial Sequence
  Synthetic
agttttggugggacatctctaagug

SEQ ID NO: 24921 - DNA, 24 bp, Artificial Sequence
  Synthetic
aggaggcuaccaaatgacaatgug

SEQ ID NO: 24922 - DNA, 21 bp, Artificial Sequence
  Synthetic
ctggcacugcagcatctagua

SEQ ID NO: 24923 - DNA, 21 bp, Artificial Sequence
  Synthetic
ggccugcacttgagauagcag

SEQ ID NO: 24924 - DNA, 19 bp, Artificial Sequence
  Synthetic
cgcaccaaguctgttuggg

SEQ ID NO: 24925 - DNA, 22 bp, Artificial Sequence
  Synthetic
ccgaaggutgtctguccaaaga

SEQ ID NO: 24926 - DNA, 20 bp, Artificial Sequence
  Synthetic
cucctgctttugggcagagt

SEQ ID NO: 24927 - DNA, 27 bp, Artificial Sequence
  Synthetic
cagagagggaaacaaguaaaaagctuc

SEQ ID NO: 24928 - DNA, 23 bp, Artificial Sequence
  Synthetic
gacatttgtcuccctctgaccuc

SEQ ID NO: 24929 - DNA, 19 bp, Artificial Sequence
  Synthetic
gccttgggaugccacacut

SEQ ID NO: 24930 - DNA, 22 bp, Artificial Sequence
  Synthetic
ccactgaccucagtctgttuct

SEQ ID NO: 24931 - DNA, 21 bp, Artificial Sequence
  Synthetic
agagaauccgctactcugggt

SEQ ID NO: 24932 - DNA, 19 bp, Artificial Sequence
  Synthetic
gttutggtggcuggcgaag

SEQ ID NO: 24933 - DNA, 27 bp, Artificial Sequence
  Synthetic
ccttgtgagtttuggtttctgttgtut

SEQ ID NO: 24934 - DNA, 18 bp, Artificial Sequence
  Synthetic
gcucaggcacctguagct

SEQ ID NO: 24935 - DNA, 19 bp, Artificial Sequence
  Synthetic
cctggcggugcacactaut

SEQ ID NO: 24936 - DNA, 19 bp, Artificial Sequence
  Synthetic
ctgctgcuggatgttugct

SEQ ID NO: 24937 - DNA, 19 bp, Artificial Sequence
  Synthetic
gctgcacaguagcctugct

SEQ ID NO: 24938 - DNA, 17 bp, Artificial Sequence
  Synthetic
acgaggugggccaguct

SEQ ID NO: 24939 - DNA, 17 bp, Artificial Sequence
  Synthetic
cagcaguctccguccgt

SEQ ID NO: 24940 - DNA, 18 bp, Artificial Sequence
  Synthetic
gggctugcggaccttcut

SEQ ID NO: 24941 - DNA, 20 bp, Artificial Sequence
  Synthetic
tgcaucacgacatcgugagg

SEQ ID NO: 24942 - DNA, 18 bp, Artificial Sequence
  Synthetic
tgggcucacccaggucat

SEQ ID NO: 24943 - DNA, 20 bp, Artificial Sequence
  Synthetic
agaucctgauccggaaccga

SEQ ID NO: 24944 - DNA, 22 bp, Artificial Sequence
  Synthetic
gttgtccuggatgttggcauct

SEQ ID NO: 24945 - DNA, 24 bp, Artificial Sequence
  Synthetic
cgtcatcuccgacttcatcuacca

SEQ ID NO: 24946 - DNA, 24 bp, Artificial Sequence
  Synthetic
ctccucgaactacauagagggagt

SEQ ID NO: 24947 - DNA, 19 bp, Artificial Sequence
  Synthetic
cttcagacggugcccucat

SEQ ID NO: 24948 - DNA, 18 bp, Artificial Sequence
  Synthetic
gctcacacccguggguag

SEQ ID NO: 24949 - DNA, 21 bp, Artificial Sequence
  Synthetic
cagccucaacatccccuacaa

SEQ ID NO: 24950 - DNA, 17 bp, Artificial Sequence
  Synthetic
ctgtugcgcagctgcuc

SEQ ID NO: 24951 - DNA, 22 bp, Artificial Sequence
  Synthetic
ccagtacugcaaggaccactuc

SEQ ID NO: 24952 - DNA, 19 bp, Artificial Sequence
  Synthetic
cacccccgaagcugtaguc

SEQ ID NO: 24953 - DNA, 18 bp, Artificial Sequence
  Synthetic
ccccgaaugccagtuccc

SEQ ID NO: 24954 - DNA, 20 bp, Artificial Sequence
  Synthetic
guaagagcagggcagugaga

SEQ ID NO: 24955 - DNA, 19 bp, Artificial Sequence
  Synthetic
gtcaacgagugcctgucca

SEQ ID NO: 24956 - DNA, 21 bp, Artificial Sequence
  Synthetic
gcaggagcacutgtaggtgut

SEQ ID NO: 24957 - DNA, 18 bp, Artificial Sequence
  Synthetic
cgttcugtcgccugcaca

SEQ ID NO: 24958 - DNA, 17 bp, Artificial Sequence
  Synthetic
tgggcacgucgcaguaa

SEQ ID NO: 24959 - DNA, 20 bp, Artificial Sequence
  Synthetic
ccagcugaccccaatctguc

SEQ ID NO: 24960 - DNA, 19 bp, Artificial Sequence
  Synthetic
tgtagctguccacgcaguc

SEQ ID NO: 24961 - DNA, 19 bp, Artificial Sequence
  Synthetic
ggcaucaacacggcctuct

SEQ ID NO: 24962 - DNA, 17 bp, Artificial Sequence
  Synthetic
ctggccagccucaccut

SEQ ID NO: 24963 - DNA, 20 bp, Artificial Sequence
  Synthetic
gtcacgtgugtctcctuccc

SEQ ID NO: 24964 - DNA, 24 bp, Artificial Sequence
  Synthetic
aagggttggautcacactcatugt

SEQ ID NO: 24965 - DNA, 19 bp, Artificial Sequence
  Synthetic
gccagcccauagggcatug

SEQ ID NO: 24966 - DNA, 17 bp, Artificial Sequence
  Synthetic
ggcacgugtcggucagt

SEQ ID NO: 24967 - DNA, 21 bp, Artificial Sequence
  Synthetic
caacaucaacgagtgcuccag

SEQ ID NO: 24968 - DNA, 21 bp, Artificial Sequence
  Synthetic
cactuggcaccattctugcag

SEQ ID NO: 24969 - DNA, 21 bp, Artificial Sequence
  Synthetic
ctgaagggccauagtgctgut

SEQ ID NO: 24970 - DNA, 19 bp, Artificial Sequence
  Synthetic
ggttggugtcgcagtugga

SEQ ID NO: 24971 - DNA, 17 bp, Artificial Sequence
  Synthetic
ggtggugtgccaugcct

SEQ ID NO: 24972 - DNA, 20 bp, Artificial Sequence
  Synthetic
gcggcagutgtaggtgtuca

SEQ ID NO: 24973 - DNA, 20 bp, Artificial Sequence
  Synthetic
ggacuggaccucagggaaga

SEQ ID NO: 24974 - DNA, 18 bp, Artificial Sequence
  Synthetic
cctcaggcugtgggucct

SEQ ID NO: 24975 - DNA, 17 bp, Artificial Sequence
  Synthetic
ctgtgcccugggctuct

SEQ ID NO: 24976 - DNA, 30 bp, Artificial Sequence
  Synthetic
aactcactattctutgggaaacatcatuct

SEQ ID NO: 24977 - DNA, 23 bp, Artificial Sequence
  Synthetic
tccacctgtucatacagccauac

SEQ ID NO: 24978 - DNA, 24 bp, Artificial Sequence
  Synthetic
cagtttgacccutaagccugaaga

SEQ ID NO: 24979 - DNA, 21 bp, Artificial Sequence
  Synthetic
agctgugaggccacagataug

SEQ ID NO: 24980 - DNA, 21 bp, Artificial Sequence
  Synthetic
agcaaaccugccagtggtuat

SEQ ID NO: 24981 - DNA, 28 bp, Artificial Sequence
  Synthetic
tgattagtaacuaactccacctacugct

SEQ ID NO: 24982 - DNA, 30 bp, Artificial Sequence
  Synthetic
tgaaaccagtgagaaguttaagctcttaut

SEQ ID NO: 24983 - DNA, 20 bp, Artificial Sequence
  Synthetic
tggccuccaagtggtcatuc

SEQ ID NO: 24984 - DNA, 28 bp, Artificial Sequence
  Synthetic
ctgaatatguggctctgtccuagaaaag

SEQ ID NO: 24985 - DNA, 26 bp, Artificial Sequence
  Synthetic
ttccttgggacutccttctttgtaug

SEQ ID NO: 24986 - DNA, 21 bp, Artificial Sequence
  Synthetic
cctcccugcagtttgtgauct

SEQ ID NO: 24987 - DNA, 29 bp, Artificial Sequence
  Synthetic
gagccaagtaugacttcatatguaagaca

SEQ ID NO: 24988 - DNA, 28 bp, Artificial Sequence
  Synthetic
ctgttgttattucagaccaaaacctugt

SEQ ID NO: 24989 - DNA, 19 bp, Artificial Sequence
  Synthetic
cauggcgggaucgagacat

SEQ ID NO: 24990 - DNA, 19 bp, Artificial Sequence
  Synthetic
cuaaaccacccgugccagt

SEQ ID NO: 24991 - DNA, 22 bp, Artificial Sequence
  Synthetic
cttcguagcgccattguaaacc

SEQ ID NO: 24992 - DNA, 24 bp, Artificial Sequence
  Synthetic
acaacucagttttggucccaaaga

SEQ ID NO: 24993 - DNA, 27 bp, Artificial Sequence
  Synthetic
ccactggtatcautcaatgtctctuca

SEQ ID NO: 24994 - DNA, 26 bp, Artificial Sequence
  Synthetic
cctgacttgaaccutagaaactgcut

SEQ ID NO: 24995 - DNA, 28 bp, Artificial Sequence
  Synthetic
gtggtatcagaaacutcctgttgattug

SEQ ID NO: 24996 - DNA, 26 bp, Artificial Sequence
  Synthetic
tccaattgctaccuttaatgctccut

SEQ ID NO: 24997 - DNA, 27 bp, Artificial Sequence
  Synthetic
tgagtttgatgaugattgaggagtgug

SEQ ID NO: 24998 - DNA, 22 bp, Artificial Sequence
  Synthetic
ccaatggtcaguacctcctcut

SEQ ID NO: 24999 - DNA, 28 bp, Artificial Sequence
  Synthetic
ttcttttcttacagauctgatggctgut

SEQ ID NO: 25000 - DNA, 26 bp, Artificial Sequence
  Synthetic
guggacacaaaacaagaaaucacagt

SEQ ID NO: 25001 - DNA, 29 bp, Artificial Sequence
  Synthetic
acatgtttaatgccauttcttacggttug

SEQ ID NO: 25002 - DNA, 22 bp, Artificial Sequence
  Synthetic
gtattccagcagccuggcttua

SEQ ID NO: 25003 - DNA, 24 bp, Artificial Sequence
  Synthetic
gttgaacgggagauccatctttug

SEQ ID NO: 25004 - DNA, 28 bp, Artificial Sequence
  Synthetic
caccaaaacttaaucactgtccatctut

SEQ ID NO: 25005 - DNA, 27 bp, Artificial Sequence
  Synthetic
gaatattcatgugactttgtggaugct

SEQ ID NO: 25006 - DNA, 27 bp, Artificial Sequence
  Synthetic
cagatgatctaucatgtcaggaugcaa

SEQ ID NO: 25007 - DNA, 24 bp, Artificial Sequence
  Synthetic
aggcttgtuggtgtacttucaact

SEQ ID NO: 25008 - DNA, 25 bp, Artificial Sequence
  Synthetic
gcgacatttggauagcatcgaaaut

SEQ ID NO: 25009 - DNA, 25 bp, Artificial Sequence
  Synthetic
gtgagtgguggaaatactgtttugg

SEQ ID NO: 25010 - DNA, 22 bp, Artificial Sequence
  Synthetic
tgcatcagagacugccaacaut

SEQ ID NO: 25011 - DNA, 28 bp, Artificial Sequence
  Synthetic
ggaaaattctgaugttccaaaacuggat

SEQ ID NO: 25012 - DNA, 24 bp, Artificial Sequence
  Synthetic
agccttcaaguacagattgcaaut

SEQ ID NO: 25013 - DNA, 26 bp, Artificial Sequence
  Synthetic
ccatgagagcutttcccttcttuacc

SEQ ID NO: 25014 - DNA, 20 bp, Artificial Sequence
  Synthetic
ggtggtgcucatcatggugt

SEQ ID NO: 25015 - DNA, 25 bp, Artificial Sequence
  Synthetic
acttttcatugagggtgcatctuct

SEQ ID NO: 25016 - DNA, 25 bp, Artificial Sequence
  Synthetic
ctctcttaagautgtgctccaugct

SEQ ID NO: 25017 - DNA, 23 bp, Artificial Sequence
  Synthetic
tcatgttgtgaaugtccctgugg

SEQ ID NO: 25018 - DNA, 21 bp, Artificial Sequence
  Synthetic
cgtgtttcacucagcctgtuc

SEQ ID NO: 25019 - DNA, 26 bp, Artificial Sequence
  Synthetic
aaggcttactgutgtttgttgttgut

SEQ ID NO: 25020 - DNA, 19 bp, Artificial Sequence
  Synthetic
gtccccgaagacugctuca

SEQ ID NO: 25021 - DNA, 19 bp, Artificial Sequence
  Synthetic
tgcatuggcaccacugagt

SEQ ID NO: 25022 - DNA, 25 bp, Artificial Sequence
  Synthetic
cccacattgaugagtattggucaga

SEQ ID NO: 25023 - DNA, 22 bp, Artificial Sequence
  Synthetic
gggttggaugattacggtuggg

SEQ ID NO: 25024 - DNA, 29 bp, Artificial Sequence
  Synthetic
agtcctcugaagtaaatgaatugaaccaa

SEQ ID NO: 25025 - DNA, 24 bp, Artificial Sequence
  Synthetic
ctgcacuagcaaaggcatuaagag

SEQ ID NO: 25026 - DNA, 22 bp, Artificial Sequence
  Synthetic
gttgcatcucacctcaugggaa

SEQ ID NO: 25027 - DNA, 24 bp, Artificial Sequence
  Synthetic
caataacaaccccauctggucagt

SEQ ID NO: 25028 - DNA, 17 bp, Artificial Sequence
  Synthetic
cagggcccucctcagug

SEQ ID NO: 25029 - DNA, 19 bp, Artificial Sequence
  Synthetic
cctgctgutcgggauccag

SEQ ID NO: 25030 - DNA, 19 bp, Artificial Sequence
  Synthetic
ggatgaagugggtgccgua

SEQ ID NO: 25031 - DNA, 22 bp, Artificial Sequence
  Synthetic
ccagctgagguctctctctuct

SEQ ID NO: 25032 - DNA, 22 bp, Artificial Sequence
  Synthetic
gcttcaguggagctgacttugg

SEQ ID NO: 25033 - DNA, 22 bp, Artificial Sequence
  Synthetic
agtggacacacaaaggutccug

SEQ ID NO: 25034 - DNA, 17 bp, Artificial Sequence
  Synthetic
ccucccagcccctgcua

SEQ ID NO: 25035 - DNA, 19 bp, Artificial Sequence
  Synthetic
ggatcuggtcgaugccgaa

SEQ ID NO: 25036 - DNA, 21 bp, Artificial Sequence
  Synthetic
gccctcucacccttcactgua

SEQ ID NO: 25037 - DNA, 19 bp, Artificial Sequence
  Synthetic
ggtacttcuggcgguggaa

SEQ ID NO: 25038 - DNA, 17 bp, Artificial Sequence
  Synthetic
gtgcgugcacaacucgt

SEQ ID NO: 25039 - DNA, 19 bp, Artificial Sequence
  Synthetic
ggucccacagggcagaaug

SEQ ID NO: 25040 - DNA, 19 bp, Artificial Sequence
  Synthetic
gggtgcugagagtcggaug

SEQ ID NO: 25041 - DNA, 20 bp, Artificial Sequence
  Synthetic
tcccccgcuttaggacuagg

SEQ ID NO: 25042 - DNA, 22 bp, Artificial Sequence
  Synthetic
gtaacacacagugacccaccuc

SEQ ID NO: 25043 - DNA, 18 bp, Artificial Sequence
  Synthetic
acuggcagacgggcauac

SEQ ID NO: 25044 - DNA, 23 bp, Artificial Sequence
  Synthetic
aggccaaagaacugaagaaggug

SEQ ID NO: 25045 - DNA, 20 bp, Artificial Sequence
  Synthetic
caccccaggcaaucaggaua

SEQ ID NO: 25046 - DNA, 24 bp, Artificial Sequence
  Synthetic
gggctaaatuaggctaaggacuca

SEQ ID NO: 25047 - DNA, 23 bp, Artificial Sequence
  Synthetic
actgtttggaaucagacacgucc

SEQ ID NO: 25048 - DNA, 18 bp, Artificial Sequence
  Synthetic
ccacagcccugcctguat

SEQ ID NO: 25049 - DNA, 17 bp, Artificial Sequence
  Synthetic
gcttccuccccggaguc

SEQ ID NO: 25050 - DNA, 22 bp, Artificial Sequence
  Synthetic
ttgaaagcgaaggaugctcuga

SEQ ID NO: 25051 - DNA, 20 bp, Artificial Sequence
  Synthetic
gtuggtgaggtugacaacgc

SEQ ID NO: 25052 - DNA, 22 bp, Artificial Sequence
  Synthetic
ggttgagcaucctgcatcctua

SEQ ID NO: 25053 - DNA, 20 bp, Artificial Sequence
  Synthetic
ccagctccuccatctctgug

SEQ ID NO: 25054 - DNA, 21 bp, Artificial Sequence
  Synthetic
cctctgauagcgacucggact

SEQ ID NO: 25055 - DNA, 21 bp, Artificial Sequence
  Synthetic
agatactcuggaccccgucac

SEQ ID NO: 25056 - DNA, 24 bp, Artificial Sequence
  Synthetic
tcagacctcautcctctgtctuct

SEQ ID NO: 25057 - DNA, 20 bp, Artificial Sequence
  Synthetic
ccagauccacctuccaggga

SEQ ID NO: 25058 - DNA, 20 bp, Artificial Sequence
  Synthetic
gtcgtttgcccuctccagut

SEQ ID NO: 25059 - DNA, 19 bp, Artificial Sequence
  Synthetic
ccgtagauggcgtgcaguc

SEQ ID NO: 25060 - DNA, 25 bp, Artificial Sequence
  Synthetic
ctagtggtttuggctttgagtugac

SEQ ID NO: 25061 - DNA, 20 bp, Artificial Sequence
  Synthetic
ggcucauggcaaaaggacca

SEQ ID NO: 25062 - DNA, 21 bp, Artificial Sequence
  Synthetic
ccccagacccucagtuaccat

SEQ ID NO: 25063 - DNA, 28 bp, Artificial Sequence
  Synthetic
agaaaggttttccucactcaagacauac

SEQ ID NO: 25064 - DNA, 21 bp, Artificial Sequence
  Synthetic
cttgctccuccctgagcttut

SEQ ID NO: 25065 - DNA, 27 bp, Artificial Sequence
  Synthetic
gttgaatttcagaugtacgctcucaag

SEQ ID NO: 25066 - DNA, 17 bp, Artificial Sequence
  Synthetic
agcctgccutgtgccut

SEQ ID NO: 25067 - DNA, 20 bp, Artificial Sequence
  Synthetic
agagacgggaccugttguca

SEQ ID NO: 25068 - DNA, 20 bp, Artificial Sequence
  Synthetic
tctggugttgagucggaggt

SEQ ID NO: 25069 - DNA, 24 bp, Artificial Sequence
  Synthetic
tgattatuacaccccacccucagt

SEQ ID NO: 25070 - DNA, 25 bp, Artificial Sequence
  Synthetic
agtcttauttccagtcugaccccat

SEQ ID NO: 25071 - DNA, 22 bp, Artificial Sequence
  Synthetic
gcactuagaggccctttgctua

SEQ ID NO: 25072 - DNA, 20 bp, Artificial Sequence
  Synthetic
tcacacugcgctgagagaug

SEQ ID NO: 25073 - DNA, 22 bp, Artificial Sequence
  Synthetic
ctcctggcugtgtatgtugact

SEQ ID NO: 25074 - DNA, 25 bp, Artificial Sequence
  Synthetic
gttgguggaagcaaauaccaaagat

SEQ ID NO: 25075 - DNA, 23 bp, Artificial Sequence
  Synthetic
tcagugttatugcacacacaggt

SEQ ID NO: 25076 - DNA, 22 bp, Artificial Sequence
  Synthetic
gtagctgaauacagccuccaca

SEQ ID NO: 25077 - DNA, 22 bp, Artificial Sequence
  Synthetic
tgacagccagcuaaaugaaccc

SEQ ID NO: 25078 - DNA, 26 bp, Artificial Sequence
  Synthetic
tgagctccagaggugtctgatauaat

SEQ ID NO: 25079 - DNA, 29 bp, Artificial Sequence
  Synthetic
ggttgaagtaaaaaucctagcttctguct

SEQ ID NO: 25080 - DNA, 27 bp, Artificial Sequence
  Synthetic
caagaggatguggatgggatattcaut

SEQ ID NO: 25081 - DNA, 29 bp, Artificial Sequence
  Synthetic
ttgtgttttgtaauagtctttctccccut

SEQ ID NO: 25082 - DNA, 22 bp, Artificial Sequence
  Synthetic
cagacacaggutcctgatccuc

SEQ ID NO: 25083 - DNA, 23 bp, Artificial Sequence
  Synthetic
gctgcttucctgatctttcugct

SEQ ID NO: 25084 - DNA, 29 bp, Artificial Sequence
  Synthetic
tcaatagaattuagcaaaggatccctucc

SEQ ID NO: 25085 - DNA, 25 bp, Artificial Sequence
  Synthetic
tcaattcaaagaauaccggccugaa

SEQ ID NO: 25086 - DNA, 26 bp, Artificial Sequence
  Synthetic
agacaactacttcuttcctccggaua

SEQ ID NO: 25087 - DNA, 31 bp, Artificial Sequence
  Synthetic
ttgtaaagtagguatttgccttcauacagaa

SEQ ID NO: 25088 - DNA, 22 bp, Artificial Sequence
  Synthetic
cggtcatccugaagtgacucat

SEQ ID NO: 25089 - DNA, 23 bp, Artificial Sequence
  Synthetic
tgccaaaccuattccucaaaccc

SEQ ID NO: 25090 - DNA, 30 bp, Artificial Sequence
  Synthetic
ctgttaacaaaaauaaactcactugggcat

SEQ ID NO: 25091 - DNA, 20 bp, Artificial Sequence
  Synthetic
ccacuagaguccggccaaag

SEQ ID NO: 25092 - DNA, 28 bp, Artificial Sequence
  Synthetic
agagtctccaaaaggugagtatgtuaga

SEQ ID NO: 25093 - DNA, 25 bp, Artificial Sequence
  Synthetic
cgagctctgugttacaaatgcatug

SEQ ID NO: 25094 - DNA, 29 bp, Artificial Sequence
  Synthetic
gtatagucagtgtaacttuaagagagcca

SEQ ID NO: 25095 - DNA, 26 bp, Artificial Sequence
  Synthetic
cutactacattuggaagcagcacaac

SEQ ID NO: 25096 - DNA, 25 bp, Artificial Sequence
  Synthetic
catggaggtaaguaagggtctgtut

SEQ ID NO: 25097 - DNA, 22 bp, Artificial Sequence
  Synthetic
cttuggccaacagaaucagcag

SEQ ID NO: 25098 - DNA, 29 bp, Artificial Sequence
  Synthetic
caaaaccattttuaaaagctgcatuccaa

SEQ ID NO: 25099 - DNA, 28 bp, Artificial Sequence
  Synthetic
cagatactatggucaaagctggagtuag

SEQ ID NO: 25100 - DNA, 30 bp, Artificial Sequence
  Synthetic
aaacggagaaaagauaacacautcaauaag

SEQ ID NO: 25101 - DNA, 25 bp, Artificial Sequence
  Synthetic
gcaaataccutgtttggaacugcaa

SEQ ID NO: 25102 - DNA, 27 bp, Artificial Sequence
  Synthetic
aattcccaccuaaagcttatcagagug

SEQ ID NO: 25103 - DNA, 18 bp, Artificial Sequence
  Synthetic
gtggcacagguggcttug

SEQ ID NO: 25104 - DNA, 24 bp, Artificial Sequence
  Synthetic
tgattgaaauccctttgccuccat

SEQ ID NO: 25105 - DNA, 28 bp, Artificial Sequence
  Synthetic
aaagactccuagtcccataccuaagaag

SEQ ID NO: 25106 - DNA, 23 bp, Artificial Sequence
  Synthetic
ccctgcugagagactttgcuaaa

SEQ ID NO: 25107 - DNA, 23 bp, Artificial Sequence
  Synthetic
gttaccauccacagacugaaccc

SEQ ID NO: 25108 - DNA, 19 bp, Artificial Sequence
  Synthetic
catcctgccagugcctcua

SEQ ID NO: 25109 - DNA, 21 bp, Artificial Sequence
  Synthetic
tcaaagaaggcccuguccaag

SEQ ID NO: 25110 - DNA, 20 bp, Artificial Sequence
  Synthetic
ctgagcacagugctggagua

SEQ ID NO: 25111 - DNA, 22 bp, Artificial Sequence
  Synthetic
agcatgcagccaauccagauag

SEQ ID NO: 25112 - DNA, 22 bp, Artificial Sequence
  Synthetic
gtaagtcccugtagtccccuca

SEQ ID NO: 25113 - DNA, 24 bp, Artificial Sequence
  Synthetic
cctcctctacucagtctctagcuc

SEQ ID NO: 25114 - DNA, 23 bp, Artificial Sequence
  Synthetic
agggaugggagtgaaguagagac

SEQ ID NO: 25115 - DNA, 22 bp, Artificial Sequence
  Synthetic
ccttctagcgugaaggactgua

SEQ ID NO: 25116 - DNA, 20 bp, Artificial Sequence
  Synthetic
ccagcctgcugtagctcaug

SEQ ID NO: 25117 - DNA, 21 bp, Artificial Sequence
  Synthetic
tctcugcccacagauggagaa

SEQ ID NO: 25118 - DNA, 23 bp, Artificial Sequence
  Synthetic
ccccagagcutagagaatagcut

SEQ ID NO: 25119 - DNA, 24 bp, Artificial Sequence
  Synthetic
cctgagtcttcugtcctcctctuc

SEQ ID NO: 25120 - DNA, 24 bp, Artificial Sequence
  Synthetic
gccaactctuggacatacttcucc

SEQ ID NO: 25121 - DNA, 18 bp, Artificial Sequence
  Synthetic
agcagcugagcatgcuga

SEQ ID NO: 25122 - DNA, 20 bp, Artificial Sequence
  Synthetic
aattctuggcccagctccuc

SEQ ID NO: 25123 - DNA, 18 bp, Artificial Sequence
  Synthetic
cagaacgcagcuctgcuc

SEQ ID NO: 25124 - DNA, 22 bp, Artificial Sequence
  Synthetic
actcatctucagccttgctgug

SEQ ID NO: 25125 - DNA, 21 bp, Artificial Sequence
  Synthetic
ggacagtgcuctggagacuct

SEQ ID NO: 25126 - DNA, 19 bp, Artificial Sequence
  Synthetic
caactccuggtcctugcct

SEQ ID NO: 25127 - DNA, 19 bp, Artificial Sequence
  Synthetic
ctgaccutgcccuggagaa

SEQ ID NO: 25128 - DNA, 20 bp, Artificial Sequence
  Synthetic
cugttgctctuccagccact

SEQ ID NO: 25129 - DNA, 22 bp, Artificial Sequence
  Synthetic
tccactcugcaggaaaagaugg

SEQ ID NO: 25130 - DNA, 21 bp, Artificial Sequence
  Synthetic
tggctatccucataccgcuca

SEQ ID NO: 25131 - DNA, 21 bp, Artificial Sequence
  Synthetic
ctggaggcucgatuacagcag

SEQ ID NO: 25132 - DNA, 21 bp, Artificial Sequence
  Synthetic
ttgctttutgctgcucagacc

SEQ ID NO: 25133 - DNA, 19 bp, Artificial Sequence
  Synthetic
tgcccagaccucagugaca

SEQ ID NO: 25134 - DNA, 21 bp, Artificial Sequence
  Synthetic
gctactgcutagctgcuccac

SEQ ID NO: 25135 - DNA, 20 bp, Artificial Sequence
  Synthetic
gaccuctgagcucaccacac

SEQ ID NO: 25136 - DNA, 22 bp, Artificial Sequence
  Synthetic
gcacacagguctttctgugcat

SEQ ID NO: 25137 - DNA, 26 bp, Artificial Sequence
  Synthetic
gcctugaagagaagaaugaaatccut

SEQ ID NO: 25138 - DNA, 21 bp, Artificial Sequence
  Synthetic
aggtgcugggacattcttcuc

SEQ ID NO: 25139 - DNA, 24 bp, Artificial Sequence
  Synthetic
ggatcgcaaaaucaaccagcttuc

SEQ ID NO: 25140 - DNA, 21 bp, Artificial Sequence
  Synthetic
gacatcctuccggcaagtcua

SEQ ID NO: 25141 - DNA, 21 bp, Artificial Sequence
  Synthetic
gaugagacggcugaagaagca

SEQ ID NO: 25142 - DNA, 22 bp, Artificial Sequence
  Synthetic
gggattcucaggagtgtguacc

SEQ ID NO: 25143 - DNA, 26 bp, Artificial Sequence
  Synthetic
ctaagtgatgcuctttttctcccugt

SEQ ID NO: 25144 - DNA, 22 bp, Artificial Sequence
  Synthetic
ccagcaaucagctttgcctuag

SEQ ID NO: 25145 - DNA, 26 bp, Artificial Sequence
  Synthetic
actaggctgutccctttgattuacag

SEQ ID NO: 25146 - DNA, 21 bp, Artificial Sequence
  Synthetic
ctcatgacaggcuggctguat

SEQ ID NO: 25147 - DNA, 23 bp, Artificial Sequence
  Synthetic
aaggtacuaggacctgtcauccc

SEQ ID NO: 25148 - DNA, 26 bp, Artificial Sequence
  Synthetic
ccagttagaucccccagttaactuct

SEQ ID NO: 25149 - DNA, 24 bp, Artificial Sequence
  Synthetic
ccagccucaagtctctatctuact

SEQ ID NO: 25150 - DNA, 30 bp, Artificial Sequence
  Synthetic
aagcagcattatttutccttacacagaauc

SEQ ID NO: 25151 - DNA, 28 bp, Artificial Sequence
  Synthetic
gccttaatgttgacuttgaatctgtgut

SEQ ID NO: 25152 - DNA, 26 bp, Artificial Sequence
  Synthetic
ttgtgaggaaaggauttaagctugga

SEQ ID NO: 25153 - DNA, 31 bp, Artificial Sequence
  Synthetic
gttactactttucactttgcatctttugact

SEQ ID NO: 25154 - DNA, 22 bp, Artificial Sequence
  Synthetic
gcugaggtggauacaggagagg

SEQ ID NO: 25155 - DNA, 25 bp, Artificial Sequence
  Synthetic
cagaggctguacaaagaaatcuggt

SEQ ID NO: 25156 - DNA, 27 bp, Artificial Sequence
  Synthetic
cttgtacacaacagauagtggatuggt

SEQ ID NO: 25157 - DNA, 27 bp, Artificial Sequence
  Synthetic
agccgtgatgucatttttccaaattut

SEQ ID NO: 25158 - DNA, 26 bp, Artificial Sequence
  Synthetic
ggcuacagcagtattuacccaacaaa

SEQ ID NO: 25159 - DNA, 31 bp, Artificial Sequence
  Synthetic
tccaatttttcccuaggttaatagcaaugaa

SEQ ID NO: 25160 - DNA, 25 bp, Artificial Sequence
  Synthetic
tgcaacttguctgtatgaaacugct

SEQ ID NO: 25161 - DNA, 29 bp, Artificial Sequence
  Synthetic
tgagttgtttttcuaggcatattgggaut

SEQ ID NO: 25162 - DNA, 25 bp, Artificial Sequence
  Synthetic
aactgtgggaugttcacattcauct

SEQ ID NO: 25163 - DNA, 26 bp, Artificial Sequence
  Synthetic
cactttgtgtuaaatcttttgccugt

SEQ ID NO: 25164 - DNA, 22 bp, Artificial Sequence
  Synthetic
cagttucagggaacaggacuca

SEQ ID NO: 25165 - DNA, 22 bp, Artificial Sequence
  Synthetic
gtccutcaggacauggaagacc

SEQ ID NO: 25166 - DNA, 24 bp, Artificial Sequence
  Synthetic
cacatacatgucagctgaguaggg

SEQ ID NO: 25167 - DNA, 22 bp, Artificial Sequence
  Synthetic
gaaggttctgugtctgcaguga

SEQ ID NO: 25168 - DNA, 20 bp, Artificial Sequence
  Synthetic
cgcttccucctcagcagtuc

SEQ ID NO: 25169 - DNA, 20 bp, Artificial Sequence
  Synthetic
gcucgtcugagaaggaccat

SEQ ID NO: 25170 - DNA, 25 bp, Artificial Sequence
  Synthetic
tgtcagtcctgutaaaggagaggut

SEQ ID NO: 25171 - DNA, 21 bp, Artificial Sequence
  Synthetic
accattcugggataggucggt

SEQ ID NO: 25172 - DNA, 19 bp, Artificial Sequence
  Synthetic
gggcctuggacaagttgut

SEQ ID NO: 25173 - DNA, 20 bp, Artificial Sequence
  Synthetic
ctuccacagcauggcaacag

SEQ ID NO: 25174 - DNA, 23 bp, Artificial Sequence
  Synthetic
ccagccagaagugccagttaaua

SEQ ID NO: 25175 - DNA, 22 bp, Artificial Sequence
  Synthetic
cgctcatcccutccaccttuac

SEQ ID NO: 25176 - DNA, 24 bp, Artificial Sequence
  Synthetic
gccaaauggagatgtuccaggaat

SEQ ID NO: 25177 - DNA, 24 bp, Artificial Sequence
  Synthetic
tcaaaggatugggtttctcaccuc

SEQ ID NO: 25178 - DNA, 24 bp, Artificial Sequence
  Synthetic
cugaggagaaauaaaccaccatug

SEQ ID NO: 25179 - DNA, 26 bp, Artificial Sequence
  Synthetic
tcctcccctucaaacactagatauga

SEQ ID NO: 25180 - DNA, 17 bp, Artificial Sequence
  Synthetic
ggccctucccctgugac

SEQ ID NO: 25181 - DNA, 20 bp, Artificial Sequence
  Synthetic
gagtcautccaggucggcat

SEQ ID NO: 25182 - DNA, 19 bp, Artificial Sequence
  Synthetic
cccugccaacacctgtuca

SEQ ID NO: 25183 - DNA, 23 bp, Artificial Sequence
  Synthetic
ctaaccaggaccuctgtccttuc

SEQ ID NO: 25184 - DNA, 22 bp, Artificial Sequence
  Synthetic
agcatggaggcacautcttcug

SEQ ID NO: 25185 - DNA, 23 bp, Artificial Sequence
  Synthetic
ccccaggauggtaacuccaagat

SEQ ID NO: 25186 - DNA, 20 bp, Artificial Sequence
  Synthetic
cggatttgucccaggtgcuc

SEQ ID NO: 25187 - DNA, 20 bp, Artificial Sequence
  Synthetic
gctgtggccutcattgccua

SEQ ID NO: 25188 - DNA, 22 bp, Artificial Sequence
  Synthetic
caatgtccuggatggtgtgtuc

SEQ ID NO: 25189 - DNA, 22 bp, Artificial Sequence
  Synthetic
ggctgtgcuatgtgtcactgua

SEQ ID NO: 25190 - DNA, 21 bp, Artificial Sequence
  Synthetic
gctgcuccagagtctctucct

SEQ ID NO: 25191 - DNA, 19 bp, Artificial Sequence
  Synthetic
ctggaatuagccgggcuct

SEQ ID NO: 25192 - DNA, 20 bp, Artificial Sequence
  Synthetic
ggactgccuttgctcucgac

SEQ ID NO: 25193 - DNA, 29 bp, Artificial Sequence
  Synthetic
aaaactagatucaggagacuccaaagaac

SEQ ID NO: 25194 - DNA, 31 bp, Artificial Sequence
  Synthetic
ggatattcttagattuccggatagtgacuct

SEQ ID NO: 25195 - DNA, 28 bp, Artificial Sequence
  Synthetic
aaggctttgcttuggatgttgtattaug

SEQ ID NO: 25196 - DNA, 23 bp, Artificial Sequence
  Synthetic
ggtggaaucctgttctucaagct

SEQ ID NO: 25197 - DNA, 22 bp, Artificial Sequence
  Synthetic
gcatgaggcautcacctcuagt

SEQ ID NO: 25198 - DNA, 23 bp, Artificial Sequence
  Synthetic
gggttuagagggtgatuccaaca

SEQ ID NO: 25199 - DNA, 25 bp, Artificial Sequence
  Synthetic
ctttgagaagguccttccuaaacct

SEQ ID NO: 25200 - DNA, 22 bp, Artificial Sequence
  Synthetic
gtgatgatuggcgtgctttcug

SEQ ID NO: 25201 - DNA, 22 bp, Artificial Sequence
  Synthetic
actcctucctcccucaaagact

SEQ ID NO: 25202 - DNA, 20 bp, Artificial Sequence
  Synthetic
ggaaugagggcctcttuggg

SEQ ID NO: 25203 - DNA, 21 bp, Artificial Sequence
  Synthetic
tgccagctgugattccttcut

SEQ ID NO: 25204 - DNA, 23 bp, Artificial Sequence
  Synthetic
gagtgagauctcctttggauggg

SEQ ID NO: 25205 - DNA, 20 bp, Artificial Sequence
  Synthetic
aaggaggucccgctaugact

SEQ ID NO: 25206 - DNA, 21 bp, Artificial Sequence
  Synthetic
gagttacaacugcgggatugg

SEQ ID NO: 25207 - DNA, 19 bp, Artificial Sequence
  Synthetic
cucctcccuccccaaaagg

SEQ ID NO: 25208 - DNA, 19 bp, Artificial Sequence
  Synthetic
ggtagcugggcctccttut

SEQ ID NO: 25209 - DNA, 19 bp, Artificial Sequence
  Synthetic
ggaaguccagcagcuaccc

SEQ ID NO: 25210 - DNA, 20 bp, Artificial Sequence
  Synthetic
gggtagcugggcctccttua

SEQ ID NO: 25211 - DNA, 25 bp, Artificial Sequence
  Synthetic
ctgctctatccaugacttcttccuc

SEQ ID NO: 25212 - DNA, 23 bp, Artificial Sequence
  Synthetic
cccttcttggutggaggtcttut

SEQ ID NO: 25213 - DNA, 21 bp, Artificial Sequence
  Synthetic
acttcagcatuggcacctgut

SEQ ID NO: 25214 - DNA, 22 bp, Artificial Sequence
  Synthetic
ttgaggtaccuttggcagtugt

SEQ ID NO: 25215 - DNA, 22 bp, Artificial Sequence
  Synthetic
actccucggcctctgtaaucaa

SEQ ID NO: 25216 - DNA, 29 bp, Artificial Sequence
  Synthetic
aggtctttttgugttggaaattuaaccaa

SEQ ID NO: 25217 - DNA, 23 bp, Artificial Sequence
  Synthetic
ctcccaaagagccutctacucaa

SEQ ID NO: 25218 - DNA, 21 bp, Artificial Sequence
  Synthetic
gaagggcugcaggttatgcua

SEQ ID NO: 25219 - DNA, 25 bp, Artificial Sequence
  Synthetic
agagatctgtaautcctcccctucc

SEQ ID NO: 25220 - DNA, 27 bp, Artificial Sequence
  Synthetic
gaaatcagaacugaggaaatggtggua

SEQ ID NO: 25221 - DNA, 22 bp, Artificial Sequence
  Synthetic
ccagcccuccatgtatagucag

SEQ ID NO: 25222 - DNA, 25 bp, Artificial Sequence
  Synthetic
gccctatuaggtttgguaggaaggt

SEQ ID NO: 25223 - DNA, 21 bp, Artificial Sequence
  Synthetic
cctctcucagctgcuaaccag

SEQ ID NO: 25224 - DNA, 24 bp, Artificial Sequence
  Synthetic
agctgtgttgutgtggaaaguagt

SEQ ID NO: 25225 - DNA, 26 bp, Artificial Sequence
  Synthetic
gttactttuactaggcctugccaaaa

SEQ ID NO: 25226 - DNA, 28 bp, Artificial Sequence
  Synthetic
gaacaacatgaacccauagtagagcuaa

SEQ ID NO: 25227 - DNA, 21 bp, Artificial Sequence
  Synthetic
aacaaaatcuccaggguggct

SEQ ID NO: 25228 - DNA, 30 bp, Artificial Sequence
  Synthetic
gcattaacaccgutttctgtaatatttuct

SEQ ID NO: 25229 - DNA, 27 bp, Artificial Sequence
  Synthetic
ccttgtttgacuttatctgtggtcuca

SEQ ID NO: 25230 - DNA, 23 bp, Artificial Sequence
  Synthetic
cctgaagcaguccaggacttaug

SEQ ID NO: 25231 - DNA, 27 bp, Artificial Sequence
  Synthetic
ggucagaaaacactgugaaaagcaaag

SEQ ID NO: 25232 - DNA, 30 bp, Artificial Sequence
  Synthetic
ggcctgatgaguatgctctaaaagaataug

SEQ ID NO: 25233 - DNA, 24 bp, Artificial Sequence
  Synthetic
ctacacaccaucaacagtucccaa

SEQ ID NO: 25234 - DNA, 23 bp, Artificial Sequence
  Synthetic
cctggctcugcagtttctcttua

SEQ ID NO: 25235 - DNA, 28 bp, Artificial Sequence
  Synthetic
tttcaatataatgcuggaccgccataua

SEQ ID NO: 25236 - DNA, 27 bp, Artificial Sequence
  Synthetic
aagacagtgcuagagtctaugaaaacg

SEQ ID NO: 25237 - DNA, 25 bp, Artificial Sequence
  Synthetic
cccaaattgcutgcctgctuaaaaa

SEQ ID NO: 25238 - DNA, 17 bp, Artificial Sequence
  Synthetic
gcugcccacggagaugg

SEQ ID NO: 25239 - DNA, 18 bp, Artificial Sequence
  Synthetic
gtgccggucctggugaaa

SEQ ID NO: 25240 - DNA, 17 bp, Artificial Sequence
  Synthetic
gggcggccucactuact

SEQ ID NO: 25241 - DNA, 19 bp, Artificial Sequence
  Synthetic
ctacugcaacggcaaccug

SEQ ID NO: 25242 - DNA, 23 bp, Artificial Sequence
  Synthetic
ttggactcaucgacatgatucgg

SEQ ID NO: 25243 - DNA, 20 bp, Artificial Sequence
  Synthetic
ggtccacuccgttacgtgua

SEQ ID NO: 25244 - DNA, 24 bp, Artificial Sequence
  Synthetic
gggtgataugagggatagcaaauc

SEQ ID NO: 25245 - DNA, 23 bp, Artificial Sequence
  Synthetic
cccacctcacautccagcttuaa

SEQ ID NO: 25246 - DNA, 28 bp, Artificial Sequence
  Synthetic
aggtgatctacuagagtagagagagcut

SEQ ID NO: 25247 - DNA, 18 bp, Artificial Sequence
  Synthetic
gcaagccugtccgauggt

SEQ ID NO: 25248 - DNA, 23 bp, Artificial Sequence
  Synthetic
gugagaacacagatguacgccat

SEQ ID NO: 25249 - DNA, 25 bp, Artificial Sequence
  Synthetic
aaucttctucccaagcaccaaaaac

SEQ ID NO: 25250 - DNA, 22 bp, Artificial Sequence
  Synthetic
agaacaaaucacctugccacca

SEQ ID NO: 25251 - DNA, 22 bp, Artificial Sequence
  Synthetic
acaccgugcagaatguaaacct

SEQ ID NO: 25252 - DNA, 30 bp, Artificial Sequence
  Synthetic
gtttttcgttguagcttagaacacuagaga

SEQ ID NO: 25253 - DNA, 24 bp, Artificial Sequence
  Synthetic
gcaaauagcagcagctgugaaaat

SEQ ID NO: 25254 - DNA, 22 bp, Artificial Sequence
  Synthetic
ttcctccaaugcactgttucct

SEQ ID NO: 25255 - DNA, 30 bp, Artificial Sequence
  Synthetic
accaacaatuggatttggaaaauacagaac

SEQ ID NO: 25256 - DNA, 23 bp, Artificial Sequence
  Synthetic
gaagttagauctggtgaggugct

SEQ ID NO: 25257 - DNA, 22 bp, Artificial Sequence
  Synthetic
agctgaaggcaaugatgcauga

SEQ ID NO: 25258 - DNA, 27 bp, Artificial Sequence
  Synthetic
cacagaaacaucaaaaagtaggtccug

SEQ ID NO: 25259 - DNA, 26 bp, Artificial Sequence
  Synthetic
agtagaggguttttctgagctugaaa

SEQ ID NO: 25260 - DNA, 24 bp, Artificial Sequence
  Synthetic
tcacattttccutcactgcctgut

SEQ ID NO: 25261 - DNA, 24 bp, Artificial Sequence
  Synthetic
tctctcaatgcutcagagtggtug

SEQ ID NO: 25262 - DNA, 22 bp, Artificial Sequence
  Synthetic
tcagttcccutttgtgacugct

SEQ ID NO: 25263 - DNA, 26 bp, Artificial Sequence
  Synthetic
gagagagagaugctggagaaaacaua

SEQ ID NO: 25264 - DNA, 23 bp, Artificial Sequence
  Synthetic
ccaggtagcutcatttccctuca

SEQ ID NO: 25265 - DNA, 24 bp, Artificial Sequence
  Synthetic
gaacuagagcagttucaccaggag

SEQ ID NO: 25266 - DNA, 29 bp, Artificial Sequence
  Synthetic
acttatttgtttttcuaaggtgtgcgtut

SEQ ID NO: 25267 - DNA, 23 bp, Artificial Sequence
  Synthetic
ctttcagugaccttgagcugagt

SEQ ID NO: 25268 - DNA, 25 bp, Artificial Sequence
  Synthetic
caacttcttcugacggtgagttcut

SEQ ID NO: 25269 - DNA, 27 bp, Artificial Sequence
  Synthetic
ccagtgttggtutttaaatcccaggua

SEQ ID NO: 25270 - DNA, 21 bp, Artificial Sequence
  Synthetic
atgcccactuccaaagctgua

SEQ ID NO: 25271 - DNA, 22 bp, Artificial Sequence
  Synthetic
ggcaagcagcguttagaactug

SEQ ID NO: 25272 - DNA, 19 bp, Artificial Sequence
  Synthetic
gtccauccaaggcauccga

SEQ ID NO: 25273 - DNA, 25 bp, Artificial Sequence
  Synthetic
cactggcccutgaaaatgaacttut

SEQ ID NO: 25274 - DNA, 29 bp, Artificial Sequence
  Synthetic
cttttatucacaaagaaagcacttcugct

SEQ ID NO: 25275 - DNA, 23 bp, Artificial Sequence
  Synthetic
gatcctgacgguacaatgagugt

SEQ ID NO: 25276 - DNA, 21 bp, Artificial Sequence
  Synthetic
tggccugcagcataagagauc

SEQ ID NO: 25277 - DNA, 27 bp, Artificial Sequence
  Synthetic
cacactaatcttcucttgccttctcua

SEQ ID NO: 25278 - DNA, 20 bp, Artificial Sequence
  Synthetic
cccauagccacgttctuccc

SEQ ID NO: 25279 - DNA, 24 bp, Artificial Sequence
  Synthetic
gctguttgacagtttugacacgac

SEQ ID NO: 25280 - DNA, 17 bp, Artificial Sequence
  Synthetic
gacggugaccucagcca

SEQ ID NO: 25281 - DNA, 28 bp, Artificial Sequence
  Synthetic
gtttttcatgttguaatgatctgccgua

SEQ ID NO: 25282 - DNA, 22 bp, Artificial Sequence
  Synthetic
tuctgttgtucagccagacact

SEQ ID NO: 25283 - DNA, 22 bp, Artificial Sequence
  Synthetic
cctcctgcaauctccttctugt

SEQ ID NO: 25284 - DNA, 21 bp, Artificial Sequence
  Synthetic
cttccattccucggtctgcut

SEQ ID NO: 25285 - DNA, 24 bp, Artificial Sequence
  Synthetic
caaagctgtcuatttctgtgcugt

SEQ ID NO: 25286 - DNA, 22 bp, Artificial Sequence
  Synthetic
ccatgtguccagaaagctugaa

SEQ ID NO: 25287 - DNA, 21 bp, Artificial Sequence
  Synthetic
tctgggaaucaacctgtuggg

SEQ ID NO: 25288 - DNA, 31 bp, Artificial Sequence
  Synthetic
aaattccaaccuagagaaattctgatgaugt

SEQ ID NO: 25289 - DNA, 22 bp, Artificial Sequence
  Synthetic
gggacauttctgtugacccagt

SEQ ID NO: 25290 - DNA, 24 bp, Artificial Sequence
  Synthetic
ctggattgcugaggaagaagtuca

SEQ ID NO: 25291 - DNA, 30 bp, Artificial Sequence
  Synthetic
agataaaataagtcagucctttgatggaut

SEQ ID NO: 25292 - DNA, 23 bp, Artificial Sequence
  Synthetic
tgaccacagcaaagugggtatuc

SEQ ID NO: 25293 - DNA, 27 bp, Artificial Sequence
  Synthetic
gtaacatuacgaaccagugaagtcuat

SEQ ID NO: 25294 - DNA, 26 bp, Artificial Sequence
  Synthetic
gggaaatacgaaacugaagtgaaugt

SEQ ID NO: 25295 - DNA, 22 bp, Artificial Sequence
  Synthetic
gaagatcgugcaaggaatucgg

SEQ ID NO: 25296 - DNA, 21 bp, Artificial Sequence
  Synthetic
caagggcaacacauaccguct

SEQ ID NO: 25297 - DNA, 27 bp, Artificial Sequence
  Synthetic
tgtgtgaacttaauttgcagcatctut

SEQ ID NO: 25298 - DNA, 21 bp, Artificial Sequence
  Synthetic
gctgcagcagugccagaauaa

SEQ ID NO: 25299 - DNA, 23 bp, Artificial Sequence
  Synthetic
gaggaaaagcacgauacctcugt

SEQ ID NO: 25300 - DNA, 19 bp, Artificial Sequence
  Synthetic
cgcagtgucgctcgtacuc

SEQ ID NO: 25301 - DNA, 18 bp, Artificial Sequence
  Synthetic
gttgcugggcugacggat

SEQ ID NO: 25302 - DNA, 29 bp, Artificial Sequence
  Synthetic
ggcccttctttuctctcatttacacauat

SEQ ID NO: 25303 - DNA, 22 bp, Artificial Sequence
  Synthetic
gctccaaacugtagccagauca

SEQ ID NO: 25304 - DNA, 21 bp, Artificial Sequence
  Synthetic
acatgauaggcagcaggctug

SEQ ID NO: 25305 - DNA, 25 bp, Artificial Sequence
  Synthetic
ctgaaagtaugccctgtcctttuct

SEQ ID NO: 25306 - DNA, 23 bp, Artificial Sequence
  Synthetic
tcaattagcgggacugccaaaua

SEQ ID NO: 25307 - DNA, 28 bp, Artificial Sequence
  Synthetic
catcagatttgagutcatgaaaggtgut

SEQ ID NO: 25308 - DNA, 23 bp, Artificial Sequence
  Synthetic
cccagcacagcuatcttctucag

SEQ ID NO: 25309 - DNA, 27 bp, Artificial Sequence
  Synthetic
aaaacaacaacaacauatgtgggaugg

SEQ ID NO: 25310 - DNA, 25 bp, Artificial Sequence
  Synthetic
cuttttgtcttagaugggacccaca

SEQ ID NO: 25311 - DNA, 27 bp, Artificial Sequence
  Synthetic
gttgccauaactactggatugagacat

SEQ ID NO: 25312 - DNA, 24 bp, Artificial Sequence
  Synthetic
gatttgtgtaugtgctgttgucac

SEQ ID NO: 25313 - DNA, 23 bp, Artificial Sequence
  Synthetic
gtgaaggtgauccaactggtgut

SEQ ID NO: 25314 - DNA, 26 bp, Artificial Sequence
  Synthetic
cgtttagacagacuggatgaugcaat

SEQ ID NO: 25315 - DNA, 25 bp, Artificial Sequence
  Synthetic
cttccaattggugcattatgggaug

SEQ ID NO: 25316 - DNA, 26 bp, Artificial Sequence
  Synthetic
aaagtcagtcuggaactgttgtuaca

SEQ ID NO: 25317 - DNA, 25 bp, Artificial Sequence
  Synthetic
ccttgttcugcctctagaugaaacc

SEQ ID NO: 25318 - DNA, 23 bp, Artificial Sequence
  Synthetic
cccccugtttuagagaggaacct

SEQ ID NO: 25319 - DNA, 24 bp, Artificial Sequence
  Synthetic
tgguagtttcacuaagcccaggat

SEQ ID NO: 25320 - DNA, 21 bp, Artificial Sequence
  Synthetic
gggctttugggacttcuccag

SEQ ID NO: 25321 - DNA, 18 bp, Artificial Sequence
  Synthetic
atccugagcacagcgugt

SEQ ID NO: 25322 - DNA, 18 bp, Artificial Sequence
  Synthetic
ccagtcggugcgtgagut

SEQ ID NO: 25323 - DNA, 24 bp, Artificial Sequence
  Synthetic
gtgactcttuggatctttgcucct

SEQ ID NO: 25324 - DNA, 17 bp, Artificial Sequence
  Synthetic
gagctgcuggaggcugt

SEQ ID NO: 25325 - DNA, 18 bp, Artificial Sequence
  Synthetic
cgugcatguccagcacct

SEQ ID NO: 25326 - DNA, 25 bp, Artificial Sequence
  Synthetic
ctgactcaatuttcccaacttugca

SEQ ID NO: 25327 - DNA, 23 bp, Artificial Sequence
  Synthetic
tctccauaggaagggccttugat

SEQ ID NO: 25328 - DNA, 21 bp, Artificial Sequence
  Synthetic
ccccgucataggaagugaggt

SEQ ID NO: 25329 - DNA, 20 bp, Artificial Sequence
  Synthetic
ttggcttugggctttcugga

SEQ ID NO: 25330 - DNA, 25 bp, Artificial Sequence
  Synthetic
gaggttctgtautggaaagtgcaug

SEQ ID NO: 25331 - DNA, 17 bp, Artificial Sequence
  Synthetic
caggcuggaggctccut

SEQ ID NO: 25332 - DNA, 20 bp, Artificial Sequence
  Synthetic
ccaaugcccaggaacaucct

SEQ ID NO: 25333 - DNA, 19 bp, Artificial Sequence
  Synthetic
caagcugggaagccaugga

SEQ ID NO: 25334 - DNA, 21 bp, Artificial Sequence
  Synthetic
gcctctgagagugctacccut

SEQ ID NO: 25335 - DNA, 25 bp, Artificial Sequence
  Synthetic
gccattcatucgttgattcatucct

SEQ ID NO: 25336 - DNA, 22 bp, Artificial Sequence
  Synthetic
ctacccccaccccuttctaaut

SEQ ID NO: 25337 - DNA, 17 bp, Artificial Sequence
  Synthetic
ccaggugagccggagug

SEQ ID NO: 25338 - DNA, 20 bp, Artificial Sequence
  Synthetic
tggccucccaaacttctucc

SEQ ID NO: 25339 - DNA, 21 bp, Artificial Sequence
  Synthetic
tgtttcucgccaggtagguct

SEQ ID NO: 25340 - DNA, 19 bp, Artificial Sequence
  Synthetic
cccagccugcttucaacct

SEQ ID NO: 25341 - DNA, 21 bp, Artificial Sequence
  Synthetic
cagagacuccaagctggucac

SEQ ID NO: 25342 - DNA, 24 bp, Artificial Sequence
  Synthetic
gccaagaatguccaggtagatugg

SEQ ID NO: 25343 - DNA, 24 bp, Artificial Sequence
  Synthetic
caaagaggtguacgatgtcaugct

SEQ ID NO: 25344 - DNA, 22 bp, Artificial Sequence
  Synthetic
tgccagagugacagggttaaug

SEQ ID NO: 25345 - DNA, 23 bp, Artificial Sequence
  Synthetic
ggagcgaauctgctagugaagat

SEQ ID NO: 25346 - DNA, 19 bp, Artificial Sequence
  Synthetic
catcgccgcacacuccaua

SEQ ID NO: 25347 - DNA, 21 bp, Artificial Sequence
  Synthetic
cccctgcccugtagttgtuaa

SEQ ID NO: 25348 - DNA, 26 bp, Artificial Sequence
  Synthetic
aaacaaggaggcutaaaaggagttut

SEQ ID NO: 25349 - DNA, 30 bp, Artificial Sequence
  Synthetic
aggtttcagagaaautatgttgaauccaat

SEQ ID NO: 25350 - DNA, 26 bp, Artificial Sequence
  Synthetic
tctgaaaatgacuatgccagucaaca

SEQ ID NO: 25351 - DNA, 23 bp, Artificial Sequence
  Synthetic
gaagctaactgucctcctcctut

SEQ ID NO: 25352 - DNA, 21 bp, Artificial Sequence
  Synthetic
acagccaucccccacaauaac

SEQ ID NO: 25353 - DNA, 22 bp, Artificial Sequence
  Synthetic
ccatcaactugacgctggugaa

SEQ ID NO: 25354 - DNA, 21 bp, Artificial Sequence
  Synthetic
atctctggtguctgagggaug

SEQ ID NO: 25355 - DNA, 22 bp, Artificial Sequence
  Synthetic
gccagaaccuctactgcaucaa

SEQ ID NO: 25356 - DNA, 18 bp, Artificial Sequence
  Synthetic
ggcauccacccctuccac

SEQ ID NO: 25357 - DNA, 20 bp, Artificial Sequence
  Synthetic
ggctgaccgutaccttucct

SEQ ID NO: 25358 - DNA, 18 bp, Artificial Sequence
  Synthetic
gcuccagcagcucgaaga

SEQ ID NO: 25359 - DNA, 17 bp, Artificial Sequence
  Synthetic
gtgggcaccutccuggt

SEQ ID NO: 25360 - DNA, 19 bp, Artificial Sequence
  Synthetic
ctctgcugctguggagact

SEQ ID NO: 25361 - DNA, 19 bp, Artificial Sequence
  Synthetic
ccccagcucacctcttugt

SEQ ID NO: 25362 - DNA, 28 bp, Artificial Sequence
  Synthetic
cataaaggtgugaccaattcagugaaag

SEQ ID NO: 25363 - DNA, 27 bp, Artificial Sequence
  Synthetic
caccatcaaaccaaccugtgttttuaa

SEQ ID NO: 25364 - DNA, 23 bp, Artificial Sequence
  Synthetic
gactcugaccattgcttuccact

SEQ ID NO: 25365 - DNA, 27 bp, Artificial Sequence
  Synthetic
cgagtcgaaauggttaattaccuagca

SEQ ID NO: 25366 - DNA, 22 bp, Artificial Sequence
  Synthetic
gaacctcttcutcccctctucc

SEQ ID NO: 25367 - DNA, 21 bp, Artificial Sequence
  Synthetic
ggagacauggtcttcgctuct

SEQ ID NO: 25368 - DNA, 18 bp, Artificial Sequence
  Synthetic
cccaggucccctggauga

SEQ ID NO: 25369 - DNA, 26 bp, Artificial Sequence
  Synthetic
cttagaatgaagutgagagcgucaca

SEQ ID NO: 25370 - DNA, 23 bp, Artificial Sequence
  Synthetic
tcccaaauggcaattgtuccaga

SEQ ID NO: 25371 - DNA, 22 bp, Artificial Sequence
  Synthetic
ctgtugctggtttugggaacat

SEQ ID NO: 25372 - DNA, 31 bp, Artificial Sequence
  Synthetic
acaatgttgtucataatagtaguaccaagca

SEQ ID NO: 25373 - DNA, 30 bp, Artificial Sequence
  Synthetic
tcauactgttttaatuacagaggcaaagaa

SEQ ID NO: 25374 - DNA, 25 bp, Artificial Sequence
  Synthetic
ccagcugacagagacaaagaugaag

SEQ ID NO: 25375 - DNA, 28 bp, Artificial Sequence
  Synthetic
agatagttccagugcctgatgtgtauaa

SEQ ID NO: 25376 - DNA, 32 bp, Artificial Sequence
  Synthetic
tcautaaagttttcatatguaagacacgagac

SEQ ID NO: 25377 - DNA, 30 bp, Artificial Sequence
  Synthetic
agtgtagactaaugatgtgacttttgttut

SEQ ID NO: 25378 - DNA, 26 bp, Artificial Sequence
  Synthetic
tccagcaactuctgtagatgctttut

SEQ ID NO: 25379 - DNA, 31 bp, Artificial Sequence
  Synthetic
gggcctttctucatccatattactttauact

SEQ ID NO: 25380 - DNA, 27 bp, Artificial Sequence
  Synthetic
ctttaaactcagcautccatccctaug

SEQ ID NO: 25381 - DNA, 30 bp, Artificial Sequence
  Synthetic
ttgttgggttttgutactattttgtgacut

SEQ ID NO: 25382 - DNA, 23 bp, Artificial Sequence
  Synthetic
tgcatgugccagacatcctaaut

SEQ ID NO: 25383 - DNA, 22 bp, Artificial Sequence
  Synthetic
caatugccagaggaaaguagcc

SEQ ID NO: 25384 - DNA, 29 bp, Artificial Sequence
  Synthetic
tcatttgctgguaagttattgtaggugag

SEQ ID NO: 25385 - DNA, 23 bp, Artificial Sequence
  Synthetic
accugtaagttuggaggcacaag

SEQ ID NO: 25386 - DNA, 25 bp, Artificial Sequence
  Synthetic
gttctggagaauctggaagtucaga

SEQ ID NO: 25387 - DNA, 23 bp, Artificial Sequence
  Synthetic
actgtgtcttuggcactgatuca

SEQ ID NO: 25388 - DNA, 26 bp, Artificial Sequence
  Synthetic
agccaaaatauacctgggaaaugaat

SEQ ID NO: 25389 - DNA, 32 bp, Artificial Sequence
  Synthetic
ccaaagagctgaaaagautaagcattctatua

SEQ ID NO: 25390 - DNA, 23 bp, Artificial Sequence
  Synthetic
caagggcuggtgttgatactuca

SEQ ID NO: 25391 - DNA, 20 bp, Artificial Sequence
  Synthetic
ctgttcagcutgagccaguc

SEQ ID NO: 25392 - DNA, 27 bp, Artificial Sequence
  Synthetic
ccttcattgautttctttctccuccca

SEQ ID NO: 25393 - DNA, 22 bp, Artificial Sequence
  Synthetic
accagctgtuctcggagttcua

SEQ ID NO: 25394 - DNA, 24 bp, Artificial Sequence
  Synthetic
gctgcatttugtgtttaccgucaa

SEQ ID NO: 25395 - DNA, 19 bp, Artificial Sequence
  Synthetic
ctttaccaccgcguccauc

SEQ ID NO: 25396 - DNA, 20 bp, Artificial Sequence
  Synthetic
tgctgugggttgatcucacc

SEQ ID NO: 25397 - DNA, 20 bp, Artificial Sequence
  Synthetic
agtgtctgccuctccctcut

SEQ ID NO: 25398 - DNA, 20 bp, Artificial Sequence
  Synthetic
ggucagccagagggagtuct

SEQ ID NO: 25399 - DNA, 20 bp, Artificial Sequence
  Synthetic
cggctcccuttgtgcttuca

SEQ ID NO: 25400 - DNA, 21 bp, Artificial Sequence
  Synthetic
gtctcuggcaaaggtgttugg

SEQ ID NO: 25401 - DNA, 21 bp, Artificial Sequence
  Synthetic
gaagaccaugggtgtgtguct

SEQ ID NO: 25402 - DNA, 21 bp, Artificial Sequence
  Synthetic
cacguggcggctgaattuaat

SEQ ID NO: 25403 - DNA, 21 bp, Artificial Sequence
  Synthetic
tgcttguacgagacucggaac

SEQ ID NO: 25404 - DNA, 25 bp, Artificial Sequence
  Synthetic
ctgcaaagaacuctuggaaacagag

SEQ ID NO: 25405 - DNA, 20 bp, Artificial Sequence
  Synthetic
gcugagggcatcuggcaaaa

SEQ ID NO: 25406 - DNA, 21 bp, Artificial Sequence
  Synthetic
ccttccugctggacucagaga

SEQ ID NO: 25407 - DNA, 18 bp, Artificial Sequence
  Synthetic
tgcactgcugggcagtut

SEQ ID NO: 25408 - DNA, 22 bp, Artificial Sequence
  Synthetic
gttgacutcccaatuccagcag

SEQ ID NO: 25409 - DNA, 20 bp, Artificial Sequence
  Synthetic
ccaagaucccctggucaaga

SEQ ID NO: 25410 - DNA, 21 bp, Artificial Sequence
  Synthetic
tttcauccagaggccatuggg

SEQ ID NO: 25411 - DNA, 20 bp, Artificial Sequence
  Synthetic
agtcuccaagccaggaguca

SEQ ID NO: 25412 - DNA, 18 bp, Artificial Sequence
  Synthetic
gggtccuctgtccacuca

SEQ ID NO: 25413 - DNA, 18 bp, Artificial Sequence
  Synthetic
gacgaguggcauggaggt

SEQ ID NO: 25414 - DNA, 21 bp, Artificial Sequence
  Synthetic
aaatggaagucctgggtgcut

SEQ ID NO: 25415 - DNA, 21 bp, Artificial Sequence
  Synthetic
gtucaagacagaagggccuga

SEQ ID NO: 25416 - DNA, 23 bp, Artificial Sequence
  Synthetic
tgaggcataacugcaccctuggt

SEQ ID NO: 25417 - DNA, 23 bp, Artificial Sequence
  Synthetic
tttgugcctgtccugggagagac

SEQ ID NO: 25418 - DNA, 21 bp, Artificial Sequence
  Synthetic
gggccagaccuaagagcaauc

SEQ ID NO: 25419 - DNA, 21 bp, Artificial Sequence
  Synthetic
ggccatcuacaagcagucaca

SEQ ID NO: 25420 - DNA, 22 bp, Artificial Sequence
  Synthetic
ctgguaggttttcugggaaggg

SEQ ID NO: 25421 - DNA, 28 bp, Artificial Sequence
  Synthetic
acgatattgaacaauggttcacugaaga

SEQ ID NO: 25422 - DNA, 17 bp, Artificial Sequence
  Synthetic
ggcccccuatgguggga

SEQ ID NO: 25423 - DNA, 20 bp, Artificial Sequence
  Synthetic
gcaggaaacugcaccagcua

SEQ ID NO: 25424 - DNA, 17 bp, Artificial Sequence
  Synthetic
cccgucccaggcttcuc

SEQ ID NO: 25425 - DNA, 18 bp, Artificial Sequence
  Synthetic
gcuccgagccaugcagaa

SEQ ID NO: 25426 - DNA, 20 bp, Artificial Sequence
  Synthetic
cctcggaagagucgatgcug

SEQ ID NO: 25427 - DNA, 20 bp, Artificial Sequence
  Synthetic
ccactgggauggacatgugg

SEQ ID NO: 25428 - DNA, 18 bp, Artificial Sequence
  Synthetic
gggucagtgcucaccagt

SEQ ID NO: 25429 - DNA, 20 bp, Artificial Sequence
  Synthetic
gatgcagcuctccacuccag

SEQ ID NO: 25430 - DNA, 24 bp, Artificial Sequence
  Synthetic
gggtugggaacagatagtuaggga

SEQ ID NO: 25431 - DNA, 18 bp, Artificial Sequence
  Synthetic
ctucccagcggttgucca

SEQ ID NO: 25432 - DNA, 18 bp, Artificial Sequence
  Synthetic
gcuacctcgcucgccaag

SEQ ID NO: 25433 - DNA, 18 bp, Artificial Sequence
  Synthetic
agacgccuaccguccagt

SEQ ID NO: 25434 - DNA, 20 bp, Artificial Sequence
  Synthetic
gagcagggugcattggauct

SEQ ID NO: 25435 - DNA, 23 bp, Artificial Sequence
  Synthetic
cagcaccacuaagcgtaaatgug

SEQ ID NO: 25436 - DNA, 24 bp, Artificial Sequence
  Synthetic
gtctctucacccacacatcaucat

SEQ ID NO: 25437 - DNA, 20 bp, Artificial Sequence
  Synthetic
gttctgcucactgtggugct

SEQ ID NO: 25438 - DNA, 19 bp, Artificial Sequence
  Synthetic
cacugccctauccccaacg

SEQ ID NO: 25439 - DNA, 20 bp, Artificial Sequence
  Synthetic
actccccuatccgcttcugt

SEQ ID NO: 25440 - DNA, 23 bp, Artificial Sequence
  Synthetic
tcatgtcuggccatgaggaaaug

SEQ ID NO: 25441 - DNA, 19 bp, Artificial Sequence
  Synthetic
tccgccuaaccccgtaugt

SEQ ID NO: 25442 - DNA, 21 bp, Artificial Sequence
  Synthetic
gagauggagcaguggaaccat

SEQ ID NO: 25443 - DNA, 24 bp, Artificial Sequence
  Synthetic
cgaaucgtctacattucggagcag

SEQ ID NO: 25444 - DNA, 21 bp, Artificial Sequence
  Synthetic
ccautccctctugggacacac

SEQ ID NO: 25445 - DNA, 22 bp, Artificial Sequence
  Synthetic
ggcaaggacucagaaggaacuc

SEQ ID NO: 25446 - DNA, 18 bp, Artificial Sequence
  Synthetic
ggctgaguccttgccgut

SEQ ID NO: 25447 - DNA, 17 bp, Artificial Sequence
  Synthetic
ccagccuggccgaugac

SEQ ID NO: 25448 - DNA, 19 bp, Artificial Sequence
  Synthetic
gcacuccacagaccctcuc

SEQ ID NO: 25449 - DNA, 17 bp, Artificial Sequence
  Synthetic
acggccuggacccatuc

SEQ ID NO: 25450 - DNA, 30 bp, Artificial Sequence
  Synthetic
tgugattatttctatttuagcaaccaaagg

SEQ ID NO: 25451 - DNA, 23 bp, Artificial Sequence
  Synthetic
agaattccgaagutcagcugcat

SEQ ID NO: 25452 - DNA, 33 bp, Artificial Sequence
  Synthetic
ctgagttgtattugtgttaacttattcuagagt

SEQ ID NO: 25453 - DNA, 28 bp, Artificial Sequence
  Synthetic
ggttgtaacttaccutttccaggctaut

SEQ ID NO: 25454 - DNA, 22 bp, Artificial Sequence
  Synthetic
agtaggcagcugacagaaagug

SEQ ID NO: 25455 - DNA, 30 bp, Artificial Sequence
  Synthetic
aagtttgtaguagagaaagaataagcaugt

SEQ ID NO: 25456 - DNA, 26 bp, Artificial Sequence
  Synthetic
ggcctaagatugatgctgtgtatugt

SEQ ID NO: 25457 - DNA, 28 bp, Artificial Sequence
  Synthetic
aaatgcaauagaaaggaggtgagatuca

SEQ ID NO: 25458 - DNA, 22 bp, Artificial Sequence
  Synthetic
acacaugccagagattgcucag

SEQ ID NO: 25459 - DNA, 28 bp, Artificial Sequence
  Synthetic
tccagaaatgacauctacctgttacuca

SEQ ID NO: 25460 - DNA, 32 bp, Artificial Sequence
  Synthetic
gcattaggttattgaugatgctagtaacaaug

SEQ ID NO: 25461 - DNA, 25 bp, Artificial Sequence
  Synthetic
gatcaatattucccgcaaccactug

SEQ ID NO: 25462 - DNA, 30 bp, Artificial Sequence
  Synthetic
aaattacccaagtugcaaatatatgtctuc

SEQ ID NO: 25463 - DNA, 20 bp, Artificial Sequence
  Synthetic
gcttcagugtcagggtucca

SEQ ID NO: 25464 - DNA, 30 bp, Artificial Sequence
  Synthetic
atgtttagctcuagactaagttgcttucaa

SEQ ID NO: 25465 - DNA, 31 bp, Artificial Sequence
  Synthetic
agttaacagacaaaagucaacttuacagact

SEQ ID NO: 25466 - DNA, 29 bp, Artificial Sequence
  Synthetic
gtaagggttctaugatttcagtgatguct

SEQ ID NO: 25467 - DNA, 25 bp, Artificial Sequence
  Synthetic
ggacucaattcuagacccaccagat

SEQ ID NO: 25468 - DNA, 28 bp, Artificial Sequence
  Synthetic
agaatgccttcucttttgtctatatcug

SEQ ID NO: 25469 - DNA, 26 bp, Artificial Sequence
  Synthetic
ctctcctugccatcattactucaact

SEQ ID NO: 25470 - DNA, 25 bp, Artificial Sequence
  Synthetic
gatacggccutcactatguaaaggt

SEQ ID NO: 25471 - DNA, 19 bp, Artificial Sequence
  Synthetic
gaccguacagtgccucagt

SEQ ID NO: 25472 - DNA, 30 bp, Artificial Sequence
  Synthetic
cttcctaccuaagaataaaaatgggatugt

SEQ ID NO: 25473 - DNA, 27 bp, Artificial Sequence
  Synthetic
catggagtcugccaattctacttctut

SEQ ID NO: 25474 - DNA, 23 bp, Artificial Sequence
  Synthetic
cggaacctccutcagatgacuga

SEQ ID NO: 25475 - DNA, 31 bp, Artificial Sequence
  Synthetic
aataatggtaatcuctaactgtaagcauacc

SEQ ID NO: 25476 - DNA, 32 bp, Artificial Sequence
  Synthetic
tataaccctgtttuattgtgtagatactucag

SEQ ID NO: 25477 - DNA, 25 bp, Artificial Sequence
  Synthetic
gcaacugagtaaguggcaagaaaat

SEQ ID NO: 25478 - DNA, 28 bp, Artificial Sequence
  Synthetic
ccttttgataagauggcaacacttctug

SEQ ID NO: 25479 - DNA, 30 bp, Artificial Sequence
  Synthetic
tctcaaucaaaaagaaagcaaucaactaut

SEQ ID NO: 25480 - DNA, 27 bp, Artificial Sequence
  Synthetic
gaaattgtaguggaccttacccauacc

SEQ ID NO: 25481 - DNA, 25 bp, Artificial Sequence
  Synthetic
gctcatgauacttggtgtacuccct

SEQ ID NO: 25482 - DNA, 30 bp, Artificial Sequence
  Synthetic
tgacatttattaugcttcggaaatugaaga

SEQ ID NO: 25483 - DNA, 25 bp, Artificial Sequence
  Synthetic
cgggtccggauatgaatgauagact

SEQ ID NO: 25484 - DNA, 24 bp, Artificial Sequence
  Synthetic
agggccagutactagagacaucag

SEQ ID NO: 25485 - DNA, 30 bp, Artificial Sequence
  Synthetic
tgctaaatccagaaauacactctuccaaaa

SEQ ID NO: 25486 - DNA, 29 bp, Artificial Sequence
  Synthetic
tccttcttcaacuagattacagatcugct

SEQ ID NO: 25487 - DNA, 24 bp, Artificial Sequence
  Synthetic
acattuccagaagccaaagcuaca

SEQ ID NO: 25488 - DNA, 23 bp, Artificial Sequence
  Synthetic
cctacctctuccacgttgtuact

SEQ ID NO: 25489 - DNA, 28 bp, Artificial Sequence
  Synthetic
ggagaaaggaacuggtaaacacaaatuc

SEQ ID NO: 25490 - DNA, 30 bp, Artificial Sequence
  Synthetic
aacacaaaggtutttataagttctguggat

SEQ ID NO: 25491 - DNA, 23 bp, Artificial Sequence
  Synthetic
gctttauctgcccaugagacact

SEQ ID NO: 25492 - DNA, 31 bp, Artificial Sequence
  Synthetic
gttttgaaagagacuatgtcatgattcauct

SEQ ID NO: 25493 - DNA, 21 bp, Artificial Sequence
  Synthetic
tgcgguacctgctgaauacaa

SEQ ID NO: 25494 - DNA, 24 bp, Artificial Sequence
  Synthetic
ttttgtaggguacaggcatcctuc

SEQ ID NO: 25495 - DNA, 21 bp, Artificial Sequence
  Synthetic
gtaggccacgcuctgtgtaut

SEQ ID NO: 25496 - DNA, 24 bp, Artificial Sequence
  Synthetic
aaacgatggutgtatttgucacca

SEQ ID NO: 25497 - DNA, 20 bp, Artificial Sequence
  Synthetic
ctggccgacagutggauagg

SEQ ID NO: 25498 - DNA, 26 bp, Artificial Sequence
  Synthetic
aggtgaagtgautatccaggtgttug

SEQ ID NO: 25499 - DNA, 29 bp, Artificial Sequence
  Synthetic
caagagaacattugattcagacacugaaa

SEQ ID NO: 25500 - DNA, 30 bp, Artificial Sequence
  Synthetic
ttttcctctaaaatgutcctctgttgacut

SEQ ID NO: 25501 - DNA, 30 bp, Artificial Sequence
  Synthetic
gcacaattccauggattggattuaacaaat

SEQ ID NO: 25502 - DNA, 22 bp, Artificial Sequence
  Synthetic
ccagtgaagaauccctccugac

SEQ ID NO: 25503 - DNA, 30 bp, Artificial Sequence
  Synthetic
attgttgctcaaagucatataaagaucaca

SEQ ID NO: 25504 - DNA, 17 bp, Artificial Sequence
  Synthetic
gcgauggcgccucagaa

SEQ ID NO: 25505 - DNA, 17 bp, Artificial Sequence
  Synthetic
cacccccuccacagcuc

SEQ ID NO: 25506 - DNA, 24 bp, Artificial Sequence
  Synthetic
ccugacctcaaucaaacaaaaccc

SEQ ID NO: 25507 - DNA, 27 bp, Artificial Sequence
  Synthetic
ttcttcctggacgagucactctaaaua

SEQ ID NO: 25508 - DNA, 29 bp, Artificial Sequence
  Synthetic
gtctgcttctgutgtctataaacaugact

SEQ ID NO: 25509 - DNA, 31 bp, Artificial Sequence
  Synthetic
accctttgaccuagaaattaatcatgttgut

SEQ ID NO: 25510 - DNA, 23 bp, Artificial Sequence
  Synthetic
cctttcaacaguccagctttucc

SEQ ID NO: 25511 - DNA, 29 bp, Artificial Sequence
  Synthetic
gaucaaaggcactuagaagaacaagaaac

SEQ ID NO: 25512 - DNA, 24 bp, Artificial Sequence
  Synthetic
aagcatcaattuaagcctcctuga

SEQ ID NO: 25513 - DNA, 20 bp, Artificial Sequence
  Synthetic
ggaucccccagccttgtuaa

SEQ ID NO: 25514 - DNA, 22 bp, Artificial Sequence
  Synthetic
gctgtaaguccttcuccccaaa

SEQ ID NO: 25515 - DNA, 26 bp, Artificial Sequence
  Synthetic
gtatctcctaugaaccagacagcuct

SEQ ID NO: 25516 - DNA, 32 bp, Artificial Sequence
  Synthetic
gcatctatgagttugaaactgcataagauaat

SEQ ID NO: 25517 - DNA, 29 bp, Artificial Sequence
  Synthetic
tttattctttcaggugaggaaaagtucca

SEQ ID NO: 25518 - DNA, 23 bp, Artificial Sequence
  Synthetic
ctttgggtucaacttggcttucc

SEQ ID NO: 25519 - DNA, 26 bp, Artificial Sequence
  Synthetic
ttgaccctgacugtgttacaatcaut

SEQ ID NO: 25520 - DNA, 32 bp, Artificial Sequence
  Synthetic
gtctaataaaacccaugactttatactcacut

SEQ ID NO: 25521 - DNA, 21 bp, Artificial Sequence
  Synthetic
aacccgugcaattcaggauga

SEQ ID NO: 25522 - DNA, 24 bp, Artificial Sequence
  Synthetic
ccacaaccauttcttttccuggat

SEQ ID NO: 25523 - DNA, 30 bp, Artificial Sequence
  Synthetic
ccctccatcttuaaactatattcctccugt

SEQ ID NO: 25524 - DNA, 23 bp, Artificial Sequence
  Synthetic
ctgagtgaacugagtgaaccgut

SEQ ID NO: 25525 - DNA, 25 bp, Artificial Sequence
  Synthetic
ggacctaaccagguagatgaacuga

SEQ ID NO: 25526 - DNA, 25 bp, Artificial Sequence
  Synthetic
tcatgtgactcucagaacacattug

SEQ ID NO: 25527 - DNA, 22 bp, Artificial Sequence
  Synthetic
ctccatcccgaugtcaatguct

SEQ ID NO: 25528 - DNA, 26 bp, Artificial Sequence
  Synthetic
atgcaaccuaagaatagggacttugg

SEQ ID NO: 25529 - DNA, 24 bp, Artificial Sequence
  Synthetic
ccagaagugatctuacagaaggca

SEQ ID NO: 25530 - DNA, 22 bp, Artificial Sequence
  Synthetic
gaagaaacugggaggucagcaa

SEQ ID NO: 25531 - DNA, 23 bp, Artificial Sequence
  Synthetic
tcucccaggaccuagagaaaacc

SEQ ID NO: 25532 - DNA, 21 bp, Artificial Sequence
  Synthetic
tgggctcaucatcagctugaa

SEQ ID NO: 25533 - DNA, 22 bp, Artificial Sequence
  Synthetic
agctggcugataagattcugga

SEQ ID NO: 25534 - DNA, 22 bp, Artificial Sequence
  Synthetic
tgactcucagcccagtactcut

SEQ ID NO: 25535 - DNA, 23 bp, Artificial Sequence
  Synthetic
gatccttagcaaacugctggaug

SEQ ID NO: 25536 - DNA, 26 bp, Artificial Sequence
  Synthetic
tgaacgctatucagaaatgtguacca

SEQ ID NO: 25537 - DNA, 26 bp, Artificial Sequence
  Synthetic
gtaccttaagaaaugactcccuggaa

SEQ ID NO: 25538 - DNA, 21 bp, Artificial Sequence
  Synthetic
ccagcuttacaugccgaagga

SEQ ID NO: 25539 - DNA, 22 bp, Artificial Sequence
  Synthetic
tcgccucctaccttuaaccact

SEQ ID NO: 25540 - DNA, 31 bp, Artificial Sequence
  Synthetic
tcacagtaccacugtaaaataagtttatugt

SEQ ID NO: 25541 - DNA, 26 bp, Artificial Sequence
  Synthetic
ccgtctctccutgatcaatcacauag

SEQ ID NO: 25542 - DNA, 22 bp, Artificial Sequence
  Synthetic
cacacugagaaagcggaagaug

SEQ ID NO: 25543 - DNA, 28 bp, Artificial Sequence
  Synthetic
cttttcccaaguccatccaattctaaut

SEQ ID NO: 25544 - DNA, 28 bp, Artificial Sequence
  Synthetic
catagaagttagccugttacccatctut

SEQ ID NO: 25545 - DNA, 22 bp, Artificial Sequence
  Synthetic
gtttgaggaugtctgagcaugg

SEQ ID NO: 25546 - DNA, 21 bp, Artificial Sequence
  Synthetic
ctcttcccgccutcctacuac

SEQ ID NO: 25547 - DNA, 22 bp, Artificial Sequence
  Synthetic
agcccaccugagtaagactuct

SEQ ID NO: 25548 - DNA, 21 bp, Artificial Sequence
  Synthetic
gcgugaagaacucagaaccct

SEQ ID NO: 25549 - DNA, 20 bp, Artificial Sequence
  Synthetic
ccacctgcutggacgagaug

SEQ ID NO: 25550 - DNA, 22 bp, Artificial Sequence
  Synthetic
ccaagaggguggagauccagat

SEQ ID NO: 25551 - DNA, 19 bp, Artificial Sequence
  Synthetic
gugtagccucagccacagg

SEQ ID NO: 25552 - DNA, 18 bp, Artificial Sequence
  Synthetic
ggctgcuccagtgugcat

SEQ ID NO: 25553 - DNA, 20 bp, Artificial Sequence
  Synthetic
ccgtguccaggagaaagcug

SEQ ID NO: 25554 - DNA, 18 bp, Artificial Sequence
  Synthetic
cagagaugccgggcucaa

SEQ ID NO: 25555 - DNA, 19 bp, Artificial Sequence
  Synthetic
gtggcaugcaaggugagga

SEQ ID NO: 25556 - DNA, 21 bp, Artificial Sequence
  Synthetic
catctcatgugcctgcugact

SEQ ID NO: 25557 - DNA, 22 bp, Artificial Sequence
  Synthetic
gatgaaguagaggcagcagugg

SEQ ID NO: 25558 - DNA, 20 bp, Artificial Sequence
  Synthetic
cctucccgcacatgtguaac

SEQ ID NO: 25559 - DNA, 22 bp, Artificial Sequence
  Synthetic
gatggtaccccacutggtctuc

SEQ ID NO: 25560 - DNA, 18 bp, Artificial Sequence
  Synthetic
cgaggcguaccgtgugaa

SEQ ID NO: 25561 - DNA, 19 bp, Artificial Sequence
  Synthetic
gggacggaaaugactuggg

SEQ ID NO: 25562 - DNA, 28 bp, Artificial Sequence
  Synthetic
ctcccagcccuaatttctgtattaaugt

SEQ ID NO: 25563 - DNA, 19 bp, Artificial Sequence
  Synthetic
cccaggacucggctcucat

SEQ ID NO: 25564 - DNA, 24 bp, Artificial Sequence
  Synthetic
gataacguggagggtuaagacaca

SEQ ID NO: 25565 - DNA, 24 bp, Artificial Sequence
  Synthetic
ctccatgtcuatcacctcttuggg

SEQ ID NO: 25566 - DNA, 23 bp, Artificial Sequence
  Synthetic
caatccgagutttatuggcgaca

SEQ ID NO: 25567 - DNA, 23 bp, Artificial Sequence
  Synthetic
cgctagaucttcttcccuaaccc

SEQ ID NO: 25568 - DNA, 22 bp, Artificial Sequence
  Synthetic
ccgacaaaacguatgagcucac

SEQ ID NO: 25569 - DNA, 21 bp, Artificial Sequence
  Synthetic
tgtcagcautgguaccaccac

SEQ ID NO: 25570 - DNA, 20 bp, Artificial Sequence
  Synthetic
tcagctgguttgggcuacag

SEQ ID NO: 25571 - DNA, 24 bp, Artificial Sequence
  Synthetic
gctggatguagagctttucagcaa

SEQ ID NO: 25572 - DNA, 26 bp, Artificial Sequence
  Synthetic
ggtgtgtuaccatgcctcttuagaaa

SEQ ID NO: 25573 - DNA, 22 bp, Artificial Sequence
  Synthetic
gttcttggcgauggttttccuc

SEQ ID NO: 25574 - DNA, 17 bp, Artificial Sequence
  Synthetic
gggcuggcggaagacuc

SEQ ID NO: 25575 - DNA, 21 bp, Artificial Sequence
  Synthetic
ggttcatctuggcagggucaa

SEQ ID NO: 25576 - DNA, 21 bp, Artificial Sequence
  Synthetic
cgggctucgtgactacuacag

SEQ ID NO: 25577 - DNA, 23 bp, Artificial Sequence
  Synthetic
tccaaagctuggatgtcatccut

SEQ ID NO: 25578 - DNA, 22 bp, Artificial Sequence
  Synthetic
gttuccccaaggaucaagagua

SEQ ID NO: 25579 - DNA, 23 bp, Artificial Sequence
  Synthetic
gtggacgtaguactggttgagug

SEQ ID NO: 25580 - DNA, 20 bp, Artificial Sequence
  Synthetic
cgtctucatcggcuaccact

SEQ ID NO: 25581 - DNA, 17 bp, Artificial Sequence
  Synthetic
gggcguagcgcagtuca

SEQ ID NO: 25582 - DNA, 19 bp, Artificial Sequence
  Synthetic
ggcuccgaaacccacacuc

SEQ ID NO: 25583 - DNA, 17 bp, Artificial Sequence
  Synthetic
gguaccaucgccacgca

SEQ ID NO: 25584 - DNA, 18 bp, Artificial Sequence
  Synthetic
cagugggctuggaacacc

SEQ ID NO: 25585 - DNA, 23 bp, Artificial Sequence
  Synthetic
gtttccttucccaccttcucaga

SEQ ID NO: 25586 - DNA, 24 bp, Artificial Sequence
  Synthetic
tctttcttgcggguatccaagaug

SEQ ID NO: 25587 - DNA, 22 bp, Artificial Sequence
  Synthetic
agccactccutgcttccttuag

SEQ ID NO: 25588 - DNA, 23 bp, Artificial Sequence
  Synthetic
cgtcccttucagctggaaaauca

SEQ ID NO: 25589 - DNA, 22 bp, Artificial Sequence
  Synthetic
ttgcaattcuagccacccauct

SEQ ID NO: 25590 - DNA, 22 bp, Artificial Sequence
  Synthetic
ctgcacuaggaaacugaaagcg

SEQ ID NO: 25591 - DNA, 19 bp, Artificial Sequence
  Synthetic
ttccaacgggcutccauca

SEQ ID NO: 25592 - DNA, 22 bp, Artificial Sequence
  Synthetic
gattttcuccaccgcactctuc

SEQ ID NO: 25593 - DNA, 23 bp, Artificial Sequence
  Synthetic
tgutcttccttucggaaaagggt

SEQ ID NO: 25594 - DNA, 22 bp, Artificial Sequence
  Synthetic
cauttgctucaaggacaacgct

SEQ ID NO: 25595 - DNA, 22 bp, Artificial Sequence
  Synthetic
caugagacaugcagaagcgaga

SEQ ID NO: 25596 - DNA, 20 bp, Artificial Sequence
  Synthetic
ccacagucacatuggcgact

SEQ ID NO: 25597 - DNA, 25 bp, Artificial Sequence
  Synthetic
ccttaaggaaacgaccutcctctuc

SEQ ID NO: 25598 - DNA, 19 bp, Artificial Sequence
  Synthetic
cugcagcaagucaagcagt

SEQ ID NO: 25599 - DNA, 19 bp, Artificial Sequence
  Synthetic
gctugacaacgtcctuggg

SEQ ID NO: 25600 - DNA, 28 bp, Artificial Sequence
  Synthetic
ttgatgtgtattuggtgtcagtgtaugt

SEQ ID NO: 25601 - DNA, 23 bp, Artificial Sequence
  Synthetic
cgatgtugcaaaacggctgauat

SEQ ID NO: 25602 - DNA, 23 bp, Artificial Sequence
  Synthetic
tcattagccaaugtgtgtccugt

SEQ ID NO: 25603 - DNA, 20 bp, Artificial Sequence
  Synthetic
actctccugacccacgaucc

SEQ ID NO: 25604 - DNA, 24 bp, Artificial Sequence
  Synthetic
gctcaccaucttctcuacaaacca

SEQ ID NO: 25605 - DNA, 18 bp, Artificial Sequence
  Synthetic
gcactgtgucccagcauc

SEQ ID NO: 25606 - DNA, 24 bp, Artificial Sequence
  Synthetic
gcctugcaaagggatctagugaag

SEQ ID NO: 25607 - DNA, 21 bp, Artificial Sequence
  Synthetic
cctgttccccuatgcagugat

SEQ ID NO: 25608 - DNA, 22 bp, Artificial Sequence
  Synthetic
gctccaacugtgagaaauggga

SEQ ID NO: 25609 - DNA, 23 bp, Artificial Sequence
  Synthetic
ccgctccacutcataactgauga

SEQ ID NO: 25610 - DNA, 22 bp, Artificial Sequence
  Synthetic
gacatcccuctcctgctttuca

SEQ ID NO: 25611 - DNA, 21 bp, Artificial Sequence
  Synthetic
gcaugtttggauccccaccag

SEQ ID NO: 25612 - DNA, 22 bp, Artificial Sequence
  Synthetic
ccttctcccugcaggcttuaat

SEQ ID NO: 25613 - DNA, 23 bp, Artificial Sequence
  Synthetic
gccagtcugatttaggaatgugc

SEQ ID NO: 25614 - DNA, 28 bp, Artificial Sequence
  Synthetic
tgctgaaatggaaucgagaaatgagaua

SEQ ID NO: 25615 - DNA, 22 bp, Artificial Sequence
  Synthetic
ccttggtcutgaattcggugct

SEQ ID NO: 25616 - DNA, 22 bp, Artificial Sequence
  Synthetic
tcctccatacugctgacctugt

SEQ ID NO: 25617 - DNA, 24 bp, Artificial Sequence
  Synthetic
ttccctgagutctagggactuacc

SEQ ID NO: 25618 - DNA, 25 bp, Artificial Sequence
  Synthetic
ccatcaggguaatattgctggtuca

SEQ ID NO: 25619 - DNA, 28 bp, Artificial Sequence
  Synthetic
aagcctttgaugacatagagaacacaut

SEQ ID NO: 25620 - DNA, 24 bp, Artificial Sequence
  Synthetic
catagttucccattggttguccct

SEQ ID NO: 25621 - DNA, 22 bp, Artificial Sequence
  Synthetic
gaccuggacccaatcaacucaa

SEQ ID NO: 25622 - DNA, 26 bp, Artificial Sequence
  Synthetic
cttactgcuggtaaaagagacugcat

SEQ ID NO: 25623 - DNA, 29 bp, Artificial Sequence
  Synthetic
gtacttaggcagguaggaagaaaattaut

SEQ ID NO: 25624 - DNA, 27 bp, Artificial Sequence
  Synthetic
acatgtcuaacaattttcctugcaacg

SEQ ID NO: 25625 - DNA, 24 bp, Artificial Sequence
  Synthetic
tgctcagacaggcaucattactug

SEQ ID NO: 25626 - DNA, 18 bp, Artificial Sequence
  Synthetic
tctagguggctggucgga

SEQ ID NO: 25627 - DNA, 30 bp, Artificial Sequence
  Synthetic
tggattcacauagacacuatcacatttuaa

SEQ ID NO: 25628 - DNA, 32 bp, Artificial Sequence
  Synthetic
catctatgaatguaccatgttaatgtcttcut

SEQ ID NO: 25629 - DNA, 24 bp, Artificial Sequence
  Synthetic
gtaaatccatuctgctgctgucct

SEQ ID NO: 25630 - DNA, 24 bp, Artificial Sequence
  Synthetic
catgggaggaugttctttcccaut

SEQ ID NO: 25631 - DNA, 23 bp, Artificial Sequence
  Synthetic
acaaaagcgauctccuccagaag

SEQ ID NO: 25632 - DNA, 28 bp, Artificial Sequence
  Synthetic
agtcaggcatuggtttttaatgtaugga

SEQ ID NO: 25633 - DNA, 17 bp, Artificial Sequence
  Synthetic
tguttccugccacggct

SEQ ID NO: 25634 - DNA, 18 bp, Artificial Sequence
  Synthetic
gcccuccagctccuagac

SEQ ID NO: 25635 - DNA, 28 bp, Artificial Sequence
  Synthetic
aaacaggatugtattttgtaguccacca

SEQ ID NO: 25636 - DNA, 20 bp, Artificial Sequence
  Synthetic
gtgaaggaggugctggacuc

SEQ ID NO: 25637 - DNA, 20 bp, Artificial Sequence
  Synthetic
gaaccaucagcaccgugact

SEQ ID NO: 25638 - DNA, 20 bp, Artificial Sequence
  Synthetic
ggcucccaggcagcugcaaa

SEQ ID NO: 25639 - DNA, 22 bp, Artificial Sequence
  Synthetic
tgccctggcuatgcaggtacuc

SEQ ID NO: 25640 - DNA, 19 bp, Artificial Sequence
  Synthetic
ccactgctuctgggcgtut

SEQ ID NO: 25641 - DNA, 19 bp, Artificial Sequence
  Synthetic
tcgaagaggucctcgucct

SEQ ID NO: 25642 - DNA, 20 bp, Artificial Sequence
  Synthetic
gcagcugagcaccaaaucca

SEQ ID NO: 25643 - DNA, 17 bp, Artificial Sequence
  Synthetic
cgttguccccacaugcc

SEQ ID NO: 25644 - DNA, 17 bp, Artificial Sequence
  Synthetic
tctgcaccugggtgugg

SEQ ID NO: 25645 - DNA, 20 bp, Artificial Sequence
  Synthetic
atgtgccagaugcaccucaa

SEQ ID NO: 25646 - DNA, 19 bp, Artificial Sequence
  Synthetic
tgaggugcagtuggcacat

SEQ ID NO: 25647 - DNA, 19 bp, Artificial Sequence
  Synthetic
gacgaggacgaccutcucc

SEQ ID NO: 25648 - DNA, 22 bp, Artificial Sequence
  Synthetic
tcaagggcutaccactguagga

SEQ ID NO: 25649 - DNA, 17 bp, Artificial Sequence
  Synthetic
ccctgaugcacccguct

SEQ ID NO: 25650 - DNA, 18 bp, Artificial Sequence
  Synthetic
cggcctcucaggtcacut

SEQ ID NO: 25651 - DNA, 19 bp, Artificial Sequence
  Synthetic
gtgggccucacctctctuc

SEQ ID NO: 25652 - DNA, 18 bp, Artificial Sequence
  Synthetic
ctgctgcutccactgcug

SEQ ID NO: 25653 - DNA, 17 bp, Artificial Sequence
  Synthetic
acucggcccccacctua

SEQ ID NO: 25654 - DNA, 18 bp, Artificial Sequence
  Synthetic
taccucccttugcaggct

SEQ ID NO: 25655 - DNA, 18 bp, Artificial Sequence
  Synthetic
gtccccutcgggcaugaa

SEQ ID NO: 25656 - DNA, 21 bp, Artificial Sequence
  Synthetic
ggacaggaaacucagggtcuc

SEQ ID NO: 25657 - DNA, 23 bp, Artificial Sequence
  Synthetic
gagggtgacccauaactctcuct

SEQ ID NO: 25658 - DNA, 21 bp, Artificial Sequence
  Synthetic
gtcactgagcuccttgtcugt

SEQ ID NO: 25659 - DNA, 22 bp, Artificial Sequence
  Synthetic
tcttctccccuccctgtttcuc

SEQ ID NO: 25660 - DNA, 18 bp, Artificial Sequence
  Synthetic
gggctccaugccccatua

SEQ ID NO: 25661 - DNA, 19 bp, Artificial Sequence
  Synthetic
cacgccuctccctucacag

SEQ ID NO: 25662 - DNA, 19 bp, Artificial Sequence
  Synthetic
ggagcagcaccuggatcuc

SEQ ID NO: 25663 - DNA, 19 bp, Artificial Sequence
  Synthetic
gctucccccaccacttcuc

SEQ ID NO: 25664 - DNA, 20 bp, Artificial Sequence
  Synthetic
agcacgcaguttcttccuca

SEQ ID NO: 25665 - DNA, 22 bp, Artificial Sequence
  Synthetic
tcctgtcctcutcttcctccua

SEQ ID NO: 25666 - DNA, 18 bp, Artificial Sequence
  Synthetic
ctgccaccucacgtucca

SEQ ID NO: 25667 - DNA, 18 bp, Artificial Sequence
  Synthetic
tgaccgcauccccatucc

SEQ ID NO: 25668 - DNA, 23 bp, Artificial Sequence
  Synthetic
cattuaaccagaaccagcugcac

SEQ ID NO: 25669 - DNA, 18 bp, Artificial Sequence
  Synthetic
acaccgaggguggaggua

SEQ ID NO: 25670 - DNA, 20 bp, Artificial Sequence
  Synthetic
gcaccccucagaagctgaut

SEQ ID NO: 25671 - DNA, 18 bp, Artificial Sequence
  Synthetic
ggtgaugcggctctgcut

SEQ ID NO: 25672 - DNA, 21 bp, Artificial Sequence
  Synthetic
ggcttgtccucttccctccua

SEQ ID NO: 25673 - DNA, 23 bp, Artificial Sequence
  Synthetic
gcttctccagcutctcagtgaug

SEQ ID NO: 25674 - DNA, 22 bp, Artificial Sequence
  Synthetic
gtgctcacagacaugcacatug

SEQ ID NO: 25675 - DNA, 21 bp, Artificial Sequence
  Synthetic
tgaggtuagccacgtacucgt

SEQ ID NO: 25676 - DNA, 19 bp, Artificial Sequence
  Synthetic
cggugaaggtgauccacgt

SEQ ID NO: 25677 - DNA, 20 bp, Artificial Sequence
  Synthetic
gacttggauccccacugcat

SEQ ID NO: 25678 - DNA, 19 bp, Artificial Sequence
  Synthetic
ctacuatgccguggcccat

SEQ ID NO: 25679 - DNA, 17 bp, Artificial Sequence
  Synthetic
cugcaccgaggcagcua

SEQ ID NO: 25680 - DNA, 19 bp, Artificial Sequence
  Synthetic
cgagctgugcatcctgcut

SEQ ID NO: 25681 - DNA, 22 bp, Artificial Sequence
  Synthetic
cattucccauagggacacgtua

SEQ ID NO: 25682 - DNA, 21 bp, Artificial Sequence
  Synthetic
acgcttgctuctcctgtctug

SEQ ID NO: 25683 - DNA, 20 bp, Artificial Sequence
  Synthetic
ggctccccucaaaacuccat

SEQ ID NO: 25684 - DNA, 21 bp, Artificial Sequence
  Synthetic
gtcactgaccccuctctccut

SEQ ID NO: 25685 - DNA, 21 bp, Artificial Sequence
  Synthetic
acagaaaaccuctggguggac

SEQ ID NO: 25686 - DNA, 23 bp, Artificial Sequence
  Synthetic
gcatgctgcugaaaacctucaac

SEQ ID NO: 25687 - DNA, 21 bp, Artificial Sequence
  Synthetic
gtgaggatuccagtcgctguc

SEQ ID NO: 25688 - DNA, 21 bp, Artificial Sequence
  Synthetic
caacguggaccagaaggugat

SEQ ID NO: 25689 - DNA, 18 bp, Artificial Sequence
  Synthetic
gctcacgcguccaccaut

SEQ ID NO: 25690 - DNA, 18 bp, Artificial Sequence
  Synthetic
cttgucgacctgggugct

SEQ ID NO: 25691 - DNA, 17 bp, Artificial Sequence
  Synthetic
cgtcgcugtctcgctug

SEQ ID NO: 25692 - DNA, 22 bp, Artificial Sequence
  Synthetic
cagccucaacgaccuagagaag

SEQ ID NO: 25693 - DNA, 18 bp, Artificial Sequence
  Synthetic
gggucaaagcccagcugt

SEQ ID NO: 25694 - DNA, 20 bp, Artificial Sequence
  Synthetic
agaucaagctuggccggaag

SEQ ID NO: 25695 - DNA, 18 bp, Artificial Sequence
  Synthetic
cggccucacctcctctug

SEQ ID NO: 25696 - DNA, 18 bp, Artificial Sequence
  Synthetic
gcucactcugccccacag

SEQ ID NO: 25697 - DNA, 20 bp, Artificial Sequence
  Synthetic
cggtcgauggcattctccut

SEQ ID NO: 25698 - DNA, 21 bp, Artificial Sequence
  Synthetic
cagctcgtugaggaggagtug

SEQ ID NO: 25699 - DNA, 20 bp, Artificial Sequence
  Synthetic
aacacggaugccaccagaut

SEQ ID NO: 25700 - DNA, 23 bp, Artificial Sequence
  Synthetic
tgctattatugccggctguaagg

SEQ ID NO: 25701 - DNA, 20 bp, Artificial Sequence
  Synthetic
cagcucaagccaaccaccua

SEQ ID NO: 25702 - DNA, 28 bp, Artificial Sequence
  Synthetic
ggatcagacacuaaacgaacttaacugt

SEQ ID NO: 25703 - DNA, 22 bp, Artificial Sequence
  Synthetic
cutgacattuccagcaaagcga

SEQ ID NO: 25704 - DNA, 22 bp, Artificial Sequence
  Synthetic
catcaagaagcugtccaccauc

SEQ ID NO: 25705 - DNA, 28 bp, Artificial Sequence
  Synthetic
tctcttatatagugaaaaccaccuccca

SEQ ID NO: 25706 - DNA, 20 bp, Artificial Sequence
  Synthetic
ggcctcttcuccgtctgcua

SEQ ID NO: 25707 - DNA, 23 bp, Artificial Sequence
  Synthetic
gaccaaaaggaguctgaggctut

SEQ ID NO: 25708 - DNA, 18 bp, Artificial Sequence
  Synthetic
ccctggugatgcccacuc

SEQ ID NO: 25709 - DNA, 24 bp, Artificial Sequence
  Synthetic
tggaaaccucagctcctataugct

SEQ ID NO: 25710 - DNA, 23 bp, Artificial Sequence
  Synthetic
gcagaagcaggutattgtctcut

SEQ ID NO: 25711 - DNA, 23 bp, Artificial Sequence
  Synthetic
agagagacccaugatgacugagg

SEQ ID NO: 25712 - DNA, 22 bp, Artificial Sequence
  Synthetic
tcattgaguacatgccccucct

SEQ ID NO: 25713 - DNA, 22 bp, Artificial Sequence
  Synthetic
cctccacuaagcctucaaagcc

SEQ ID NO: 25714 - DNA, 23 bp, Artificial Sequence
  Synthetic
gaggcagcaggaaaugagagtua

SEQ ID NO: 25715 - DNA, 21 bp, Artificial Sequence
  Synthetic
atugaagcggacatuggcaac

SEQ ID NO: 25716 - DNA, 25 bp, Artificial Sequence
  Synthetic
cctgttttccuagttctgtctcucg

SEQ ID NO: 25717 - DNA, 19 bp, Artificial Sequence
  Synthetic
ccaugcacagggagugaca

SEQ ID NO: 25718 - DNA, 20 bp, Artificial Sequence
  Synthetic
tggagucagcgcatttccug

SEQ ID NO: 25719 - DNA, 22 bp, Artificial Sequence
  Synthetic
ccuccagagaaagagacacugt

SEQ ID NO: 25720 - DNA, 18 bp, Artificial Sequence
  Synthetic
gggauccgcactcaccua

SEQ ID NO: 25721 - DNA, 21 bp, Artificial Sequence
  Synthetic
tggagtttgugtcaggtgguc

SEQ ID NO: 25722 - DNA, 24 bp, Artificial Sequence
  Synthetic
catacccttcuctctgctccaaut

SEQ ID NO: 25723 - DNA, 17 bp, Artificial Sequence
  Synthetic
cggctgcugagccugat

SEQ ID NO: 25724 - DNA, 21 bp, Artificial Sequence
  Synthetic
gcucagagagggagautggug

SEQ ID NO: 25725 - DNA, 17 bp, Artificial Sequence
  Synthetic
ctcugcaccggcagugt

SEQ ID NO: 25726 - DNA, 19 bp, Artificial Sequence
  Synthetic
aagacccgccuaactgcuc

SEQ ID NO: 25727 - DNA, 19 bp, Artificial Sequence
  Synthetic
gggatcucccaggcaucct

SEQ ID NO: 25728 - DNA, 17 bp, Artificial Sequence
  Synthetic
aggagcuggagcugggt

SEQ ID NO: 25729 - DNA, 19 bp, Artificial Sequence
  Synthetic
cugggtgctugaggaccaa

SEQ ID NO: 25730 - DNA, 22 bp, Artificial Sequence
  Synthetic
ccaaatuccccatcaaguggac

SEQ ID NO: 25731 - DNA, 22 bp, Artificial Sequence
  Synthetic
acaggccaugaggaccttctua

SEQ ID NO: 25732 - DNA, 17 bp, Artificial Sequence
  Synthetic
agucucgggcccacagt

SEQ ID NO: 25733 - DNA, 19 bp, Artificial Sequence
  Synthetic
ggaggtgguccccacucat

SEQ ID NO: 25734 - DNA, 28 bp, Artificial Sequence
  Synthetic
cgctttgtgacutaactttttacaguga

SEQ ID NO: 25735 - DNA, 27 bp, Artificial Sequence
  Synthetic
aaactctgtaccutttcctctttucgt

SEQ ID NO: 25736 - DNA, 25 bp, Artificial Sequence
  Synthetic
gtgctttcucaccatgtttcttugt

SEQ ID NO: 25737 - DNA, 25 bp, Artificial Sequence
  Synthetic
cattttaacccagugctgagatgut

SEQ ID NO: 25738 - DNA, 26 bp, Artificial Sequence
  Synthetic
tcgttgtttutctttcatcuccccat

SEQ ID NO: 25739 - DNA, 23 bp, Artificial Sequence
  Synthetic
cttccgtcugggctttgaaauac

SEQ ID NO: 25740 - DNA, 28 bp, Artificial Sequence
  Synthetic
tgaaaggtgaaatuattcctcacatcut

SEQ ID NO: 25741 - DNA, 26 bp, Artificial Sequence
  Synthetic
ggaaaccagccaaguaaccttgtuat

SEQ ID NO: 25742 - DNA, 27 bp, Artificial Sequence
  Synthetic
tgtctcttccatucatgctcatcttut

SEQ ID NO: 25743 - DNA, 25 bp, Artificial Sequence
  Synthetic
ctctaccacauattcctgaccaucc

SEQ ID NO: 25744 - DNA, 27 bp, Artificial Sequence
  Synthetic
agatcctttcttauaaccgtgccaauc

SEQ ID NO: 25745 - DNA, 21 bp, Artificial Sequence
  Synthetic
acagcagacacagutccctuc

SEQ ID NO: 25746 - DNA, 22 bp, Artificial Sequence
  Synthetic
cagataugggccattgcugagt

SEQ ID NO: 25747 - DNA, 27 bp, Artificial Sequence
  Synthetic
ctcatagtctucatcagccatgucaat

SEQ ID NO: 25748 - DNA, 17 bp, Artificial Sequence
  Synthetic
ccgcucacgctctcucc

SEQ ID NO: 25749 - DNA, 23 bp, Artificial Sequence
  Synthetic
tctgtgctuagactctgcaugac

SEQ ID NO: 25750 - DNA, 17 bp, Artificial Sequence
  Synthetic
gccacgugtccaugcag

SEQ ID NO: 25751 - DNA, 21 bp, Artificial Sequence
  Synthetic
ttgguccgagacacgtagtug

SEQ ID NO: 25752 - DNA, 19 bp, Artificial Sequence
  Synthetic
caggctctucccagcagua

SEQ ID NO: 25753 - DNA, 18 bp, Artificial Sequence
  Synthetic
cagctgcuctgcgtucct

SEQ ID NO: 25754 - DNA, 18 bp, Artificial Sequence
  Synthetic
gggagccccgucacagua

SEQ ID NO: 25755 - DNA, 21 bp, Artificial Sequence
  Synthetic
ggaugggcacatcuggaaaca

SEQ ID NO: 25756 - DNA, 19 bp, Artificial Sequence
  Synthetic
cctcgtcguctacgtcguc

SEQ ID NO: 25757 - DNA, 20 bp, Artificial Sequence
  Synthetic
gcgatgtugaggtcgugcat

SEQ ID NO: 25758 - DNA, 17 bp, Artificial Sequence
  Synthetic
cggcuccatccguccac

SEQ ID NO: 25759 - DNA, 17 bp, Artificial Sequence
  Synthetic
ggcaccuggcacaugct

SEQ ID NO: 25760 - DNA, 18 bp, Artificial Sequence
  Synthetic
gcgcaggaccauggacug

SEQ ID NO: 25761 - DNA, 24 bp, Artificial Sequence
  Synthetic
ctactggaccagcucaggtuaaag

SEQ ID NO: 25762 - DNA, 19 bp, Artificial Sequence
  Synthetic
ggtgggagacuccggguag

SEQ ID NO: 25763 - DNA, 20 bp, Artificial Sequence
  Synthetic
gggugtggatugacccagat

SEQ ID NO: 25764 - DNA, 28 bp, Artificial Sequence
  Synthetic
gttattttgguacctgagaacguaacag

SEQ ID NO: 25765 - DNA, 22 bp, Artificial Sequence
  Synthetic
gtcacgugagcaaacagctuag

SEQ ID NO: 25766 - DNA, 31 bp, Artificial Sequence
  Synthetic
tcgcagagagtguatcatctgttttatttut

SEQ ID NO: 25767 - DNA, 20 bp, Artificial Sequence
  Synthetic
gtggcacacggauggaaauc

SEQ ID NO: 25768 - DNA, 19 bp, Artificial Sequence
  Synthetic
tgaaggcgccuggatagug

SEQ ID NO: 25769 - DNA, 20 bp, Artificial Sequence
  Synthetic
ctactcactuccgctccgut

SEQ ID NO: 25770 - DNA, 24 bp, Artificial Sequence
  Synthetic
gggauggacagaagaautgactuc

SEQ ID NO: 25771 - DNA, 21 bp, Artificial Sequence
  Synthetic
aatgcatucgcggctctauaa

SEQ ID NO: 25772 - DNA, 27 bp, Artificial Sequence
  Synthetic
aaacgtgttucaagcatagtttugaca

SEQ ID NO: 25773 - DNA, 22 bp, Artificial Sequence
  Synthetic
tgtgatggcuggcaatgaugaa

SEQ ID NO: 25774 - DNA, 18 bp, Artificial Sequence
  Synthetic
cagcaccuccaccaugct

SEQ ID NO: 25775 - DNA, 19 bp, Artificial Sequence
  Synthetic
cgtauccccgtagaugcca

SEQ ID NO: 25776 - DNA, 28 bp, Artificial Sequence
  Synthetic
aggaaatgacucaaatatgctgtcugaa

SEQ ID NO: 25777 - DNA, 26 bp, Artificial Sequence
  Synthetic
ggagaagaaagagagaugtagggcua

SEQ ID NO: 25778 - DNA, 21 bp, Artificial Sequence
  Synthetic
cagaaccccagcutgtauccc

SEQ ID NO: 25779 - DNA, 20 bp, Artificial Sequence
  Synthetic
tgcggcagautgtgactuga

SEQ ID NO: 25780 - DNA, 27 bp, Artificial Sequence
  Synthetic
aacatctcuttaagattcugccaacct

SEQ ID NO: 25781 - DNA, 26 bp, Artificial Sequence
  Synthetic
gccggauaccaagtagaaaaagugat

SEQ ID NO: 25782 - DNA, 28 bp, Artificial Sequence
  Synthetic
tgaaagtagagagcutttcctagtuaga

SEQ ID NO: 25783 - DNA, 23 bp, Artificial Sequence
  Synthetic
ccgcactaucgtgaccagaatut

SEQ ID NO: 25784 - DNA, 24 bp, Artificial Sequence
  Synthetic
gtagttctcgtuccagtcgtctug

SEQ ID NO: 25785 - DNA, 28 bp, Artificial Sequence
  Synthetic
agaaagaaacucatggataatccuccct

SEQ ID NO: 25786 - DNA, 17 bp, Artificial Sequence
  Synthetic
ggaagccugcgucagga

SEQ ID NO: 25787 - DNA, 19 bp, Artificial Sequence
  Synthetic
gggucaccaccagctatug

SEQ ID NO: 25788 - DNA, 17 bp, Artificial Sequence
  Synthetic
cctggccucaccuccct

SEQ ID NO: 25789 - DNA, 20 bp, Artificial Sequence
  Synthetic
cagtgcacucggttgtctug

SEQ ID NO: 25790 - DNA, 19 bp, Artificial Sequence
  Synthetic
aattacgcucaccgggugt

SEQ ID NO: 25791 - DNA, 23 bp, Artificial Sequence
  Synthetic
ctgguaccccaagactctacuca

SEQ ID NO: 25792 - DNA, 20 bp, Artificial Sequence
  Synthetic
augaagcagcagaugcagga

SEQ ID NO: 25793 - DNA, 24 bp, Artificial Sequence
  Synthetic
gggtggtgcugagaataaatuagg

SEQ ID NO: 25794 - DNA, 22 bp, Artificial Sequence
  Synthetic
cgacuagccactguggaagaga

SEQ ID NO: 25795 - DNA, 24 bp, Artificial Sequence
  Synthetic
atcttcatgacauaagcgaguggt

SEQ ID NO: 25796 - DNA, 22 bp, Artificial Sequence
  Synthetic
cuccacaaccaucaacaggaac

SEQ ID NO: 25797 - DNA, 24 bp, Artificial Sequence
  Synthetic
cacaaggucaaagcagagtgttut

SEQ ID NO: 25798 - DNA, 24 bp, Artificial Sequence
  Synthetic
agaaatcctcugtgacgatcugga

SEQ ID NO: 25799 - DNA, 20 bp, Artificial Sequence
  Synthetic
cagtgcugggtgagaaguca

SEQ ID NO: 25800 - DNA, 18 bp, Artificial Sequence
  Synthetic
cccactgcuggagacuct

SEQ ID NO: 25801 - DNA, 22 bp, Artificial Sequence
  Synthetic
gtcucagagaccaugggagact

SEQ ID NO: 25802 - DNA, 19 bp, Artificial Sequence
  Synthetic
gcttcccgcaugagctuca

SEQ ID NO: 25803 - DNA, 20 bp, Artificial Sequence
  Synthetic
agaacctcucgagctuccac

SEQ ID NO: 25804 - DNA, 23 bp, Artificial Sequence
  Synthetic
tcacctutcacttctuggccaaa

SEQ ID NO: 25805 - DNA, 20 bp, Artificial Sequence
  Synthetic
ccactccugggcaagttcuc

SEQ ID NO: 25806 - DNA, 22 bp, Artificial Sequence
  Synthetic
cgctcuccacccatctcactua

SEQ ID NO: 25807 - DNA, 23 bp, Artificial Sequence
  Synthetic
agcucagagaggttucaacacac

SEQ ID NO: 25808 - DNA, 25 bp, Artificial Sequence
  Synthetic
ccagtaggcagugaagtaaattugt

SEQ ID NO: 25809 - DNA, 24 bp, Artificial Sequence
  Synthetic
gaacttccaaagaaucggcttucc

SEQ ID NO: 25810 - DNA, 20 bp, Artificial Sequence
  Synthetic
cagaggcugagcaggaaaug

SEQ ID NO: 25811 - DNA, 17 bp, Artificial Sequence
  Synthetic
agcctccucgccaguct

SEQ ID NO: 25812 - DNA, 23 bp, Artificial Sequence
  Synthetic
cctcctgacauaccaagctucaa

SEQ ID NO: 25813 - DNA, 20 bp, Artificial Sequence
  Synthetic
ggccccaaucactcagtcua

SEQ ID NO: 25814 - DNA, 21 bp, Artificial Sequence
  Synthetic
tgguttagccucaagcccaag

SEQ ID NO: 25815 - DNA, 18 bp, Artificial Sequence
  Synthetic
ccctcguaagggcucagt

SEQ ID NO: 25816 - DNA, 20 bp, Artificial Sequence
  Synthetic
cauttccctucaggccccat

SEQ ID NO: 25817 - DNA, 21 bp, Artificial Sequence
  Synthetic
ggctcaccuttctctccucag

SEQ ID NO: 25818 - DNA, 20 bp, Artificial Sequence
  Synthetic
cugcgcagagaaguaaagug

SEQ ID NO: 25819 - DNA, 24 bp, Artificial Sequence
  Synthetic
ctgcctccuacttaaaggtccaug

SEQ ID NO: 25820 - DNA, 22 bp, Artificial Sequence
  Synthetic
tctgacaugggaaagacuccga

SEQ ID NO: 25821 - DNA, 18 bp, Artificial Sequence
  Synthetic
ccagtggccugttggcua

SEQ ID NO: 25822 - DNA, 22 bp, Artificial Sequence
  Synthetic
gaccgugagaacagcatcauct

SEQ ID NO: 25823 - DNA, 24 bp, Artificial Sequence
  Synthetic
tccctcttggutctctctttucca

SEQ ID NO: 25824 - DNA, 21 bp, Artificial Sequence
  Synthetic
gatggguagcccattcucacc

SEQ ID NO: 25825 - DNA, 22 bp, Artificial Sequence
  Synthetic
catccttccaugcggtctaugt

SEQ ID NO: 25826 - DNA, 22 bp, Artificial Sequence
  Synthetic
cgutggtcatguccaaagggaa

SEQ ID NO: 25827 - DNA, 22 bp, Artificial Sequence
  Synthetic
gctgatgaggucggttaucgag

SEQ ID NO: 25828 - DNA, 19 bp, Artificial Sequence
  Synthetic
ggttgugcagcatcuccgt

SEQ ID NO: 25829 - DNA, 18 bp, Artificial Sequence
  Synthetic
cgcttcucgctgcugagg

SEQ ID NO: 25830 - DNA, 21 bp, Artificial Sequence
  Synthetic
ctgagccuggaaaggtggtua

SEQ ID NO: 25831 - DNA, 22 bp, Artificial Sequence
  Synthetic
tcttuaagaaggccacggugac

SEQ ID NO: 25832 - DNA, 19 bp, Artificial Sequence
  Synthetic
ccaggaagutggcgtuggt

SEQ ID NO: 25833 - DNA, 19 bp, Artificial Sequence
  Synthetic
gctccugacccaggttucg

SEQ ID NO: 25834 - DNA, 23 bp, Artificial Sequence
  Synthetic
ggaagacaagacguggagaggua

SEQ ID NO: 25835 - DNA, 23 bp, Artificial Sequence
  Synthetic
atttggaggauctggugcaagag

SEQ ID NO: 25836 - DNA, 22 bp, Artificial Sequence
  Synthetic
ccaggccuaagtttgtccctua

SEQ ID NO: 25837 - DNA, 22 bp, Artificial Sequence
  Synthetic
cagtccctucccatctacucac

SEQ ID NO: 25838 - DNA, 22 bp, Artificial Sequence
  Synthetic
accctcatcucccaactctuct

SEQ ID NO: 25839 - DNA, 22 bp, Artificial Sequence
  Synthetic
ggtgagccgaaggutcactuat

SEQ ID NO: 25840 - DNA, 22 bp, Artificial Sequence
  Synthetic
ccaggccuaagtttgtccctua

SEQ ID NO: 25841 - DNA, 22 bp, Artificial Sequence
  Synthetic
cagccactucccatctacucac

SEQ ID NO: 25842 - DNA, 22 bp, Artificial Sequence
  Synthetic
caacguacccaaccctcatcut

SEQ ID NO: 25843 - DNA, 22 bp, Artificial Sequence
  Synthetic
ggtgagccgaaggutcactuac

SEQ ID NO: 25844 - DNA, 22 bp, Artificial Sequence
  Synthetic
gcccaagcutgcctctuaagaa

SEQ ID NO: 25845 - DNA, 20 bp, Artificial Sequence
  Synthetic
ctttccagccccutccaguc

SEQ ID NO: 25846 - DNA, 25 bp, Artificial Sequence
  Synthetic
caatcuacccaaccctcatttucca

SEQ ID NO: 25847 - DNA, 23 bp, Artificial Sequence
  Synthetic
gggtgguccgaaagttcactuac

SEQ ID NO: 25848 - DNA, 22 bp, Artificial Sequence
  Synthetic
tcctcctccuccatcagaaugt

SEQ ID NO: 25849 - DNA, 20 bp, Artificial Sequence
  Synthetic
cccagaaugctccccaucag

SEQ ID NO: 25850 - DNA, 19 bp, Artificial Sequence
  Synthetic
ggctcuccaggtcttugga

SEQ ID NO: 25851 - DNA, 23 bp, Artificial Sequence
  Synthetic
aaactcctcaugtggcattucct

SEQ ID NO: 25852 - DNA, 26 bp, Artificial Sequence
  Synthetic
gtcttggtgauacagaaatgcccuaa

SEQ ID NO: 25853 - DNA, 27 bp, Artificial Sequence
  Synthetic
agtccagttacaaugatgaaatgcuca

SEQ ID NO: 25854 - DNA, 22 bp, Artificial Sequence
  Synthetic
gtggacagguactgttucacct

SEQ ID NO: 25855 - DNA, 22 bp, Artificial Sequence
  Synthetic
tttgagtccugttctgcctugt

SEQ ID NO: 25856 - DNA, 23 bp, Artificial Sequence
  Synthetic
atgaagaagaugacgacauggca

SEQ ID NO: 25857 - DNA, 24 bp, Artificial Sequence
  Synthetic
ggcttgggaugagacttttagcut

SEQ ID NO: 25858 - DNA, 17 bp, Artificial Sequence
  Synthetic
cgcaccugagcagcuga

SEQ ID NO: 25859 - DNA, 18 bp, Artificial Sequence
  Synthetic
ccgggcgucatgtcucat

SEQ ID NO: 25860 - DNA, 22 bp, Artificial Sequence
  Synthetic
gccagagggautgttccugaat

SEQ ID NO: 25861 - DNA, 22 bp, Artificial Sequence
  Synthetic
aaatgatucggaggaagugcca

SEQ ID NO: 25862 - DNA, 28 bp, Artificial Sequence
  Synthetic
cccaagcttguctcttaaggaauaaaca

SEQ ID NO: 25863 - DNA, 22 bp, Artificial Sequence
  Synthetic
ccacggtuagggtcattaucca

SEQ ID NO: 25864 - DNA, 26 bp, Artificial Sequence
  Synthetic
acatataagtcaucaggaagguggct

SEQ ID NO: 25865 - DNA, 24 bp, Artificial Sequence
  Synthetic
gtggtgatgutgatgatgcttuct

SEQ ID NO: 25866 - DNA, 22 bp, Artificial Sequence
  Synthetic
ttgatggcugctaaggtgtuct

SEQ ID NO: 25867 - DNA, 23 bp, Artificial Sequence
  Synthetic
aactgtaagggaugcactauggc

SEQ ID NO: 25868 - DNA, 22 bp, Artificial Sequence
  Synthetic
agcccauggaccagttagauga

SEQ ID NO: 25869 - DNA, 22 bp, Artificial Sequence
  Synthetic
gaacatgugcagcaaagaccug

SEQ ID NO: 25870 - DNA, 21 bp, Artificial Sequence
  Synthetic
acutcggaggauggaagagct

SEQ ID NO: 25871 - DNA, 21 bp, Artificial Sequence
  Synthetic
cgagguagcatggcaguagga

SEQ ID NO: 25872 - DNA, 24 bp, Artificial Sequence
  Synthetic
cactactctgccutaggtgctaug

SEQ ID NO: 25873 - DNA, 29 bp, Artificial Sequence
  Synthetic
ccaccattuagaattactgtuaaggcact

SEQ ID NO: 25874 - DNA, 21 bp, Artificial Sequence
  Synthetic
tgtggtguatgtgtgtgugct

SEQ ID NO: 25875 - DNA, 25 bp, Artificial Sequence
  Synthetic
tctctttctctcucctttccagcut

SEQ ID NO: 25876 - DNA, 28 bp, Artificial Sequence
  Synthetic
gaatactattcaguacacagccauggat

SEQ ID NO: 25877 - DNA, 21 bp, Artificial Sequence
  Synthetic
gtgaaguagagagcccuccct

SEQ ID NO: 25878 - DNA, 22 bp, Artificial Sequence
  Synthetic
caccaggcucacatttaccuct

SEQ ID NO: 25879 - DNA, 27 bp, Artificial Sequence
  Synthetic
gttuacaggagacataugaggccaaaa

SEQ ID NO: 25880 - DNA, 20 bp, Artificial Sequence
  Synthetic
gcttcctgugtgtagcccut

SEQ ID NO: 25881 - DNA, 22 bp, Artificial Sequence
  Synthetic
gctttcgttugccttcggttuc

SEQ ID NO: 25882 - DNA, 25 bp, Artificial Sequence
  Synthetic
ggcaatgaaauacaagcagacaugg

SEQ ID NO: 25883 - DNA, 22 bp, Artificial Sequence
  Synthetic
tctgtcccugctctccctttua

SEQ ID NO: 25884 - DNA, 28 bp, Artificial Sequence
  Synthetic
tccagccatuaaggatccatattctgua

SEQ ID NO: 25885 - DNA, 20 bp, Artificial Sequence
  Synthetic
tttgacagcutgccugacca

SEQ ID NO: 25886 - DNA, 22 bp, Artificial Sequence
  Synthetic
accaaagcaaauccgtctucca

SEQ ID NO: 25887 - DNA, 25 bp, Artificial Sequence
  Synthetic
tgaacaaaagagggcgucttctuag

SEQ ID NO: 25888 - DNA, 26 bp, Artificial Sequence
  Synthetic
catatggttuctgtaatcaugaggct

SEQ ID NO: 25889 - DNA, 21 bp, Artificial Sequence
  Synthetic
gtattgctcugacccctccuc

SEQ ID NO: 25890 - DNA, 22 bp, Artificial Sequence
  Synthetic
cccagatcaguttactgtggug

SEQ ID NO: 25891 - DNA, 22 bp, Artificial Sequence
  Synthetic
tgggcugaaacaactttccuga

SEQ ID NO: 25892 - DNA, 25 bp, Artificial Sequence
  Synthetic
gttttuaagccaagaagtcugcagt

SEQ ID NO: 25893 - DNA, 22 bp, Artificial Sequence
  Synthetic
ctaaagcggaaugaggaugcct

SEQ ID NO: 25894 - DNA, 25 bp, Artificial Sequence
  Synthetic
gagtagtctatutagggccacucct

SEQ ID NO: 25895 - DNA, 25 bp, Artificial Sequence
  Synthetic
ccaagctctugacttttgctttugg

SEQ ID NO: 25896 - DNA, 23 bp, Artificial Sequence
  Synthetic
cctcucccatctgcuaaggagaa

SEQ ID NO: 25897 - DNA, 27 bp, Artificial Sequence
  Synthetic
gatgattttgcuctttctttgctucct

SEQ ID NO: 25898 - DNA, 28 bp, Artificial Sequence
  Synthetic
gttgttctaagccuttaagttttguggt

SEQ ID NO: 25899 - DNA, 24 bp, Artificial Sequence
  Synthetic
gctcaaggataucagcagctttuc

SEQ ID NO: 25900 - DNA, 25 bp, Artificial Sequence
  Synthetic
cagaatcacagucccagtagattuc

SEQ ID NO: 25901 - DNA, 29 bp, Artificial Sequence
  Synthetic
ggagggttgautgatggactauagaaaat

SEQ ID NO: 25902 - DNA, 21 bp, Artificial Sequence
  Synthetic
agcactcugcctaactcccua

SEQ ID NO: 25903 - DNA, 27 bp, Artificial Sequence
  Synthetic
cctatcatctcugtgtttctcctucag

SEQ ID NO: 25904 - DNA, 27 bp, Artificial Sequence
  Synthetic
ctgaaaatttgacutactgtgccaucc

SEQ ID NO: 25905 - DNA, 28 bp, Artificial Sequence
  Synthetic
tgaggagcagguttctatatgagagtut

SEQ ID NO: 25906 - DNA, 24 bp, Artificial Sequence
  Synthetic
tcaggagguggtgaataaaugaac

SEQ ID NO: 25907 - DNA, 27 bp, Artificial Sequence
  Synthetic
ctaactggatgccutattcttggtgua

SEQ ID NO: 25908 - DNA, 23 bp, Artificial Sequence
  Synthetic
tgtcuaccccaaattcuccaggt

SEQ ID NO: 25909 - DNA, 22 bp, Artificial Sequence
  Synthetic
tctgcccgucttcctgtagtua

SEQ ID NO: 25910 - DNA, 26 bp, Artificial Sequence
  Synthetic
agattcaccuccaatcagttuggaag

SEQ ID NO: 25911 - DNA, 26 bp, Artificial Sequence
  Synthetic
tcacgttggaaugtgctttttcttut

SEQ ID NO: 25912 - DNA, 27 bp, Artificial Sequence
  Synthetic
ggaggauggagagaattatgcaaauca

SEQ ID NO: 25913 - DNA, 30 bp, Artificial Sequence
  Synthetic
gtctgtaacatttcuctttttcccacaaut

SEQ ID NO: 25914 - DNA, 19 bp, Artificial Sequence
  Synthetic
gcagcagagcucaggguag

SEQ ID NO: 25915 - DNA, 17 bp, Artificial Sequence
  Synthetic
cgacgacutcgcucgga

SEQ ID NO: 25916 - DNA, 22 bp, Artificial Sequence
  Synthetic
gcatatcuttgagggugggaca

SEQ ID NO: 25917 - DNA, 28 bp, Artificial Sequence
  Synthetic
tgtcttggtagagacugtgatatgtcut

SEQ ID NO: 25918 - DNA, 22 bp, Artificial Sequence
  Synthetic
gggctggutctccaaaucagaa

SEQ ID NO: 25919 - DNA, 26 bp, Artificial Sequence
  Synthetic
caatagaagcugaatttggtgtgcug

SEQ ID NO: 25920 - DNA, 26 bp, Artificial Sequence
  Synthetic
cagaatccttaucactgtcactguca

SEQ ID NO: 25921 - DNA, 23 bp, Artificial Sequence
  Synthetic
ctttucagacagccgatcaucag

SEQ ID NO: 25922 - DNA, 25 bp, Artificial Sequence
  Synthetic
tgccgtgttutgtattttcgttucc

SEQ ID NO: 25923 - DNA, 29 bp, Artificial Sequence
  Synthetic
ccagagctcatuattctagacagtctuca

SEQ ID NO: 25924 - DNA, 23 bp, Artificial Sequence
  Synthetic
cgatctctatutctgctccguga

SEQ ID NO: 25925 - DNA, 28 bp, Artificial Sequence
  Synthetic
gaaagcatcaugggaagaaaagaaugaa

SEQ ID NO: 25926 - DNA, 25 bp, Artificial Sequence
  Synthetic
ttcaggtttcugggagatgacaaug

SEQ ID NO: 25927 - DNA, 30 bp, Artificial Sequence
  Synthetic
tctgattctgaggacutaggttcttaugag

SEQ ID NO: 25928 - DNA, 21 bp, Artificial Sequence
  Synthetic
tgtatcugagacgtggcucct

SEQ ID NO: 25929 - DNA, 23 bp, Artificial Sequence
  Synthetic
aaggcagccautctgattctuca

SEQ ID NO: 25930 - DNA, 27 bp, Artificial Sequence
  Synthetic
tcttaaaucagacacaaatgccugact

SEQ ID NO: 25931 - DNA, 29 bp, Artificial Sequence
  Synthetic
gtgctcgagtuagaaatattgaagauggt

SEQ ID NO: 25932 - DNA, 28 bp, Artificial Sequence
  Synthetic
gaggaatttcaacauctctaggtctugt

SEQ ID NO: 25933 - DNA, 27 bp, Artificial Sequence
  Synthetic
cagaagatgacutcaaggagtatgucc

SEQ ID NO: 25934 - DNA, 28 bp, Artificial Sequence
  Synthetic
gcagcgatcuaagtaagacacattauca

SEQ ID NO: 25935 - DNA, 31 bp, Artificial Sequence
  Synthetic
gcatttttgtugagactatttagtcatucct

SEQ ID NO: 25936 - DNA, 17 bp, Artificial Sequence
  Synthetic
ggauccgcgaaggcgua

SEQ ID NO: 25937 - DNA, 21 bp, Artificial Sequence
  Synthetic
gaaggcgggugttgtgtttug

SEQ ID NO: 25938 - DNA, 20 bp, Artificial Sequence
  Synthetic
cagcccagucagtcagucac

SEQ ID NO: 25939 - DNA, 19 bp, Artificial Sequence
  Synthetic
agutaccgttugcccggaa

SEQ ID NO: 25940 - DNA, 24 bp, Artificial Sequence
  Synthetic
agagagctcugaggactgatctug

SEQ ID NO: 25941 - DNA, 20 bp, Artificial Sequence
  Synthetic
tgcagggcuctacaggctua

SEQ ID NO: 25942 - DNA, 21 bp, Artificial Sequence
  Synthetic
caggtaaccuggctccaacug

SEQ ID NO: 25943 - DNA, 27 bp, Artificial Sequence
  Synthetic
caactctgguttgaaagttguaagagg

SEQ ID NO: 25944 - DNA, 25 bp, Artificial Sequence
  Synthetic
aguaacatttctgttuccacagggt

SEQ ID NO: 25945 - DNA, 25 bp, Artificial Sequence
  Synthetic
cattaatccugttcccatguccaca

SEQ ID NO: 25946 - DNA, 22 bp, Artificial Sequence
  Synthetic
gcctatttgcugaccacacucc

SEQ ID NO: 25947 - DNA, 23 bp, Artificial Sequence
  Synthetic
aggatcctacutgggagacugac

SEQ ID NO: 25948 - DNA, 26 bp, Artificial Sequence
  Synthetic
gataactguaaaagggctctctcucc

SEQ ID NO: 25949 - DNA, 22 bp, Artificial Sequence
  Synthetic
gccagactgutctgagtccuga

SEQ ID NO: 25950 - DNA, 24 bp, Artificial Sequence
  Synthetic
cttcctgaggutcattaccaccug

SEQ ID NO: 25951 - DNA, 28 bp, Artificial Sequence
  Synthetic
aaggttcacacucctctgatatuagagt

SEQ ID NO: 25952 - DNA, 23 bp, Artificial Sequence
  Synthetic
cagctcaagcucttcaaaacgug

SEQ ID NO: 25953 - DNA, 22 bp, Artificial Sequence
  Synthetic
cctattgugggtggugaacact

SEQ ID NO: 25954 - DNA, 25 bp, Artificial Sequence
  Synthetic
atcttcatgugaccccttagttugg

SEQ ID NO: 25955 - DNA, 26 bp, Artificial Sequence
  Synthetic
tctctaggccucagtttcccttttua

SEQ ID NO: 25956 - DNA, 21 bp, Artificial Sequence
  Synthetic
tgggcugggacacatuaaagg

SEQ ID NO: 25957 - DNA, 25 bp, Artificial Sequence
  Synthetic
aaattgattcctcutcacccctgut

SEQ ID NO: 25958 - DNA, 22 bp, Artificial Sequence
  Synthetic
cttttcuggcatctucccacag

SEQ ID NO: 25959 - DNA, 23 bp, Artificial Sequence
  Synthetic
tcatgccttucaagacactgcut

SEQ ID NO: 25960 - DNA, 23 bp, Artificial Sequence
  Synthetic
tcattcaucccccaagucacaag

SEQ ID NO: 25961 - DNA, 21 bp, Artificial Sequence
  Synthetic
cctagccucaccccttcatug

SEQ ID NO: 25962 - DNA, 21 bp, Artificial Sequence
  Synthetic
ccacatctucacctggcagut

SEQ ID NO: 25963 - DNA, 22 bp, Artificial Sequence
  Synthetic
ccgtgtccucctatcccttuag

SEQ ID NO: 25964 - DNA, 24 bp, Artificial Sequence
  Synthetic
agtctggaggaccacutaaaggua

SEQ ID NO: 25965 - DNA, 23 bp, Artificial Sequence
  Synthetic
gcttctggutgtccttcttuccc

SEQ ID NO: 25966 - DNA, 20 bp, Artificial Sequence
  Synthetic
caagacggucagcacucaac

SEQ ID NO: 25967 - DNA, 23 bp, Artificial Sequence
  Synthetic
gatggaggaugaggtgctactuc

SEQ ID NO: 25968 - DNA, 23 bp, Artificial Sequence
  Synthetic
ccctgccccgaguaattataucg

SEQ ID NO: 25969 - DNA, 20 bp, Artificial Sequence
  Synthetic
tgacaaccccuccctcaugt

SEQ ID NO: 25970 - DNA, 18 bp, Artificial Sequence
  Synthetic
cccacagagguggtcugg

SEQ ID NO: 25971 - DNA, 19 bp, Artificial Sequence
  Synthetic
cgtcccauctgtccuggaa

SEQ ID NO: 25972 - DNA, 23 bp, Artificial Sequence
  Synthetic
ccatgtctgtucctggaggtcua

SEQ ID NO: 25973 - DNA, 25 bp, Artificial Sequence
  Synthetic
ggccagtcacuatatccacattguc

SEQ ID NO: 25974 - DNA, 22 bp, Artificial Sequence
  Synthetic
ggctgggccauatgatatcuga

SEQ ID NO: 25975 - DNA, 25 bp, Artificial Sequence
  Synthetic
gactgcttttccutctcactctgut

SEQ ID NO: 25976 - DNA, 21 bp, Artificial Sequence
  Synthetic
cguatgcttcaaugcacccat

SEQ ID NO: 25977 - DNA, 23 bp, Artificial Sequence
  Synthetic
gcacccucagtgatttctauccc

SEQ ID NO: 25978 - DNA, 23 bp, Artificial Sequence
  Synthetic
cacagttgccaucattgtcuacc

SEQ ID NO: 25979 - DNA, 28 bp, Artificial Sequence
  Synthetic
ctcatcagcatuatttccttgtgttugt

SEQ ID NO: 25980 - DNA, 28 bp, Artificial Sequence
  Synthetic
gcttccacacacauctgtaggatuaaat

SEQ ID NO: 25981 - DNA, 29 bp, Artificial Sequence
  Synthetic
tcctatagcagugtctaatttgtcaugaa

SEQ ID NO: 25982 - DNA, 30 bp, Artificial Sequence
  Synthetic
ggcacttagaguttcaagaatatggucaat

SEQ ID NO: 25983 - DNA, 27 bp, Artificial Sequence
  Synthetic
ccacttaacatguatggcagaagcaua

SEQ ID NO: 25984 - DNA, 28 bp, Artificial Sequence
  Synthetic
actcacgtatguataaagcctagucagt

SEQ ID NO: 25985 - DNA, 25 bp, Artificial Sequence
  Synthetic
tgaccagttuatacagttggtugcc

SEQ ID NO: 25986 - DNA, 24 bp, Artificial Sequence
  Synthetic
gatgagcaagauaggaaggcagut

SEQ ID NO: 25987 - DNA, 30 bp, Artificial Sequence
  Synthetic
accactgacatuaagcattccataaaaaug

SEQ ID NO: 25988 - DNA, 26 bp, Artificial Sequence
  Synthetic
tctgacaaaaacagccautagacuga

SEQ ID NO: 25989 - DNA, 28 bp, Artificial Sequence
  Synthetic
tctatcagacaugccataacaaaacugg

SEQ ID NO: 25990 - DNA, 22 bp, Artificial Sequence
  Synthetic
ggcatcaaaccugtctccauga

SEQ ID NO: 25991 - DNA, 29 bp, Artificial Sequence
  Synthetic
gttcttatatctttauttctccccggcut

SEQ ID NO: 25992 - DNA, 28 bp, Artificial Sequence
  Synthetic
caagtaccacaacaucaagtucaaagaa

SEQ ID NO: 25993 - DNA, 30 bp, Artificial Sequence
  Synthetic
ggcaattucaggaactctatttuaagaacc

SEQ ID NO: 25994 - DNA, 25 bp, Artificial Sequence
  Synthetic
ctctgcagauaaccataggttucca

SEQ ID NO: 25995 - DNA, 22 bp, Artificial Sequence
  Synthetic
cctacttucgagctactgucca

SEQ ID NO: 25996 - DNA, 19 bp, Artificial Sequence
  Synthetic
tggtgccacucaagctucc

SEQ ID NO: 25997 - DNA, 21 bp, Artificial Sequence
  Synthetic
ctccaacacauccauggcaga

SEQ ID NO: 25998 - DNA, 21 bp, Artificial Sequence
  Synthetic
catctgcautgggatcugcac

SEQ ID NO: 25999 - DNA, 21 bp, Artificial Sequence
  Synthetic
ccagugagcaatgugagcaac

SEQ ID NO: 26000 - DNA, 21 bp, Artificial Sequence
  Synthetic
gaactcgtuccagcacucgat

SEQ ID NO: 26001 - DNA, 23 bp, Artificial Sequence
  Synthetic
ccatcatguacggcaagttcucc

SEQ ID NO: 26002 - DNA, 19 bp, Artificial Sequence
  Synthetic
gccagguccttgugaacca

SEQ ID NO: 26003 - DNA, 21 bp, Artificial Sequence
  Synthetic
ccccugagcatgatctucagc

SEQ ID NO: 26004 - DNA, 24 bp, Artificial Sequence
  Synthetic
gctttgtcctucagcgttttgaug

SEQ ID NO: 26005 - DNA, 21 bp, Artificial Sequence
  Synthetic
cggtgacagugatgttucacg

SEQ ID NO: 26006 - DNA, 21 bp, Artificial Sequence
  Synthetic
ccutctgcttatuccggcaca

SEQ ID NO: 26007 - DNA, 29 bp, Artificial Sequence
  Synthetic
ggttgguagagaacttagaguagaaaagg

SEQ ID NO: 26008 - DNA, 17 bp, Artificial Sequence
  Synthetic
gggtuccggcaguaggc

SEQ ID NO: 26009 - DNA, 24 bp, Artificial Sequence
  Synthetic
gtgtaggcagaauggttttgtugt

SEQ ID NO: 26010 - DNA, 19 bp, Artificial Sequence
  Synthetic
gggcgauggtgtactccug

SEQ ID NO: 26011 - DNA, 17 bp, Artificial Sequence
  Synthetic
cccgcuaacgcgaguct

SEQ ID NO: 26012 - DNA, 22 bp, Artificial Sequence
  Synthetic
aaagacatgagcuggcaggaut

SEQ ID NO: 26013 - DNA, 31 bp, Artificial Sequence
  Synthetic
aagaaggttgtatuccaaatcatggagtaut

SEQ ID NO: 26014 - DNA, 22 bp, Artificial Sequence
  Synthetic
ggattcgcagucgtgaaccaua

SEQ ID NO: 26015 - DNA, 22 bp, Artificial Sequence
  Synthetic
tcttttgugaccgctctcctug

SEQ ID NO: 26016 - DNA, 18 bp, Artificial Sequence
  Synthetic
caagcgagccgugagcua

SEQ ID NO: 26017 - DNA, 19 bp, Artificial Sequence
  Synthetic
cgaagctcugagggctucc

SEQ ID NO: 26018 - DNA, 22 bp, Artificial Sequence
  Synthetic
aggagaacctugtcctcctcut

SEQ ID NO: 26019 - DNA, 19 bp, Artificial Sequence
  Synthetic
actgaccacggccugttug

SEQ ID NO: 26020 - DNA, 20 bp, Artificial Sequence
  Synthetic
gaagccgucacagtggugat

SEQ ID NO: 26021 - DNA, 22 bp, Artificial Sequence
  Synthetic
gcgcagagacgcutttgaaaut

SEQ ID NO: 26022 - DNA, 24 bp, Artificial Sequence
  Synthetic
cgtctgggaacuatactccgaguc

SEQ ID NO: 26023 - DNA, 20 bp, Artificial Sequence
  Synthetic
agtguggccagcagguaaat

SEQ ID NO: 26024 - DNA, 22 bp, Artificial Sequence
  Synthetic
ccggcccaaucacaatgattuc

SEQ ID NO: 26025 - DNA, 25 bp, Artificial Sequence
  Synthetic
gatcttgugaacatcctcatugcac

SEQ ID NO: 26026 - DNA, 21 bp, Artificial Sequence
  Synthetic
cagaagcgaucaggaugacca

SEQ ID NO: 26027 - DNA, 23 bp, Artificial Sequence
  Synthetic
tgatcugaaccgaggacacctua

SEQ ID NO: 26028 - DNA, 21 bp, Artificial Sequence
  Synthetic
cccaggcucgtatagttgcug

SEQ ID NO: 26029 - DNA, 27 bp, Artificial Sequence
  Synthetic
agtcagtaagcuttcatgcaaagtuct

SEQ ID NO: 26030 - DNA, 19 bp, Artificial Sequence
  Synthetic
tgacccaagccgucaggua

SEQ ID NO: 26031 - DNA, 21 bp, Artificial Sequence
  Synthetic
tgtaatgctgugcgaagcuca

SEQ ID NO: 26032 - DNA, 23 bp, Artificial Sequence
  Synthetic
acaaaggaaccugttgaagcuga

SEQ ID NO: 26033 - DNA, 28 bp, Artificial Sequence
  Synthetic
aacaugtatatagucacccagaaagcag

SEQ ID NO: 26034 - DNA, 26 bp, Artificial Sequence
  Synthetic
aagtagaagcaauctgatgaacucca

SEQ ID NO: 26035 - DNA, 19 bp, Artificial Sequence
  Synthetic
tgctcucccagttcuccga

SEQ ID NO: 26036 - DNA, 20 bp, Artificial Sequence
  Synthetic
tgtagtacacgugcgtgugg

SEQ ID NO: 26037 - DNA, 22 bp, Artificial Sequence
  Synthetic
tgcaacatgtutcccctcctut

SEQ ID NO: 26038 - DNA, 22 bp, Artificial Sequence
  Synthetic
ggaucaccacagccttcaucac

SEQ ID NO: 26039 - DNA, 20 bp, Artificial Sequence
  Synthetic
catgtccagugcagctcuca

SEQ ID NO: 26040 - DNA, 22 bp, Artificial Sequence
  Synthetic
cauttgucaacggacagcagat

SEQ ID NO: 26041 - DNA, 20 bp, Artificial Sequence
  Synthetic
tgttctgugcccccattgut

SEQ ID NO: 26042 - DNA, 20 bp, Artificial Sequence
  Synthetic
gccgatucgaaggtgggtut

SEQ ID NO: 26043 - DNA, 22 bp, Artificial Sequence
  Synthetic
actgatgatgugccttccctug

SEQ ID NO: 26044 - DNA, 22 bp, Artificial Sequence
  Synthetic
gtgttttgcuctccaccctuct

SEQ ID NO: 26045 - DNA, 25 bp, Artificial Sequence
  Synthetic
gaaatgctgaauaaggctgaggtug

SEQ ID NO: 26046 - DNA, 27 bp, Artificial Sequence
  Synthetic
tgutcaaaactgaaauggaacaaacaa

SEQ ID NO: 26047 - DNA, 27 bp, Artificial Sequence
  Synthetic
catggcctcutctttttaacttugaca

SEQ ID NO: 26048 - DNA, 20 bp, Artificial Sequence
  Synthetic
cgccttaccugctgctcaut

SEQ ID NO: 26049 - DNA, 24 bp, Artificial Sequence
  Synthetic
agaccccuaaagaagaaggtgcua

SEQ ID NO: 26050 - DNA, 19 bp, Artificial Sequence
  Synthetic
tcuaucaaccgcgaggagg

SEQ ID NO: 26051 - DNA, 20 bp, Artificial Sequence
  Synthetic
tcgcggugggatuaaaagca

SEQ ID NO: 26052 - DNA, 23 bp, Artificial Sequence
  Synthetic
aagugggaggagagagtcugaaa

SEQ ID NO: 26053 - DNA, 17 bp, Artificial Sequence
  Synthetic
catggccucggctggua

SEQ ID NO: 26054 - DNA, 28 bp, Artificial Sequence
  Synthetic
ctttttcttctccuccgttttcttctuc

SEQ ID NO: 26055 - DNA, 23 bp, Artificial Sequence
  Synthetic
gagggccauggaactgcttaaua

SEQ ID NO: 26056 - DNA, 31 bp, Artificial Sequence
  Synthetic
aataaatagaattgcutgttgtctgcugaag

SEQ ID NO: 26057 - DNA, 24 bp, Artificial Sequence
  Synthetic
gaucaacagaagaacccaguggaa

SEQ ID NO: 26058 - DNA, 28 bp, Artificial Sequence
  Synthetic
tccaatctctccutatactgctgatcut

SEQ ID NO: 26059 - DNA, 29 bp, Artificial Sequence
  Synthetic
tttgctgatacaguctattttctccucag

SEQ ID NO: 26060 - DNA, 28 bp, Artificial Sequence
  Synthetic
tgtactgcctautcactattgtttgugg

SEQ ID NO: 26061 - DNA, 28 bp, Artificial Sequence
  Synthetic
gctactcaggaggcutaaaaatatcugt

SEQ ID NO: 26062 - DNA, 21 bp, Artificial Sequence
  Synthetic
ggcggaucaccaagcaatcua

SEQ ID NO: 26063 - DNA, 28 bp, Artificial Sequence
  Synthetic
caaactatttuccattctgcatcuccag

SEQ ID NO: 26064 - DNA, 24 bp, Artificial Sequence
  Synthetic
tcaugaaccucagaagacaagaga

SEQ ID NO: 26065 - DNA, 24 bp, Artificial Sequence
  Synthetic
gtcttcttccugttcccttgucag

SEQ ID NO: 26066 - DNA, 27 bp, Artificial Sequence
  Synthetic
aatgattgtactuacctgccagagtuc

SEQ ID NO: 26067 - DNA, 22 bp, Artificial Sequence
  Synthetic
cctgaugcaggagcacatguat

SEQ ID NO: 26068 - DNA, 23 bp, Artificial Sequence
  Synthetic
tttgaagccaaggauggtgtuat

SEQ ID NO: 26069 - DNA, 26 bp, Artificial Sequence
  Synthetic
gtctttgtgugaatctttttccugca

SEQ ID NO: 26070 - DNA, 24 bp, Artificial Sequence
  Synthetic
ttaaatctguggtgtggcaaugac

SEQ ID NO: 26071 - DNA, 29 bp, Artificial Sequence
  Synthetic
cattctggtgtucttcacttattaccuca

SEQ ID NO: 26072 - DNA, 33 bp, Artificial Sequence
  Synthetic
ttttcttctctagcuatttatgcttgattucct

SEQ ID NO: 26073 - DNA, 26 bp, Artificial Sequence
  Synthetic
ggtaggtgtutcttggaaatguggaa

SEQ ID NO: 26074 - DNA, 32 bp, Artificial Sequence
  Synthetic
acttattgtcttcacacauaaatcacaagcua

SEQ ID NO: 26075 - DNA, 28 bp, Artificial Sequence
  Synthetic
gttaggtaaaatggugtatcctggcuat

SEQ ID NO: 26076 - DNA, 29 bp, Artificial Sequence
  Synthetic
tcaaaaagucatcaagacuccaaaagaca

SEQ ID NO: 26077 - DNA, 26 bp, Artificial Sequence
  Synthetic
ctccgagtaauctagctagcttucac

SEQ ID NO: 26078 - DNA, 22 bp, Artificial Sequence
  Synthetic
caaagcccacgcuctttcuact

SEQ ID NO: 26079 - DNA, 28 bp, Artificial Sequence
  Synthetic
tttgtgaactagauctgtgaatctugca

SEQ ID NO: 26080 - DNA, 28 bp, Artificial Sequence
  Synthetic
tcaaccttgaucaatagaagucaaaagt

SEQ ID NO: 26081 - DNA, 24 bp, Artificial Sequence
  Synthetic
ggtctgtcatucaccatttgacug

SEQ ID NO: 26082 - DNA, 21 bp, Artificial Sequence
  Synthetic
atttaggacugcatgcuggct

SEQ ID NO: 26083 - DNA, 29 bp, Artificial Sequence
  Synthetic
accatccccttaguattaggtgaaatcut

SEQ ID NO: 26084 - DNA, 24 bp, Artificial Sequence
  Synthetic
tuactggcatcuagaacagcaagg

SEQ ID NO: 26085 - DNA, 29 bp, Artificial Sequence
  Synthetic
tccctaggtctaaucctcttctttcttut

SEQ ID NO: 26086 - DNA, 20 bp, Artificial Sequence
  Synthetic
gtcagucgtccagugccaat

SEQ ID NO: 26087 - DNA, 25 bp, Artificial Sequence
  Synthetic
gccttctttucattttccctugcag

SEQ ID NO: 26088 - DNA, 29 bp, Artificial Sequence
  Synthetic
aaattccctctauagctatggaaagucct

SEQ ID NO: 26089 - DNA, 28 bp, Artificial Sequence
  Synthetic
tcgatattgtaacacuctgagtttgcut

SEQ ID NO: 26090 - DNA, 30 bp, Artificial Sequence
  Synthetic
actgcaatatattuccatacctgtttcugg

SEQ ID NO: 26091 - DNA, 25 bp, Artificial Sequence
  Synthetic
ctgaggcttguttgattctgggaua

SEQ ID NO: 26092 - DNA, 24 bp, Artificial Sequence
  Synthetic
tgacauggctattagugcacaagg

SEQ ID NO: 26093 - DNA, 29 bp, Artificial Sequence
  Synthetic
aggtacttaggaauggcaaatttgtuaca

SEQ ID NO: 26094 - DNA, 22 bp, Artificial Sequence
  Synthetic
ccctcacuggagtcttccacut

SEQ ID NO: 26095 - DNA, 29 bp, Artificial Sequence
  Synthetic
ggttaatttgctugtgtttactttgguga

SEQ ID NO: 26096 - DNA, 21 bp, Artificial Sequence
  Synthetic
actgaggatuccctggaccut

SEQ ID NO: 26097 - DNA, 28 bp, Artificial Sequence
  Synthetic
tcttcacccccugaatcatttcattuaa

SEQ ID NO: 26098 - DNA, 19 bp, Artificial Sequence
  Synthetic
ctgctcaguctctccugct

SEQ ID NO: 26099 - DNA, 17 bp, Artificial Sequence
  Synthetic
gccaggacccugaccuc

SEQ ID NO: 26100 - DNA, 22 bp, Artificial Sequence
  Synthetic
cctactgtgaccucagccacua

SEQ ID NO: 26101 - DNA, 21 bp, Artificial Sequence
  Synthetic
gccagggaguaaaccuggaag

SEQ ID NO: 26102 - DNA, 21 bp, Artificial Sequence
  Synthetic
ccggtttugggtatggguact

SEQ ID NO: 26103 - DNA, 19 bp, Artificial Sequence
  Synthetic
gtggcccuacctacccaug

SEQ ID NO: 26104 - DNA, 19 bp, Artificial Sequence
  Synthetic
caggtgggutagcacguga

SEQ ID NO: 26105 - DNA, 22 bp, Artificial Sequence
  Synthetic
gttggcttaguctccccatcug

SEQ ID NO: 26106 - DNA, 21 bp, Artificial Sequence
  Synthetic
gggaggaaccagaugtccaug

SEQ ID NO: 26107 - DNA, 17 bp, Artificial Sequence
  Synthetic
ctggccugcctctgcua

SEQ ID NO: 26108 - DNA, 20 bp, Artificial Sequence
  Synthetic
gccacaaugctggcatugag

SEQ ID NO: 26109 - DNA, 20 bp, Artificial Sequence
  Synthetic
gtggcacagacugtguccat

SEQ ID NO: 26110 - DNA, 17 bp, Artificial Sequence
  Synthetic
ccauacccggccgagug

SEQ ID NO: 26111 - DNA, 17 bp, Artificial Sequence
  Synthetic
aggtgcgcgugtctcug

SEQ ID NO: 26112 - DNA, 20 bp, Artificial Sequence
  Synthetic
gggtuggagggaacacacuc

SEQ ID NO: 26113 - DNA, 22 bp, Artificial Sequence
  Synthetic
tctgactggacugtgtgtguct

SEQ ID NO: 26114 - DNA, 17 bp, Artificial Sequence
  Synthetic
gggcgugagcucaggat

SEQ ID NO: 26115 - DNA, 17 bp, Artificial Sequence
  Synthetic
gcccugccacuggacac

SEQ ID NO: 26116 - DNA, 23 bp, Artificial Sequence
  Synthetic
tcagccactcugcttacaatguc

SEQ ID NO: 26117 - DNA, 23 bp, Artificial Sequence
  Synthetic
gtggaugaacagcaccttgttuc

SEQ ID NO: 26118 - DNA, 21 bp, Artificial Sequence
  Synthetic
catcatgucctagcccugacc

SEQ ID NO: 26119 - DNA, 27 bp, Artificial Sequence
  Synthetic
gtgttcgctttutccccttttaatuca

SEQ ID NO: 26120 - DNA, 19 bp, Artificial Sequence
  Synthetic
ctgtucagaccacccucgt

SEQ ID NO: 26121 - DNA, 24 bp, Artificial Sequence
  Synthetic
actcctgatuggctttgtcttucc

SEQ ID NO: 26122 - DNA, 21 bp, Artificial Sequence
  Synthetic
tgtctcagggucactcaggut

SEQ ID NO: 26123 - DNA, 17 bp, Artificial Sequence
  Synthetic
ccaggucgctcccucac

SEQ ID NO: 26124 - DNA, 23 bp, Artificial Sequence
  Synthetic
ctgtccttgccuacttcttccut

SEQ ID NO: 26125 - DNA, 21 bp, Artificial Sequence
  Synthetic
aggagguagcggtcctcauac

SEQ ID NO: 26126 - DNA, 20 bp, Artificial Sequence
  Synthetic
ctccugacagccctctgtuc

SEQ ID NO: 26127 - DNA, 21 bp, Artificial Sequence
  Synthetic
gatgctagugctccctgcuaa

SEQ ID NO: 26128 - DNA, 21 bp, Artificial Sequence
  Synthetic
cacctgugctgtctcttucct

SEQ ID NO: 26129 - DNA, 19 bp, Artificial Sequence
  Synthetic
aggaccaaggaugggugga

SEQ ID NO: 26130 - DNA, 21 bp, Artificial Sequence
  Synthetic
ggtguccagggactggtaugt

SEQ ID NO: 26131 - DNA, 20 bp, Artificial Sequence
  Synthetic
ccttcgagucccaacaggug

SEQ ID NO: 26132 - DNA, 20 bp, Artificial Sequence
  Synthetic
ggtgggtgacuctgagccut

SEQ ID NO: 26133 - DNA, 20 bp, Artificial Sequence
  Synthetic
cagggatcuctgggttugct

SEQ ID NO: 26134 - DNA, 22 bp, Artificial Sequence
  Synthetic
gcctccctaguggtatcctgut

SEQ ID NO: 26135 - DNA, 24 bp, Artificial Sequence
  Synthetic
ctcctcattguagagagacagugg

SEQ ID NO: 26136 - DNA, 22 bp, Artificial Sequence
  Synthetic
gctgagcugacaagcttcuact

SEQ ID NO: 26137 - DNA, 21 bp, Artificial Sequence
  Synthetic
cctttacaccuggaggctcug

SEQ ID NO: 26138 - DNA, 21 bp, Artificial Sequence
  Synthetic
gggaaggucaagaggcattuc

SEQ ID NO: 26139 - DNA, 27 bp, Artificial Sequence
  Synthetic
aatgagactcaucatgaacacagcuaa

SEQ ID NO: 26140 - DNA, 23 bp, Artificial Sequence
  Synthetic
caagtcttugcccagttctguct

SEQ ID NO: 26141 - DNA, 19 bp, Artificial Sequence
  Synthetic
cattcagcagucgguggga

SEQ ID NO: 26142 - DNA, 20 bp, Artificial Sequence
  Synthetic
ggtcttgguctcaccgtugt

SEQ ID NO: 26143 - DNA, 25 bp, Artificial Sequence
  Synthetic
cagtgtgagugagtgtcagtguaat

SEQ ID NO: 26144 - DNA, 21 bp, Artificial Sequence
  Synthetic
cctgcagcugtcctcugaaag

SEQ ID NO: 26145 - DNA, 24 bp, Artificial Sequence
  Synthetic
gcutgataccucccaaaaacggat

SEQ ID NO: 26146 - DNA, 23 bp, Artificial Sequence
  Synthetic
ggagacatacugtctgggtcuga

SEQ ID NO: 26147 - DNA, 28 bp, Artificial Sequence
  Synthetic
tcggatttttcacuttgctcatgtttut

SEQ ID NO: 26148 - DNA, 21 bp, Artificial Sequence
  Synthetic
agcugaacaagucaaggacac

SEQ ID NO: 26149 - DNA, 26 bp, Artificial Sequence
  Synthetic
gaacaagctagauacaatcagcucca

SEQ ID NO: 26150 - DNA, 22 bp, Artificial Sequence
  Synthetic
caaaaagcaagcuccacctguc

SEQ ID NO: 26151 - DNA, 22 bp, Artificial Sequence
  Synthetic
ccctcccuctgctttacaauca

SEQ ID NO: 26152 - DNA, 26 bp, Artificial Sequence
  Synthetic
gtgggagtgugaagaatgattctugt

SEQ ID NO: 26153 - DNA, 25 bp, Artificial Sequence
  Synthetic
acugaggagctgtuaaagaaagcaa

SEQ ID NO: 26154 - DNA, 23 bp, Artificial Sequence
  Synthetic
ggactgggagugaagatacuggt

SEQ ID NO: 26155 - DNA, 22 bp, Artificial Sequence
  Synthetic
agacagtcucccaggttcucag

SEQ ID NO: 26156 - DNA, 23 bp, Artificial Sequence
  Synthetic
cctgtgagcaauggcacaaaauc

SEQ ID NO: 26157 - DNA, 28 bp, Artificial Sequence
  Synthetic
tgacttcagttguctttgtttctctuca

SEQ ID NO: 26158 - DNA, 22 bp, Artificial Sequence
  Synthetic
gcttctcaaagugaggctugca

SEQ ID NO: 26159 - DNA, 27 bp, Artificial Sequence
  Synthetic
gtgttcatatatgutctgcccttguct

SEQ ID NO: 26160 - DNA, 27 bp, Artificial Sequence
  Synthetic
tttcccaaccacauactaaatcugacc

SEQ ID NO: 26161 - DNA, 26 bp, Artificial Sequence
  Synthetic
cccctgtgttcutctcttccatttua

SEQ ID NO: 26162 - DNA, 27 bp, Artificial Sequence
  Synthetic
gctgagatttggugagacacagaauag

SEQ ID NO: 26163 - DNA, 29 bp, Artificial Sequence
  Synthetic
gcactgagtugacactctgaagtattuaa

SEQ ID NO: 26164 - DNA, 30 bp, Artificial Sequence
  Synthetic
acaguatactaaguagcaaacaaacaagca

SEQ ID NO: 26165 - DNA, 25 bp, Artificial Sequence
  Synthetic
ctcttctcaacgggutccttttcua

SEQ ID NO: 26166 - DNA, 30 bp, Artificial Sequence
  Synthetic
ccatttcattcaaauccttacaaacaucct

SEQ ID NO: 26167 - DNA, 27 bp, Artificial Sequence
  Synthetic
gactgccctugttcttttacatttuca

SEQ ID NO: 26168 - DNA, 24 bp, Artificial Sequence
  Synthetic
tgtatcagcaggautctaguggct

SEQ ID NO: 26169 - DNA, 20 bp, Artificial Sequence
  Synthetic
gcctucgagcgagagaaugg

SEQ ID NO: 26170 - DNA, 17 bp, Artificial Sequence
  Synthetic
ccagtguccgtcgcguc

SEQ ID NO: 26171 - DNA, 20 bp, Artificial Sequence
  Synthetic
ggcagaacucaccttugcct

SEQ ID NO: 26172 - DNA, 20 bp, Artificial Sequence
  Synthetic
cagcatctcuacggcacgua

SEQ ID NO: 26173 - DNA, 21 bp, Artificial Sequence
  Synthetic
ccatgccaagcutcagtguca

SEQ ID NO: 26174 - DNA, 21 bp, Artificial Sequence
  Synthetic
cuctgctucccagagacaagg

SEQ ID NO: 26175 - DNA, 26 bp, Artificial Sequence
  Synthetic
tgaagaataaaccagauggcttgugt

SEQ ID NO: 26176 - DNA, 19 bp, Artificial Sequence
  Synthetic
ggtggtgauggtgccctuc

SEQ ID NO: 26177 - DNA, 18 bp, Artificial Sequence
  Synthetic
acacggtugggtggcuac

SEQ ID NO: 26178 - DNA, 21 bp, Artificial Sequence
  Synthetic
cagacgtgguacctgcaucag

SEQ ID NO: 26179 - DNA, 21 bp, Artificial Sequence
  Synthetic
atgaagagugagcaccucaut

SEQ ID NO: 26180 - DNA, 23 bp, Artificial Sequence
  Synthetic
ggtcaaugactcagactuccagg

SEQ ID NO: 26181 - DNA, 23 bp, Artificial Sequence
  Synthetic
ccuttcaatctuccccagacagg

SEQ ID NO: 26182 - DNA, 23 bp, Artificial Sequence
  Synthetic
ccugtttgtgaaugacaccaagg

SEQ ID NO: 26183 - DNA, 22 bp, Artificial Sequence
  Synthetic
tgcagctguactgcttttcuca

SEQ ID NO: 26184 - DNA, 20 bp, Artificial Sequence
  Synthetic
gcaggauctgccuaggaggt

SEQ ID NO: 26185 - DNA, 22 bp, Artificial Sequence
  Synthetic
atgccctgautaaaccctgcut

SEQ ID NO: 26186 - DNA, 19 bp, Artificial Sequence
  Synthetic
cagagcauacgcagccugt

SEQ ID NO: 26187 - DNA, 20 bp, Artificial Sequence
  Synthetic
cctccggaaggucatcucag

SEQ ID NO: 26188 - DNA, 20 bp, Artificial Sequence
  Synthetic
ttcctccccugtcatccuca

SEQ ID NO: 26189 - DNA, 17 bp, Artificial Sequence
  Synthetic
cctgtgccuggcaggua

SEQ ID NO: 26190 - DNA, 20 bp, Artificial Sequence
  Synthetic
ctccuggaagacccaagcug

SEQ ID NO: 26191 - DNA, 21 bp, Artificial Sequence
  Synthetic
aatgagatgaggucgcccaug

SEQ ID NO: 26192 - DNA, 22 bp, Artificial Sequence
  Synthetic
catggccugacgactcgtgcua

SEQ ID NO: 26193 - DNA, 21 bp, Artificial Sequence
  Synthetic
catggugcacctgggauccct

SEQ ID NO: 26194 - DNA, 22 bp, Artificial Sequence
  Synthetic
cactggtccuttcactctcugc

SEQ ID NO: 26195 - DNA, 21 bp, Artificial Sequence
  Synthetic
agggaaugcacacagatgucc

SEQ ID NO: 26196 - DNA, 26 bp, Artificial Sequence
  Synthetic
ctgagttguatctagttguggcacat

SEQ ID NO: 26197 - DNA, 29 bp, Artificial Sequence
  Synthetic
aaatgcatgggaaautctaccatagagut

SEQ ID NO: 26198 - DNA, 26 bp, Artificial Sequence
  Synthetic
gttcttcagugcagaacaaatgauct

SEQ ID NO: 26199 - DNA, 29 bp, Artificial Sequence
  Synthetic
gagtccattaccuttcacaaagaaatgut

SEQ ID NO: 26200 - DNA, 20 bp, Artificial Sequence
  Synthetic
gcaccccaaggcuggaauaa

SEQ ID NO: 26201 - DNA, 21 bp, Artificial Sequence
  Synthetic
cctcttctucgctgtccucag

SEQ ID NO: 26202 - DNA, 17 bp, Artificial Sequence
  Synthetic
gaagugcggccagctug

SEQ ID NO: 26203 - DNA, 17 bp, Artificial Sequence
  Synthetic
ctctccucggctcugct

SEQ ID NO: 26204 - DNA, 21 bp, Artificial Sequence
  Synthetic
gagggtttgugacaggccuat

SEQ ID NO: 26205 - DNA, 22 bp, Artificial Sequence
  Synthetic
gagagggcuccaaaagtcacuc

SEQ ID NO: 26206 - DNA, 19 bp, Artificial Sequence
  Synthetic
tgcaugcgacacttggugt

SEQ ID NO: 26207 - DNA, 24 bp, Artificial Sequence
  Synthetic
ccctcttctaugggttccttguct

SEQ ID NO: 26208 - DNA, 18 bp, Artificial Sequence
  Synthetic
ccugggaggaagggcuca

SEQ ID NO: 26209 - DNA, 24 bp, Artificial Sequence
  Synthetic
acagagcuggaaaaagacaagguc

SEQ ID NO: 26210 - DNA, 22 bp, Artificial Sequence
  Synthetic
gccccttugcatgaagcaauac

SEQ ID NO: 26211 - DNA, 23 bp, Artificial Sequence
  Synthetic
cggagaagguaatggacgugaac

SEQ ID NO: 26212 - DNA, 23 bp, Artificial Sequence
  Synthetic
gggatctgutcactcagtugaga

SEQ ID NO: 26213 - DNA, 22 bp, Artificial Sequence
  Synthetic
catgagaugggcatggagaugt

SEQ ID NO: 26214 - DNA, 21 bp, Artificial Sequence
  Synthetic
cactcccuctttcctgtugca

SEQ ID NO: 26215 - DNA, 24 bp, Artificial Sequence
  Synthetic
gttaagacgcuttccagacugaca

SEQ ID NO: 26216 - DNA, 22 bp, Artificial Sequence
  Synthetic
cuaggacacagaucaggctcua

SEQ ID NO: 26217 - DNA, 30 bp, Artificial Sequence
  Synthetic
catttctgctucttaatgaatgtttuccca

SEQ ID NO: 26218 - DNA, 23 bp, Artificial Sequence
  Synthetic
accatgtgccautcatcctucat

SEQ ID NO: 26219 - DNA, 20 bp, Artificial Sequence
  Synthetic
gcagccucactggtttccug

SEQ ID NO: 26220 - DNA, 22 bp, Artificial Sequence
  Synthetic
gcccacttcucatctcctgtuc

SEQ ID NO: 26221 - DNA, 22 bp, Artificial Sequence
  Synthetic
acactactcutgggcgauagct

SEQ ID NO: 26222 - DNA, 22 bp, Artificial Sequence
  Synthetic
agccagagaccauccttttcug

SEQ ID NO: 26223 - DNA, 23 bp, Artificial Sequence
  Synthetic
cctcgtggcuttttcctttgtug

SEQ ID NO: 26224 - DNA, 31 bp, Artificial Sequence
  Synthetic
aaacgattaattgauaacaatgtgagugcaa

SEQ ID NO: 26225 - DNA, 28 bp, Artificial Sequence
  Synthetic
cctccatataccaaugacaaaactguga

SEQ ID NO: 26226 - DNA, 28 bp, Artificial Sequence
  Synthetic
tgatgttcttacugtcaatcatggacuc

SEQ ID NO: 26227 - DNA, 26 bp, Artificial Sequence
  Synthetic
cacatgaggagaaugtacctcugaac

SEQ ID NO: 26228 - DNA, 27 bp, Artificial Sequence
  Synthetic
gccgttgatatuactgtggatacuagg

SEQ ID NO: 26229 - DNA, 28 bp, Artificial Sequence
  Synthetic
gttttggattucacaggcaatgtaauca

SEQ ID NO: 26230 - DNA, 21 bp, Artificial Sequence
  Synthetic
gtacctgauagccccauggac

SEQ ID NO: 26231 - DNA, 29 bp, Artificial Sequence
  Synthetic
aagaaccuaagauggaagaagaagaacac

SEQ ID NO: 26232 - DNA, 25 bp, Artificial Sequence
  Synthetic
gactctgtggautccgattcttcug

SEQ ID NO: 26233 - DNA, 23 bp, Artificial Sequence
  Synthetic
gaaacucactcuggaccaagagg

SEQ ID NO: 26234 - DNA, 24 bp, Artificial Sequence
  Synthetic
gggaatattcuggctctctuccat

SEQ ID NO: 26235 - DNA, 27 bp, Artificial Sequence
  Synthetic
gctgacactucaattgcatttucacaa

SEQ ID NO: 26236 - DNA, 23 bp, Artificial Sequence
  Synthetic
cctcaccauattcctcctgucca

SEQ ID NO: 26237 - DNA, 22 bp, Artificial Sequence
  Synthetic
tcgautgaauggcggaagaaaa

SEQ ID NO: 26238 - DNA, 30 bp, Artificial Sequence
  Synthetic
gggtaaaataatagagucttctttgacgut

SEQ ID NO: 26239 - DNA, 27 bp, Artificial Sequence
  Synthetic
gtgccctucagaagtaacaaataugga

SEQ ID NO: 26240 - DNA, 23 bp, Artificial Sequence
  Synthetic
ctgaggaugccttttggttcuct

SEQ ID NO: 26241 - DNA, 23 bp, Artificial Sequence
  Synthetic
caccaccuccttctattcctugc

SEQ ID NO: 26242 - DNA, 25 bp, Artificial Sequence
  Synthetic
gacgtugaaacggaaaguggaaaaa

SEQ ID NO: 26243 - DNA, 24 bp, Artificial Sequence
  Synthetic
aattttgcccauccaccaaacauc

SEQ ID NO: 26244 - DNA, 30 bp, Artificial Sequence
  Synthetic
actgatgacattaggutctgatttgagtuc

SEQ ID NO: 26245 - DNA, 27 bp, Artificial Sequence
  Synthetic
gtacaaacaaaagagguagcagcaauc

SEQ ID NO: 26246 - DNA, 24 bp, Artificial Sequence
  Synthetic
agcctctgaaucttttctctuggg

SEQ ID NO: 26247 - DNA, 25 bp, Artificial Sequence
  Synthetic
gtagacggaucactuaagagcaaca

SEQ ID NO: 26248 - DNA, 30 bp, Artificial Sequence
  Synthetic
cuttgttgaaaatgguagagaaggaaaaga

SEQ ID NO: 26249 - DNA, 28 bp, Artificial Sequence
  Synthetic
cttgctttaguaggttagtgttgttugg

SEQ ID NO: 26250 - DNA, 24 bp, Artificial Sequence
  Synthetic
gcaccaucaatatttuacaacgca

SEQ ID NO: 26251 - DNA, 28 bp, Artificial Sequence
  Synthetic
accagcatuaaaaagagaggagaaaguc

SEQ ID NO: 26252 - DNA, 28 bp, Artificial Sequence
  Synthetic
aagtacttatagccucaagtcagaauca

SEQ ID NO: 26253 - DNA, 28 bp, Artificial Sequence
  Synthetic
ttccctagaagautacaccaaatgugac

SEQ ID NO: 26254 - DNA, 30 bp, Artificial Sequence
  Synthetic
cctgcacatgtaucccctgaatctaaaaua

SEQ ID NO: 26255 - DNA, 21 bp, Artificial Sequence
  Synthetic
ctttcagguctccgtggucaa

SEQ ID NO: 26256 - DNA, 28 bp, Artificial Sequence
  Synthetic
cttgaaacttgaaguaggatctccucat

SEQ ID NO: 26257 - DNA, 31 bp, Artificial Sequence
  Synthetic
ccatttcataagggutatcttttcctgctua

SEQ ID NO: 26258 - DNA, 31 bp, Artificial Sequence
  Synthetic
ttgtccactgagaaugatattttagacauag

SEQ ID NO: 26259 - DNA, 26 bp, Artificial Sequence
  Synthetic
tgtgaatggaccuctggattaugaga

SEQ ID NO: 26260 - DNA, 28 bp, Artificial Sequence
  Synthetic
ctaagtttacuggttgatggugagaaca

SEQ ID NO: 26261 - DNA, 29 bp, Artificial Sequence
  Synthetic
aatacatcatcutctctaaaccugcagac

SEQ ID NO: 26262 - DNA, 26 bp, Artificial Sequence
  Synthetic
aaaaatgtgcugtcatctgtuaagcc

SEQ ID NO: 26263 - DNA, 26 bp, Artificial Sequence
  Synthetic
ctgccaguatttttgaaguggaagaa

SEQ ID NO: 26264 - DNA, 31 bp, Artificial Sequence
  Synthetic
gagtgttaaggatutttctcagtacagtuca

SEQ ID NO: 26265 - DNA, 28 bp, Artificial Sequence
  Synthetic
cctaacctggtutcaactgaagtacuaa

SEQ ID NO: 26266 - DNA, 23 bp, Artificial Sequence
  Synthetic
ttcttggtcuggaaatgccucat

SEQ ID NO: 26267 - DNA, 31 bp, Artificial Sequence
  Synthetic
ctgcatttctttatuttggtaacgtcacuaa

SEQ ID NO: 26268 - DNA, 23 bp, Artificial Sequence
  Synthetic
ccagcuggcaaattctctucaac

SEQ ID NO: 26269 - DNA, 27 bp, Artificial Sequence
  Synthetic
acagagaagucagggactactaugaac

SEQ ID NO: 26270 - DNA, 30 bp, Artificial Sequence
  Synthetic
aacagattacatuagctgagtttctttuga

SEQ ID NO: 26271 - DNA, 28 bp, Artificial Sequence
  Synthetic
agtgttugatccttatcugccaagaaat

SEQ ID NO: 26272 - DNA, 21 bp, Artificial Sequence
  Synthetic
cctucacagggagcatacuca

SEQ ID NO: 26273 - DNA, 31 bp, Artificial Sequence
  Synthetic
agaagactctcctugtgacataatatctcut

SEQ ID NO: 26274 - DNA, 30 bp, Artificial Sequence
  Synthetic
gccaagcttgucactttagaatttauacac

SEQ ID NO: 26275 - DNA, 28 bp, Artificial Sequence
  Synthetic
cgtaaccatctucttttcctctcttuct

SEQ ID NO: 26276 - DNA, 21 bp, Artificial Sequence
  Synthetic
gcgatggtgauaagccctgut

SEQ ID NO: 26277 - DNA, 24 bp, Artificial Sequence
  Synthetic
gacatgguggtgaaaagtugagac

SEQ ID NO: 26278 - DNA, 21 bp, Artificial Sequence
  Synthetic
agggaaggtuggcgtgttauc

SEQ ID NO: 26279 - DNA, 30 bp, Artificial Sequence
  Synthetic
ttgttaaactguaagagcaaactctguact

SEQ ID NO: 26280 - DNA, 30 bp, Artificial Sequence
  Synthetic
aagtaataccuacgtgttttagugaagaaa

SEQ ID NO: 26281 - DNA, 27 bp, Artificial Sequence
  Synthetic
gtgcggttgugatcatttacattuaca

SEQ ID NO: 26282 - DNA, 22 bp, Artificial Sequence
  Synthetic
agactgtccgaaauggttgcuc

SEQ ID NO: 26283 - DNA, 26 bp, Artificial Sequence
  Synthetic
gtgaaacuccaaaaagauagcacgac

SEQ ID NO: 26284 - DNA, 24 bp, Artificial Sequence
  Synthetic
tttactggcuccaggagacuaagt

SEQ ID NO: 26285 - DNA, 23 bp, Artificial Sequence
  Synthetic
gctttgttccucagctgaugaag

SEQ ID NO: 26286 - DNA, 31 bp, Artificial Sequence
  Synthetic
tgtctacaaaatactugaacatgatcccaut

SEQ ID NO: 26287 - DNA, 25 bp, Artificial Sequence
  Synthetic
tccaatgtttctuccttgtgtccut

SEQ ID NO: 26288 - DNA, 23 bp, Artificial Sequence
  Synthetic
gcacagagcuctccaagagtauc

SEQ ID NO: 26289 - DNA, 29 bp, Artificial Sequence
  Synthetic
cccctaatgttgacuggaaatatagtgut

SEQ ID NO: 26290 - DNA, 27 bp, Artificial Sequence
  Synthetic
aggtatttacauaccggatcatcugga

SEQ ID NO: 26291 - DNA, 26 bp, Artificial Sequence
  Synthetic
atttctggtgugcagttgataaaaug

SEQ ID NO: 26292 - DNA, 29 bp, Artificial Sequence
  Synthetic
cttcatggtagauaatagtgcccacttut

SEQ ID NO: 26293 - DNA, 27 bp, Artificial Sequence
  Synthetic
gaaaaatgtacugaatgaacgagugct

SEQ ID NO: 26294 - DNA, 31 bp, Artificial Sequence
  Synthetic
cacccagtaauccacattatccttuaaagaa

SEQ ID NO: 26295 - DNA, 20 bp, Artificial Sequence
  Synthetic
gccgcgguttaagagcauga

SEQ ID NO: 26296 - DNA, 22 bp, Artificial Sequence
  Synthetic
caggaagctuctcaccctctuc

SEQ ID NO: 26297 - DNA, 22 bp, Artificial Sequence
  Synthetic
gucccagagcacaaagaugaac

SEQ ID NO: 26298 - DNA, 20 bp, Artificial Sequence
  Synthetic
tctgctctcucccttggcua

SEQ ID NO: 26299 - DNA, 21 bp, Artificial Sequence
  Synthetic
ctguccccaggagagaatugg

SEQ ID NO: 26300 - DNA, 22 bp, Artificial Sequence
  Synthetic
tcacaggattuctggaccccua

SEQ ID NO: 26301 - DNA, 24 bp, Artificial Sequence
  Synthetic
ggtctctgauaccctcaaggguaa

SEQ ID NO: 26302 - DNA, 22 bp, Artificial Sequence
  Synthetic
cccaattcutcgccatugacag

SEQ ID NO: 26303 - DNA, 23 bp, Artificial Sequence
  Synthetic
ctgggtcaaugtcccatuggaat

SEQ ID NO: 26304 - DNA, 24 bp, Artificial Sequence
  Synthetic
caaactcaaguccctcctctctuc

SEQ ID NO: 26305 - DNA, 21 bp, Artificial Sequence
  Synthetic
tcagagccugagatgccuact

SEQ ID NO: 26306 - DNA, 22 bp, Artificial Sequence
  Synthetic
gggtgactgauctctgtccaua

SEQ ID NO: 26307 - DNA, 22 bp, Artificial Sequence
  Synthetic
ccaccuggatgaagaguggaag

SEQ ID NO: 26308 - DNA, 22 bp, Artificial Sequence
  Synthetic
ccttcctgacuggcttcttcug

SEQ ID NO: 26309 - DNA, 22 bp, Artificial Sequence
  Synthetic
ccactccaaaaugccagugagt

SEQ ID NO: 26310 - DNA, 25 bp, Artificial Sequence
  Synthetic
ctatgccaaggugaagatcactcuc

SEQ ID NO: 26311 - DNA, 21 bp, Artificial Sequence
  Synthetic
ccttccctgautgctgagguc

SEQ ID NO: 26312 - DNA, 22 bp, Artificial Sequence
  Synthetic
gcctggcaguaatgacttctug

SEQ ID NO: 26313 - DNA, 26 bp, Artificial Sequence
  Synthetic
gaaaagttcccagauctcatgaguct

SEQ ID NO: 26314 - DNA, 21 bp, Artificial Sequence
  Synthetic
ccgggucaggatcaatgtgut

SEQ ID NO: 26315 - DNA, 27 bp, Artificial Sequence
  Synthetic
gtacagggagaaggcuaagataaaugg

SEQ ID NO: 26316 - DNA, 24 bp, Artificial Sequence
  Synthetic
ctcaagtctgcutacagagggauc

SEQ ID NO: 26317 - DNA, 23 bp, Artificial Sequence
  Synthetic
agcactcaccaucccttacacua

SEQ ID NO: 26318 - DNA, 20 bp, Artificial Sequence
  Synthetic
cccacctutttcccccugaa

SEQ ID NO: 26319 - DNA, 20 bp, Artificial Sequence
  Synthetic
gtggaggaccaggguactug

SEQ ID NO: 26320 - DNA, 18 bp, Artificial Sequence
  Synthetic
aagatugcccgugggcat

SEQ ID NO: 26321 - DNA, 19 bp, Artificial Sequence
  Synthetic
ctgctcugccaccaccuac

SEQ ID NO: 26322 - DNA, 19 bp, Artificial Sequence
  Synthetic
gcacccuggtguacagcat

SEQ ID NO: 26323 - DNA, 18 bp, Artificial Sequence
  Synthetic
cccgcagccuaaggtgug

SEQ ID NO: 26324 - DNA, 22 bp, Artificial Sequence
  Synthetic
gagaagcauccatcccagtguc

SEQ ID NO: 26325 - DNA, 18 bp, Artificial Sequence
  Synthetic
cagcuggtacuccgcgat

SEQ ID NO: 26326 - DNA, 23 bp, Artificial Sequence
  Synthetic
attcattcccuacttggtcuggt

SEQ ID NO: 26327 - DNA, 19 bp, Artificial Sequence
  Synthetic
tcgttguccgtgcagtuca

SEQ ID NO: 26328 - DNA, 19 bp, Artificial Sequence
  Synthetic
ccagcucaggagcagaguc

SEQ ID NO: 26329 - DNA, 18 bp, Artificial Sequence
  Synthetic
gtgcgggacuggtgcaua

SEQ ID NO: 26330 - DNA, 24 bp, Artificial Sequence
  Synthetic
actgtccuggatgtgaaugacaac

SEQ ID NO: 26331 - DNA, 19 bp, Artificial Sequence
  Synthetic
ctctggugccacugagcat

SEQ ID NO: 26332 - DNA, 18 bp, Artificial Sequence
  Synthetic
gggtcugtcccuccacac

SEQ ID NO: 26333 - DNA, 18 bp, Artificial Sequence
  Synthetic
ccgtccugaggucagcac

SEQ ID NO: 26334 - DNA, 22 bp, Artificial Sequence
  Synthetic
ccccacucagttctatcuggga

SEQ ID NO: 26335 - DNA, 24 bp, Artificial Sequence
  Synthetic
cgacacatucatcatgtagcuggt

SEQ ID NO: 26336 - DNA, 22 bp, Artificial Sequence
  Synthetic
ggcactggguactgagattgug

SEQ ID NO: 26337 - DNA, 28 bp, Artificial Sequence
  Synthetic
gacattttaugacaaagaggagagugct

SEQ ID NO: 26338 - DNA, 22 bp, Artificial Sequence
  Synthetic
ctgtaggtcuctgaccacgtuc

SEQ ID NO: 26339 - DNA, 21 bp, Artificial Sequence
  Synthetic
ggtggatccuggctgttucac

SEQ ID NO: 26340 - DNA, 21 bp, Artificial Sequence
  Synthetic
gctttagcccugactccagut

SEQ ID NO: 26341 - DNA, 22 bp, Artificial Sequence
  Synthetic
cccccgtaugtccagctataug

SEQ ID NO: 26342 - DNA, 19 bp, Artificial Sequence
  Synthetic
ccgcaucagcggtgagauc

SEQ ID NO: 26343 - DNA, 25 bp, Artificial Sequence
  Synthetic
ggaattccatuctcacccatctugt

SEQ ID NO: 26344 - DNA, 20 bp, Artificial Sequence
  Synthetic
ccaacggcacagucaccuat

SEQ ID NO: 26345 - DNA, 21 bp, Artificial Sequence
  Synthetic
agactgcauctttgctccauc

SEQ ID NO: 26346 - DNA, 26 bp, Artificial Sequence
  Synthetic
gaggcagaatuatcaggtccattuca

SEQ ID NO: 26347 - DNA, 23 bp, Artificial Sequence
  Synthetic
cagtgactucaaatggtcccuca

SEQ ID NO: 26348 - DNA, 21 bp, Artificial Sequence
  Synthetic
gagugaggcttgcuagaggaa

SEQ ID NO: 26349 - DNA, 22 bp, Artificial Sequence
  Synthetic
ggttguagaaggcgatggtcuc

SEQ ID NO: 26350 - DNA, 19 bp, Artificial Sequence
  Synthetic
cgaacctccucctcggtug

SEQ ID NO: 26351 - DNA, 19 bp, Artificial Sequence
  Synthetic
agggctgtuctcgctgaug

SEQ ID NO: 26352 - DNA, 25 bp, Artificial Sequence
  Synthetic
aaguagaaaguagggaaaaggtcuc

SEQ ID NO: 26353 - DNA, 20 bp, Artificial Sequence
  Synthetic
tctctctccaugcgcctcua

SEQ ID NO: 26354 - DNA, 18 bp, Artificial Sequence
  Synthetic
gggctgggutggtctugt

SEQ ID NO: 26355 - DNA, 20 bp, Artificial Sequence
  Synthetic
ccagaaucaggctgggagug

SEQ ID NO: 26356 - DNA, 24 bp, Artificial Sequence
  Synthetic
ctcatcaccaucctggaugacaat

SEQ ID NO: 26357 - DNA, 20 bp, Artificial Sequence
  Synthetic
gcaaacuccgtguccaacct

SEQ ID NO: 26358 - DNA, 21 bp, Artificial Sequence
  Synthetic
tgttggtaaugccaccaucga

SEQ ID NO: 26359 - DNA, 22 bp, Artificial Sequence
  Synthetic
tggtcaauggccgtgatatugg

SEQ ID NO: 26360 - DNA, 22 bp, Artificial Sequence
  Synthetic
ccugggaagggcagatttuagg

SEQ ID NO: 26361 - DNA, 23 bp, Artificial Sequence
  Synthetic
caatgagagaugtcugcagggaa

SEQ ID NO: 26362 - DNA, 22 bp, Artificial Sequence
  Synthetic
gccctttgggaucacctacuac

SEQ ID NO: 26363 - DNA, 26 bp, Artificial Sequence
  Synthetic
cctcctcugacagatttctaaccuac

SEQ ID NO: 26364 - DNA, 20 bp, Artificial Sequence
  Synthetic
ggactgaccutggcctacuc

SEQ ID NO: 26365 - DNA, 23 bp, Artificial Sequence
  Synthetic
gtccttcccacutccaaatucca

SEQ ID NO: 26366 - DNA, 21 bp, Artificial Sequence
  Synthetic
cctttggccutgacctccauc

SEQ ID NO: 26367 - DNA, 21 bp, Artificial Sequence
  Synthetic
tguccaaggaaggccacauac

SEQ ID NO: 26368 - DNA, 21 bp, Artificial Sequence
  Synthetic
cgagaagutcagtcugaccgt

SEQ ID NO: 26369 - DNA, 23 bp, Artificial Sequence
  Synthetic
gccacagcuggaagaaggaaaua

SEQ ID NO: 26370 - DNA, 25 bp, Artificial Sequence
  Synthetic
agttcttcatcaucgacccaaucag

SEQ ID NO: 26371 - DNA, 21 bp, Artificial Sequence
  Synthetic
agttccccuagggacttucca

SEQ ID NO: 26372 - DNA, 20 bp, Artificial Sequence
  Synthetic
ggccccaugtgatgacaucc

SEQ ID NO: 26373 - DNA, 23 bp, Artificial Sequence
  Synthetic
gtaatcagggcacuagctctguc

SEQ ID NO: 26374 - DNA, 20 bp, Artificial Sequence
  Synthetic
ttcatcgucaaggccuccag

SEQ ID NO: 26375 - DNA, 19 bp, Artificial Sequence
  Synthetic
gcagguggtgtaaguggca

SEQ ID NO: 26376 - DNA, 21 bp, Artificial Sequence
  Synthetic
gcactgagtcuctgagccgua

SEQ ID NO: 26377 - DNA, 26 bp, Artificial Sequence
  Synthetic
gggatctcgutaatgacgatctugac

SEQ ID NO: 26378 - DNA, 21 bp, Artificial Sequence
  Synthetic
cctaaaagaggccugcccauc

SEQ ID NO: 26379 - DNA, 21 bp, Artificial Sequence
  Synthetic
acaggcugacaguccaaacac

SEQ ID NO: 26380 - DNA, 23 bp, Artificial Sequence
  Synthetic
aaggagcagcuacggaatcttut

SEQ ID NO: 26381 - DNA, 20 bp, Artificial Sequence
  Synthetic
aggacgatgaucgccatcug

SEQ ID NO: 26382 - DNA, 18 bp, Artificial Sequence
  Synthetic
gcaccccaucctcccuca

SEQ ID NO: 26383 - DNA, 18 bp, Artificial Sequence
  Synthetic
ctgggagacugcagcuct

SEQ ID NO: 26384 - DNA, 21 bp, Artificial Sequence
  Synthetic
gctccagcuaacatccccuct

SEQ ID NO: 26385 - DNA, 23 bp, Artificial Sequence
  Synthetic
tctctaccacccugtgttctcug

SEQ ID NO: 26386 - DNA, 21 bp, Artificial Sequence
  Synthetic
gcggcucaaaaagctcttugc

SEQ ID NO: 26387 - DNA, 25 bp, Artificial Sequence
  Synthetic
agagcuccagagacauagagaagga

SEQ ID NO: 26388 - DNA, 17 bp, Artificial Sequence
  Synthetic
cuggccaccgaccucaa

SEQ ID NO: 26389 - DNA, 22 bp, Artificial Sequence
  Synthetic
cacaaggctuccctgtctaguc

SEQ ID NO: 26390 - DNA, 19 bp, Artificial Sequence
  Synthetic
ggccguaggcagccuaaat

SEQ ID NO: 26391 - DNA, 18 bp, Artificial Sequence
  Synthetic
cucggauacgcggcagat

SEQ ID NO: 26392 - DNA, 23 bp, Artificial Sequence
  Synthetic
aaatgguaaggaagggcacauca

SEQ ID NO: 26393 - DNA, 28 bp, Artificial Sequence
  Synthetic
gtcttgtacatuttggctagttttuccc

SEQ ID NO: 26394 - DNA, 28 bp, Artificial Sequence
  Synthetic
ccagagtggugggtaatgattttaaugt

SEQ ID NO: 26395 - DNA, 30 bp, Artificial Sequence
  Synthetic
attttccttaaugaactataccttttugcc

SEQ ID NO: 26396 - DNA, 30 bp, Artificial Sequence
  Synthetic
ctaataattgttgugcatgagtgttacuac

SEQ ID NO: 26397 - DNA, 25 bp, Artificial Sequence
  Synthetic
agtcccaggaaacugcaaatacaut

SEQ ID NO: 26398 - DNA, 20 bp, Artificial Sequence
  Synthetic
cgtguggacatguggcagat

SEQ ID NO: 26399 - DNA, 20 bp, Artificial Sequence
  Synthetic
gcttcuggcaaguggaggac

SEQ ID NO: 26400 - DNA, 20 bp, Artificial Sequence
  Synthetic
ctctctgguctgggccacua

SEQ ID NO: 26401 - DNA, 20 bp, Artificial Sequence
  Synthetic
gggagguctttggcattugg

SEQ ID NO: 26402 - DNA, 29 bp, Artificial Sequence
  Synthetic
tgaacaatgccucagctatacattuacat

SEQ ID NO: 26403 - DNA, 25 bp, Artificial Sequence
  Synthetic
ggcctaactautcaaacagggauga

SEQ ID NO: 26404 - DNA, 23 bp, Artificial Sequence
  Synthetic
actgggaugaaatcagacuccga

SEQ ID NO: 26405 - DNA, 26 bp, Artificial Sequence
  Synthetic
tcctaactctuaagaagggctgcaua

SEQ ID NO: 26406 - DNA, 28 bp, Artificial Sequence
  Synthetic
actcttcutttaggattcuccaaaagcc

SEQ ID NO: 26407 - DNA, 27 bp, Artificial Sequence
  Synthetic
tcaattctagguagcctggttactgua

SEQ ID NO: 26408 - DNA, 29 bp, Artificial Sequence
  Synthetic
tttctgagggaaggauaatggtauagaga

SEQ ID NO: 26409 - DNA, 28 bp, Artificial Sequence
  Synthetic
ggaataaatgcutcatcctgtuccaaat

SEQ ID NO: 26410 - DNA, 24 bp, Artificial Sequence
  Synthetic
tgggtacaccaugctttttgauga

SEQ ID NO: 26411 - DNA, 26 bp, Artificial Sequence
  Synthetic
catacttctccauatcggccttuacc

SEQ ID NO: 26412 - DNA, 26 bp, Artificial Sequence
  Synthetic
aatgagcattactuctccctagccua

SEQ ID NO: 26413 - DNA, 26 bp, Artificial Sequence
  Synthetic
gcagctgaauaagccaattuaagcag

SEQ ID NO: 26414 - DNA, 23 bp, Artificial Sequence
  Synthetic
tcaacttggaccutggctttcut

SEQ ID NO: 26415 - DNA, 24 bp, Artificial Sequence
  Synthetic
cagaaacuactcaaacucccacct

SEQ ID NO: 26416 - DNA, 24 bp, Artificial Sequence
  Synthetic
agtccccugaagaagtgattcgua

SEQ ID NO: 26417 - DNA, 27 bp, Artificial Sequence
  Synthetic
ctagagtttcucctccgatggttuaac

SEQ ID NO: 26418 - DNA, 17 bp, Artificial Sequence
  Synthetic
gcaggcccucctcgtua

SEQ ID NO: 26419 - DNA, 17 bp, Artificial Sequence
  Synthetic
cgaugggcgcguagagc

SEQ ID NO: 26420 - DNA, 17 bp, Artificial Sequence
  Synthetic
cuagacccgcgcgtcuc

SEQ ID NO: 26421 - DNA, 20 bp, Artificial Sequence
  Synthetic
ctcucaggaagcacctucgt

SEQ ID NO: 26422 - DNA, 18 bp, Artificial Sequence
  Synthetic
ccacuccccaggtgcauc

SEQ ID NO: 26423 - DNA, 19 bp, Artificial Sequence
  Synthetic
catgacauccagccaugcc

SEQ ID NO: 26424 - DNA, 18 bp, Artificial Sequence
  Synthetic
ggctguggcgaucacgaa

SEQ ID NO: 26425 - DNA, 21 bp, Artificial Sequence
  Synthetic
gcatcugagcaaggtggaugg

SEQ ID NO: 26426 - DNA, 22 bp, Artificial Sequence
  Synthetic
acactgtgtgutttctggccua

SEQ ID NO: 26427 - DNA, 22 bp, Artificial Sequence
  Synthetic
tgcctggaaguttccgactuac

SEQ ID NO: 26428 - DNA, 19 bp, Artificial Sequence
  Synthetic
gaccgguaaccacgtccug

SEQ ID NO: 26429 - DNA, 28 bp, Artificial Sequence
  Synthetic
acaataacagugaccaaaatgacaguga

SEQ ID NO: 26430 - DNA, 21 bp, Artificial Sequence
  Synthetic
cgatguccaggaaccgcuaat

SEQ ID NO: 26431 - DNA, 22 bp, Artificial Sequence
  Synthetic
catagccgucgacagagaagug

SEQ ID NO: 26432 - DNA, 19 bp, Artificial Sequence
  Synthetic
ggaggccuaacgtgctguc

SEQ ID NO: 26433 - DNA, 20 bp, Artificial Sequence
  Synthetic
gactcctugagctccagucc

SEQ ID NO: 26434 - DNA, 21 bp, Artificial Sequence
  Synthetic
gaggagaagugatgcgtguct

SEQ ID NO: 26435 - DNA, 17 bp, Artificial Sequence
  Synthetic
gcaccgcugatcaugca

SEQ ID NO: 26436 - DNA, 20 bp, Artificial Sequence
  Synthetic
cagcactuggccctgattug

SEQ ID NO: 26437 - DNA, 19 bp, Artificial Sequence
  Synthetic
cctgcaggagcutcacgut

SEQ ID NO: 26438 - DNA, 22 bp, Artificial Sequence
  Synthetic
actcaucaccgacatgctucac

SEQ ID NO: 26439 - DNA, 20 bp, Artificial Sequence
  Synthetic
cctccucaggacccctcauc

SEQ ID NO: 26440 - DNA, 23 bp, Artificial Sequence
  Synthetic
tttaaatgcacugaccucccaca

SEQ ID NO: 26441 - DNA, 22 bp, Artificial Sequence
  Synthetic
cctggcccacaaguatcacuaa

SEQ ID NO: 26442 - DNA, 25 bp, Artificial Sequence
  Synthetic
tgtaccctgtuacttatcccctucc

SEQ ID NO: 26443 - DNA, 22 bp, Artificial Sequence
  Synthetic
ctaaggugaaggctcauggcaa

SEQ ID NO: 26444 - DNA, 24 bp, Artificial Sequence
  Synthetic
acatgcccaguttctattggtcuc

SEQ ID NO: 26445 - DNA, 23 bp, Artificial Sequence
  Synthetic
cauaaaagucagggcagagccat

SEQ ID NO: 26446 - DNA, 18 bp, Artificial Sequence
  Synthetic
gucugcacggacgaagga

SEQ ID NO: 26447 - DNA, 17 bp, Artificial Sequence
  Synthetic
cccugcccagcaucgag

SEQ ID NO: 26448 - DNA, 21 bp, Artificial Sequence
  Synthetic
cctagcaucccacuaaaccct

SEQ ID NO: 26449 - DNA, 18 bp, Artificial Sequence
  Synthetic
catcuccccgggctgtut

SEQ ID NO: 26450 - DNA, 17 bp, Artificial Sequence
  Synthetic
cggatggugccgcugaa

SEQ ID NO: 26451 - DNA, 19 bp, Artificial Sequence
  Synthetic
ctcacugggacccaugcag

SEQ ID NO: 26452 - DNA, 18 bp, Artificial Sequence
  Synthetic
cgcctgucctgcagcaut

SEQ ID NO: 26453 - DNA, 20 bp, Artificial Sequence
  Synthetic
ggauactagctguggcccat

SEQ ID NO: 26454 - DNA, 18 bp, Artificial Sequence
  Synthetic
gggagtgcuggtgtcuga

SEQ ID NO: 26455 - DNA, 20 bp, Artificial Sequence
  Synthetic
ctgtggcuctaaccccugag

SEQ ID NO: 26456 - DNA, 21 bp, Artificial Sequence
  Synthetic
cccctgtuccactcctaccut

SEQ ID NO: 26457 - DNA, 25 bp, Artificial Sequence
  Synthetic
ctcttaactgutccactctgtuccc

SEQ ID NO: 26458 - DNA, 22 bp, Artificial Sequence
  Synthetic
tggatgaaguagcacacgaugg

SEQ ID NO: 26459 - DNA, 26 bp, Artificial Sequence
  Synthetic
agcactcuaaacacagtcaauaccaa

SEQ ID NO: 26460 - DNA, 25 bp, Artificial Sequence
  Synthetic
ctaaggcucagagaacagtgactug

SEQ ID NO: 26461 - DNA, 20 bp, Artificial Sequence
  Synthetic
cacgtcugtcactguggagt

SEQ ID NO: 26462 - DNA, 19 bp, Artificial Sequence
  Synthetic
cacucccaacctcugccat

SEQ ID NO: 26463 - DNA, 17 bp, Artificial Sequence
  Synthetic
cgagccugcgccaagua

SEQ ID NO: 26464 - DNA, 21 bp, Artificial Sequence
  Synthetic
tctctguggctgaucagacct

SEQ ID NO: 26465 - DNA, 28 bp, Artificial Sequence
  Synthetic
ccaccaaccatauatcctgaagacatug

SEQ ID NO: 26466 - DNA, 19 bp, Artificial Sequence
  Synthetic
ctgcccccuatagccugac

SEQ ID NO: 26467 - DNA, 23 bp, Artificial Sequence
  Synthetic
tccctacccuctactctctucct

SEQ ID NO: 26468 - DNA, 21 bp, Artificial Sequence
  Synthetic
ccccucagaggctgctacuaa

SEQ ID NO: 26469 - DNA, 20 bp, Artificial Sequence
  Synthetic
ccaactcugaccaggcugac

SEQ ID NO: 26470 - DNA, 19 bp, Artificial Sequence
  Synthetic
cacccuggagggagtugac

SEQ ID NO: 26471 - DNA, 23 bp, Artificial Sequence
  Synthetic
gagagctcaguatgcctttccuc

SEQ ID NO: 26472 - DNA, 24 bp, Artificial Sequence
  Synthetic
tgaggaggauggtuaaaaggagat

SEQ ID NO: 26473 - DNA, 22 bp, Artificial Sequence
  Synthetic
gggtaatggutgttcagacucc

SEQ ID NO: 26474 - DNA, 19 bp, Artificial Sequence
  Synthetic
cctctgggagutggtgcug

SEQ ID NO: 26475 - DNA, 20 bp, Artificial Sequence
  Synthetic
agtgggucctcaccuccaaa

SEQ ID NO: 26476 - DNA, 18 bp, Artificial Sequence
  Synthetic
agcctugaggcugacaca

SEQ ID NO: 26477 - DNA, 20 bp, Artificial Sequence
  Synthetic
tcacttgugcctctguccac

SEQ ID NO: 26478 - DNA, 19 bp, Artificial Sequence
  Synthetic
tccutgcatguacgcagca

SEQ ID NO: 26479 - DNA, 23 bp, Artificial Sequence
  Synthetic
agtattccaaugagcggcugaag

SEQ ID NO: 26480 - DNA, 20 bp, Artificial Sequence
  Synthetic
acacacaccuttgggcacuc

SEQ ID NO: 26481 - DNA, 20 bp, Artificial Sequence
  Synthetic
agggcaaccaucaggucaaa

SEQ ID NO: 26482 - DNA, 32 bp, Artificial Sequence
  Synthetic
atggacattattccuaataatggttcttaugg

SEQ ID NO: 26483 - DNA, 26 bp, Artificial Sequence
  Synthetic
catttctgcaagcaucctactatgug

SEQ ID NO: 26484 - DNA, 27 bp, Artificial Sequence
  Synthetic
tctcagaaacaacugaaaaccatcuag

SEQ ID NO: 26485 - DNA, 21 bp, Artificial Sequence
  Synthetic
actgtgcauctttgggaucgt

SEQ ID NO: 26486 - DNA, 23 bp, Artificial Sequence
  Synthetic
ctctcugtgacccuaaaccagaa

SEQ ID NO: 26487 - DNA, 21 bp, Artificial Sequence
  Synthetic
ccttcgugaatctgctgucca

SEQ ID NO: 26488 - DNA, 17 bp, Artificial Sequence
  Synthetic
ggccagagccuctgcut

SEQ ID NO: 26489 - DNA, 25 bp, Artificial Sequence
  Synthetic
atcaccaagaccaucaagtttguca

SEQ ID NO: 26490 - DNA, 21 bp, Artificial Sequence
  Synthetic
ctccctccuacacctcaccua

SEQ ID NO: 26491 - DNA, 23 bp, Artificial Sequence
  Synthetic
tcctgtcugtttctctcucccat

SEQ ID NO: 26492 - DNA, 18 bp, Artificial Sequence
  Synthetic
gcctccucctcccuccct

SEQ ID NO: 26493 - DNA, 20 bp, Artificial Sequence
  Synthetic
tcaacaacggcugctttgug

SEQ ID NO: 26494 - DNA, 17 bp, Artificial Sequence
  Synthetic
aagaguggcccgagcug

SEQ ID NO: 26495 - DNA, 25 bp, Artificial Sequence
  Synthetic
ggacctucttctgaaguccaaaagg

SEQ ID NO: 26496 - DNA, 18 bp, Artificial Sequence
  Synthetic
agcagauggccacugcaa

SEQ ID NO: 26497 - DNA, 24 bp, Artificial Sequence
  Synthetic
gttttgtgttucttgctctgcuct

SEQ ID NO: 26498 - DNA, 23 bp, Artificial Sequence
  Synthetic
tgaggcaucctattgugagacct

SEQ ID NO: 26499 - DNA, 21 bp, Artificial Sequence
  Synthetic
gttggccaaucagcctcauct

SEQ ID NO: 26500 - DNA, 22 bp, Artificial Sequence
  Synthetic
cccaggagugaccttgagagua

SEQ ID NO: 26501 - DNA, 25 bp, Artificial Sequence
  Synthetic
ctcaaagctucccactgtcttttuc

SEQ ID NO: 26502 - DNA, 25 bp, Artificial Sequence
  Synthetic
aggtacucccagagagaaagaagug

SEQ ID NO: 26503 - DNA, 29 bp, Artificial Sequence
  Synthetic
ctattggtaacauccaatgtggaacttut

SEQ ID NO: 26504 - DNA, 22 bp, Artificial Sequence
  Synthetic
ggacaugggaaacagcagtuct

SEQ ID NO: 26505 - DNA, 22 bp, Artificial Sequence
  Synthetic
gaagaagcacugagcaaccauc

SEQ ID NO: 26506 - DNA, 20 bp, Artificial Sequence
  Synthetic
ctgcacccauggagaggaug

SEQ ID NO: 26507 - DNA, 19 bp, Artificial Sequence
  Synthetic
acaccacugaccuggacga

SEQ ID NO: 26508 - DNA, 22 bp, Artificial Sequence
  Synthetic
agcaggaggguctatguggaaa

SEQ ID NO: 26509 - DNA, 23 bp, Artificial Sequence
  Synthetic
ttcaaatgugccctttgtccuct

SEQ ID NO: 26510 - DNA, 26 bp, Artificial Sequence
  Synthetic
tcacaccauttagtgttgauaggaca

SEQ ID NO: 26511 - DNA, 26 bp, Artificial Sequence
  Synthetic
gctgaactgtguctcatcattttgut

SEQ ID NO: 26512 - DNA, 23 bp, Artificial Sequence
  Synthetic
gggccagcauttctgactagtuc

SEQ ID NO: 26513 - DNA, 23 bp, Artificial Sequence
  Synthetic
gttcugactccaguaacaggcat

SEQ ID NO: 26514 - DNA, 17 bp, Artificial Sequence
  Synthetic
ggctggcugcacucact

SEQ ID NO: 26515 - DNA, 20 bp, Artificial Sequence
  Synthetic
gggcctcutttctcccauga

SEQ ID NO: 26516 - DNA, 20 bp, Artificial Sequence
  Synthetic
guggagaugacaagggccaa

SEQ ID NO: 26517 - DNA, 19 bp, Artificial Sequence
  Synthetic
ctgtccugcagaugagcga

SEQ ID NO: 26518 - DNA, 21 bp, Artificial Sequence
  Synthetic
gcaaggttucctcggaagugg

SEQ ID NO: 26519 - DNA, 28 bp, Artificial Sequence
  Synthetic
cgtgattctgcutctatctctcttucag

SEQ ID NO: 26520 - DNA, 20 bp, Artificial Sequence
  Synthetic
cctcccaccgucatggagua

SEQ ID NO: 26521 - DNA, 21 bp, Artificial Sequence
  Synthetic
ctgcctcuctctgtggucaag

SEQ ID NO: 26522 - DNA, 18 bp, Artificial Sequence
  Synthetic
cgcccagggugatctcuc

SEQ ID NO: 26523 - DNA, 19 bp, Artificial Sequence
  Synthetic
gcatucccggcatcuccac

SEQ ID NO: 26524 - DNA, 17 bp, Artificial Sequence
  Synthetic
ggtguccacccccuacc

SEQ ID NO: 26525 - DNA, 18 bp, Artificial Sequence
  Synthetic
cggctcuttccagcucct

SEQ ID NO: 26526 - DNA, 28 bp, Artificial Sequence
  Synthetic
tgtaaatcatagugtgagatacagcugc

SEQ ID NO: 26527 - DNA, 26 bp, Artificial Sequence
  Synthetic
acaacccagugaagagttctaccaua

SEQ ID NO: 26528 - DNA, 28 bp, Artificial Sequence
  Synthetic
caagatggccutcatggatuagaaaaag

SEQ ID NO: 26529 - DNA, 26 bp, Artificial Sequence
  Synthetic
aatttctcautctgtgguacaaccca

SEQ ID NO: 26530 - DNA, 20 bp, Artificial Sequence
  Synthetic
gctguggaacacccagguaa

SEQ ID NO: 26531 - DNA, 28 bp, Artificial Sequence
  Synthetic
agcttctgccgutaactaggttaauaaa

SEQ ID NO: 26532 - DNA, 20 bp, Artificial Sequence
  Synthetic
ggacggaucacaaggucagg

SEQ ID NO: 26533 - DNA, 21 bp, Artificial Sequence
  Synthetic
tgtgatcacugctcagugcaa

SEQ ID NO: 26534 - DNA, 24 bp, Artificial Sequence
  Synthetic
tgctttaaacauttgtctgugcgt

SEQ ID NO: 26535 - DNA, 24 bp, Artificial Sequence
  Synthetic
ggtttgaaaagcugttggcctauc

SEQ ID NO: 26536 - DNA, 28 bp, Artificial Sequence
  Synthetic
gctgctttttctutaaacggtacacaua

SEQ ID NO: 26537 - DNA, 22 bp, Artificial Sequence
  Synthetic
ctggcatguagtgtcacggaut

SEQ ID NO: 26538 - DNA, 24 bp, Artificial Sequence
  Synthetic
cagatgcuaagaccaggtactuca

SEQ ID NO: 26539 - DNA, 24 bp, Artificial Sequence
  Synthetic
aacgtttgcacuatgacctucaga

SEQ ID NO: 26540 - DNA, 22 bp, Artificial Sequence
  Synthetic
gcagcaaagacutccgaatucc

SEQ ID NO: 26541 - DNA, 21 bp, Artificial Sequence
  Synthetic
cgcttgccucagaacaactuc

SEQ ID NO: 26542 - DNA, 24 bp, Artificial Sequence
  Synthetic
catcagagagucctcctggagaut

SEQ ID NO: 26543 - DNA, 20 bp, Artificial Sequence
  Synthetic
gggaugcagctcgtuaccac

SEQ ID NO: 26544 - DNA, 18 bp, Artificial Sequence
  Synthetic
cuccagagccgugcgaat

SEQ ID NO: 26545 - DNA, 19 bp, Artificial Sequence
  Synthetic
gagagucgccgtcuccaag

SEQ ID NO: 26546 - DNA, 31 bp, Artificial Sequence
  Synthetic
cccatagtcacugactgaattaacacaauat

SEQ ID NO: 26547 - DNA, 28 bp, Artificial Sequence
  Synthetic
ccatgtctgttuctcaaagggaatauct

SEQ ID NO: 26548 - DNA, 21 bp, Artificial Sequence
  Synthetic
cctgagccacucctcactuct

SEQ ID NO: 26549 - DNA, 26 bp, Artificial Sequence
  Synthetic
ctctgactacugtcatttctctugcc

SEQ ID NO: 26550 - DNA, 24 bp, Artificial Sequence
  Synthetic
agtactctguacaagcacctcugt

SEQ ID NO: 26551 - DNA, 30 bp, Artificial Sequence
  Synthetic
ggcacaatatggaaaaucaacttactctut

SEQ ID NO: 26552 - DNA, 21 bp, Artificial Sequence
  Synthetic
tcagctgaagucgcattugag

SEQ ID NO: 26553 - DNA, 26 bp, Artificial Sequence
  Synthetic
gctcttggaguttaagacuacaccag

SEQ ID NO: 26554 - DNA, 24 bp, Artificial Sequence
  Synthetic
acacagacuaagagacaguggaga

SEQ ID NO: 26555 - DNA, 24 bp, Artificial Sequence
  Synthetic
gcgacuccagaagttguaagcaaa

SEQ ID NO: 26556 - DNA, 25 bp, Artificial Sequence
  Synthetic
gggaaguggacagaaaaccacatua

SEQ ID NO: 26557 - DNA, 29 bp, Artificial Sequence
  Synthetic
gctctctacaguaagttctcataccatug

SEQ ID NO: 26558 - DNA, 17 bp, Artificial Sequence
  Synthetic
cgtcgcgaguccctgug

SEQ ID NO: 26559 - DNA, 29 bp, Artificial Sequence
  Synthetic
ccgaggattaacucctattttcttgcuaa

SEQ ID NO: 26560 - DNA, 24 bp, Artificial Sequence
  Synthetic
acttgaaagcagutcacacacugt

SEQ ID NO: 26561 - DNA, 24 bp, Artificial Sequence
  Synthetic
tgtctctttgutgcaagtgtcuct

SEQ ID NO: 26562 - DNA, 29 bp, Artificial Sequence
  Synthetic
aacaacaaagagaaucatgaaaucaaccc

SEQ ID NO: 26563 - DNA, 25 bp, Artificial Sequence
  Synthetic
gcctttaaugagatcccctttucca

SEQ ID NO: 26564 - DNA, 22 bp, Artificial Sequence
  Synthetic
agggccaaagaguccatcagua

SEQ ID NO: 26565 - DNA, 24 bp, Artificial Sequence
  Synthetic
actgagcctutttcccttcttugt

SEQ ID NO: 26566 - DNA, 27 bp, Artificial Sequence
  Synthetic
agttctaagcaccuttgaaatggtuca

SEQ ID NO: 26567 - DNA, 27 bp, Artificial Sequence
  Synthetic
ccattgctttugaagaaacagttgugt

SEQ ID NO: 26568 - DNA, 21 bp, Artificial Sequence
  Synthetic
gggagaaggacuccactuggt

SEQ ID NO: 26569 - DNA, 21 bp, Artificial Sequence
  Synthetic
cgctgacacugtgcttctcuc

SEQ ID NO: 26570 - DNA, 20 bp, Artificial Sequence
  Synthetic
agugaacuggccggaaaagt

SEQ ID NO: 26571 - DNA, 19 bp, Artificial Sequence
  Synthetic
cttcggctuacgggtcgut

SEQ ID NO: 26572 - DNA, 17 bp, Artificial Sequence
  Synthetic
gcugctguaggcaccca

SEQ ID NO: 26573 - DNA, 17 bp, Artificial Sequence
  Synthetic
gtccgcucccccactuc

SEQ ID NO: 26574 - DNA, 18 bp, Artificial Sequence
  Synthetic
cgctctucccatcuccca

SEQ ID NO: 26575 - DNA, 18 bp, Artificial Sequence
  Synthetic
ccgctuccgcatgtucag

SEQ ID NO: 26576 - DNA, 20 bp, Artificial Sequence
  Synthetic
ccagcgccuaaagttcccua

SEQ ID NO: 26577 - DNA, 22 bp, Artificial Sequence
  Synthetic
gtaccaagucctgucaccaaca

SEQ ID NO: 26578 - DNA, 17 bp, Artificial Sequence
  Synthetic
cccagacccugggcuca

SEQ ID NO: 26579 - DNA, 18 bp, Artificial Sequence
  Synthetic
tgacccccugctcacugt

SEQ ID NO: 26580 - DNA, 22 bp, Artificial Sequence
  Synthetic
tgtcctccaugttctcaaugcg

SEQ ID NO: 26581 - DNA, 24 bp, Artificial Sequence
  Synthetic
caggttcagggutaagctttucct

SEQ ID NO: 26582 - DNA, 19 bp, Artificial Sequence
  Synthetic
gtcaauggcgggtcttgug

SEQ ID NO: 26583 - DNA, 23 bp, Artificial Sequence
  Synthetic
cacacaucgatactggugaagga

SEQ ID NO: 26584 - DNA, 21 bp, Artificial Sequence
  Synthetic
tcaatggcaaggugagcaugt

SEQ ID NO: 26585 - DNA, 20 bp, Artificial Sequence
  Synthetic
gctcagaccccuctcugacc

SEQ ID NO: 26586 - DNA, 19 bp, Artificial Sequence
  Synthetic
cgtagacgcgcauctcgua

SEQ ID NO: 26587 - DNA, 21 bp, Artificial Sequence
  Synthetic
aaacagauccgagggaaggug

SEQ ID NO: 26588 - DNA, 21 bp, Artificial Sequence
  Synthetic
cgtgatguttgtcgaguggct

SEQ ID NO: 26589 - DNA, 21 bp, Artificial Sequence
  Synthetic
ggaagaugagggcgtcuacac

SEQ ID NO: 26590 - DNA, 19 bp, Artificial Sequence
  Synthetic
tcggcaccacguagguaga

SEQ ID NO: 26591 - DNA, 20 bp, Artificial Sequence
  Synthetic
gtcagctccuctgctcccua

SEQ ID NO: 26592 - DNA, 24 bp, Artificial Sequence
  Synthetic
ttttgatcctugctcttccctcug

SEQ ID NO: 26593 - DNA, 18 bp, Artificial Sequence
  Synthetic
ctccaggguagggugggt

SEQ ID NO: 26594 - DNA, 17 bp, Artificial Sequence
  Synthetic
catccaccugcccugca

SEQ ID NO: 26595 - DNA, 18 bp, Artificial Sequence
  Synthetic
acacccucccgagcucaa

SEQ ID NO: 26596 - DNA, 24 bp, Artificial Sequence
  Synthetic
gttgatgatcagguggtgtctcug

SEQ ID NO: 26597 - DNA, 25 bp, Artificial Sequence
  Synthetic
gcaagtcaaauggtgagtuccagaa

SEQ ID NO: 26598 - DNA, 19 bp, Artificial Sequence
  Synthetic
catctccuccccaggtucc

SEQ ID NO: 26599 - DNA, 18 bp, Artificial Sequence
  Synthetic
ggtguccgcagcttucct

SEQ ID NO: 26600 - DNA, 24 bp, Artificial Sequence
  Synthetic
cattcttgagccauttgaccucag

SEQ ID NO: 26601 - DNA, 19 bp, Artificial Sequence
  Synthetic
ccacagccacaguagctug

SEQ ID NO: 26602 - DNA, 20 bp, Artificial Sequence
  Synthetic
ggctccuggcagaatuaggg

SEQ ID NO: 26603 - DNA, 21 bp, Artificial Sequence
  Synthetic
aggaaguaaaggcccaugggt

SEQ ID NO: 26604 - DNA, 19 bp, Artificial Sequence
  Synthetic
gaacugccacccaggacuc

SEQ ID NO: 26605 - DNA, 21 bp, Artificial Sequence
  Synthetic
ggctagtguccctttcuccct

SEQ ID NO: 26606 - DNA, 21 bp, Artificial Sequence
  Synthetic
acgaggcaucctccttagugt

SEQ ID NO: 26607 - DNA, 19 bp, Artificial Sequence
  Synthetic
cguccctccaugcacacag

SEQ ID NO: 26608 - DNA, 18 bp, Artificial Sequence
  Synthetic
cccctucccaccccaaug

SEQ ID NO: 26609 - DNA, 30 bp, Artificial Sequence
  Synthetic
caagacuccatcucaaacaaacagaaaaag

SEQ ID NO: 26610 - DNA, 20 bp, Artificial Sequence
  Synthetic
caaaccucagggaaggcuga

SEQ ID NO: 26611 - DNA, 18 bp, Artificial Sequence
  Synthetic
cgggcaggagugaaggug

SEQ ID NO: 26612 - DNA, 20 bp, Artificial Sequence
  Synthetic
tcctcgucaacccccucaag

SEQ ID NO: 26613 - DNA, 25 bp, Artificial Sequence
  Synthetic
cccauatatagugggaaggacagga

SEQ ID NO: 26614 - DNA, 21 bp, Artificial Sequence
  Synthetic
ccuagagugccccgaagagat

SEQ ID NO: 26615 - DNA, 20 bp, Artificial Sequence
  Synthetic
cacgtugtgaggtuccacga

SEQ ID NO: 26616 - DNA, 21 bp, Artificial Sequence
  Synthetic
ctcatgacgugagtaggcuca

SEQ ID NO: 26617 - DNA, 20 bp, Artificial Sequence
  Synthetic
ctggcctaugctcacctucc

SEQ ID NO: 26618 - DNA, 22 bp, Artificial Sequence
  Synthetic
gggatggaaucaggctgtauca

SEQ ID NO: 26619 - DNA, 19 bp, Artificial Sequence
  Synthetic
ggtgguggcagaggaguag

SEQ ID NO: 26620 - DNA, 20 bp, Artificial Sequence
  Synthetic
ctcauggcccggtactucag

SEQ ID NO: 26621 - DNA, 20 bp, Artificial Sequence
  Synthetic
cctgccccuacctgctgtua

SEQ ID NO: 26622 - DNA, 23 bp, Artificial Sequence
  Synthetic
gtcatcattgutgtgggcauagc

SEQ ID NO: 26623 - DNA, 23 bp, Artificial Sequence
  Synthetic
tgcgagttucacaagaccatcuc

SEQ ID NO: 26624 - DNA, 18 bp, Artificial Sequence
  Synthetic
cagccugacccucgaacg

SEQ ID NO: 26625 - DNA, 22 bp, Artificial Sequence
  Synthetic
tguaccaguccaaccagacaga

SEQ ID NO: 26626 - DNA, 21 bp, Artificial Sequence
  Synthetic
ccaatcggugtccctctcuac

SEQ ID NO: 26627 - DNA, 18 bp, Artificial Sequence
  Synthetic
cagcccugccagcttuac

SEQ ID NO: 26628 - DNA, 17 bp, Artificial Sequence
  Synthetic
cctccugcccaggctuc

SEQ ID NO: 26629 - DNA, 17 bp, Artificial Sequence
  Synthetic
cugcgcaggaugagcac

SEQ ID NO: 26630 - DNA, 22 bp, Artificial Sequence
  Synthetic
caaaggagtgcugaggttccua

SEQ ID NO: 26631 - DNA, 22 bp, Artificial Sequence
  Synthetic
cautgacaggtuggcaaaccac

SEQ ID NO: 26632 - DNA, 21 bp, Artificial Sequence
  Synthetic
gcccuggtaccuggagaagag

SEQ ID NO: 26633 - DNA, 24 bp, Artificial Sequence
  Synthetic
ttctagccucagttucccaaaagg

SEQ ID NO: 26634 - DNA, 20 bp, Artificial Sequence
  Synthetic
catgagcuggacctcgtugt

SEQ ID NO: 26635 - DNA, 22 bp, Artificial Sequence
  Synthetic
gagacctucctttccugacact

SEQ ID NO: 26636 - DNA, 23 bp, Artificial Sequence
  Synthetic
gagagggagagautccuccaagt

SEQ ID NO: 26637 - DNA, 24 bp, Artificial Sequence
  Synthetic
ctcgggcttautccagtacatguc

SEQ ID NO: 26638 - DNA, 21 bp, Artificial Sequence
  Synthetic
aagtaaggccaggugttgguc

SEQ ID NO: 26639 - DNA, 25 bp, Artificial Sequence
  Synthetic
ccacagtagttuggtccttgagtut

SEQ ID NO: 26640 - DNA, 20 bp, Artificial Sequence
  Synthetic
tgtggacgccutcaagtcug

SEQ ID NO: 26641 - DNA, 27 bp, Artificial Sequence
  Synthetic
ccagaactcacaguctttaagctttug

SEQ ID NO: 26642 - DNA, 24 bp, Artificial Sequence
  Synthetic
agatccccgaaaaucaccucaaag

SEQ ID NO: 26643 - DNA, 23 bp, Artificial Sequence
  Synthetic
cccuaggaaattguggaggaagg

SEQ ID NO: 26644 - DNA, 21 bp, Artificial Sequence
  Synthetic
gggaccaggugaaggaagaug

SEQ ID NO: 26645 - DNA, 18 bp, Artificial Sequence
  Synthetic
cctgccacccuttccugt

SEQ ID NO: 26646 - DNA, 24 bp, Artificial Sequence
  Synthetic
ctcactagggaugaagcacatucc

SEQ ID NO: 26647 - DNA, 30 bp, Artificial Sequence
  Synthetic
tgaataaaaggcautaaaggctgaaguagt

SEQ ID NO: 26648 - DNA, 19 bp, Artificial Sequence
  Synthetic
cccacagggcutctcccua

SEQ ID NO: 26649 - DNA, 22 bp, Artificial Sequence
  Synthetic
cctgctgcccuacttctacauc

SEQ ID NO: 26650 - DNA, 18 bp, Artificial Sequence
  Synthetic
cccaucggcggatgtgua

SEQ ID NO: 26651 - DNA, 17 bp, Artificial Sequence
  Synthetic
accgctugacccctucc

SEQ ID NO: 26652 - DNA, 19 bp, Artificial Sequence
  Synthetic
gguaccacccgaagtgguc

SEQ ID NO: 26653 - DNA, 20 bp, Artificial Sequence
  Synthetic
gcatctgcguggagtgugat

SEQ ID NO: 26654 - DNA, 21 bp, Artificial Sequence
  Synthetic
gacaggtugatgaggguccag

SEQ ID NO: 26655 - DNA, 21 bp, Artificial Sequence
  Synthetic
ctgggcuctcgctaaguaagg

SEQ ID NO: 26656 - DNA, 20 bp, Artificial Sequence
  Synthetic
agacggcauagccaaggaug

SEQ ID NO: 26657 - DNA, 22 bp, Artificial Sequence
  Synthetic
ggaaagcgccutcatttcugaa

SEQ ID NO: 26658 - DNA, 19 bp, Artificial Sequence
  Synthetic
ccaccugctgtgucccaac

SEQ ID NO: 26659 - DNA, 23 bp, Artificial Sequence
  Synthetic
cccccttcaucgtctactactuc

SEQ ID NO: 26660 - DNA, 24 bp, Artificial Sequence
  Synthetic
gtccttcattccuttgggtccaua

SEQ ID NO: 26661 - DNA, 25 bp, Artificial Sequence
  Synthetic
gtaagcaaggutctctttctugcag

SEQ ID NO: 26662 - DNA, 22 bp, Artificial Sequence
  Synthetic
ctgagactcuctctcgcccaua

SEQ ID NO: 26663 - DNA, 24 bp, Artificial Sequence
  Synthetic
ctttcgatcauctccctgcaucaa

SEQ ID NO: 26664 - DNA, 23 bp, Artificial Sequence
  Synthetic
agagcccaagagcuttcuagagt

SEQ ID NO: 26665 - DNA, 24 bp, Artificial Sequence
  Synthetic
catctccccaaucttcttgtuggt

SEQ ID NO: 26666 - DNA, 20 bp, Artificial Sequence
  Synthetic
cctgggcugagttccagtug

SEQ ID NO: 26667 - DNA, 20 bp, Artificial Sequence
  Synthetic
ccctcggaacuctggtccua

SEQ ID NO: 26668 - DNA, 20 bp, Artificial Sequence
  Synthetic
gcactgugcccacatttuca

SEQ ID NO: 26669 - DNA, 21 bp, Artificial Sequence
  Synthetic
ccctacaaucctagggugggt

SEQ ID NO: 26670 - DNA, 23 bp, Artificial Sequence
  Synthetic
caugttcacugacaccgagaact

SEQ ID NO: 26671 - DNA, 23 bp, Artificial Sequence
  Synthetic
gtgcuaggacagaaactgagcug

SEQ ID NO: 26672 - DNA, 17 bp, Artificial Sequence
  Synthetic
gcaggcuggcaggugag

SEQ ID NO: 26673 - DNA, 22 bp, Artificial Sequence
  Synthetic
caucaagagcccaactucccaa

SEQ ID NO: 26674 - DNA, 21 bp, Artificial Sequence
  Synthetic
gggccugaacaacaccctuac

SEQ ID NO: 26675 - DNA, 22 bp, Artificial Sequence
  Synthetic
ttgtcagugaactcgatgugca

SEQ ID NO: 26676 - DNA, 17 bp, Artificial Sequence
  Synthetic
aggagagggugggcuca

SEQ ID NO: 26677 - DNA, 23 bp, Artificial Sequence
  Synthetic
gggtctcauagtagacgaugcct

SEQ ID NO: 26678 - DNA, 21 bp, Artificial Sequence
  Synthetic
gagaggugactgctgttugct

SEQ ID NO: 26679 - DNA, 21 bp, Artificial Sequence
  Synthetic
ctcagcugaagctgtuggaca

SEQ ID NO: 26680 - DNA, 21 bp, Artificial Sequence
  Synthetic
gcctttgtcugggttggucaa

SEQ ID NO: 26681 - DNA, 22 bp, Artificial Sequence
  Synthetic
ctctacgaagcugtagcggaug

SEQ ID NO: 26682 - DNA, 22 bp, Artificial Sequence
  Synthetic
gctgtccatucccttgtgtucc

SEQ ID NO: 26683 - DNA, 23 bp, Artificial Sequence
  Synthetic
cagcccacaucatgggaattuac

SEQ ID NO: 26684 - DNA, 21 bp, Artificial Sequence
  Synthetic
ctgaucccaaacccacctgua

SEQ ID NO: 26685 - DNA, 20 bp, Artificial Sequence
  Synthetic
cagcaaggcugggtucaaag

SEQ ID NO: 26686 - DNA, 20 bp, Artificial Sequence
  Synthetic
agcgcaucatccagtuccag

SEQ ID NO: 26687 - DNA, 20 bp, Artificial Sequence
  Synthetic
ctgagggugatgcauggaca

SEQ ID NO: 26688 - DNA, 23 bp, Artificial Sequence
  Synthetic
gtgtcttctgugtcaccccaaut

SEQ ID NO: 26689 - DNA, 24 bp, Artificial Sequence
  Synthetic
cttgtccaccaugtctgagtgaut

SEQ ID NO: 26690 - DNA, 22 bp, Artificial Sequence
  Synthetic
agggcataccucttgtctccut

SEQ ID NO: 26691 - DNA, 22 bp, Artificial Sequence
  Synthetic
ggtagagcaguggctgttugag

SEQ ID NO: 26692 - DNA, 22 bp, Artificial Sequence
  Synthetic
gccaggtcautttgacagctut

SEQ ID NO: 26693 - DNA, 27 bp, Artificial Sequence
  Synthetic
ctcataaaucttggtcaucacagggat

SEQ ID NO: 26694 - DNA, 19 bp, Artificial Sequence
  Synthetic
ccccgcaaagucttgcugt

SEQ ID NO: 26695 - DNA, 18 bp, Artificial Sequence
  Synthetic
ccuaggccaccuaaggca

SEQ ID NO: 26696 - DNA, 18 bp, Artificial Sequence
  Synthetic
ccagcacuccggtcagug

SEQ ID NO: 26697 - DNA, 22 bp, Artificial Sequence
  Synthetic
tccaagggaugcctgtttuagg

SEQ ID NO: 26698 - DNA, 18 bp, Artificial Sequence
  Synthetic
cctcagcggguactcugg

SEQ ID NO: 26699 - DNA, 20 bp, Artificial Sequence
  Synthetic
catutacacacgugcgcaca

SEQ ID NO: 26700 - DNA, 22 bp, Artificial Sequence
  Synthetic
autcatggaugggaccaccaag

SEQ ID NO: 26701 - DNA, 20 bp, Artificial Sequence
  Synthetic
tgaauagccccggcaaguag

SEQ ID NO: 26702 - DNA, 19 bp, Artificial Sequence
  Synthetic
tctcccagugcgagcagua

SEQ ID NO: 26703 - DNA, 21 bp, Artificial Sequence
  Synthetic
cggaagatuccctcccacuca

SEQ ID NO: 26704 - DNA, 25 bp, Artificial Sequence
  Synthetic
gcagctgattuttagagcaaacuca

SEQ ID NO: 26705 - DNA, 20 bp, Artificial Sequence
  Synthetic
gcuacagagcaagggacugg

SEQ ID NO: 26706 - DNA, 21 bp, Artificial Sequence
  Synthetic
gggcatgacugactcaacugg

SEQ ID NO: 26707 - DNA, 22 bp, Artificial Sequence
  Synthetic
gtattcgucccccttgatggug

SEQ ID NO: 26708 - DNA, 25 bp, Artificial Sequence
  Synthetic
gcagacatgagugataacaccucag

SEQ ID NO: 26709 - DNA, 21 bp, Artificial Sequence
  Synthetic
gtcctctcautgatgccgtug

SEQ ID NO: 26710 - DNA, 20 bp, Artificial Sequence
  Synthetic
gccacagguagagagcugac

SEQ ID NO: 26711 - DNA, 19 bp, Artificial Sequence
  Synthetic
cctgtggcucccatcctuc

SEQ ID NO: 26712 - DNA, 21 bp, Artificial Sequence
  Synthetic
tctatucggcacaagccctuc

SEQ ID NO: 26713 - DNA, 19 bp, Artificial Sequence
  Synthetic
gtgaggtcugcccctcauc

SEQ ID NO: 26714 - DNA, 21 bp, Artificial Sequence
  Synthetic
ctttucccacccagcaacauc

SEQ ID NO: 26715 - DNA, 22 bp, Artificial Sequence
  Synthetic
aactgctatguggtcctcaucc

SEQ ID NO: 26716 - DNA, 21 bp, Artificial Sequence
  Synthetic
gggctcaguataggaggcaua

SEQ ID NO: 26717 - DNA, 23 bp, Artificial Sequence
  Synthetic
gaatcccuctgaggactugagga

SEQ ID NO: 26718 - DNA, 20 bp, Artificial Sequence
  Synthetic
agacaggccutaggugggaa

SEQ ID NO: 26719 - DNA, 20 bp, Artificial Sequence
  Synthetic
gccucagatgaucccaggac

SEQ ID NO: 26720 - DNA, 21 bp, Artificial Sequence
  Synthetic
tgtgaccugctctgtctcuga

SEQ ID NO: 26721 - DNA, 17 bp, Artificial Sequence
  Synthetic
gaugcccaccccaugct

SEQ ID NO: 26722 - DNA, 22 bp, Artificial Sequence
  Synthetic
ggctucattcctguccccaaat

SEQ ID NO: 26723 - DNA, 22 bp, Artificial Sequence
  Synthetic
guctgtggtucaggcagagaag

SEQ ID NO: 26724 - DNA, 21 bp, Artificial Sequence
  Synthetic
attcctgggagcugtgctaug

SEQ ID NO: 26725 - DNA, 20 bp, Artificial Sequence
  Synthetic
ctccccgugactgttcacut

SEQ ID NO: 26726 - DNA, 19 bp, Artificial Sequence
  Synthetic
gutccaatucccgcccaga

SEQ ID NO: 26727 - DNA, 20 bp, Artificial Sequence
  Synthetic
gcautgccgtuaccagacat

SEQ ID NO: 26728 - DNA, 23 bp, Artificial Sequence
  Synthetic
aagutcctttctuccaagccagt

SEQ ID NO: 26729 - DNA, 27 bp, Artificial Sequence
  Synthetic
atcataactgttcugacaaacctccuc

SEQ ID NO: 26730 - DNA, 23 bp, Artificial Sequence
  Synthetic
ggattatgugcctctguccccat

SEQ ID NO: 26731 - DNA, 25 bp, Artificial Sequence
  Synthetic
gaauccctucagggaaggaaagaag

SEQ ID NO: 26732 - DNA, 22 bp, Artificial Sequence
  Synthetic
ctaggcuccaccactgaaguag

SEQ ID NO: 26733 - DNA, 23 bp, Artificial Sequence
  Synthetic
gccccttacutgcaagactctua

SEQ ID NO: 26734 - DNA, 23 bp, Artificial Sequence
  Synthetic
gaaaggaacagugactgccuagt

SEQ ID NO: 26735 - DNA, 23 bp, Artificial Sequence
  Synthetic
gtcactctuccaaaaggauccgt

SEQ ID NO: 26736 - DNA, 24 bp, Artificial Sequence
  Synthetic
tacccaggcuttctagatgauagg

SEQ ID NO: 26737 - DNA, 23 bp, Artificial Sequence
  Synthetic
gggaaggcauatgtcaccatgug

SEQ ID NO: 26738 - DNA, 23 bp, Artificial Sequence
  Synthetic
cccacagtugccttttcagugat

SEQ ID NO: 26739 - DNA, 23 bp, Artificial Sequence
  Synthetic
agaaatgccacagucctccttuc

SEQ ID NO: 26740 - DNA, 23 bp, Artificial Sequence
  Synthetic
cttgttcucaccaaaucccacct

SEQ ID NO: 26741 - DNA, 20 bp, Artificial Sequence
  Synthetic
tgugccccacaaaccagtua

SEQ ID NO: 26742 - DNA, 23 bp, Artificial Sequence
  Synthetic
gcttggguacctcagtuccaaac

SEQ ID NO: 26743 - DNA, 22 bp, Artificial Sequence
  Synthetic
caagaacacucactgccucaga

SEQ ID NO: 26744 - DNA, 22 bp, Artificial Sequence
  Synthetic
ctcagatgccuatgggctucat

SEQ ID NO: 26745 - DNA, 28 bp, Artificial Sequence
  Synthetic
guaaaaacacagugggcaagagaaaaat

SEQ ID NO: 26746 - DNA, 25 bp, Artificial Sequence
  Synthetic
aagtaacagagugttttcacgugga

SEQ ID NO: 26747 - DNA, 27 bp, Artificial Sequence
  Synthetic
gggaccagucagtctcattataaucct

SEQ ID NO: 26748 - DNA, 22 bp, Artificial Sequence
  Synthetic
gtggcuaagagggtcagtugaa

SEQ ID NO: 26749 - DNA, 27 bp, Artificial Sequence
  Synthetic
gattcggaaagagguatctgaacucac

SEQ ID NO: 26750 - DNA, 21 bp, Artificial Sequence
  Synthetic
ggtgaguacagggtcctctug

SEQ ID NO: 26751 - DNA, 24 bp, Artificial Sequence
  Synthetic
ggactggaaagugacaatgtccua

SEQ ID NO: 26752 - DNA, 22 bp, Artificial Sequence
  Synthetic
gggtggtcaugatggatcucct

SEQ ID NO: 26753 - DNA, 28 bp, Artificial Sequence
  Synthetic
aagttctggaaccugaaaaacuaagagt

SEQ ID NO: 26754 - DNA, 22 bp, Artificial Sequence
  Synthetic
cttgagagcgagauggtgagug

SEQ ID NO: 26755 - DNA, 22 bp, Artificial Sequence
  Synthetic
ctcacccacaccuttcagtgua

SEQ ID NO: 26756 - DNA, 21 bp, Artificial Sequence
  Synthetic
tgtgagctucaccaacgaguc

SEQ ID NO: 26757 - DNA, 22 bp, Artificial Sequence
  Synthetic
gtcaccctccuactgggactua

SEQ ID NO: 26758 - DNA, 21 bp, Artificial Sequence
  Synthetic
attgacccugatgtgcagugt

SEQ ID NO: 26759 - DNA, 23 bp, Artificial Sequence
  Synthetic
cttcccaacaaauggctctucaa

SEQ ID NO: 26760 - DNA, 21 bp, Artificial Sequence
  Synthetic
tgacuaaccagccctagctut

SEQ ID NO: 26761 - DNA, 24 bp, Artificial Sequence
  Synthetic
cuaacatagacaaugccaaacgca

SEQ ID NO: 26762 - DNA, 29 bp, Artificial Sequence
  Synthetic
catttaagguaaaagctaacagtcugcat

SEQ ID NO: 26763 - DNA, 30 bp, Artificial Sequence
  Synthetic
gaagaaaaagaagucaaagacaaagtgugt

SEQ ID NO: 26764 - DNA, 26 bp, Artificial Sequence
  Synthetic
gttgccaccutgttaccttuaaaaga

SEQ ID NO: 26765 - DNA, 32 bp, Artificial Sequence
  Synthetic
acagactttaaagaagutgtgttttacaaugc

SEQ ID NO: 26766 - DNA, 29 bp, Artificial Sequence
  Synthetic
aattccataactucttgctaagtccugag

SEQ ID NO: 26767 - DNA, 29 bp, Artificial Sequence
  Synthetic
ttgtggacaggutttgaaagatatttgug

SEQ ID NO: 26768 - DNA, 21 bp, Artificial Sequence
  Synthetic
cctccccagucctcatguact

SEQ ID NO: 26769 - DNA, 32 bp, Artificial Sequence
  Synthetic
tttttgaagtaaaaggugcactgtaataaucc

SEQ ID NO: 26770 - DNA, 23 bp, Artificial Sequence
  Synthetic
gctgtatcgucaaggcactctug

SEQ ID NO: 26771 - DNA, 28 bp, Artificial Sequence
  Synthetic
tgagtttgtatuaaaaggtactggugga

SEQ ID NO: 26772 - DNA, 26 bp, Artificial Sequence
  Synthetic
cagccgagaauactttgtcatttucc

SEQ ID NO: 26773 - DNA, 24 bp, Artificial Sequence
  Synthetic
cttgacutgacccugggaagaaat

SEQ ID NO: 26774 - DNA, 21 bp, Artificial Sequence
  Synthetic
gtcaugaccgcacatucacaa

SEQ ID NO: 26775 - DNA, 30 bp, Artificial Sequence
  Synthetic
tgaacaacataauccaaaacagtuaccaga

SEQ ID NO: 26776 - DNA, 22 bp, Artificial Sequence
  Synthetic
catctttgugaacgggagguga

SEQ ID NO: 26777 - DNA, 23 bp, Artificial Sequence
  Synthetic
gaaagatgcugcatgttggugac

SEQ ID NO: 26778 - DNA, 27 bp, Artificial Sequence
  Synthetic
aaaagtaggaaaucaggcccaatacuc

SEQ ID NO: 26779 - DNA, 23 bp, Artificial Sequence
  Synthetic
tggattccttutgtgtgtgguca

SEQ ID NO: 26780 - DNA, 26 bp, Artificial Sequence
  Synthetic
cgactgccaaaacauccaatacttut

SEQ ID NO: 26781 - DNA, 30 bp, Artificial Sequence
  Synthetic
acacctgcaaggauatctatatgtauacga

SEQ ID NO: 26782 - DNA, 20 bp, Artificial Sequence
  Synthetic
ggcaggguacaggtagcaut

SEQ ID NO: 26783 - DNA, 29 bp, Artificial Sequence
  Synthetic
gttttcatggtaacuctgtgcttttcuag

SEQ ID NO: 26784 - DNA, 24 bp, Artificial Sequence
  Synthetic
aucaatcatttgcuccaggaaact

SEQ ID NO: 26785 - DNA, 23 bp, Artificial Sequence
  Synthetic
caacaaatuggaggtggcugaac

SEQ ID NO: 26786 - DNA, 27 bp, Artificial Sequence
  Synthetic
agtgtgcaaagucaccataauagaagt

SEQ ID NO: 26787 - DNA, 24 bp, Artificial Sequence
  Synthetic
ctgaatctgugcctgtttgtcuag

SEQ ID NO: 26788 - DNA, 20 bp, Artificial Sequence
  Synthetic
gctguggaaggagctcugat

SEQ ID NO: 26789 - DNA, 20 bp, Artificial Sequence
  Synthetic
cagcauggctctgtuagcga

SEQ ID NO: 26790 - DNA, 20 bp, Artificial Sequence
  Synthetic
aatcgctgugcgtgtaguga

SEQ ID NO: 26791 - DNA, 31 bp, Artificial Sequence
  Synthetic
gtaattagtccucagcaaagttgaaattuga

SEQ ID NO: 26792 - DNA, 19 bp, Artificial Sequence
  Synthetic
gcgggauaggaggagguga

SEQ ID NO: 26793 - DNA, 18 bp, Artificial Sequence
  Synthetic
cuccgaggccaagcugaa

SEQ ID NO: 26794 - DNA, 27 bp, Artificial Sequence
  Synthetic
gaacaccgagautttattttgcaguct

SEQ ID NO: 26795 - DNA, 20 bp, Artificial Sequence
  Synthetic
ggccgguctgcttcttguaa

SEQ ID NO: 26796 - DNA, 21 bp, Artificial Sequence
  Synthetic
cacaggcagcucttctctcug

SEQ ID NO: 26797 - DNA, 23 bp, Artificial Sequence
  Synthetic
cagaacaucacctaccacugcaa

SEQ ID NO: 26798 - DNA, 23 bp, Artificial Sequence
  Synthetic
tgcuaaaagctuccagggagaaa

SEQ ID NO: 26799 - DNA, 22 bp, Artificial Sequence
  Synthetic
gagacttgcguctaccccaauc

SEQ ID NO: 26800 - DNA, 20 bp, Artificial Sequence
  Synthetic
catctccucccttgctgcua

SEQ ID NO: 26801 - DNA, 19 bp, Artificial Sequence
  Synthetic
ggccugagacagcaugacg

SEQ ID NO: 26802 - DNA, 24 bp, Artificial Sequence
  Synthetic
ccuaaaagaggcccugagcaaaaa

SEQ ID NO: 26803 - DNA, 22 bp, Artificial Sequence
  Synthetic
tcctcacgaccuctctctctug

SEQ ID NO: 26804 - DNA, 20 bp, Artificial Sequence
  Synthetic
gctcaagugggctctgtgug

SEQ ID NO: 26805 - DNA, 24 bp, Artificial Sequence
  Synthetic
gactcaatcggugtctgtcttgut

SEQ ID NO: 26806 - DNA, 23 bp, Artificial Sequence
  Synthetic
cttaguccagagacugcggaaac

SEQ ID NO: 26807 - DNA, 23 bp, Artificial Sequence
  Synthetic
attcttcuctgagccugagacct

SEQ ID NO: 26808 - DNA, 20 bp, Artificial Sequence
  Synthetic
tgggactugtccttgcugac

SEQ ID NO: 26809 - DNA, 24 bp, Artificial Sequence
  Synthetic
cactcatcauccttgtctctgucc

SEQ ID NO: 26810 - DNA, 19 bp, Artificial Sequence
  Synthetic
gggcctggugagggactua

SEQ ID NO: 26811 - DNA, 24 bp, Artificial Sequence
  Synthetic
acttcccgcautttctccttcuag

SEQ ID NO: 26812 - DNA, 17 bp, Artificial Sequence
  Synthetic
cgccaugggagcctcug

SEQ ID NO: 26813 - DNA, 18 bp, Artificial Sequence
  Synthetic
cgucttcctugggccact

SEQ ID NO: 26814 - DNA, 22 bp, Artificial Sequence
  Synthetic
catccattuccctcccugacaa

SEQ ID NO: 26815 - DNA, 20 bp, Artificial Sequence
  Synthetic
catgcccccutctcucacag

SEQ ID NO: 26816 - DNA, 19 bp, Artificial Sequence
  Synthetic
ccgccttuggcaggagaua

SEQ ID NO: 26817 - DNA, 18 bp, Artificial Sequence
  Synthetic
cgcaccaaggutggctug

SEQ ID NO: 26818 - DNA, 22 bp, Artificial Sequence
  Synthetic
ccauaagggaauggaagcgauc

SEQ ID NO: 26819 - DNA, 24 bp, Artificial Sequence
  Synthetic
tgtccacuacagactccctctuac

SEQ ID NO: 26820 - DNA, 22 bp, Artificial Sequence
  Synthetic
cttgccucctaggcaucagaaa

SEQ ID NO: 26821 - DNA, 23 bp, Artificial Sequence
  Synthetic
ctttgggtcugccctatactgug

SEQ ID NO: 26822 - DNA, 20 bp, Artificial Sequence
  Synthetic
ggaggcugggcaggtactua

SEQ ID NO: 26823 - DNA, 20 bp, Artificial Sequence
  Synthetic
cuggaaactcugggccagaa

SEQ ID NO: 26824 - DNA, 23 bp, Artificial Sequence
  Synthetic
ccctggtuaaactctacucagga

SEQ ID NO: 26825 - DNA, 26 bp, Artificial Sequence
  Synthetic
tctgagaatggugttctgtcttucag

SEQ ID NO: 26826 - DNA, 22 bp, Artificial Sequence
  Synthetic
gcaacagcagcuctgctactua

SEQ ID NO: 26827 - DNA, 22 bp, Artificial Sequence
  Synthetic
atcgctgaggucacatggtauc

SEQ ID NO: 26828 - DNA, 21 bp, Artificial Sequence
  Synthetic
ggatggagccuccacatucac

SEQ ID NO: 26829 - DNA, 26 bp, Artificial Sequence
  Synthetic
tgaaggctcacuctgtttctctttut

SEQ ID NO: 26830 - DNA, 22 bp, Artificial Sequence
  Synthetic
gggtttgacuccagagatguca

SEQ ID NO: 26831 - DNA, 21 bp, Artificial Sequence
  Synthetic
gacuttgcuaccccaggagag

SEQ ID NO: 26832 - DNA, 24 bp, Artificial Sequence
  Synthetic
ccacaactgucagagcaaaguaca

SEQ ID NO: 26833 - DNA, 26 bp, Artificial Sequence
  Synthetic
cttcatttcatccuccctgtctctuc

SEQ ID NO: 26834 - DNA, 21 bp, Artificial Sequence
  Synthetic
tgctgtggutgcacccaauac

SEQ ID NO: 26835 - DNA, 23 bp, Artificial Sequence
  Synthetic
catggtcacutccttcttgcuca

SEQ ID NO: 26836 - DNA, 26 bp, Artificial Sequence
  Synthetic
acaacacagaauatgaacttugcaca

SEQ ID NO: 26837 - DNA, 22 bp, Artificial Sequence
  Synthetic
cttttggcgucttcccuaggag

SEQ ID NO: 26838 - DNA, 22 bp, Artificial Sequence
  Synthetic
ttcugggaaacccaagtuggaa

SEQ ID NO: 26839 - DNA, 22 bp, Artificial Sequence
  Synthetic
acaccuccactttggatugcag

SEQ ID NO: 26840 - DNA, 23 bp, Artificial Sequence
  Synthetic
cagctccucatttgtctacucgt

SEQ ID NO: 26841 - DNA, 27 bp, Artificial Sequence
  Synthetic
ggcttccaaaacuacaatgtcaaagut

SEQ ID NO: 26842 - DNA, 23 bp, Artificial Sequence
  Synthetic
aatgaggauaccaggtcaauccc

SEQ ID NO: 26843 - DNA, 27 bp, Artificial Sequence
  Synthetic
tgtagtaaaccccucattttctgtucc

SEQ ID NO: 26844 - DNA, 23 bp, Artificial Sequence
  Synthetic
caggtaagugcaagcagcaatut

SEQ ID NO: 26845 - DNA, 28 bp, Artificial Sequence
  Synthetic
attgatgccuttttctctttaugccaag

SEQ ID NO: 26846 - DNA, 25 bp, Artificial Sequence
  Synthetic
tgaagaacauggtaagaugacagca

SEQ ID NO: 26847 - DNA, 25 bp, Artificial Sequence
  Synthetic
gctctcctcuaacttaccatccugt

SEQ ID NO: 26848 - DNA, 27 bp, Artificial Sequence
  Synthetic
acagactggatuaacatagcattgcut

SEQ ID NO: 26849 - DNA, 31 bp, Artificial Sequence
  Synthetic
atgagtgtttgagugacaagaataggtatut

SEQ ID NO: 26850 - DNA, 22 bp, Artificial Sequence
  Synthetic
ctgaggcaguctttcacgtcut

SEQ ID NO: 26851 - DNA, 25 bp, Artificial Sequence
  Synthetic
actgcaacctcuctctttttctcuc

SEQ ID NO: 26852 - DNA, 17 bp, Artificial Sequence
  Synthetic
cuggcccugacaccgaa

SEQ ID NO: 26853 - DNA, 17 bp, Artificial Sequence
  Synthetic
gcttcccccucctgcuc

SEQ ID NO: 26854 - DNA, 22 bp, Artificial Sequence
  Synthetic
cttgcagcaggutcttagcuct

SEQ ID NO: 26855 - DNA, 19 bp, Artificial Sequence
  Synthetic
ggaggtctugccggaggua

SEQ ID NO: 26856 - DNA, 27 bp, Artificial Sequence
  Synthetic
ggaaaaguttggatcuagaaacagcag

SEQ ID NO: 26857 - DNA, 27 bp, Artificial Sequence
  Synthetic
tgggagctgtuaacccttaattcaaut

SEQ ID NO: 26858 - DNA, 20 bp, Artificial Sequence
  Synthetic
gtaaguggcgatcuccacgt

SEQ ID NO: 26859 - DNA, 23 bp, Artificial Sequence
  Synthetic
accccactcucctcctttctauc

SEQ ID NO: 26860 - DNA, 23 bp, Artificial Sequence
  Synthetic
cctcacucaggagacagtcauca

SEQ ID NO: 26861 - DNA, 23 bp, Artificial Sequence
  Synthetic
aaccagaugaccgactccaaauc

SEQ ID NO: 26862 - DNA, 21 bp, Artificial Sequence
  Synthetic
gatgautggcacugcacacac

SEQ ID NO: 26863 - DNA, 23 bp, Artificial Sequence
  Synthetic
ctgacaaacacutcccatcccut

SEQ ID NO: 26864 - DNA, 21 bp, Artificial Sequence
  Synthetic
ctgcctccugaggttgtugat

SEQ ID NO: 26865 - DNA, 23 bp, Artificial Sequence
  Synthetic
cttuagagggauggaaagaggug

SEQ ID NO: 26866 - DNA, 22 bp, Artificial Sequence
  Synthetic
tcaggagacuctggtugacagt

SEQ ID NO: 26867 - DNA, 20 bp, Artificial Sequence
  Synthetic
gcactagtgguggcagctuc

SEQ ID NO: 26868 - DNA, 21 bp, Artificial Sequence
  Synthetic
cauagccacccacuccacaag

SEQ ID NO: 26869 - DNA, 21 bp, Artificial Sequence
  Synthetic
cucttgcuccaccaggaacaa

SEQ ID NO: 26870 - DNA, 28 bp, Artificial Sequence
  Synthetic
ccatggauaaataaacacuaggaacgca

SEQ ID NO: 26871 - DNA, 21 bp, Artificial Sequence
  Synthetic
cucaccaugcaagaagacuca

SEQ ID NO: 26872 - DNA, 26 bp, Artificial Sequence
  Synthetic
caaggacaaggccautaagaaatucg

SEQ ID NO: 26873 - DNA, 23 bp, Artificial Sequence
  Synthetic
ccugagaggcuccaaagaacaga

SEQ ID NO: 26874 - DNA, 27 bp, Artificial Sequence
  Synthetic
tgaagctacatuactgtgtgagttgug

SEQ ID NO: 26875 - DNA, 26 bp, Artificial Sequence
  Synthetic
accctccaggaugaaatttuaaccat

SEQ ID NO: 26876 - DNA, 24 bp, Artificial Sequence
  Synthetic
gctcaacacacaagutttcagugg

SEQ ID NO: 26877 - DNA, 28 bp, Artificial Sequence
  Synthetic
agctagtcccaaucgaatcagagtauag

SEQ ID NO: 26878 - DNA, 33 bp, Artificial Sequence
  Synthetic
gtgtatcattttcuaaaacattcagatgcuagt

SEQ ID NO: 26879 - DNA, 27 bp, Artificial Sequence
  Synthetic
agggcttaucgagacaaattgaagtut

SEQ ID NO: 26880 - DNA, 25 bp, Artificial Sequence
  Synthetic
ggaacatggautcatagaaguccct

SEQ ID NO: 26881 - DNA, 27 bp, Artificial Sequence
  Synthetic
ggaatccacauccttgttttgtuaggt

SEQ ID NO: 26882 - DNA, 26 bp, Artificial Sequence
  Synthetic
aaaagccagaccuttgtgattacuct

SEQ ID NO: 26883 - DNA, 29 bp, Artificial Sequence
  Synthetic
tcagctctgatgugatatctgatctacut

SEQ ID NO: 26884 - DNA, 23 bp, Artificial Sequence
  Synthetic
actgcgccugaccagaatuaaat

SEQ ID NO: 26885 - DNA, 29 bp, Artificial Sequence
  Synthetic
cagccactgaauatatctcaagtcttuga

SEQ ID NO: 26886 - DNA, 28 bp, Artificial Sequence
  Synthetic
gcacatttcaaguagccttagttcugaa

SEQ ID NO: 26887 - DNA, 27 bp, Artificial Sequence
  Synthetic
acatttgcagatuccctcagatatgua

SEQ ID NO: 26888 - DNA, 23 bp, Artificial Sequence
  Synthetic
gcatgagaaagaaugaggcugga

SEQ ID NO: 26889 - DNA, 27 bp, Artificial Sequence
  Synthetic
cuggaaagccagaugacaaaagaaaag

SEQ ID NO: 26890 - DNA, 27 bp, Artificial Sequence
  Synthetic
catgaccattcacutttacactcacug

SEQ ID NO: 26891 - DNA, 23 bp, Artificial Sequence
  Synthetic
aagtcagcctugctgagatcaut

SEQ ID NO: 26892 - DNA, 23 bp, Artificial Sequence
  Synthetic
ctgggctcuccttgttgagtuaa

SEQ ID NO: 26893 - DNA, 29 bp, Artificial Sequence
  Synthetic
ctcacgttucaaaatacaaacgaugaaga

SEQ ID NO: 26894 - DNA, 28 bp, Artificial Sequence
  Synthetic
gttggcaauagaagcatgtcgaattaut

SEQ ID NO: 26895 - DNA, 26 bp, Artificial Sequence
  Synthetic
gaaaacagaggaaaaaugcccagtua

SEQ ID NO: 26896 - DNA, 24 bp, Artificial Sequence
  Synthetic
caggaattcgcacauccctgatua

SEQ ID NO: 26897 - DNA, 28 bp, Artificial Sequence
  Synthetic
gtaattacagcaagaauccctcttctuc

SEQ ID NO: 26898 - DNA, 25 bp, Artificial Sequence
  Synthetic
atcccaaucgcaggctgaattatua

SEQ ID NO: 26899 - DNA, 31 bp, Artificial Sequence
  Synthetic
acucaagaataaaatgtaucagaagccagaa

SEQ ID NO: 26900 - DNA, 26 bp, Artificial Sequence
  Synthetic
atccttcccaaacaugacatcaucat

SEQ ID NO: 26901 - DNA, 27 bp, Artificial Sequence
  Synthetic
caaacagctcucattcactctctttut

SEQ ID NO: 26902 - DNA, 26 bp, Artificial Sequence
  Synthetic
ggtgacaaugaaaatatuccgaaccc

SEQ ID NO: 26903 - DNA, 27 bp, Artificial Sequence
  Synthetic
ggauaaagaggaggagguatgactuaa

SEQ ID NO: 26904 - DNA, 22 bp, Artificial Sequence
  Synthetic
gagaatgugccaggctaatugc

SEQ ID NO: 26905 - DNA, 24 bp, Artificial Sequence
  Synthetic
ccagcctcaugatgtggaaaauga

SEQ ID NO: 26906 - DNA, 30 bp, Artificial Sequence
  Synthetic
ccactcagaatuttgttattcaaacaucca

SEQ ID NO: 26907 - DNA, 28 bp, Artificial Sequence
  Synthetic
cctgccatcuctttatccttctttucat

SEQ ID NO: 26908 - DNA, 23 bp, Artificial Sequence
  Synthetic
aaacacaaaaucctgtguaccca

SEQ ID NO: 26909 - DNA, 28 bp, Artificial Sequence
  Synthetic
gggaggtataguagcccatatgtatgua

SEQ ID NO: 26910 - DNA, 26 bp, Artificial Sequence
  Synthetic
taactcagaaagaucccutaaacugt

SEQ ID NO: 26911 - DNA, 26 bp, Artificial Sequence
  Synthetic
agtctttgaugcgaagaaaacgttuc

SEQ ID NO: 26912 - DNA, 23 bp, Artificial Sequence
  Synthetic
caggcagguataggtctgtcuct

SEQ ID NO: 26913 - DNA, 17 bp, Artificial Sequence
  Synthetic
cgccggagcugcaauga

SEQ ID NO: 26914 - DNA, 22 bp, Artificial Sequence
  Synthetic
cacagcugacagaccacatuct

SEQ ID NO: 26915 - DNA, 23 bp, Artificial Sequence
  Synthetic
ccaagaagcccacutatccccua

SEQ ID NO: 26916 - DNA, 21 bp, Artificial Sequence
  Synthetic
agagctaguggctcaccttug

SEQ ID NO: 26917 - DNA, 28 bp, Artificial Sequence
  Synthetic
gggaatactgaucctgatttaacaguga

SEQ ID NO: 26918 - DNA, 26 bp, Artificial Sequence
  Synthetic
ggagtaggaaaguttcaaagaccuga

SEQ ID NO: 26919 - DNA, 28 bp, Artificial Sequence
  Synthetic
ccaatuacaggaauagaacaggttcuat

SEQ ID NO: 26920 - DNA, 22 bp, Artificial Sequence
  Synthetic
ggaaaagauggcgctcattgug

SEQ ID NO: 26921 - DNA, 29 bp, Artificial Sequence
  Synthetic
gtgatgagcttugagttttctttcttcut

SEQ ID NO: 26922 - DNA, 27 bp, Artificial Sequence
  Synthetic
gttatcttcauggaagccacagtacut

SEQ ID NO: 26923 - DNA, 28 bp, Artificial Sequence
  Synthetic
agacacctatttugtgcctgtattcuag

SEQ ID NO: 26924 - DNA, 25 bp, Artificial Sequence
  Synthetic
agtgaacaaguacattgcuccaagt

SEQ ID NO: 26925 - DNA, 22 bp, Artificial Sequence
  Synthetic
gtactcaggacgutgccttcuc

SEQ ID NO: 26926 - DNA, 26 bp, Artificial Sequence
  Synthetic
aagatcttgaugatgtttgucagagc

SEQ ID NO: 26927 - DNA, 24 bp, Artificial Sequence
  Synthetic
ttcctgttcuggttctgcatctut

SEQ ID NO: 26928 - DNA, 21 bp, Artificial Sequence
  Synthetic
ccagcagtcutcggatctcut

SEQ ID NO: 26929 - DNA, 24 bp, Artificial Sequence
  Synthetic
ctaaaaagucagagaccucacucc

SEQ ID NO: 26930 - DNA, 20 bp, Artificial Sequence
  Synthetic
cagggucagggacagaaucc

SEQ ID NO: 26931 - DNA, 20 bp, Artificial Sequence
  Synthetic
ccgagtcugagggactcuga

SEQ ID NO: 26932 - DNA, 21 bp, Artificial Sequence
  Synthetic
gctgctacutcccacagauga

SEQ ID NO: 26933 - DNA, 22 bp, Artificial Sequence
  Synthetic
tgttgagccccauaatgucacg

SEQ ID NO: 26934 - DNA, 22 bp, Artificial Sequence
  Synthetic
cccatgtgugtctgtcacugaa

SEQ ID NO: 26935 - DNA, 20 bp, Artificial Sequence
  Synthetic
cctcatggcagutccctcug

SEQ ID NO: 26936 - DNA, 22 bp, Artificial Sequence
  Synthetic
gccccaggugacacaaagagua

SEQ ID NO: 26937 - DNA, 30 bp, Artificial Sequence
  Synthetic
acaggcaaattcuttttcctttttctucat

SEQ ID NO: 26938 - DNA, 24 bp, Artificial Sequence
  Synthetic
aagtggcugcaaagaattuggaag

SEQ ID NO: 26939 - DNA, 28 bp, Artificial Sequence
  Synthetic
cccactcaccagauactgatgtttatut

SEQ ID NO: 26940 - DNA, 18 bp, Artificial Sequence
  Synthetic
cgtctuccacgcccugag

SEQ ID NO: 26941 - DNA, 17 bp, Artificial Sequence
  Synthetic
gccagcugtggguggag

SEQ ID NO: 26942 - DNA, 24 bp, Artificial Sequence
  Synthetic
gguagaagcaguagaagggaggag

SEQ ID NO: 26943 - DNA, 23 bp, Artificial Sequence
  Synthetic
agcuagcacgaggatagttuaca

SEQ ID NO: 26944 - DNA, 22 bp, Artificial Sequence
  Synthetic
aatgggctguagtgcacttuga

SEQ ID NO: 26945 - DNA, 23 bp, Artificial Sequence
  Synthetic
cccagugaaaggaacacagtuga

SEQ ID NO: 26946 - DNA, 25 bp, Artificial Sequence
  Synthetic
ggatggatcguaaagacagtctgut

SEQ ID NO: 26947 - DNA, 23 bp, Artificial Sequence
  Synthetic
aattctttccugtcgcttugcag

SEQ ID NO: 26948 - DNA, 30 bp, Artificial Sequence
  Synthetic
acaaggaaaatatugttcaacaagtcuact

SEQ ID NO: 26949 - DNA, 27 bp, Artificial Sequence
  Synthetic
gaaaatgcacaccucaaaaggctaaut

SEQ ID NO: 26950 - DNA, 22 bp, Artificial Sequence
  Synthetic
agagttaggccutaccagccut

SEQ ID NO: 26951 - DNA, 22 bp, Artificial Sequence
  Synthetic
cagcatcaucagagtgccauga

SEQ ID NO: 26952 - DNA, 24 bp, Artificial Sequence
  Synthetic
gttactcaatucatgcagcaugca

SEQ ID NO: 26953 - DNA, 23 bp, Artificial Sequence
  Synthetic
ttctcatgccuagctctcuagca

SEQ ID NO: 26954 - DNA, 26 bp, Artificial Sequence
  Synthetic
actaaaacaaaautcagauggcaggt

SEQ ID NO: 26955 - DNA, 28 bp, Artificial Sequence
  Synthetic
gtccatgtagattucactggcctttaua

SEQ ID NO: 26956 - DNA, 21 bp, Artificial Sequence
  Synthetic
gctggaaguctgaacccctug

SEQ ID NO: 26957 - DNA, 28 bp, Artificial Sequence
  Synthetic
gatcaaagacaaaautgaaccaagugct

SEQ ID NO: 26958 - DNA, 28 bp, Artificial Sequence
  Synthetic
atgtttctgactguatacataacgcaut

SEQ ID NO: 26959 - DNA, 33 bp, Artificial Sequence
  Synthetic
taaacctgtgtctuaacagttcttaatttuaca

SEQ ID NO: 26960 - DNA, 29 bp, Artificial Sequence
  Synthetic
cctctaacatucaatttcacagcugagat

SEQ ID NO: 26961 - DNA, 25 bp, Artificial Sequence
  Synthetic
gcttctccccaagcuggtattatuc

SEQ ID NO: 26962 - DNA, 22 bp, Artificial Sequence
  Synthetic
agagttgtagcucagccctcut

SEQ ID NO: 26963 - DNA, 24 bp, Artificial Sequence
  Synthetic
gaaatcacagaguttctgcuggga

SEQ ID NO: 26964 - DNA, 29 bp, Artificial Sequence
  Synthetic
gacaaacaaaaacaugaacaaattguggt

SEQ ID NO: 26965 - DNA, 21 bp, Artificial Sequence
  Synthetic
ctaccagucaggtcccaacuc

SEQ ID NO: 26966 - DNA, 25 bp, Artificial Sequence
  Synthetic
acaagtctggucaaaatactugcct

SEQ ID NO: 26967 - DNA, 28 bp, Artificial Sequence
  Synthetic
ctcctggacaaagaaauagagaagucat

SEQ ID NO: 26968 - DNA, 24 bp, Artificial Sequence
  Synthetic
acacagaccutgagttgtgtaucc

SEQ ID NO: 26969 - DNA, 22 bp, Artificial Sequence
  Synthetic
tcaagtgcccaguacaaagcuc

SEQ ID NO: 26970 - DNA, 28 bp, Artificial Sequence
  Synthetic
aagctgatgaaaaucaaagacaaaugca

SEQ ID NO: 26971 - DNA, 28 bp, Artificial Sequence
  Synthetic
tgaaugaaagggaauaactacttugaca

SEQ ID NO: 26972 - DNA, 29 bp, Artificial Sequence
  Synthetic
gtaagatcactgugaaaatctttgctuga

SEQ ID NO: 26973 - DNA, 28 bp, Artificial Sequence
  Synthetic
ccgaaacgugaagaaataatggagagua

SEQ ID NO: 26974 - DNA, 30 bp, Artificial Sequence
  Synthetic
agtggctttaaaaacuaggtaaaacacuga

SEQ ID NO: 26975 - DNA, 26 bp, Artificial Sequence
  Synthetic
gtgaccggguagtatactgtttctut

SEQ ID NO: 26976 - DNA, 24 bp, Artificial Sequence
  Synthetic
ggcatttgguctgtggtuagagat

SEQ ID NO: 26977 - DNA, 32 bp, Artificial Sequence
  Synthetic
ggaaatatttttcagcutatttagcctgtuga

SEQ ID NO: 26978 - DNA, 17 bp, Artificial Sequence
  Synthetic
ccauacaccggcucgca

SEQ ID NO: 26979 - DNA, 17 bp, Artificial Sequence
  Synthetic
ggcggcuccttggtcuc

SEQ ID NO: 26980 - DNA, 17 bp, Artificial Sequence
  Synthetic
gggcagcugcacaguct

SEQ ID NO: 26981 - DNA, 17 bp, Artificial Sequence
  Synthetic
cucctcaccuccgcgat

SEQ ID NO: 26982 - DNA, 25 bp, Artificial Sequence
  Synthetic
tcaacacutaggtaaaauccgacgt

SEQ ID NO: 26983 - DNA, 25 bp, Artificial Sequence
  Synthetic
ctcccctccauacaggtcataguaa

SEQ ID NO: 26984 - DNA, 25 bp, Artificial Sequence
  Synthetic
aattgtgttuaggagagctgacugt

SEQ ID NO: 26985 - DNA, 31 bp, Artificial Sequence
  Synthetic
aagaaaactaccaugttttcctttttcagut

SEQ ID NO: 26986 - DNA, 23 bp, Artificial Sequence
  Synthetic
gcagtgaacaugagagtgctuga

SEQ ID NO: 26987 - DNA, 25 bp, Artificial Sequence
  Synthetic
ggagaaagctugagctttccaauct

SEQ ID NO: 26988 - DNA, 28 bp, Artificial Sequence
  Synthetic
ttccttaaagaaguaatgctgauccagg

SEQ ID NO: 26989 - DNA, 26 bp, Artificial Sequence
  Synthetic
caagagugactattacugagcggaat

SEQ ID NO: 26990 - DNA, 30 bp, Artificial Sequence
  Synthetic
ctgaccatacattuctagcctatttttgua

SEQ ID NO: 26991 - DNA, 23 bp, Artificial Sequence
  Synthetic
tcacucgggagttttctuggaac

SEQ ID NO: 26992 - DNA, 28 bp, Artificial Sequence
  Synthetic
tttaggctttuatttcagagtucacaga

SEQ ID NO: 26993 - DNA, 27 bp, Artificial Sequence
  Synthetic
cagttcccaaaguctctagaauacgac

SEQ ID NO: 26994 - DNA, 21 bp, Artificial Sequence
  Synthetic
ggcaauaccacttucggacct

SEQ ID NO: 26995 - DNA, 26 bp, Artificial Sequence
  Synthetic
gttaaagagcuaggagtgggtaggua

SEQ ID NO: 26996 - DNA, 31 bp, Artificial Sequence
  Synthetic
gcagtttctcttuattcttcatgatgttucc

SEQ ID NO: 26997 - DNA, 22 bp, Artificial Sequence
  Synthetic
agagaatgagaauccgcaugcc

SEQ ID NO: 26998 - DNA, 24 bp, Artificial Sequence
  Synthetic
tcatgtaagcutaaacagcguggt

SEQ ID NO: 26999 - DNA, 30 bp, Artificial Sequence
  Synthetic
aaacaattaaccaauagagcacttgcatut

SEQ ID NO: 27000 - DNA, 22 bp, Artificial Sequence
  Synthetic
tgtgaagcaggccucacttuag

SEQ ID NO: 27001 - DNA, 21 bp, Artificial Sequence
  Synthetic
ctgggagagggaaugtuccag

SEQ ID NO: 27002 - DNA, 20 bp, Artificial Sequence
  Synthetic
cagcugctguaggaaggcat

SEQ ID NO: 27003 - DNA, 25 bp, Artificial Sequence
  Synthetic
catccctauaagaagccctacaugg

SEQ ID NO: 27004 - DNA, 23 bp, Artificial Sequence
  Synthetic
aatgaatactccucacccccuca

SEQ ID NO: 27005 - DNA, 23 bp, Artificial Sequence
  Synthetic
accagtgugagaatggtgttucc

SEQ ID NO: 27006 - DNA, 23 bp, Artificial Sequence
  Synthetic
tgctggctuacctgggtaattug

SEQ ID NO: 27007 - DNA, 27 bp, Artificial Sequence
  Synthetic
cttgttctctcutcctctttcctucag

SEQ ID NO: 27008 - DNA, 22 bp, Artificial Sequence
  Synthetic
cgtgagugcagaacgctgtaut

SEQ ID NO: 27009 - DNA, 25 bp, Artificial Sequence
  Synthetic
gcagggutttatcuggagacaaagg

SEQ ID NO: 27010 - DNA, 30 bp, Artificial Sequence
  Synthetic
ctgatacaacutttcaacttttugggagaa

SEQ ID NO: 27011 - DNA, 21 bp, Artificial Sequence
  Synthetic
ccctccguccctctctctuag

SEQ ID NO: 27012 - DNA, 19 bp, Artificial Sequence
  Synthetic
gaagcgcgagguctcctua

SEQ ID NO: 27013 - DNA, 20 bp, Artificial Sequence
  Synthetic
cccctgcutcttgtccucag

SEQ ID NO: 27014 - DNA, 19 bp, Artificial Sequence
  Synthetic
gcagagcuccattguggca

SEQ ID NO: 27015 - DNA, 32 bp, Artificial Sequence
  Synthetic
tgctaattagatatugttctgggaagucaaaa

SEQ ID NO: 27016 - DNA, 22 bp, Artificial Sequence
  Synthetic
ctgtgaagacagucttcuccgt

SEQ ID NO: 27017 - DNA, 24 bp, Artificial Sequence
  Synthetic
gaggagaucaaaacccagaagguc

SEQ ID NO: 27018 - DNA, 20 bp, Artificial Sequence
  Synthetic
cguggacacgaagaucagct

SEQ ID NO: 27019 - DNA, 22 bp, Artificial Sequence
  Synthetic
agcattggaaagauctggcuca

SEQ ID NO: 27020 - DNA, 17 bp, Artificial Sequence
  Synthetic
gctccuaggcgggucct

SEQ ID NO: 27021 - DNA, 19 bp, Artificial Sequence
  Synthetic
cccagucuccgagggaaga

SEQ ID NO: 27022 - DNA, 26 bp, Artificial Sequence
  Synthetic
gacgcagcuacattttacctugaaat

SEQ ID NO: 27023 - DNA, 21 bp, Artificial Sequence
  Synthetic
gctgcttaacguggcagagut

SEQ ID NO: 27024 - DNA, 24 bp, Artificial Sequence
  Synthetic
ggtgguacccattguaaaggaagt

SEQ ID NO: 27025 - DNA, 22 bp, Artificial Sequence
  Synthetic
ccatgcatguggcctacuacag

SEQ ID NO: 27026 - DNA, 21 bp, Artificial Sequence
  Synthetic
cgaagtccucttgctcgucac

SEQ ID NO: 27027 - DNA, 22 bp, Artificial Sequence
  Synthetic
tcccaaggccucttccacuaat

SEQ ID NO: 27028 - DNA, 23 bp, Artificial Sequence
  Synthetic
gcatgaagagggcguacaagtua

SEQ ID NO: 27029 - DNA, 30 bp, Artificial Sequence
  Synthetic
cttatgtcttctcutctgaattctgagugt

SEQ ID NO: 27030 - DNA, 26 bp, Artificial Sequence
  Synthetic
tacacgttucagaagacatccuaaag

SEQ ID NO: 27031 - DNA, 23 bp, Artificial Sequence
  Synthetic
tccatccucaggcgtagaagtua

SEQ ID NO: 27032 - DNA, 21 bp, Artificial Sequence
  Synthetic
aggaugaaccgggaggaatug

SEQ ID NO: 27033 - DNA, 21 bp, Artificial Sequence
  Synthetic
agcaaggcuccgtcucaaaaa

SEQ ID NO: 27034 - DNA, 19 bp, Artificial Sequence
  Synthetic
cagaugcaccgacugcaag

SEQ ID NO: 27035 - DNA, 22 bp, Artificial Sequence
  Synthetic
ttcccagtgucttagccctgua

SEQ ID NO: 27036 - DNA, 30 bp, Artificial Sequence
  Synthetic
gtaccaaggttacugattcacttaattuct

SEQ ID NO: 27037 - DNA, 22 bp, Artificial Sequence
  Synthetic
gcatgcauagaccaatgggtut

SEQ ID NO: 27038 - DNA, 25 bp, Artificial Sequence
  Synthetic
gagacaagagggagguattctuact

SEQ ID NO: 27039 - DNA, 21 bp, Artificial Sequence
  Synthetic
cagctgaugatggcaacucac

SEQ ID NO: 27040 - DNA, 17 bp, Artificial Sequence
  Synthetic
ccctcccugccauggac

SEQ ID NO: 27041 - DNA, 21 bp, Artificial Sequence
  Synthetic
gggacccaaaugtggtacuca

SEQ ID NO: 27042 - DNA, 30 bp, Artificial Sequence
  Synthetic
aaccttagtgggaagautaaattcacacut

SEQ ID NO: 27043 - DNA, 24 bp, Artificial Sequence
  Synthetic
tgcatttuggaggagctctactuc

SEQ ID NO: 27044 - DNA, 30 bp, Artificial Sequence
  Synthetic
tcatatttatacucccttttaccaaugcgt

SEQ ID NO: 27045 - DNA, 23 bp, Artificial Sequence
  Synthetic
ccccttccugtaccatcttucct

SEQ ID NO: 27046 - DNA, 22 bp, Artificial Sequence
  Synthetic
tccacccucctctacccuaaga

SEQ ID NO: 27047 - DNA, 24 bp, Artificial Sequence
  Synthetic
ctggtggaugtgcagtucaaaaag

SEQ ID NO: 27048 - DNA, 23 bp, Artificial Sequence
  Synthetic
acctcccaguatgtgauggagac

SEQ ID NO: 27049 - DNA, 24 bp, Artificial Sequence
  Synthetic
gaaattctgcautggtgctuagga

SEQ ID NO: 27050 - DNA, 24 bp, Artificial Sequence
  Synthetic
cccttttccucaatccaugaccaa

SEQ ID NO: 27051 - DNA, 25 bp, Artificial Sequence
  Synthetic
gaatcgagccuggtctctaaaguag

SEQ ID NO: 27052 - DNA, 25 bp, Artificial Sequence
  Synthetic
gggaaggaaguagataaggtgcuga

SEQ ID NO: 27053 - DNA, 22 bp, Artificial Sequence
  Synthetic
ctggttucaggaagctcucagg

SEQ ID NO: 27054 - DNA, 28 bp, Artificial Sequence
  Synthetic
gagagaaatgaaguctaacactagtucc

SEQ ID NO: 27055 - DNA, 26 bp, Artificial Sequence
  Synthetic
ccccaugaggaggttttctctuagat

SEQ ID NO: 27056 - DNA, 30 bp, Artificial Sequence
  Synthetic
agcuaatattuaaaaagaagguaggaagga

SEQ ID NO: 27057 - DNA, 26 bp, Artificial Sequence
  Synthetic
cctcttccucgtgctgattttuaaag

SEQ ID NO: 27058 - DNA, 21 bp, Artificial Sequence
  Synthetic
gtgaccagacaguggatugga

SEQ ID NO: 27059 - DNA, 29 bp, Artificial Sequence
  Synthetic
cgtatgcaatgatuactccagtgtactua

SEQ ID NO: 27060 - DNA, 22 bp, Artificial Sequence
  Synthetic
cttcuacccagaggcagaagug

SEQ ID NO: 27061 - DNA, 23 bp, Artificial Sequence
  Synthetic
atcagacttccucaccccaguaa

SEQ ID NO: 27062 - DNA, 28 bp, Artificial Sequence
  Synthetic
aagcattaagaguatcaacagtgcugaa

SEQ ID NO: 27063 - DNA, 23 bp, Artificial Sequence
  Synthetic
tgactcacugtctagctctugct

SEQ ID NO: 27064 - DNA, 24 bp, Artificial Sequence
  Synthetic
gctgctgtccuccatgctattuac

SEQ ID NO: 27065 - DNA, 30 bp, Artificial Sequence
  Synthetic
tcattagatugagagacactagacaucaca

SEQ ID NO: 27066 - DNA, 17 bp, Artificial Sequence
  Synthetic
agtcugagcggcgaugg

SEQ ID NO: 27067 - DNA, 17 bp, Artificial Sequence
  Synthetic
cuccagcagcagcucct

SEQ ID NO: 27068 - DNA, 22 bp, Artificial Sequence
  Synthetic
tggtgguggaagtgcaacauat

SEQ ID NO: 27069 - DNA, 31 bp, Artificial Sequence
  Synthetic
cggagatgttccuttcaggactattaaauaa

SEQ ID NO: 27070 - DNA, 22 bp, Artificial Sequence
  Synthetic
gctcactttcauggctgtggut

SEQ ID NO: 27071 - DNA, 27 bp, Artificial Sequence
  Synthetic
tgttaacaccaaauaacttactgcuca

SEQ ID NO: 27072 - DNA, 25 bp, Artificial Sequence
  Synthetic
gtgtataaactcuccaggttgccut

SEQ ID NO: 27073 - DNA, 21 bp, Artificial Sequence
  Synthetic
ggagcagcccauctatccuga

SEQ ID NO: 27074 - DNA, 25 bp, Artificial Sequence
  Synthetic
cgacatcatgguattccccttacua

SEQ ID NO: 27075 - DNA, 18 bp, Artificial Sequence
  Synthetic
tgggcctucccctacucc

SEQ ID NO: 27076 - DNA, 24 bp, Artificial Sequence
  Synthetic
aatgtggaagugactagugaagcc

SEQ ID NO: 27077 - DNA, 23 bp, Artificial Sequence
  Synthetic
catagcccauctccagctcatuc

SEQ ID NO: 27078 - DNA, 24 bp, Artificial Sequence
  Synthetic
ggccagagaagaaacutccacauc

SEQ ID NO: 27079 - DNA, 18 bp, Artificial Sequence
  Synthetic
cgagcagaucgcccucaa

SEQ ID NO: 27080 - DNA, 23 bp, Artificial Sequence
  Synthetic
aaggccttguttctgtcttuagg

SEQ ID NO: 27081 - DNA, 30 bp, Artificial Sequence
  Synthetic
atatttgatcattttuctctctccatguct

SEQ ID NO: 27082 - DNA, 21 bp, Artificial Sequence
  Synthetic
gctggtcucaatcagctccug

SEQ ID NO: 27083 - DNA, 21 bp, Artificial Sequence
  Synthetic
ctcacacccacuctcctgaug

SEQ ID NO: 27084 - DNA, 19 bp, Artificial Sequence
  Synthetic
gtguctctgcauccaggga

SEQ ID NO: 27085 - DNA, 18 bp, Artificial Sequence
  Synthetic
ctctcaacccugcccugt

SEQ ID NO: 27086 - DNA, 21 bp, Artificial Sequence
  Synthetic
actcatctcuggcctctugga

SEQ ID NO: 27087 - DNA, 20 bp, Artificial Sequence
  Synthetic
ggctgaagagugagcctugt

SEQ ID NO: 27088 - DNA, 22 bp, Artificial Sequence
  Synthetic
ctctacguccaccatcaagucc

SEQ ID NO: 27089 - DNA, 22 bp, Artificial Sequence
  Synthetic
cagtgtugcccagtagagucac

SEQ ID NO: 27090 - DNA, 21 bp, Artificial Sequence
  Synthetic
tgtctcctccucgtactgcuc

SEQ ID NO: 27091 - DNA, 22 bp, Artificial Sequence
  Synthetic
gctgggctuggttgaagtacua

SEQ ID NO: 27092 - DNA, 23 bp, Artificial Sequence
  Synthetic
ggccattucacaagtcatgucct

SEQ ID NO: 27093 - DNA, 22 bp, Artificial Sequence
  Synthetic
ccttcctgucttgcttccugaa

SEQ ID NO: 27094 - DNA, 17 bp, Artificial Sequence
  Synthetic
cguggcctccuccaggt

SEQ ID NO: 27095 - DNA, 20 bp, Artificial Sequence
  Synthetic
cuttgtgtcugacccaggca

SEQ ID NO: 27096 - DNA, 22 bp, Artificial Sequence
  Synthetic
gcctcagtuacctcagggcuat

SEQ ID NO: 27097 - DNA, 22 bp, Artificial Sequence
  Synthetic
gaaggaaggcuacctgtcacuc

SEQ ID NO: 27098 - DNA, 23 bp, Artificial Sequence
  Synthetic
cattggtgtugcctgcaaaauct

SEQ ID NO: 27099 - DNA, 21 bp, Artificial Sequence
  Synthetic
caucgctaagcugaccaagga

SEQ ID NO: 27100 - DNA, 23 bp, Artificial Sequence
  Synthetic
aggaccaggauaacacuctaguc

SEQ ID NO: 27101 - DNA, 23 bp, Artificial Sequence
  Synthetic
tggaggaugaggaggagaugaac

SEQ ID NO: 27102 - DNA, 21 bp, Artificial Sequence
  Synthetic
cctggttgugagatgggcuat

SEQ ID NO: 27103 - DNA, 22 bp, Artificial Sequence
  Synthetic
ccaccaugaaggaagagtucgg

SEQ ID NO: 27104 - DNA, 20 bp, Artificial Sequence
  Synthetic
ttgacatugcggatcugcct

SEQ ID NO: 27105 - DNA, 21 bp, Artificial Sequence
  Synthetic
gcctgttgcauctacccctug

SEQ ID NO: 27106 - DNA, 22 bp, Artificial Sequence
  Synthetic
ctcccccugttctatgagcuct

SEQ ID NO: 27107 - DNA, 23 bp, Artificial Sequence
  Synthetic
actttacccuaaggctgacccut

SEQ ID NO: 27108 - DNA, 24 bp, Artificial Sequence
  Synthetic
tttcctcaucaaactcaagcauca

SEQ ID NO: 27109 - DNA, 29 bp, Artificial Sequence
  Synthetic
tgttgattatttcucctctcgctgttuag

SEQ ID NO: 27110 - DNA, 22 bp, Artificial Sequence
  Synthetic
ccaggaugttgtaguccacagt

SEQ ID NO: 27111 - DNA, 24 bp, Artificial Sequence
  Synthetic
tgattctctcuttgcctctucacc

SEQ ID NO: 27112 - DNA, 23 bp, Artificial Sequence
  Synthetic
ctcagcaaauggctgttgaaugt

SEQ ID NO: 27113 - DNA, 22 bp, Artificial Sequence
  Synthetic
gcagcaggugtactactccauc

SEQ ID NO: 27114 - DNA, 18 bp, Artificial Sequence
  Synthetic
gtcagcaccucaggccut

SEQ ID NO: 27115 - DNA, 22 bp, Artificial Sequence
  Synthetic
ctctttgtcuctcgctctgucc

SEQ ID NO: 27116 - DNA, 18 bp, Artificial Sequence
  Synthetic
tgcaugcaggagtcgtug

SEQ ID NO: 27117 - DNA, 25 bp, Artificial Sequence
  Synthetic
ctctactcuctttccttccucacct

SEQ ID NO: 27118 - DNA, 26 bp, Artificial Sequence
  Synthetic
aagccagauacagtacaatcaacugg

SEQ ID NO: 27119 - DNA, 24 bp, Artificial Sequence
  Synthetic
catgcagttcugctcctttcauag

SEQ ID NO: 27120 - DNA, 20 bp, Artificial Sequence
  Synthetic
tgcaaucccagcctuaaacc

SEQ ID NO: 27121 - DNA, 19 bp, Artificial Sequence
  Synthetic
cagatccucagcccugacc

SEQ ID NO: 27122 - DNA, 21 bp, Artificial Sequence
  Synthetic
cctggctuatttaggccucca

SEQ ID NO: 27123 - DNA, 18 bp, Artificial Sequence
  Synthetic
cttaugcgcccccuccag

SEQ ID NO: 27124 - DNA, 24 bp, Artificial Sequence
  Synthetic
tggcttugacaaactcttcctugt

SEQ ID NO: 27125 - DNA, 22 bp, Artificial Sequence
  Synthetic
gggctcccucaggagtaacaua

SEQ ID NO: 27126 - DNA, 20 bp, Artificial Sequence
  Synthetic
agggtgcuctgtctggguat

SEQ ID NO: 27127 - DNA, 19 bp, Artificial Sequence
  Synthetic
tcaccucatgcucccacct

SEQ ID NO: 27128 - DNA, 22 bp, Artificial Sequence
  Synthetic
cattctccucagctggttguca

SEQ ID NO: 27129 - DNA, 19 bp, Artificial Sequence
  Synthetic
cgagcagaucgcccucaag

SEQ ID NO: 27130 - DNA, 21 bp, Artificial Sequence
  Synthetic
cggagagacacuggtcuggat

SEQ ID NO: 27131 - DNA, 23 bp, Artificial Sequence
  Synthetic
gatgctcaaugcttttcctgcuc

SEQ ID NO: 27132 - DNA, 22 bp, Artificial Sequence
  Synthetic
acccgcucactagtctcaauca

SEQ ID NO: 27133 - DNA, 21 bp, Artificial Sequence
  Synthetic
ctcatgcccacuctcctgauc

SEQ ID NO: 27134 - DNA, 18 bp, Artificial Sequence
  Synthetic
gcgtguctctgcguccag

SEQ ID NO: 27135 - DNA, 17 bp, Artificial Sequence
  Synthetic
ccctgugccctgacugt

SEQ ID NO: 27136 - DNA, 17 bp, Artificial Sequence
  Synthetic
ccuccccagcctctugg

SEQ ID NO: 27137 - DNA, 20 bp, Artificial Sequence
  Synthetic
ggctgaagagugagcctugt

SEQ ID NO: 27138 - DNA, 22 bp, Artificial Sequence
  Synthetic
ctacgtccaccaucaagtccuc

SEQ ID NO: 27139 - DNA, 22 bp, Artificial Sequence
  Synthetic
gtttcctcutgtccccauccac

SEQ ID NO: 27140 - DNA, 23 bp, Artificial Sequence
  Synthetic
gtctcatactuggtcctccacug

SEQ ID NO: 27141 - DNA, 25 bp, Artificial Sequence
  Synthetic
gggttgcttuatggagaaagcugaa

SEQ ID NO: 27142 - DNA, 20 bp, Artificial Sequence
  Synthetic
gagacugtggugggaaccat

SEQ ID NO: 27143 - DNA, 28 bp, Artificial Sequence
  Synthetic
catcatataactcuccttcccttcucag

SEQ ID NO: 27144 - DNA, 17 bp, Artificial Sequence
  Synthetic
cguggcctccuccaggt

SEQ ID NO: 27145 - DNA, 18 bp, Artificial Sequence
  Synthetic
tcugaccaggcacgcauc

SEQ ID NO: 27146 - DNA, 23 bp, Artificial Sequence
  Synthetic
ccugtaatgctgugaacaggaca

SEQ ID NO: 27147 - DNA, 22 bp, Artificial Sequence
  Synthetic
ccttaccucaccatccctccut

SEQ ID NO: 27148 - DNA, 23 bp, Artificial Sequence
  Synthetic
gggcacagauagacatggcauat

SEQ ID NO: 27149 - DNA, 22 bp, Artificial Sequence
  Synthetic
gatcatugccaagcugaccaag

SEQ ID NO: 27150 - DNA, 25 bp, Artificial Sequence
  Synthetic
agtatggtcugagagtcctgaugag

SEQ ID NO: 27151 - DNA, 24 bp, Artificial Sequence
  Synthetic
caaggugaaggagaugaacgagag

SEQ ID NO: 27152 - DNA, 21 bp, Artificial Sequence
  Synthetic
ggguggaagagccaacaguag

SEQ ID NO: 27153 - DNA, 25 bp, Artificial Sequence
  Synthetic
gcugaagagugcagaaagagagaag

SEQ ID NO: 27154 - DNA, 22 bp, Artificial Sequence
  Synthetic
cgggaaaccucctcttgagauc

SEQ ID NO: 27155 - DNA, 22 bp, Artificial Sequence
  Synthetic
cccaccatcuctttccctcgua

SEQ ID NO: 27156 - DNA, 22 bp, Artificial Sequence
  Synthetic
ctcccccugttctatgagcuct

SEQ ID NO: 27157 - DNA, 25 bp, Artificial Sequence
  Synthetic
acagactccucctacttccttctug

SEQ ID NO: 27158 - DNA, 17 bp, Artificial Sequence
  Synthetic
gggctgugtcccacuca

SEQ ID NO: 27159 - DNA, 25 bp, Artificial Sequence
  Synthetic
caaaugccagcaaggatguaaagag

SEQ ID NO: 27160 - DNA, 24 bp, Artificial Sequence
  Synthetic
ccaatgatgtugtagtccacgaug

SEQ ID NO: 27161 - DNA, 22 bp, Artificial Sequence
  Synthetic
cactcagtgaugctctctccug

SEQ ID NO: 27162 - DNA, 22 bp, Artificial Sequence
  Synthetic
gggagcgagugagtgattgtuc

SEQ ID NO: 27163 - DNA, 23 bp, Artificial Sequence
  Synthetic
aatatgggtcuctcctccaccut

SEQ ID NO: 27164 - DNA, 21 bp, Artificial Sequence
  Synthetic
gagaugactgcugagcagaca

SEQ ID NO: 27165 - DNA, 27 bp, Artificial Sequence
  Synthetic
cttcactucagaggagaaaaacuccat

SEQ ID NO: 27166 - DNA, 22 bp, Artificial Sequence
  Synthetic
gcgtctuagctctgctttugga

SEQ ID NO: 27167 - DNA, 22 bp, Artificial Sequence
  Synthetic
gtgtcccacccuaaccatgtut

SEQ ID NO: 27168 - DNA, 24 bp, Artificial Sequence
  Synthetic
agagagagaggucaagaccagaug

SEQ ID NO: 27169 - DNA, 22 bp, Artificial Sequence
  Synthetic
agauatgagcctucccccaact

SEQ ID NO: 27170 - DNA, 21 bp, Artificial Sequence
  Synthetic
caggugagagctcttcuccct

SEQ ID NO: 27171 - DNA, 22 bp, Artificial Sequence
  Synthetic
ccaauaagcccctgtctucaca

SEQ ID NO: 27172 - DNA, 23 bp, Artificial Sequence
  Synthetic
cctatcccagutccctucaggaa

SEQ ID NO: 27173 - DNA, 25 bp, Artificial Sequence
  Synthetic
gcaagtcacugctccttttctaucc

SEQ ID NO: 27174 - DNA, 23 bp, Artificial Sequence
  Synthetic
cgatcctugaggttguagagcac

SEQ ID NO: 27175 - DNA, 23 bp, Artificial Sequence
  Synthetic
ctcttgagcacuattgccctguc

SEQ ID NO: 27176 - DNA, 23 bp, Artificial Sequence
  Synthetic
aaactccugtttgtcaucaggca

SEQ ID NO: 27177 - DNA, 21 bp, Artificial Sequence
  Synthetic
aagggaagaaugggcagaugg

SEQ ID NO: 27178 - DNA, 20 bp, Artificial Sequence
  Synthetic
ctgcuccaggaatccctucg

SEQ ID NO: 27179 - DNA, 20 bp, Artificial Sequence
  Synthetic
ccttctgcugcagggcaaua

SEQ ID NO: 27180 - DNA, 17 bp, Artificial Sequence
  Synthetic
ccuagggucgcccgagt

SEQ ID NO: 27181 - DNA, 22 bp, Artificial Sequence
  Synthetic
ggagaccagcuactgctucaag

SEQ ID NO: 27182 - DNA, 19 bp, Artificial Sequence
  Synthetic
cgagaacuggtggctcucc

SEQ ID NO: 27183 - DNA, 18 bp, Artificial Sequence
  Synthetic
tcgatgcugccgtcgtut

SEQ ID NO: 27184 - DNA, 17 bp, Artificial Sequence
  Synthetic
cccagcaggcugtgcuc

SEQ ID NO: 27185 - DNA, 18 bp, Artificial Sequence
  Synthetic
gucccaaggugaccagca

SEQ ID NO: 27186 - DNA, 28 bp, Artificial Sequence
  Synthetic
tttttaacgtatcutagtgtgagcucgt

SEQ ID NO: 27187 - DNA, 23 bp, Artificial Sequence
  Synthetic
gcatggcccuttggagacuaaag

SEQ ID NO: 27188 - DNA, 23 bp, Artificial Sequence
  Synthetic
gggactccutgctaaccauagga

SEQ ID NO: 27189 - DNA, 30 bp, Artificial Sequence
  Synthetic
ctaaagaaaagatagugggtgtacctcaut

SEQ ID NO: 27190 - DNA, 21 bp, Artificial Sequence
  Synthetic
ggtggtuaatgtgtccucggt

SEQ ID NO: 27191 - DNA, 21 bp, Artificial Sequence
  Synthetic
ccaagttgcugtggacctcua

SEQ ID NO: 27192 - DNA, 23 bp, Artificial Sequence
  Synthetic
ctcttcuccccctttgucaagac

SEQ ID NO: 27193 - DNA, 22 bp, Artificial Sequence
  Synthetic
atcaggcacaaacucagctuct

SEQ ID NO: 27194 - DNA, 23 bp, Artificial Sequence
  Synthetic
cttctaggaauccggtgggagua

SEQ ID NO: 27195 - DNA, 20 bp, Artificial Sequence
  Synthetic
aggtguccacaactcaugcc

SEQ ID NO: 27196 - DNA, 24 bp, Artificial Sequence
  Synthetic
gttgttaaucccaggtcuaaccgt

SEQ ID NO: 27197 - DNA, 24 bp, Artificial Sequence
  Synthetic
gccatatttcaaugtcagctccuc

SEQ ID NO: 27198 - DNA, 24 bp, Artificial Sequence
  Synthetic
ggtaatgtggutggtgatcuccat

SEQ ID NO: 27199 - DNA, 24 bp, Artificial Sequence
  Synthetic
caaagatctgugtctcatgcucac

SEQ ID NO: 27200 - DNA, 30 bp, Artificial Sequence
  Synthetic
tattaatatctaatguttgggagccaucac

SEQ ID NO: 27201 - DNA, 23 bp, Artificial Sequence
  Synthetic
catucccaccacaccaaaatucc

SEQ ID NO: 27202 - DNA, 26 bp, Artificial Sequence
  Synthetic
cctaccacccauttacaagttuagcc

SEQ ID NO: 27203 - DNA, 27 bp, Artificial Sequence
  Synthetic
tgcttcagtuccgataaattcuacact

SEQ ID NO: 27204 - DNA, 26 bp, Artificial Sequence
  Synthetic
gagctgtaactuccactttctctuga

SEQ ID NO: 27205 - DNA, 28 bp, Artificial Sequence
  Synthetic
actttgcaacauagagaaatgcacauac

SEQ ID NO: 27206 - DNA, 24 bp, Artificial Sequence
  Synthetic
tgtgaatgtgugtctttcccauct

SEQ ID NO: 27207 - DNA, 30 bp, Artificial Sequence
  Synthetic
gggattutaaccgcaaauatgctagataua

SEQ ID NO: 27208 - DNA, 22 bp, Artificial Sequence
  Synthetic
ccgaagacagcacugttaccug

SEQ ID NO: 27209 - DNA, 21 bp, Artificial Sequence
  Synthetic
ccaagtcucccctcttcaugg

SEQ ID NO: 27210 - DNA, 22 bp, Artificial Sequence
  Synthetic
cctacagauaccagggugcaac

SEQ ID NO: 27211 - DNA, 25 bp, Artificial Sequence
  Synthetic
gccttgaauttcttttcugcacgac

SEQ ID NO: 27212 - DNA, 23 bp, Artificial Sequence
  Synthetic
acagcttctuacagtgctggaug

SEQ ID NO: 27213 - DNA, 24 bp, Artificial Sequence
  Synthetic
gctacactcutccaaacctucact

SEQ ID NO: 27214 - DNA, 27 bp, Artificial Sequence
  Synthetic
aaggcttctgaguggtacaacttttua

SEQ ID NO: 27215 - DNA, 21 bp, Artificial Sequence
  Synthetic
caaggcugacactcacgauga

SEQ ID NO: 27216 - DNA, 22 bp, Artificial Sequence
  Synthetic
gggtgatcutgttgaaggtugg

SEQ ID NO: 27217 - DNA, 24 bp, Artificial Sequence
  Synthetic
ctgatcacugggagtcatcatgug

SEQ ID NO: 27218 - DNA, 22 bp, Artificial Sequence
  Synthetic
tgagttggccuacaggtatugt

SEQ ID NO: 27219 - DNA, 30 bp, Artificial Sequence
  Synthetic
cttacatttttctgutgggtagtttgtgut

SEQ ID NO: 27220 - DNA, 21 bp, Artificial Sequence
  Synthetic
gcttcagaaucacagcucggt

SEQ ID NO: 27221 - DNA, 20 bp, Artificial Sequence
  Synthetic
acagaugcgctaaugacggt

SEQ ID NO: 27222 - DNA, 28 bp, Artificial Sequence
  Synthetic
cgcaattttccuattatcggagugaaag

SEQ ID NO: 27223 - DNA, 20 bp, Artificial Sequence
  Synthetic
gagugagaggactccuccgt

SEQ ID NO: 27224 - DNA, 20 bp, Artificial Sequence
  Synthetic
gcaggagugctcacgatcug

SEQ ID NO: 27225 - DNA, 27 bp, Artificial Sequence
  Synthetic
gccctcttaacuacactctcatuacct

SEQ ID NO: 27226 - DNA, 25 bp, Artificial Sequence
  Synthetic
cacagcauccaagaggtaaagtuct

SEQ ID NO: 27227 - DNA, 27 bp, Artificial Sequence
  Synthetic
ggctttcttcaugatcttgtacatguc

SEQ ID NO: 27228 - DNA, 21 bp, Artificial Sequence
  Synthetic
cccctgugttgttcccuacat

SEQ ID NO: 27229 - DNA, 26 bp, Artificial Sequence
  Synthetic
gtcagttctgauaatcggaggtguac

SEQ ID NO: 27230 - DNA, 25 bp, Artificial Sequence
  Synthetic
agacagaagautcccttuccagaga

SEQ ID NO: 27231 - DNA, 21 bp, Artificial Sequence
  Synthetic
tctcauggctcagtucccaac

SEQ ID NO: 27232 - DNA, 20 bp, Artificial Sequence
  Synthetic
cctgctcccauatggctcuc

SEQ ID NO: 27233 - DNA, 20 bp, Artificial Sequence
  Synthetic
cccaucaagagcatcuccca

SEQ ID NO: 27234 - DNA, 20 bp, Artificial Sequence
  Synthetic
gagtugggaagggaccctug

SEQ ID NO: 27235 - DNA, 25 bp, Artificial Sequence
  Synthetic
catgttgatguaggttttgctccug

SEQ ID NO: 27236 - DNA, 21 bp, Artificial Sequence
  Synthetic
gcttgcttcuggtgacacuga

SEQ ID NO: 27237 - DNA, 20 bp, Artificial Sequence
  Synthetic
cattctccccugcaccauct

SEQ ID NO: 27238 - DNA, 23 bp, Artificial Sequence
  Synthetic
tgtgcctgtucagactgtaaucc

SEQ ID NO: 27239 - DNA, 20 bp, Artificial Sequence
  Synthetic
gcauaggaagcccctguagc

SEQ ID NO: 27240 - DNA, 22 bp, Artificial Sequence
  Synthetic
acacagccagguggaatttgut

SEQ ID NO: 27241 - DNA, 23 bp, Artificial Sequence
  Synthetic
cccatttgguttgagcaacucac

SEQ ID NO: 27242 - DNA, 22 bp, Artificial Sequence
  Synthetic
ctccuagaccctcccuccaaat

SEQ ID NO: 27243 - DNA, 23 bp, Artificial Sequence
  Synthetic
tgactcccacgcutcattttcuc

SEQ ID NO: 27244 - DNA, 22 bp, Artificial Sequence
  Synthetic
ctccacguccacctctaacaug

SEQ ID NO: 27245 - DNA, 25 bp, Artificial Sequence
  Synthetic
agattatcaggugagatgcctgtug

SEQ ID NO: 27246 - DNA, 21 bp, Artificial Sequence
  Synthetic
ctttcctcutgccccguaaga

SEQ ID NO: 27247 - DNA, 26 bp, Artificial Sequence
  Synthetic
gtgaaactgaaaucctgagtgaucct

SEQ ID NO: 27248 - DNA, 24 bp, Artificial Sequence
  Synthetic
agtattggcugtcttgaggaaugc

SEQ ID NO: 27249 - DNA, 24 bp, Artificial Sequence
  Synthetic
gcttcagcauctgcatcttctuct

SEQ ID NO: 27250 - DNA, 17 bp, Artificial Sequence
  Synthetic
cgacgcccgugtgtugt

SEQ ID NO: 27251 - DNA, 18 bp, Artificial Sequence
  Synthetic
gctgtccuccgccttgug

SEQ ID NO: 27252 - DNA, 21 bp, Artificial Sequence
  Synthetic
ccctgtccutctggttctgug

SEQ ID NO: 27253 - DNA, 25 bp, Artificial Sequence
  Synthetic
gcatcttugagagcctcagagtaut

SEQ ID NO: 27254 - DNA, 17 bp, Artificial Sequence
  Synthetic
gcgactuccggacugct

SEQ ID NO: 27255 - DNA, 19 bp, Artificial Sequence
  Synthetic
caggcuccggatcttccug

SEQ ID NO: 27256 - DNA, 22 bp, Artificial Sequence
  Synthetic
agccattucctgaagcuaccac

SEQ ID NO: 27257 - DNA, 22 bp, Artificial Sequence
  Synthetic
agatggctgaugaggcattcuc

SEQ ID NO: 27258 - DNA, 21 bp, Artificial Sequence
  Synthetic
gggcctgaugggatctgauct

SEQ ID NO: 27259 - DNA, 24 bp, Artificial Sequence
  Synthetic
tcatgctgttuagtcactgctcug

SEQ ID NO: 27260 - DNA, 24 bp, Artificial Sequence
  Synthetic
ccatccctcucctttttctcucct

SEQ ID NO: 27261 - DNA, 24 bp, Artificial Sequence
  Synthetic
cagctctuaaaagatgccttuccc

SEQ ID NO: 27262 - DNA, 27 bp, Artificial Sequence
  Synthetic
tataggtgatgugcttcattttcaucc

SEQ ID NO: 27263 - DNA, 22 bp, Artificial Sequence
  Synthetic
tgccaggutggtatucaaccat

SEQ ID NO: 27264 - DNA, 23 bp, Artificial Sequence
  Synthetic
tcccaccuttttatctucacgca

SEQ ID NO: 27265 - DNA, 28 bp, Artificial Sequence
  Synthetic
gtttatttgacacugaaacgaagagcut

SEQ ID NO: 27266 - DNA, 22 bp, Artificial Sequence
  Synthetic
actaaagcuggccctgaaugag

SEQ ID NO: 27267 - DNA, 31 bp, Artificial Sequence
  Synthetic
agagaacgtaatuattccagccatauagaga

SEQ ID NO: 27268 - DNA, 29 bp, Artificial Sequence
  Synthetic
ctggatcagacuttactggagtuaaacaa

SEQ ID NO: 27269 - DNA, 18 bp, Artificial Sequence
  Synthetic
accaggaucgcccugaca

SEQ ID NO: 27270 - DNA, 22 bp, Artificial Sequence
  Synthetic
aggutcatggacugaggcaaag

SEQ ID NO: 27271 - DNA, 22 bp, Artificial Sequence
  Synthetic
cctaccuccaggagaagccaua

SEQ ID NO: 27272 - DNA, 22 bp, Artificial Sequence
  Synthetic
cgggaagcacuatggcatcuat

SEQ ID NO: 27273 - DNA, 21 bp, Artificial Sequence
  Synthetic
ggctuggacattttugcccaa

SEQ ID NO: 27274 - DNA, 20 bp, Artificial Sequence
  Synthetic
gaugaaccaggacggugagg

SEQ ID NO: 27275 - DNA, 21 bp, Artificial Sequence
  Synthetic
ggactcagugttggacuccat

SEQ ID NO: 27276 - DNA, 21 bp, Artificial Sequence
  Synthetic
cgagaagcaggcgcuaagauc

SEQ ID NO: 27277 - DNA, 22 bp, Artificial Sequence
  Synthetic
cacttgacggccaugaagagua

SEQ ID NO: 27278 - DNA, 22 bp, Artificial Sequence
  Synthetic
aagctgtgugtctgccauaaca

SEQ ID NO: 27279 - DNA, 23 bp, Artificial Sequence
  Synthetic
ccggaaccgagagauagttucct

SEQ ID NO: 27280 - DNA, 21 bp, Artificial Sequence
  Synthetic
gccagcctuataacagccgua

SEQ ID NO: 27281 - DNA, 24 bp, Artificial Sequence
  Synthetic
gttagaggucagggacagaugagt

SEQ ID NO: 27282 - DNA, 21 bp, Artificial Sequence
  Synthetic
gactagtgcucagaagcuggt

SEQ ID NO: 27283 - DNA, 27 bp, Artificial Sequence
  Synthetic
gaacataucacaaaggagcttcuccat

SEQ ID NO: 27284 - DNA, 28 bp, Artificial Sequence
  Synthetic
aatgccacatuactctttattgaaugcg

SEQ ID NO: 27285 - DNA, 23 bp, Artificial Sequence
  Synthetic
ttctgugagcaggagttugaaca

SEQ ID NO: 27286 - DNA, 31 bp, Artificial Sequence
  Synthetic
agtgttagctatugttaattattgtctucct

SEQ ID NO: 27287 - DNA, 23 bp, Artificial Sequence
  Synthetic
tggagcaacaagutgacatcuga

SEQ ID NO: 27288 - DNA, 22 bp, Artificial Sequence
  Synthetic
gaagggtacuagtccagaggug

SEQ ID NO: 27289 - DNA, 24 bp, Artificial Sequence
  Synthetic
ctgttgttgcutgttttcccucag

SEQ ID NO: 27290 - DNA, 25 bp, Artificial Sequence
  Synthetic
gaccagtuccagctccttcatauag

SEQ ID NO: 27291 - DNA, 23 bp, Artificial Sequence
  Synthetic
gcacataccugttgtcccatgut

SEQ ID NO: 27292 - DNA, 21 bp, Artificial Sequence
  Synthetic
gcctgacucggtauggaaagg

SEQ ID NO: 27293 - DNA, 24 bp, Artificial Sequence
  Synthetic
gcattaggcuttcaggatgtugaa

SEQ ID NO: 27294 - DNA, 23 bp, Artificial Sequence
  Synthetic
tgggaagacagagcugacttcua

SEQ ID NO: 27295 - DNA, 21 bp, Artificial Sequence
  Synthetic
cttacgtguaggactgugcgt

SEQ ID NO: 27296 - DNA, 22 bp, Artificial Sequence
  Synthetic
actggcuggttaggaugagaga

SEQ ID NO: 27297 - DNA, 25 bp, Artificial Sequence
  Synthetic
tcacagtgugcactttaaccuacag

SEQ ID NO: 27298 - DNA, 27 bp, Artificial Sequence
  Synthetic
ccaggatccuaaggcaaaacaagatut

SEQ ID NO: 27299 - DNA, 28 bp, Artificial Sequence
  Synthetic
tttactctgccuctctacatcttccuag

SEQ ID NO: 27300 - DNA, 22 bp, Artificial Sequence
  Synthetic
ggccatccagagutacagctuc

SEQ ID NO: 27301 - DNA, 23 bp, Artificial Sequence
  Synthetic
accaagctuaccctgtcttccua

SEQ ID NO: 27302 - DNA, 27 bp, Artificial Sequence
  Synthetic
ctgacatcgtacuggaattgaaagtug

SEQ ID NO: 27303 - DNA, 19 bp, Artificial Sequence
  Synthetic
ccugaccagggtcucacgt

SEQ ID NO: 27304 - DNA, 20 bp, Artificial Sequence
  Synthetic
ccacaccgaugttggcauct

SEQ ID NO: 27305 - DNA, 19 bp, Artificial Sequence
  Synthetic
gaagccagccuggaccaua

SEQ ID NO: 27306 - DNA, 28 bp, Artificial Sequence
  Synthetic
ctcagatccuatgtgtaaugaggaacaa

SEQ ID NO: 27307 - DNA, 26 bp, Artificial Sequence
  Synthetic
gtgagagtagautgggtctcttucag

SEQ ID NO: 27308 - DNA, 21 bp, Artificial Sequence
  Synthetic
acctcgtcauggatgctgaug

SEQ ID NO: 27309 - DNA, 22 bp, Artificial Sequence
  Synthetic
ggccagagugaagcttctctug

SEQ ID NO: 27310 - DNA, 22 bp, Artificial Sequence
  Synthetic
caaagcauccaagctcttcugg

SEQ ID NO: 27311 - DNA, 24 bp, Artificial Sequence
  Synthetic
cgtggaatgauggtgataacacug

SEQ ID NO: 27312 - DNA, 23 bp, Artificial Sequence
  Synthetic
catuagtaagcgcucagcaaagg

SEQ ID NO: 27313 - DNA, 22 bp, Artificial Sequence
  Synthetic
gcagaatgtucctgagctgcut

SEQ ID NO: 27314 - DNA, 23 bp, Artificial Sequence
  Synthetic
ccucagagcccagtttcuacaga

SEQ ID NO: 27315 - DNA, 23 bp, Artificial Sequence
  Synthetic
cctgcuaagacccatttcctucc

SEQ ID NO: 27316 - DNA, 20 bp, Artificial Sequence
  Synthetic
ggaaaggcaucccaggacuc

SEQ ID NO: 27317 - DNA, 21 bp, Artificial Sequence
  Synthetic
ctgcttccuttgctctgucca

SEQ ID NO: 27318 - DNA, 22 bp, Artificial Sequence
  Synthetic
gaactctggcugggaagaacua

SEQ ID NO: 27319 - DNA, 22 bp, Artificial Sequence
  Synthetic
ctactttgguccttggacugct

SEQ ID NO: 27320 - DNA, 22 bp, Artificial Sequence
  Synthetic
acccaaacuctttccacuagcc

SEQ ID NO: 27321 - DNA, 21 bp, Artificial Sequence
  Synthetic
gcacttaccugggatggctuc

SEQ ID NO: 27322 - DNA, 22 bp, Artificial Sequence
  Synthetic
tcctgagaauggagcaagggua

SEQ ID NO: 27323 - DNA, 24 bp, Artificial Sequence
  Synthetic
cttctcctgcucctgattgtctuc

SEQ ID NO: 27324 - DNA, 22 bp, Artificial Sequence
  Synthetic
ctaaggcuaagccgaaggcuag

SEQ ID NO: 27325 - DNA, 21 bp, Artificial Sequence
  Synthetic
caaccagaacugggagcgtua

SEQ ID NO: 27326 - DNA, 20 bp, Artificial Sequence
  Synthetic
agcgccaccugattacagug

SEQ ID NO: 27327 - DNA, 20 bp, Artificial Sequence
  Synthetic
gtggtgguaatgggauggct

SEQ ID NO: 27328 - DNA, 17 bp, Artificial Sequence
  Synthetic
caccggcagugtgcuct

SEQ ID NO: 27329 - DNA, 22 bp, Artificial Sequence
  Synthetic
ccttttctccucctcctccuca

SEQ ID NO: 27330 - DNA, 21 bp, Artificial Sequence
  Synthetic
cactaactgcucctgccaguc

SEQ ID NO: 27331 - DNA, 26 bp, Artificial Sequence
  Synthetic
tggttgttguggagtggaagttuaat

SEQ ID NO: 27332 - DNA, 19 bp, Artificial Sequence
  Synthetic
cagaccuccacgucgaaca

SEQ ID NO: 27333 - DNA, 20 bp, Artificial Sequence
  Synthetic
acaaccuggaccagcactuc

SEQ ID NO: 27334 - DNA, 18 bp, Artificial Sequence
  Synthetic
gcatcucccctcctugcc

SEQ ID NO: 27335 - DNA, 17 bp, Artificial Sequence
  Synthetic
tgggtcuccagcuccgt

SEQ ID NO: 27336 - DNA, 17 bp, Artificial Sequence
  Synthetic
gggccggcacucttcug

SEQ ID NO: 27337 - DNA, 17 bp, Artificial Sequence
  Synthetic
ttgaggguggcctgugg

SEQ ID NO: 27338 - DNA, 18 bp, Artificial Sequence
  Synthetic
guggacgacaugcccaac

SEQ ID NO: 27339 - DNA, 18 bp, Artificial Sequence
  Synthetic
gcuacaccucccgcaacc

SEQ ID NO: 27340 - DNA, 21 bp, Artificial Sequence
  Synthetic
tggacaagtucctggcttcug

SEQ ID NO: 27341 - DNA, 21 bp, Artificial Sequence
  Synthetic
ctccattgutggcacatuccg

SEQ ID NO: 27342 - DNA, 22 bp, Artificial Sequence
  Synthetic
ctggaaaaugcagtgggaguct

SEQ ID NO: 27343 - DNA, 29 bp, Artificial Sequence
  Synthetic
ctctctagtagcucaactggataaaccua

SEQ ID NO: 27344 - DNA, 25 bp, Artificial Sequence
  Synthetic
gctgatcctguggcttttgtcttua

SEQ ID NO: 27345 - DNA, 21 bp, Artificial Sequence
  Synthetic
cgucaaggucagagaaaccuc

SEQ ID NO: 27346 - DNA, 22 bp, Artificial Sequence
  Synthetic
ccatgcgugttattgacgucat

SEQ ID NO: 27347 - DNA, 20 bp, Artificial Sequence
  Synthetic
cucccagaaaccagggugaa

SEQ ID NO: 27348 - DNA, 20 bp, Artificial Sequence
  Synthetic
cccugacacgcattgtguct

SEQ ID NO: 27349 - DNA, 22 bp, Artificial Sequence
  Synthetic
aggactctcuaagccagtgugt

SEQ ID NO: 27350 - DNA, 19 bp, Artificial Sequence
  Synthetic
ctcaggcgugctactcucg

SEQ ID NO: 27351 - DNA, 26 bp, Artificial Sequence
  Synthetic
ctatacttcttgaugagcctggugat

SEQ ID NO: 27352 - DNA, 19 bp, Artificial Sequence
  Synthetic
ccatgcggugggtgtguag

SEQ ID NO: 27353 - DNA, 19 bp, Artificial Sequence
  Synthetic
gagacccguggaactcgut

SEQ ID NO: 27354 - DNA, 21 bp, Artificial Sequence
  Synthetic
caacaccggcucttctttuga

SEQ ID NO: 27355 - DNA, 20 bp, Artificial Sequence
  Synthetic
ctcaucgggcatccugagac

SEQ ID NO: 27356 - DNA, 18 bp, Artificial Sequence
  Synthetic
cgagatguggccctcgut

SEQ ID NO: 27357 - DNA, 18 bp, Artificial Sequence
  Synthetic
cggguacaacggctcuca

SEQ ID NO: 27358 - DNA, 17 bp, Artificial Sequence
  Synthetic
ggtgagcugcgtccuct

SEQ ID NO: 27359 - DNA, 20 bp, Artificial Sequence
  Synthetic
gctuccaggaaccacaccug

SEQ ID NO: 27360 - DNA, 22 bp, Artificial Sequence
  Synthetic
ctcagctgcutctcttgctuct

SEQ ID NO: 27361 - DNA, 18 bp, Artificial Sequence
  Synthetic
caacgugggacggauggt

SEQ ID NO: 27362 - DNA, 22 bp, Artificial Sequence
  Synthetic
ggagaggttucatgcctggaut

SEQ ID NO: 27363 - DNA, 21 bp, Artificial Sequence
  Synthetic
tgtcctgcuctgacctccuac

SEQ ID NO: 27364 - DNA, 24 bp, Artificial Sequence
  Synthetic
agatgccugacatcatcaucaagg

SEQ ID NO: 27365 - DNA, 20 bp, Artificial Sequence
  Synthetic
ggtuccccaaggagtccuga

SEQ ID NO: 27366 - DNA, 18 bp, Artificial Sequence
  Synthetic
cctgagcgccucggttut

SEQ ID NO: 27367 - DNA, 21 bp, Artificial Sequence
  Synthetic
cuaccgagagauacagcctuc

SEQ ID NO: 27368 - DNA, 19 bp, Artificial Sequence
  Synthetic
cccctccacuggcttgtuc

SEQ ID NO: 27369 - DNA, 17 bp, Artificial Sequence
  Synthetic
cccgacagucccgcuac

SEQ ID NO: 27370 - DNA, 23 bp, Artificial Sequence
  Synthetic
gatagccugaaaaaccuccacct

SEQ ID NO: 27371 - DNA, 22 bp, Artificial Sequence
  Synthetic
cuagaagacagggagcgugaaa

SEQ ID NO: 27372 - DNA, 19 bp, Artificial Sequence
  Synthetic
ctaaguccaccctgugcgt

SEQ ID NO: 27373 - DNA, 20 bp, Artificial Sequence
  Synthetic
cttccugaacacugggacca

SEQ ID NO: 27374 - DNA, 20 bp, Artificial Sequence
  Synthetic
cgaaaccugagaaggccuca

SEQ ID NO: 27375 - DNA, 24 bp, Artificial Sequence
  Synthetic
caaataucccaagagggucaaguc

SEQ ID NO: 27376 - DNA, 20 bp, Artificial Sequence
  Synthetic
gagctgtcuaacgcccucat

SEQ ID NO: 27377 - DNA, 18 bp, Artificial Sequence
  Synthetic
ggagccacautgccguca

SEQ ID NO: 27378 - DNA, 20 bp, Artificial Sequence
  Synthetic
ggtcaggagaaggcuggtuc

SEQ ID NO: 27379 - DNA, 19 bp, Artificial Sequence
  Synthetic
ggctcugagccacacucac

SEQ ID NO: 27380 - DNA, 21 bp, Artificial Sequence
  Synthetic
tctgtggaccuctcctuccag

SEQ ID NO: 27381 - DNA, 18 bp, Artificial Sequence
  Synthetic
agcacttuccccguccag

SEQ ID NO: 27382 - DNA, 22 bp, Artificial Sequence
  Synthetic
cgaggtuacaccatcuccgact

SEQ ID NO: 27383 - DNA, 19 bp, Artificial Sequence
  Synthetic
caagugaggcaccaggtuc

SEQ ID NO: 27384 - DNA, 18 bp, Artificial Sequence
  Synthetic
cctaagcuccctguggca

SEQ ID NO: 27385 - DNA, 18 bp, Artificial Sequence
  Synthetic
gccctguccaggcaccua

SEQ ID NO: 27386 - DNA, 21 bp, Artificial Sequence
  Synthetic
gctcatcgagcugaaggacug

SEQ ID NO: 27387 - DNA, 20 bp, Artificial Sequence
  Synthetic
ggtagcaggacuggauggga

SEQ ID NO: 27388 - DNA, 20 bp, Artificial Sequence
  Synthetic
ccugggcaacgactttgugt

SEQ ID NO: 27389 - DNA, 19 bp, Artificial Sequence
  Synthetic
cctcgugaccgaagcucag

SEQ ID NO: 27390 - DNA, 19 bp, Artificial Sequence
  Synthetic
ggcgugaccaccaagtcuc

SEQ ID NO: 27391 - DNA, 21 bp, Artificial Sequence
  Synthetic
tgagctcacuatcagguggca

SEQ ID NO: 27392 - DNA, 20 bp, Artificial Sequence
  Synthetic
ctcccagacutacugcccaa

SEQ ID NO: 27393 - DNA, 18 bp, Artificial Sequence
  Synthetic
ccggccucacacaaacuc

SEQ ID NO: 27394 - DNA, 20 bp, Artificial Sequence
  Synthetic
ggagttgcgguccaggaauc

SEQ ID NO: 27395 - DNA, 19 bp, Artificial Sequence
  Synthetic
cauccacgucgaagaggca

SEQ ID NO: 27396 - DNA, 28 bp, Artificial Sequence
  Synthetic
tgtacttgtgtuacccttagagtttugg

SEQ ID NO: 27397 - DNA, 28 bp, Artificial Sequence
  Synthetic
accagatgtaatuagcaacccatcatut

SEQ ID NO: 27398 - DNA, 22 bp, Artificial Sequence
  Synthetic
ctgaagacccugggtttgcuat

SEQ ID NO: 27399 - DNA, 23 bp, Artificial Sequence
  Synthetic
gtgacgccuctttgtuaaaagca

SEQ ID NO: 27400 - DNA, 24 bp, Artificial Sequence
  Synthetic
gataatccuacctttguggccagt

SEQ ID NO: 27401 - DNA, 29 bp, Artificial Sequence
  Synthetic
caagttuggaacacaggcaatatauacaa

SEQ ID NO: 27402 - DNA, 22 bp, Artificial Sequence
  Synthetic
gggagcctucatctgtactucg

SEQ ID NO: 27403 - DNA, 20 bp, Artificial Sequence
  Synthetic
aatgccctaugctggctugt

SEQ ID NO: 27404 - DNA, 17 bp, Artificial Sequence
  Synthetic
cgtugcccaggcuggag

SEQ ID NO: 27405 - DNA, 23 bp, Artificial Sequence
  Synthetic
aatggaaucaaggccagugaaua

SEQ ID NO: 27406 - DNA, 24 bp, Artificial Sequence
  Synthetic
gcatugggcagaaaagaaauggat

SEQ ID NO: 27407 - DNA, 27 bp, Artificial Sequence
  Synthetic
gaatatactuaaccgggctccttctug

SEQ ID NO: 27408 - DNA, 18 bp, Artificial Sequence
  Synthetic
ctgcggtuggcgttgaug

SEQ ID NO: 27409 - DNA, 22 bp, Artificial Sequence
  Synthetic
cgagcaguacaaggagcaggua

SEQ ID NO: 27410 - DNA, 23 bp, Artificial Sequence
  Synthetic
ggtggactugaacttggactuga

SEQ ID NO: 27411 - DNA, 20 bp, Artificial Sequence
  Synthetic
ggtctcagugcgctctctug

SEQ ID NO: 27412 - DNA, 25 bp, Artificial Sequence
  Synthetic
ccctcttccuccattcagtttccua

SEQ ID NO: 27413 - DNA, 22 bp, Artificial Sequence
  Synthetic
gagttgtcaggguggactctug

SEQ ID NO: 27414 - DNA, 20 bp, Artificial Sequence
  Synthetic
catgccccaagcucctagug

SEQ ID NO: 27415 - DNA, 22 bp, Artificial Sequence
  Synthetic
ggcagcacacauctctatucct

SEQ ID NO: 27416 - DNA, 23 bp, Artificial Sequence
  Synthetic
gcttggagauccctttcgaacug

SEQ ID NO: 27417 - DNA, 26 bp, Artificial Sequence
  Synthetic
ttcatgaagtugagcctcatagaaug

SEQ ID NO: 27418 - DNA, 23 bp, Artificial Sequence
  Synthetic
cggctttgagcautttgttgguc

SEQ ID NO: 27419 - DNA, 22 bp, Artificial Sequence
  Synthetic
agaagtcaccuctgggtctugt

SEQ ID NO: 27420 - DNA, 23 bp, Artificial Sequence
  Synthetic
gctgaagccugttcttggtctut

SEQ ID NO: 27421 - DNA, 20 bp, Artificial Sequence
  Synthetic
cctcucaccctacccuggac

SEQ ID NO: 27422 - DNA, 22 bp, Artificial Sequence
  Synthetic
ctccugcaaaagggaugcaaag

SEQ ID NO: 27423 - DNA, 21 bp, Artificial Sequence
  Synthetic
ccagtctctuggcaccctuag

SEQ ID NO: 27424 - DNA, 19 bp, Artificial Sequence
  Synthetic
ccatcgcugcactuggact

SEQ ID NO: 27425 - DNA, 21 bp, Artificial Sequence
  Synthetic
tgttatcccucccctctgcut

SEQ ID NO: 27426 - DNA, 22 bp, Artificial Sequence
  Synthetic
ggatagcaggauggtgggatug

SEQ ID NO: 27427 - DNA, 25 bp, Artificial Sequence
  Synthetic
agaagaacaaugcccugaagaagat

SEQ ID NO: 27428 - DNA, 18 bp, Artificial Sequence
  Synthetic
cagcaaaugcccctugcc

SEQ ID NO: 27429 - DNA, 23 bp, Artificial Sequence
  Synthetic
tcctgaagagcaccutggtttut

SEQ ID NO: 27430 - DNA, 21 bp, Artificial Sequence
  Synthetic
gtgctcggautataggcguga

SEQ ID NO: 27431 - DNA, 26 bp, Artificial Sequence
  Synthetic
gtuactcttttcccuccacaacaaag

SEQ ID NO: 27432 - DNA, 24 bp, Artificial Sequence
  Synthetic
ctccatctcaugcagtatctccuc

SEQ ID NO: 27433 - DNA, 22 bp, Artificial Sequence
  Synthetic
gtacctguatggatgcauggct

SEQ ID NO: 27434 - DNA, 23 bp, Artificial Sequence
  Synthetic
caaatgtgaaggcuccagaguga

SEQ ID NO: 27435 - DNA, 19 bp, Artificial Sequence
  Synthetic
agggtguggcttcaugacc

SEQ ID NO: 27436 - DNA, 22 bp, Artificial Sequence
  Synthetic
gccagtgaugacatggguaaga

SEQ ID NO: 27437 - DNA, 24 bp, Artificial Sequence
  Synthetic
ggtgacttcugctctgtgttucaa

SEQ ID NO: 27438 - DNA, 18 bp, Artificial Sequence
  Synthetic
ggacagcccuggcttcug

SEQ ID NO: 27439 - DNA, 20 bp, Artificial Sequence
  Synthetic
gauggccaagaugacggaga

SEQ ID NO: 27440 - DNA, 24 bp, Artificial Sequence
  Synthetic
tgttcaatuctccagcucaaagca

SEQ ID NO: 27441 - DNA, 27 bp, Artificial Sequence
  Synthetic
gccttggtttcuaagtttctagttucc

SEQ ID NO: 27442 - DNA, 21 bp, Artificial Sequence
  Synthetic
ctccacgaaagacutguccgt

SEQ ID NO: 27443 - DNA, 22 bp, Artificial Sequence
  Synthetic
ggatgcccaugcgttgtgtaua

SEQ ID NO: 27444 - DNA, 21 bp, Artificial Sequence
  Synthetic
gatgaagtuccactcgaugcc

SEQ ID NO: 27445 - DNA, 24 bp, Artificial Sequence
  Synthetic
ggctccttgucttctgacttcaua

SEQ ID NO: 27446 - DNA, 21 bp, Artificial Sequence
  Synthetic
tttgtucacgcgggtgaguat

SEQ ID NO: 27447 - DNA, 23 bp, Artificial Sequence
  Synthetic
gcacccggucaagaauaaaaauc

SEQ ID NO: 27448 - DNA, 21 bp, Artificial Sequence
  Synthetic
ccaaccccaaagucattgguc

SEQ ID NO: 27449 - DNA, 23 bp, Artificial Sequence
  Synthetic
agtggcttuaggctccaaaacuc

SEQ ID NO: 27450 - DNA, 26 bp, Artificial Sequence
  Synthetic
caggatcugagactgttttaauagcc

SEQ ID NO: 27451 - DNA, 23 bp, Artificial Sequence
  Synthetic
gaatcccuaactcccuccaaacc

SEQ ID NO: 27452 - DNA, 24 bp, Artificial Sequence
  Synthetic
caggagaugacaccaaagctttuc

SEQ ID NO: 27453 - DNA, 30 bp, Artificial Sequence
  Synthetic
ggttgctttcuccaataactagatgugaat

SEQ ID NO: 27454 - DNA, 24 bp, Artificial Sequence
  Synthetic
cctgagttcutgcaatgatgtuct

SEQ ID NO: 27455 - DNA, 26 bp, Artificial Sequence
  Synthetic
catagatgatgtucccgtgtcttuca

SEQ ID NO: 27456 - DNA, 22 bp, Artificial Sequence
  Synthetic
aaacuccacattccuggcaaga

SEQ ID NO: 27457 - DNA, 21 bp, Artificial Sequence
  Synthetic
ctgcccauctacucggagaag

SEQ ID NO: 27458 - DNA, 26 bp, Artificial Sequence
  Synthetic
tcccaacacatutctaatgcctacut

SEQ ID NO: 27459 - DNA, 22 bp, Artificial Sequence
  Synthetic
tggagaauggcaagaaggucac

SEQ ID NO: 27460 - DNA, 21 bp, Artificial Sequence
  Synthetic
ccacugggctgttgaugaagt

SEQ ID NO: 27461 - DNA, 21 bp, Artificial Sequence
  Synthetic
tctgcagaccgagutccuaga

SEQ ID NO: 27462 - DNA, 20 bp, Artificial Sequence
  Synthetic
ccttacuccgccttctccuc

SEQ ID NO: 27463 - DNA, 18 bp, Artificial Sequence
  Synthetic
cuccaccgagctcuccac

SEQ ID NO: 27464 - DNA, 25 bp, Artificial Sequence
  Synthetic
cctaaaacuaaatgtguggcccact

SEQ ID NO: 27465 - DNA, 22 bp, Artificial Sequence
  Synthetic
cgctaugacaggaaagaugggt

SEQ ID NO: 27466 - DNA, 30 bp, Artificial Sequence
  Synthetic
ctgtggttatguaagagaaattcattgucc

SEQ ID NO: 27467 - DNA, 17 bp, Artificial Sequence
  Synthetic
guggcgcacgggttuac

SEQ ID NO: 27468 - DNA, 19 bp, Artificial Sequence
  Synthetic
cacttuaccccagcugcgt

SEQ ID NO: 27469 - DNA, 26 bp, Artificial Sequence
  Synthetic
agagggacttgucacttctttgttuc

SEQ ID NO: 27470 - DNA, 21 bp, Artificial Sequence
  Synthetic
gugagggcacuaaaaggtgua

SEQ ID NO: 27471 - DNA, 21 bp, Artificial Sequence
  Synthetic
ttggccgguatgtatgtcugg

SEQ ID NO: 27472 - DNA, 22 bp, Artificial Sequence
  Synthetic
gcacagagggugacatttcugg

SEQ ID NO: 27473 - DNA, 21 bp, Artificial Sequence
  Synthetic
gaagacccucatcaccaucgg

SEQ ID NO: 27474 - DNA, 20 bp, Artificial Sequence
  Synthetic
ggagtcuctgtgcugcgaat

SEQ ID NO: 27475 - DNA, 20 bp, Artificial Sequence
  Synthetic
gtgttcaugcgctgtgtucc

SEQ ID NO: 27476 - DNA, 20 bp, Artificial Sequence
  Synthetic
acacgaagaugccagtgucg

SEQ ID NO: 27477 - DNA, 22 bp, Artificial Sequence
  Synthetic
caccctggagucatccgtttua

SEQ ID NO: 27478 - DNA, 17 bp, Artificial Sequence
  Synthetic
tcagugcccuggaggct

SEQ ID NO: 27479 - DNA, 22 bp, Artificial Sequence
  Synthetic
ccactggcugctgatggatuac

SEQ ID NO: 27480 - DNA, 24 bp, Artificial Sequence
  Synthetic
tctcctgcuctctcatctuacaca

SEQ ID NO: 27481 - DNA, 22 bp, Artificial Sequence
  Synthetic
ggtcaccaaugtcaucccacag

SEQ ID NO: 27482 - DNA, 22 bp, Artificial Sequence
  Synthetic
gctcctugaagagctucaccag

SEQ ID NO: 27483 - DNA, 21 bp, Artificial Sequence
  Synthetic
tgucagaaggugggacacaga

SEQ ID NO: 27484 - DNA, 26 bp, Artificial Sequence
  Synthetic
aaaguccaagagaagcauaaaaggua

SEQ ID NO: 27485 - DNA, 24 bp, Artificial Sequence
  Synthetic
tctctctcugactttctcctcucc

SEQ ID NO: 27486 - DNA, 22 bp, Artificial Sequence
  Synthetic
ctcctttucagcctcctctuca

SEQ ID NO: 27487 - DNA, 23 bp, Artificial Sequence
  Synthetic
gatcuaacaggagctgcugagac

SEQ ID NO: 27488 - DNA, 22 bp, Artificial Sequence
  Synthetic
gtucccagacaggugagcaaat

SEQ ID NO: 27489 - DNA, 24 bp, Artificial Sequence
  Synthetic
aatagaggcaggagguagacucag

SEQ ID NO: 27490 - DNA, 19 bp, Artificial Sequence
  Synthetic
tgutctggtcugggaggct

SEQ ID NO: 27491 - DNA, 19 bp, Artificial Sequence
  Synthetic
gggagcuggaggtctcuga

SEQ ID NO: 27492 - DNA, 22 bp, Artificial Sequence
  Synthetic
cccacauacagucagacccaag

SEQ ID NO: 27493 - DNA, 22 bp, Artificial Sequence
  Synthetic
ggtcaaggucacgtgcuagaag

SEQ ID NO: 27494 - DNA, 17 bp, Artificial Sequence
  Synthetic
ggcgcugcatugagggt

SEQ ID NO: 27495 - DNA, 19 bp, Artificial Sequence
  Synthetic
tgcttuccccgctgctuag

SEQ ID NO: 27496 - DNA, 24 bp, Artificial Sequence
  Synthetic
catatactcaacuccctgcctcuc

SEQ ID NO: 27497 - DNA, 17 bp, Artificial Sequence
  Synthetic
cccgaggugggctgtua

SEQ ID NO: 27498 - DNA, 18 bp, Artificial Sequence
  Synthetic
ccuccagccccagcagua

SEQ ID NO: 27499 - DNA, 20 bp, Artificial Sequence
  Synthetic
tcgagggccucattgagcua

SEQ ID NO: 27500 - DNA, 17 bp, Artificial Sequence
  Synthetic
cagcctcgugggctcug

SEQ ID NO: 27501 - DNA, 26 bp, Artificial Sequence
  Synthetic
tcacctaggacutacatgatcctgut

SEQ ID NO: 27502 - DNA, 21 bp, Artificial Sequence
  Synthetic
gattcggutctggtuccacct

SEQ ID NO: 27503 - DNA, 26 bp, Artificial Sequence
  Synthetic
tgtacaactcauaagagtggcccaua

SEQ ID NO: 27504 - DNA, 19 bp, Artificial Sequence
  Synthetic
ggtgcagcagagcuggaut

SEQ ID NO: 27505 - DNA, 17 bp, Artificial Sequence
  Synthetic
gcgccuagccgtgtcug

SEQ ID NO: 27506 - DNA, 26 bp, Artificial Sequence
  Synthetic
gaaatatgtgugggttcttcugacac

SEQ ID NO: 27507 - DNA, 23 bp, Artificial Sequence
  Synthetic
ggtgatuacgccatctacctuac

SEQ ID NO: 27508 - DNA, 21 bp, Artificial Sequence
  Synthetic
gccctgggaguaggagctuaa

SEQ ID NO: 27509 - DNA, 27 bp, Artificial Sequence
  Synthetic
ctccaggtttucgattttctgtatucc

SEQ ID NO: 27510 - DNA, 25 bp, Artificial Sequence
  Synthetic
tttgacttctgcugaccttacctuc

SEQ ID NO: 27511 - DNA, 28 bp, Artificial Sequence
  Synthetic
ggtgctttttcgutgtttttgttttugt

SEQ ID NO: 27512 - DNA, 26 bp, Artificial Sequence
  Synthetic
cccggttaucagacagattcctaaut

SEQ ID NO: 27513 - DNA, 28 bp, Artificial Sequence
  Synthetic
aatgtgatcagaaggcutttctcttcut

SEQ ID NO: 27514 - DNA, 26 bp, Artificial Sequence
  Synthetic
gaagaagaucacagacagcatugaag

SEQ ID NO: 27515 - DNA, 25 bp, Artificial Sequence
  Synthetic
ttgcctaatcucaaaggaactcugg

SEQ ID NO: 27516 - DNA, 25 bp, Artificial Sequence
  Synthetic
gaaacaaggcagaagauggagcuat

SEQ ID NO: 27517 - DNA, 20 bp, Artificial Sequence
  Synthetic
tgacgacaguagcaggguct

SEQ ID NO: 27518 - DNA, 22 bp, Artificial Sequence
  Synthetic
gauggagaucaagagccagagg

SEQ ID NO: 27519 - DNA, 20 bp, Artificial Sequence
  Synthetic
tgtgtgttuctccgcucaca

SEQ ID NO: 27520 - DNA, 26 bp, Artificial Sequence
  Synthetic
tgauggaacgagaauggaagattuag

SEQ ID NO: 27521 - DNA, 33 bp, Artificial Sequence
  Synthetic
ctaacagtaaaactgauacttatctccaagaut

SEQ ID NO: 27522 - DNA, 27 bp, Artificial Sequence
  Synthetic
agaatatgtgcuttccgaagatugagg

SEQ ID NO: 27523 - DNA, 24 bp, Artificial Sequence
  Synthetic
tggtgtctugttttcggattucca

SEQ ID NO: 27524 - DNA, 20 bp, Artificial Sequence
  Synthetic
acaggucacccttcctucca

SEQ ID NO: 27525 - DNA, 23 bp, Artificial Sequence
  Synthetic
gggaaaacuatgatgcttucggt

SEQ ID NO: 27526 - DNA, 22 bp, Artificial Sequence
  Synthetic
gggatcuggaaccgagtuacat

SEQ ID NO: 27527 - DNA, 18 bp, Artificial Sequence
  Synthetic
gccctgguacgtgtugcc

SEQ ID NO: 27528 - DNA, 19 bp, Artificial Sequence
  Synthetic
cgaguggacgcacggatuc

SEQ ID NO: 27529 - DNA, 20 bp, Artificial Sequence
  Synthetic
ggaggacgcagcucaactuc

SEQ ID NO: 27530 - DNA, 18 bp, Artificial Sequence
  Synthetic
ggcagagcgucccgtaug

SEQ ID NO: 27531 - DNA, 21 bp, Artificial Sequence
  Synthetic
aaacagccccutcttctugct

SEQ ID NO: 27532 - DNA, 17 bp, Artificial Sequence
  Synthetic
gagcaccgucagcucca

SEQ ID NO: 27533 - DNA, 17 bp, Artificial Sequence
  Synthetic
cggttgcuggcccacuc

SEQ ID NO: 27534 - DNA, 23 bp, Artificial Sequence
  Synthetic
gcaaguacaagcagaacatccuc

SEQ ID NO: 27535 - DNA, 22 bp, Artificial Sequence
  Synthetic
ctgaacagacugggcucacaaa

SEQ ID NO: 27536 - DNA, 17 bp, Artificial Sequence
  Synthetic
cggccucgctguggaat

SEQ ID NO: 27537 - DNA, 18 bp, Artificial Sequence
  Synthetic
tcaggucggagggagugg

SEQ ID NO: 27538 - DNA, 19 bp, Artificial Sequence
  Synthetic
acaaggucgcccacttcuc

SEQ ID NO: 27539 - DNA, 17 bp, Artificial Sequence
  Synthetic
gaaccucgggugcggaa

SEQ ID NO: 27540 - DNA, 21 bp, Artificial Sequence
  Synthetic
gaagcugagcaacuaccggat

SEQ ID NO: 27541 - DNA, 23 bp, Artificial Sequence
  Synthetic
gcctgaagtuctccttgttcugg

SEQ ID NO: 27542 - DNA, 21 bp, Artificial Sequence
  Synthetic
gcgttgggacutgaccttcuc

SEQ ID NO: 27543 - DNA, 21 bp, Artificial Sequence
  Synthetic
gcuggaaacccucaggaaaca

SEQ ID NO: 27544 - DNA, 23 bp, Artificial Sequence
  Synthetic
catcggagucgccattctgttua

SEQ ID NO: 27545 - DNA, 22 bp, Artificial Sequence
  Synthetic
aggcaaacugtgagtgauaccc

SEQ ID NO: 27546 - DNA, 26 bp, Artificial Sequence
  Synthetic
acgatttttaguctgcattgcttugg

SEQ ID NO: 27547 - DNA, 29 bp, Artificial Sequence
  Synthetic
gctcagctgctuctttaaacagatacaua

SEQ ID NO: 27548 - DNA, 25 bp, Artificial Sequence
  Synthetic
gtgtctgttgcucatgtgtttgtut

SEQ ID NO: 27549 - DNA, 21 bp, Artificial Sequence
  Synthetic
cagcatctcguggacaaaguc

SEQ ID NO: 27550 - DNA, 20 bp, Artificial Sequence
  Synthetic
gtagggtugctcgtctgucc

SEQ ID NO: 27551 - DNA, 29 bp, Artificial Sequence
  Synthetic
gttcaagcaucaacaaatacauccaacat

SEQ ID NO: 27552 - DNA, 17 bp, Artificial Sequence
  Synthetic
ctggcaucgtgctgcug

SEQ ID NO: 27553 - DNA, 19 bp, Artificial Sequence
  Synthetic
cctctgcucacaccuccct

SEQ ID NO: 27554 - DNA, 18 bp, Artificial Sequence
  Synthetic
ctgugggaagacgcugct

SEQ ID NO: 27555 - DNA, 19 bp, Artificial Sequence
  Synthetic
acccgtguccctttcaguc

SEQ ID NO: 27556 - DNA, 21 bp, Artificial Sequence
  Synthetic
gtgcggagccucttuaaggaa

SEQ ID NO: 27557 - DNA, 24 bp, Artificial Sequence
  Synthetic
caacctgtuctgaaagacaucgga

SEQ ID NO: 27558 - DNA, 19 bp, Artificial Sequence
  Synthetic
agggtcatucgctctgcug

SEQ ID NO: 27559 - DNA, 22 bp, Artificial Sequence
  Synthetic
ggctctgcauaaagggactugt

SEQ ID NO: 27560 - DNA, 23 bp, Artificial Sequence
  Synthetic
ctgtggcaguaactaggctugag

SEQ ID NO: 27561 - DNA, 19 bp, Artificial Sequence
  Synthetic
gctgcgggutgagaacgua

SEQ ID NO: 27562 - DNA, 21 bp, Artificial Sequence
  Synthetic
ccaactcauaccccggcatuc

SEQ ID NO: 27563 - DNA, 20 bp, Artificial Sequence
  Synthetic
ccccagucagcuacagacac

SEQ ID NO: 27564 - DNA, 18 bp, Artificial Sequence
  Synthetic
ggtggtgcugcctcagug

SEQ ID NO: 27565 - DNA, 19 bp, Artificial Sequence
  Synthetic
caggtgccaucccaaacug

SEQ ID NO: 27566 - DNA, 21 bp, Artificial Sequence
  Synthetic
tgacacagtuccctccacuca

SEQ ID NO: 27567 - DNA, 24 bp, Artificial Sequence
  Synthetic
gccutggaaatactucacgagagg

SEQ ID NO: 27568 - DNA, 22 bp, Artificial Sequence
  Synthetic
cccaugggccgaagaaaaugat

SEQ ID NO: 27569 - DNA, 22 bp, Artificial Sequence
  Synthetic
ctcagcugaaaagcaacucagg

SEQ ID NO: 27570 - DNA, 19 bp, Artificial Sequence
  Synthetic
ttccuctgctcugggacca

SEQ ID NO: 27571 - DNA, 21 bp, Artificial Sequence
  Synthetic
cccaggagccucatctctuct

SEQ ID NO: 27572 - DNA, 22 bp, Artificial Sequence
  Synthetic
aggcagcugtcaattctcaugt

SEQ ID NO: 27573 - DNA, 24 bp, Artificial Sequence
  Synthetic
cctgtgagttugcctgttttcuct

SEQ ID NO: 27574 - DNA, 23 bp, Artificial Sequence
  Synthetic
aggtgaaacugtgcttgtauccc

SEQ ID NO: 27575 - DNA, 22 bp, Artificial Sequence
  Synthetic
gctccacagaugagcagtaucc

SEQ ID NO: 27576 - DNA, 22 bp, Artificial Sequence
  Synthetic
ctcaaggagggcucgttctuaa

SEQ ID NO: 27577 - DNA, 21 bp, Artificial Sequence
  Synthetic
ttggtctccugcggttuacag

SEQ ID NO: 27578 - DNA, 27 bp, Artificial Sequence
  Synthetic
gattgaaaccaagcutgcgagaaaaua

SEQ ID NO: 27579 - DNA, 20 bp, Artificial Sequence
  Synthetic
tgcaaugaccccgttctcuc

SEQ ID NO: 27580 - DNA, 21 bp, Artificial Sequence
  Synthetic
ctgtggaguctcccactcauc

SEQ ID NO: 27581 - DNA, 24 bp, Artificial Sequence
  Synthetic
ttcactctacuagttgtgggucct

SEQ ID NO: 27582 - DNA, 20 bp, Artificial Sequence
  Synthetic
acugacagaucggacggaca

SEQ ID NO: 27583 - DNA, 23 bp, Artificial Sequence
  Synthetic
ccaccaauacagccccttcttuc

SEQ ID NO: 27584 - DNA, 24 bp, Artificial Sequence
  Synthetic
ccgcgccuggcaataaatatctua

SEQ ID NO: 27585 - DNA, 28 bp, Artificial Sequence
  Synthetic
ggcgatacugaggaggattttattguat

SEQ ID NO: 27586 - DNA, 21 bp, Artificial Sequence
  Synthetic
ggccaggguagctctttucaa

SEQ ID NO: 27587 - DNA, 26 bp, Artificial Sequence
  Synthetic
tttataaacctgucggtggattgugt

SEQ ID NO: 27588 - DNA, 23 bp, Artificial Sequence
  Synthetic
ggutctgtgtguccagagagaga

SEQ ID NO: 27589 - DNA, 22 bp, Artificial Sequence
  Synthetic
ggtctgttuccacctgagcaut

SEQ ID NO: 27590 - DNA, 23 bp, Artificial Sequence
  Synthetic
gctgcacaaaguatctcgugact

SEQ ID NO: 27591 - DNA, 28 bp, Artificial Sequence
  Synthetic
cggaatgcacuaaattcagttttaugaa

SEQ ID NO: 27592 - DNA, 21 bp, Artificial Sequence
  Synthetic
aatccctcgucctacagguca

SEQ ID NO: 27593 - DNA, 24 bp, Artificial Sequence
  Synthetic
cctggaaaautccagctuggaaga

SEQ ID NO: 27594 - DNA, 20 bp, Artificial Sequence
  Synthetic
agacgagcucatgaguccct

SEQ ID NO: 27595 - DNA, 23 bp, Artificial Sequence
  Synthetic
cgctcatgagaacugtgtctcug

SEQ ID NO: 27596 - DNA, 22 bp, Artificial Sequence
  Synthetic
gcacacaugagacacagcauga

SEQ ID NO: 27597 - DNA, 26 bp, Artificial Sequence
  Synthetic
atctggtttcutccttcttcucacag

SEQ ID NO: 27598 - DNA, 30 bp, Artificial Sequence
  Synthetic
ggtctaacaaattuctctacagaagaucca

SEQ ID NO: 27599 - DNA, 24 bp, Artificial Sequence
  Synthetic
tgtgaccagutgtguagaaagcaa

SEQ ID NO: 27600 - DNA, 23 bp, Artificial Sequence
  Synthetic
catcagagcagaguctgcacaua

SEQ ID NO: 27601 - DNA, 26 bp, Artificial Sequence
  Synthetic
ttctttttccttucctccctgtaugg

SEQ ID NO: 27602 - DNA, 26 bp, Artificial Sequence
  Synthetic
tcuatagaaacctucagggaagacac

SEQ ID NO: 27603 - DNA, 22 bp, Artificial Sequence
  Synthetic
tgcgctcugctatctatccuca

SEQ ID NO: 27604 - DNA, 22 bp, Artificial Sequence
  Synthetic
ggccttcugggaagatcaggua

SEQ ID NO: 27605 - DNA, 27 bp, Artificial Sequence
  Synthetic
gctgtgactaugtcatggttctuaact

SEQ ID NO: 27606 - DNA, 23 bp, Artificial Sequence
  Synthetic
gcaggcagcaugacaagtacuag

SEQ ID NO: 27607 - DNA, 28 bp, Artificial Sequence
  Synthetic
tgatctctgacutgaagtttttgtcugt

SEQ ID NO: 27608 - DNA, 21 bp, Artificial Sequence
  Synthetic
gggacaaacautggugcagga

SEQ ID NO: 27609 - DNA, 29 bp, Artificial Sequence
  Synthetic
tgtctgccaaatuaaagagccaagataut

SEQ ID NO: 27610 - DNA, 26 bp, Artificial Sequence
  Synthetic
cagaggagaaauacctcaaauggaaa

SEQ ID NO: 27611 - DNA, 30 bp, Artificial Sequence
  Synthetic
gcaggtatcacacaaautacagaagatuac

SEQ ID NO: 27612 - DNA, 25 bp, Artificial Sequence
  Synthetic
ctugagaguagaaggcattaucaca

SEQ ID NO: 27613 - DNA, 24 bp, Artificial Sequence
  Synthetic
gggatttagtugagccttacguct

SEQ ID NO: 27614 - DNA, 23 bp, Artificial Sequence
  Synthetic
agatcaacagaacautgccugga

SEQ ID NO: 27615 - DNA, 29 bp, Artificial Sequence
  Synthetic
ggttgggaaaauaggacatagctttagua

SEQ ID NO: 27616 - DNA, 28 bp, Artificial Sequence
  Synthetic
tgaactagaatgautagcataggccuca

SEQ ID NO: 27617 - DNA, 23 bp, Artificial Sequence
  Synthetic
cctcccaaaguactgggatuaca

SEQ ID NO: 27618 - DNA, 17 bp, Artificial Sequence
  Synthetic
gccatgccugggcugac

SEQ ID NO: 27619 - DNA, 20 bp, Artificial Sequence
  Synthetic
cttctcugggatcccugcac

SEQ ID NO: 27620 - DNA, 20 bp, Artificial Sequence
  Synthetic
ggugagcttgguggagaacg

SEQ ID NO: 27621 - DNA, 21 bp, Artificial Sequence
  Synthetic
ctgcaggugatcacgtcaaug

SEQ ID NO: 27622 - DNA, 19 bp, Artificial Sequence
  Synthetic
tggccagugtcgtctucag

SEQ ID NO: 27623 - DNA, 20 bp, Artificial Sequence
  Synthetic
caggatggugagggugacag

SEQ ID NO: 27624 - DNA, 24 bp, Artificial Sequence
  Synthetic
cctcatcatcugcaatgccaucat

SEQ ID NO: 27625 - DNA, 27 bp, Artificial Sequence
  Synthetic
catttaguccatcctcttugacaaacg

SEQ ID NO: 27626 - DNA, 20 bp, Artificial Sequence
  Synthetic
ctccaggcaggacutcucac

SEQ ID NO: 27627 - DNA, 20 bp, Artificial Sequence
  Synthetic
cttcacaucccagcugacga

SEQ ID NO: 27628 - DNA, 23 bp, Artificial Sequence
  Synthetic
ctccugcaaaaggaggtgaaauc

SEQ ID NO: 27629 - DNA, 22 bp, Artificial Sequence
  Synthetic
ctggtcacugagtcaggcatut

SEQ ID NO: 27630 - DNA, 20 bp, Artificial Sequence
  Synthetic
acaaaccagccccugaacuc

SEQ ID NO: 27631 - DNA, 17 bp, Artificial Sequence
  Synthetic
cugcggaucgggaggac

SEQ ID NO: 27632 - DNA, 22 bp, Artificial Sequence
  Synthetic
tccctactgcuatccccacauc

SEQ ID NO: 27633 - DNA, 21 bp, Artificial Sequence
  Synthetic
ctgtacacugacggccuacaa

SEQ ID NO: 27634 - DNA, 21 bp, Artificial Sequence
  Synthetic
ccccaccauacttccucccaa

SEQ ID NO: 27635 - DNA, 28 bp, Artificial Sequence
  Synthetic
attcagctctguactcctctttaccuat

SEQ ID NO: 27636 - DNA, 26 bp, Artificial Sequence
  Synthetic
gtctgagtttuaggcacaaaaugagt

SEQ ID NO: 27637 - DNA, 23 bp, Artificial Sequence
  Synthetic
tgacactcccugcctgttttuag

SEQ ID NO: 27638 - DNA, 22 bp, Artificial Sequence
  Synthetic
gaggtgaugatctcaucgccat

SEQ ID NO: 27639 - DNA, 26 bp, Artificial Sequence
  Synthetic
gggauccttgtaatauaacccacacc

SEQ ID NO: 27640 - DNA, 23 bp, Artificial Sequence
  Synthetic
aagatcagauccttgagcugcac

SEQ ID NO: 27641 - DNA, 24 bp, Artificial Sequence
  Synthetic
accccactcutccaaatctttucc

SEQ ID NO: 27642 - DNA, 23 bp, Artificial Sequence
  Synthetic
gatgagaaacagccugaagguct

SEQ ID NO: 27643 - DNA, 27 bp, Artificial Sequence
  Synthetic
ttgatctgggaggguagagactaaaut

SEQ ID NO: 27644 - DNA, 21 bp, Artificial Sequence
  Synthetic
gccttctucccagcatgtgua

SEQ ID NO: 27645 - DNA, 27 bp, Artificial Sequence
  Synthetic
actgagccutatttgtcttcucagaac

SEQ ID NO: 27646 - DNA, 22 bp, Artificial Sequence
  Synthetic
gcctggccugaaaatacauggt

SEQ ID NO: 27647 - DNA, 26 bp, Artificial Sequence
  Synthetic
ccacccagaaauactggattgacauc

SEQ ID NO: 27648 - DNA, 24 bp, Artificial Sequence
  Synthetic
ggcagacaggacaautccuaaagt

SEQ ID NO: 27649 - DNA, 28 bp, Artificial Sequence
  Synthetic
catataagaugaactcttcctgugcaga

SEQ ID NO: 27650 - DNA, 19 bp, Artificial Sequence
  Synthetic
cctcucccctcgatuccag

SEQ ID NO: 27651 - DNA, 28 bp, Artificial Sequence
  Synthetic
ctcttgatctcuaatgtcacattgucgt

SEQ ID NO: 27652 - DNA, 22 bp, Artificial Sequence
  Synthetic
ggttgtgacagguccctcuaag

SEQ ID NO: 27653 - DNA, 19 bp, Artificial Sequence
  Synthetic
tgcctgccutgccatcuag

SEQ ID NO: 27654 - DNA, 21 bp, Artificial Sequence
  Synthetic
cctgaacuccacacggtucaa

SEQ ID NO: 27655 - DNA, 22 bp, Artificial Sequence
  Synthetic
cttguaccgctacauacagcca

SEQ ID NO: 27656 - DNA, 23 bp, Artificial Sequence
  Synthetic
ggcctgagcaauagggttuagaa

SEQ ID NO: 27657 - DNA, 25 bp, Artificial Sequence
  Synthetic
ccagacacgtaucaagattggacuc

SEQ ID NO: 27658 - DNA, 23 bp, Artificial Sequence
  Synthetic
ggugtgaaaugagcagaggacag

SEQ ID NO: 27659 - DNA, 28 bp, Artificial Sequence
  Synthetic
gacatgttaaccutgactttgtggttua

SEQ ID NO: 27660 - DNA, 22 bp, Artificial Sequence
  Synthetic
cgaagccacacaugtugaacag

SEQ ID NO: 27661 - DNA, 26 bp, Artificial Sequence
  Synthetic
tttgaagggaagutcctuccaagaaa

SEQ ID NO: 27662 - DNA, 21 bp, Artificial Sequence
  Synthetic
agtacccugcaaggcuaggaa

SEQ ID NO: 27663 - DNA, 26 bp, Artificial Sequence
  Synthetic
agtattatggccuggtgatggattug

SEQ ID NO: 27664 - DNA, 23 bp, Artificial Sequence
  Synthetic
gacaagcacuccacacacaatuc

SEQ ID NO: 27665 - DNA, 28 bp, Artificial Sequence
  Synthetic
ccgctttgagaagaugtatgagaagauc

SEQ ID NO: 27666 - DNA, 26 bp, Artificial Sequence
  Synthetic
catcaagagaguaaaccaatcaugct

SEQ ID NO: 27667 - DNA, 22 bp, Artificial Sequence
  Synthetic
gatgcttaccuggaccaguacc

SEQ ID NO: 27668 - DNA, 22 bp, Artificial Sequence
  Synthetic
gguagaaccaaaggcaacugct

SEQ ID NO: 27669 - DNA, 22 bp, Artificial Sequence
  Synthetic
cacccttcccautgcttttguc

SEQ ID NO: 27670 - DNA, 25 bp, Artificial Sequence
  Synthetic
cagaacaaggutcagtcacaacuct

SEQ ID NO: 27671 - DNA, 22 bp, Artificial Sequence
  Synthetic
ccactguggacaagactgttug

SEQ ID NO: 27672 - DNA, 21 bp, Artificial Sequence
  Synthetic
ggagccagauagcccccuaat

SEQ ID NO: 27673 - DNA, 24 bp, Artificial Sequence
  Synthetic
gcatgatatuctggacatgaugcc

SEQ ID NO: 27674 - DNA, 22 bp, Artificial Sequence
  Synthetic
gggcagguactttugaagcaat

SEQ ID NO: 27675 - DNA, 29 bp, Artificial Sequence
  Synthetic
gtattcttaacttcugcttgggatcguag

SEQ ID NO: 27676 - DNA, 23 bp, Artificial Sequence
  Synthetic
cccatcagaccuggagctuaaac

SEQ ID NO: 27677 - DNA, 23 bp, Artificial Sequence
  Synthetic
cgggaagttcugcgtttgacuaa

SEQ ID NO: 27678 - DNA, 23 bp, Artificial Sequence
  Synthetic
gagcaauggacccaactgatgua

SEQ ID NO: 27679 - DNA, 23 bp, Artificial Sequence
  Synthetic
gcaaaaaccucaactaccugcac

SEQ ID NO: 27680 - DNA, 23 bp, Artificial Sequence
  Synthetic
gaggtgggaacauggagaguaag

SEQ ID NO: 27681 - DNA, 24 bp, Artificial Sequence
  Synthetic
ccaaactctggugggcttatttut

SEQ ID NO: 27682 - DNA, 22 bp, Artificial Sequence
  Synthetic
gcaatgccautggctgtatugt

SEQ ID NO: 27683 - DNA, 27 bp, Artificial Sequence
  Synthetic
ctcatcttaaguctgtgcctagtucag

SEQ ID NO: 27684 - DNA, 22 bp, Artificial Sequence
  Synthetic
ccaaccuaaacagcagcctuct

SEQ ID NO: 27685 - DNA, 28 bp, Artificial Sequence
  Synthetic
gtctgcttattctugatgttgtacccua

SEQ ID NO: 27686 - DNA, 22 bp, Artificial Sequence
  Synthetic
aaggccutcaaaucaaacaggt

SEQ ID NO: 27687 - DNA, 25 bp, Artificial Sequence
  Synthetic
tttgtctagcugcttacttgaggug

SEQ ID NO: 27688 - DNA, 21 bp, Artificial Sequence
  Synthetic
cctccaguggctcaacatcua

SEQ ID NO: 27689 - DNA, 25 bp, Artificial Sequence
  Synthetic
tgggtagaaauggttgtgtgatguc

SEQ ID NO: 27690 - DNA, 22 bp, Artificial Sequence
  Synthetic
ccaccaagaugagctgucaaag

SEQ ID NO: 27691 - DNA, 24 bp, Artificial Sequence
  Synthetic
ggaagatcautcgagaccauggag

SEQ ID NO: 27692 - DNA, 17 bp, Artificial Sequence
  Synthetic
gccgcuccacactcucg

SEQ ID NO: 27693 - DNA, 20 bp, Artificial Sequence
  Synthetic
cctttctgcugcgcttctug

SEQ ID NO: 27694 - DNA, 31 bp, Artificial Sequence
  Synthetic
caaaggagggacauaccactatatcagauaa

SEQ ID NO: 27695 - DNA, 23 bp, Artificial Sequence
  Synthetic
agaagagaccucccaaagctgua

SEQ ID NO: 27696 - DNA, 28 bp, Artificial Sequence
  Synthetic
ctttgtctugaggatcatagtuaagcca

SEQ ID NO: 27697 - DNA, 32 bp, Artificial Sequence
  Synthetic
aatgcagaagaatgutattttcagaaagttua

SEQ ID NO: 27698 - DNA, 24 bp, Artificial Sequence
  Synthetic
aatttacgtcagguggacctctug

SEQ ID NO: 27699 - DNA, 23 bp, Artificial Sequence
  Synthetic
gcctcccgutaagtctgctttua

SEQ ID NO: 27700 - DNA, 27 bp, Artificial Sequence
  Synthetic
catggtaaaaucccatggtcaatugat

SEQ ID NO: 27701 - DNA, 28 bp, Artificial Sequence
  Synthetic
gctgatgccttutcaactaaacttacut

SEQ ID NO: 27702 - DNA, 22 bp, Artificial Sequence
  Synthetic
ggccaaaucaagatggcacuct

SEQ ID NO: 27703 - DNA, 30 bp, Artificial Sequence
  Synthetic
tcagataucagcaataaaaccaugaagaca

SEQ ID NO: 27704 - DNA, 28 bp, Artificial Sequence
  Synthetic
tgtttttaaggugggtcatgataacugg

SEQ ID NO: 27705 - DNA, 28 bp, Artificial Sequence
  Synthetic
cactccaaaauctaatgtucagagacct

SEQ ID NO: 27706 - DNA, 27 bp, Artificial Sequence
  Synthetic
cagcgtagaucaaacagtaaaagtgug

SEQ ID NO: 27707 - DNA, 29 bp, Artificial Sequence
  Synthetic
agtatacaatttggautcaccatgcauga

SEQ ID NO: 27708 - DNA, 21 bp, Artificial Sequence
  Synthetic
gacccagugcctcatgtcaut

SEQ ID NO: 27709 - DNA, 24 bp, Artificial Sequence
  Synthetic
ctgaaatcugaacagacugagcca

SEQ ID NO: 27710 - DNA, 23 bp, Artificial Sequence
  Synthetic
gcatcggatugaacctcagtcut

SEQ ID NO: 27711 - DNA, 20 bp, Artificial Sequence
  Synthetic
tcugaaggagacucccacgt

SEQ ID NO: 27712 - DNA, 17 bp, Artificial Sequence
  Synthetic
ccccugccctgtctugt

SEQ ID NO: 27713 - DNA, 21 bp, Artificial Sequence
  Synthetic
ccatgugggcagagatguagg

SEQ ID NO: 27714 - DNA, 23 bp, Artificial Sequence
  Synthetic
tcaaauaccccaacggagugaac

SEQ ID NO: 27715 - DNA, 21 bp, Artificial Sequence
  Synthetic
ctctgccgugtcttctgucaa

SEQ ID NO: 27716 - DNA, 22 bp, Artificial Sequence
  Synthetic
tcgcatttgucaccatgaucgt

SEQ ID NO: 27717 - DNA, 20 bp, Artificial Sequence
  Synthetic
gccatguagctctcaccuct

SEQ ID NO: 27718 - DNA, 23 bp, Artificial Sequence
  Synthetic
ccaaccuaacaccagcttctguc

SEQ ID NO: 27719 - DNA, 23 bp, Artificial Sequence
  Synthetic
ggtgctagtucagctggtcauac

SEQ ID NO: 27720 - DNA, 18 bp, Artificial Sequence
  Synthetic
ggagaccacuctgcucct

SEQ ID NO: 27721 - DNA, 18 bp, Artificial Sequence
  Synthetic
cttcggcugcaagctugg

SEQ ID NO: 27722 - DNA, 23 bp, Artificial Sequence
  Synthetic
gagcctatgugaaccctttccuc

SEQ ID NO: 27723 - DNA, 19 bp, Artificial Sequence
  Synthetic
cgccgtguatccagcctua

SEQ ID NO: 27724 - DNA, 21 bp, Artificial Sequence
  Synthetic
gtcaguaaagaggcagcugca

SEQ ID NO: 27725 - DNA, 18 bp, Artificial Sequence
  Synthetic
cccaccccggugtttucc

SEQ ID NO: 27726 - DNA, 24 bp, Artificial Sequence
  Synthetic
tggctttttcaguatcagctccuc

SEQ ID NO: 27727 - DNA, 20 bp, Artificial Sequence
  Synthetic
gggcttcguactaaccucgt

SEQ ID NO: 27728 - DNA, 17 bp, Artificial Sequence
  Synthetic
gtccgcugggacacgut

SEQ ID NO: 27729 - DNA, 20 bp, Artificial Sequence
  Synthetic
guaccaggagaagucgtgut

SEQ ID NO: 27730 - DNA, 18 bp, Artificial Sequence
  Synthetic
cuggagggagagccagug

SEQ ID NO: 27731 - DNA, 21 bp, Artificial Sequence
  Synthetic
gaagccgcucttctacgucat

SEQ ID NO: 27732 - DNA, 23 bp, Artificial Sequence
  Synthetic
cgtcuagaagcgggtttttcuga

SEQ ID NO: 27733 - DNA, 20 bp, Artificial Sequence
  Synthetic
cgctagaucccagctuccag

SEQ ID NO: 27734 - DNA, 20 bp, Artificial Sequence
  Synthetic
ggtcugcaccctcucagagt

SEQ ID NO: 27735 - DNA, 19 bp, Artificial Sequence
  Synthetic
ttccaucccccacccctua

SEQ ID NO: 27736 - DNA, 22 bp, Artificial Sequence
  Synthetic
ccagaagugggatttttggcut

SEQ ID NO: 27737 - DNA, 23 bp, Artificial Sequence
  Synthetic
gccaatgacccutccttctugac

SEQ ID NO: 27738 - DNA, 17 bp, Artificial Sequence
  Synthetic
gccagagcugggucaga

SEQ ID NO: 27739 - DNA, 22 bp, Artificial Sequence
  Synthetic
guccctcttgucacacacagac

SEQ ID NO: 27740 - DNA, 21 bp, Artificial Sequence
  Synthetic
ggaagtcccutccctgaacut

SEQ ID NO: 27741 - DNA, 22 bp, Artificial Sequence
  Synthetic
ggcaaattucagggctctggut

SEQ ID NO: 27742 - DNA, 17 bp, Artificial Sequence
  Synthetic
gggccaggguggttucc

SEQ ID NO: 27743 - DNA, 21 bp, Artificial Sequence
  Synthetic
aagccccgagucattcctuac

SEQ ID NO: 27744 - DNA, 21 bp, Artificial Sequence
  Synthetic
gccagugacaaccccagatuc

SEQ ID NO: 27745 - DNA, 20 bp, Artificial Sequence
  Synthetic
gctctccuagggttgccuca

SEQ ID NO: 27746 - DNA, 20 bp, Artificial Sequence
  Synthetic
ccacgcccugaataucccat

SEQ ID NO: 27747 - DNA, 21 bp, Artificial Sequence
  Synthetic
cccccaacccaaautcacuca

SEQ ID NO: 27748 - DNA, 22 bp, Artificial Sequence
  Synthetic
gctucaaacacagcagaggugt

SEQ ID NO: 27749 - DNA, 26 bp, Artificial Sequence
  Synthetic
agtgagacttcugtttgggttaccua

SEQ ID NO: 27750 - DNA, 22 bp, Artificial Sequence
  Synthetic
gccaagtcugacaaagccctut

SEQ ID NO: 27751 - DNA, 20 bp, Artificial Sequence
  Synthetic
cugagcacccaaacuggact

SEQ ID NO: 27752 - DNA, 21 bp, Artificial Sequence
  Synthetic
cacatcucagcacgggcauat

SEQ ID NO: 27753 - DNA, 21 bp, Artificial Sequence
  Synthetic
cagcagucaggactcactguc

SEQ ID NO: 27754 - DNA, 20 bp, Artificial Sequence
  Synthetic
caggguggtgtauggcaact

SEQ ID NO: 27755 - DNA, 18 bp, Artificial Sequence
  Synthetic
cggctgcaguccctgaug

SEQ ID NO: 27756 - DNA, 23 bp, Artificial Sequence
  Synthetic
ccctttcctcuccttgagacuaa

SEQ ID NO: 27757 - DNA, 17 bp, Artificial Sequence
  Synthetic
ctgcggcucaggcatuc

SEQ ID NO: 27758 - DNA, 18 bp, Artificial Sequence
  Synthetic
gctgccaagcucagguga

SEQ ID NO: 27759 - DNA, 17 bp, Artificial Sequence
  Synthetic
gcccuggccgggaguat

SEQ ID NO: 27760 - DNA, 18 bp, Artificial Sequence
  Synthetic
gcaccagggcugcactua

SEQ ID NO: 27761 - DNA, 17 bp, Artificial Sequence
  Synthetic
gctggccugaccuccac

SEQ ID NO: 27762 - DNA, 23 bp, Artificial Sequence
  Synthetic
ggcttccuttggaaaucccaagt

SEQ ID NO: 27763 - DNA, 21 bp, Artificial Sequence
  Synthetic
cgggcttuggaagttctccua

SEQ ID NO: 27764 - DNA, 22 bp, Artificial Sequence
  Synthetic
gttctcuggcagctctagugac

SEQ ID NO: 27765 - DNA, 25 bp, Artificial Sequence
  Synthetic
aatgatagagcccauggatguagga

SEQ ID NO: 27766 - DNA, 22 bp, Artificial Sequence
  Synthetic
tctacctggucaacgtcatugc

SEQ ID NO: 27767 - DNA, 22 bp, Artificial Sequence
  Synthetic
tgaugctttggatuggcaggaa

SEQ ID NO: 27768 - DNA, 25 bp, Artificial Sequence
  Synthetic
tgacaaagtaccugagacctcacua

SEQ ID NO: 27769 - DNA, 25 bp, Artificial Sequence
  Synthetic
ggttggaggaggagauctttctuac

SEQ ID NO: 27770 - DNA, 20 bp, Artificial Sequence
  Synthetic
actggctguctttgcgttug

SEQ ID NO: 27771 - DNA, 19 bp, Artificial Sequence
  Synthetic
tccacccccgutggacaua

SEQ ID NO: 27772 - DNA, 20 bp, Artificial Sequence
  Synthetic
cccuccagacccctttccut

SEQ ID NO: 27773 - DNA, 28 bp, Artificial Sequence
  Synthetic
cccaaagaguaaatcagatgatacugca

SEQ ID NO: 27774 - DNA, 26 bp, Artificial Sequence
  Synthetic
caagaagtggagaaugtcagtcugag

SEQ ID NO: 27775 - DNA, 25 bp, Artificial Sequence
  Synthetic
cttcaaagcautggucagggaaaag

SEQ ID NO: 27776 - DNA, 22 bp, Artificial Sequence
  Synthetic
caaatgccccaautgcagguaa

SEQ ID NO: 27777 - DNA, 24 bp, Artificial Sequence
  Synthetic
cacctttcctugcctctttccuag

SEQ ID NO: 27778 - DNA, 21 bp, Artificial Sequence
  Synthetic
cagtgtgcaggguggcaagug

SEQ ID NO: 27779 - DNA, 26 bp, Artificial Sequence
  Synthetic
gcctcatctugggcctgtgttatcuc

SEQ ID NO: 27780 - DNA, 21 bp, Artificial Sequence
  Synthetic
gggccagaccuaagagcaauc

SEQ ID NO: 27781 - DNA, 22 bp, Artificial Sequence
  Synthetic
catggccauctacaagcaguca

SEQ ID NO: 27782 - DNA, 20 bp, Artificial Sequence
  Synthetic
acaucttgtugagggcaggg

SEQ ID NO: 27783 - DNA, 20 bp, Artificial Sequence
  Synthetic
tccugaggtguagacgccaa

SEQ ID NO: 27784 - DNA, 22 bp, Artificial Sequence
  Synthetic
cugggaagggauagaagaugac

SEQ ID NO: 27785 - DNA, 24 bp, Artificial Sequence
  Synthetic
tgactgctctuttcacccatcuac

SEQ ID NO: 27786 - DNA, 24 bp, Artificial Sequence
  Synthetic
aaagtcagucccatggaatttucg

SEQ ID NO: 27787 - DNA, 23 bp, Artificial Sequence
  Synthetic
ctggatccccacutttcctctug

SEQ ID NO: 27788 - DNA, 17 bp, Artificial Sequence
  Synthetic
ctgctucgcgcatucgg

SEQ ID NO: 27789 - DNA, 17 bp, Artificial Sequence
  Synthetic
ctccucgcacccugcaa

SEQ ID NO: 27790 - DNA, 19 bp, Artificial Sequence
  Synthetic
ggtcttccugccctucgac

SEQ ID NO: 27791 - DNA, 17 bp, Artificial Sequence
  Synthetic
cucccgggaccgtcuac

SEQ ID NO: 27792 - DNA, 17 bp, Artificial Sequence
  Synthetic
agcccccautcgtgcug

SEQ ID NO: 27793 - DNA, 21 bp, Artificial Sequence
  Synthetic
tccatggcgautgtctcagug

SEQ ID NO: 27794 - DNA, 23 bp, Artificial Sequence
  Synthetic
ctggtctctuctgacggaactug

SEQ ID NO: 27795 - DNA, 27 bp, Artificial Sequence
  Synthetic
ccaaattuacggaaagaagacaacugg

SEQ ID NO: 27796 - DNA, 23 bp, Artificial Sequence
  Synthetic
ctccccaucgtgggatttuaaga

SEQ ID NO: 27797 - DNA, 22 bp, Artificial Sequence
  Synthetic
ctgagaccuacctctguaccca

SEQ ID NO: 27798 - DNA, 22 bp, Artificial Sequence
  Synthetic
accucctcgcucagagagaaat

SEQ ID NO: 27799 - DNA, 24 bp, Artificial Sequence
  Synthetic
cccttggaaugggtaggguaagag

SEQ ID NO: 27800 - DNA, 20 bp, Artificial Sequence
  Synthetic
tggtgagggugggagtctut

SEQ ID NO: 27801 - DNA, 21 bp, Artificial Sequence
  Synthetic
actgcggcacacuacttctug

SEQ ID NO: 27802 - DNA, 19 bp, Artificial Sequence
  Synthetic
ggucagaggcagccttugt

SEQ ID NO: 27803 - DNA, 17 bp, Artificial Sequence
  Synthetic
ccacucccagccccuga

SEQ ID NO: 27804 - DNA, 19 bp, Artificial Sequence
  Synthetic
tcactgccugccatcccua

SEQ ID NO: 27805 - DNA, 23 bp, Artificial Sequence
  Synthetic
gtgtagagaucgttgagcagguc

SEQ ID NO: 27806 - DNA, 20 bp, Artificial Sequence
  Synthetic
acaagaggcaaucgctucgt

SEQ ID NO: 27807 - DNA, 20 bp, Artificial Sequence
  Synthetic
gggaaccucaggcatauggc

SEQ ID NO: 27808 - DNA, 23 bp, Artificial Sequence
  Synthetic
gtggagauaatgggugcgaagat

SEQ ID NO: 27809 - DNA, 20 bp, Artificial Sequence
  Synthetic
gtcttguccccgtcacacuc

SEQ ID NO: 27810 - DNA, 18 bp, Artificial Sequence
  Synthetic
tcaccccaguccgccuaa

SEQ ID NO: 27811 - DNA, 17 bp, Artificial Sequence
  Synthetic
ccacgucatcgcugcct

SEQ ID NO: 27812 - DNA, 20 bp, Artificial Sequence
  Synthetic
ggaaguggcccgtctgaauc

SEQ ID NO: 27813 - DNA, 23 bp, Artificial Sequence
  Synthetic
ctgctgguagttctgttgttugc

SEQ ID NO: 27814 - DNA, 24 bp, Artificial Sequence
  Synthetic
gcucgccaaggactattauaaccc

SEQ ID NO: 27815 - DNA, 20 bp, Artificial Sequence
  Synthetic
aggctctccucaccagcaua

SEQ ID NO: 27816 - DNA, 23 bp, Artificial Sequence
  Synthetic
ggtggccaaguatgaugagaact

SEQ ID NO: 27817 - DNA, 23 bp, Artificial Sequence
  Synthetic
ggaatgcugaggaaagtggguac

SEQ ID NO: 27818 - DNA, 18 bp, Artificial Sequence
  Synthetic
caugacaggccgcugact

SEQ ID NO: 27819 - DNA, 21 bp, Artificial Sequence
  Synthetic
cccgtagugctgatactuggc

SEQ ID NO: 27820 - DNA, 21 bp, Artificial Sequence
  Synthetic
cutcctacagtuccacaccgt

SEQ ID NO: 27821 - DNA, 21 bp, Artificial Sequence
  Synthetic
caggttcucagggagcttguc

SEQ ID NO: 27822 - DNA, 20 bp, Artificial Sequence
  Synthetic
gcauaaaagccagcacugca

SEQ ID NO: 27823 - DNA, 20 bp, Artificial Sequence
  Synthetic
ggcctucgagttgctgtuga

SEQ ID NO: 27824 - DNA, 19 bp, Artificial Sequence
  Synthetic
agagccuacacggcaguct

SEQ ID NO: 27825 - DNA, 20 bp, Artificial Sequence
  Synthetic
guggttcuccagcgagaagg

SEQ ID NO: 27826 - DNA, 20 bp, Artificial Sequence
  Synthetic
gcaaugccaaggactucagc

SEQ ID NO: 27827 - DNA, 20 bp, Artificial Sequence
  Synthetic
ggutgtguccgggaaacagt

SEQ ID NO: 27828 - DNA, 18 bp, Artificial Sequence
  Synthetic
gctuaccaagggccugga

SEQ ID NO: 27829 - DNA, 19 bp, Artificial Sequence
  Synthetic
cacctgccucctcctucac

SEQ ID NO: 27830 - DNA, 21 bp, Artificial Sequence
  Synthetic
cctggaagcugaggaggagua

SEQ ID NO: 27831 - DNA, 20 bp, Artificial Sequence
  Synthetic
ctctggaccuttgacucggt

SEQ ID NO: 27832 - DNA, 22 bp, Artificial Sequence
  Synthetic
caucgcaaagaaagaguctgug

SEQ ID NO: 27833 - DNA, 24 bp, Artificial Sequence
  Synthetic
gtgagagaacgaguacacatccug

SEQ ID NO: 27834 - DNA, 18 bp, Artificial Sequence
  Synthetic
cccgaugggcuccaagac

SEQ ID NO: 27835 - DNA, 20 bp, Artificial Sequence
  Synthetic
ggctgcuggagacctugaat

SEQ ID NO: 27836 - DNA, 22 bp, Artificial Sequence
  Synthetic
tcaaaaggaagucggcctucat

SEQ ID NO: 27837 - DNA, 18 bp, Artificial Sequence
  Synthetic
attgccctuggtgggcut

SEQ ID NO: 27838 - DNA, 22 bp, Artificial Sequence
  Synthetic
ccatcgugcagaagatcaccuc

SEQ ID NO: 27839 - DNA, 21 bp, Artificial Sequence
  Synthetic
cauaacggaucagccccagaa

SEQ ID NO: 27840 - DNA, 21 bp, Artificial Sequence
  Synthetic
caaaaccgaggccutcacauc

SEQ ID NO: 27841 - DNA, 21 bp, Artificial Sequence
  Synthetic
tctttggctucttgcctccuc

SEQ ID NO: 27842 - DNA, 22 bp, Artificial Sequence
  Synthetic
acaccaccucttcaccctguaa

SEQ ID NO: 27843 - DNA, 21 bp, Artificial Sequence
  Synthetic
cagtgcauatggtggugaacg

SEQ ID NO: 27844 - DNA, 21 bp, Artificial Sequence
  Synthetic
cctcgttcuccttggaugcag

SEQ ID NO: 27845 - DNA, 21 bp, Artificial Sequence
  Synthetic
cttgaagtuggccgggtttug

SEQ ID NO: 27846 - DNA, 20 bp, Artificial Sequence
  Synthetic
tgccgctugagagaacacuc

SEQ ID NO: 27847 - DNA, 21 bp, Artificial Sequence
  Synthetic
actcatgttugcgaccctugt

SEQ ID NO: 27848 - DNA, 20 bp, Artificial Sequence
  Synthetic
ggccuaccagcctguaaagc

SEQ ID NO: 27849 - DNA, 20 bp, Artificial Sequence
  Synthetic
gctccaaugccctcctgtuc

SEQ ID NO: 27850 - DNA, 18 bp, Artificial Sequence
  Synthetic
agtccgaggucgtcggua

SEQ ID NO: 27851 - DNA, 21 bp, Artificial Sequence
  Synthetic
gatcaaggaucggctcuggac

SEQ ID NO: 27852 - DNA, 23 bp, Artificial Sequence
  Synthetic
cccacucctaacaaugaccagag

SEQ ID NO: 27853 - DNA, 21 bp, Artificial Sequence
  Synthetic
gtcctucgcaccaagaacuga

SEQ ID NO: 27854 - DNA, 18 bp, Artificial Sequence
  Synthetic
cggagccccuagccaaug

SEQ ID NO: 27855 - DNA, 25 bp, Artificial Sequence
  Synthetic
cccaccatguatctaatgatccugt

SEQ ID NO: 27856 - DNA, 20 bp, Artificial Sequence
  Synthetic
gucttcacguccagcaggat

SEQ ID NO: 27857 - DNA, 20 bp, Artificial Sequence
  Synthetic
acggccacacucactaaucg

SEQ ID NO: 27858 - DNA, 22 bp, Artificial Sequence
  Synthetic
gaaugccatucacaccagaagg

SEQ ID NO: 27859 - DNA, 21 bp, Artificial Sequence
  Synthetic
gtcaaugtggagauggacgct

SEQ ID NO: 27860 - DNA, 25 bp, Artificial Sequence
  Synthetic
cctccctgcauttcttttaagcuga

SEQ ID NO: 27861 - DNA, 20 bp, Artificial Sequence
  Synthetic
gtggaagccgacaucaaugg

SEQ ID NO: 27862 - DNA, 21 bp, Artificial Sequence
  Synthetic
ggatgttcuggcccaccatut

SEQ ID NO: 27863 - DNA, 25 bp, Artificial Sequence
  Synthetic
atgaagcaagagcutaatguaggct

SEQ ID NO: 27864 - DNA, 18 bp, Artificial Sequence
  Synthetic
ccaggcggucatugaggt

SEQ ID NO: 27865 - DNA, 20 bp, Artificial Sequence
  Synthetic
gtctcatccucccgcttcuc

SEQ ID NO: 27866 - DNA, 20 bp, Artificial Sequence
  Synthetic
cccttcauggagcuggagga

SEQ ID NO: 27867 - DNA, 20 bp, Artificial Sequence
  Synthetic
gggaauggaaagugccagac

SEQ ID NO: 27868 - DNA, 24 bp, Artificial Sequence
  Synthetic
ccactttguaagctcattctuggg

SEQ ID NO: 27869 - DNA, 27 bp, Artificial Sequence
  Synthetic
tgaattgacacuaatctctgcttgugt

SEQ ID NO: 27870 - DNA, 22 bp, Artificial Sequence
  Synthetic
gcatccauagggacugacaggt

SEQ ID NO: 27871 - DNA, 26 bp, Artificial Sequence
  Synthetic
gcctgggttaaguatgcagattacug

SEQ ID NO: 27872 - DNA, 22 bp, Artificial Sequence
  Synthetic
gucttacaaaaugaagcggccc

SEQ ID NO: 27873 - DNA, 24 bp, Artificial Sequence
  Synthetic
ttatcctgaugggttgtgttuggt

SEQ ID NO: 27874 - DNA, 23 bp, Artificial Sequence
  Synthetic
agacucagcaucagcaaaaacct

SEQ ID NO: 27875 - DNA, 32 bp, Artificial Sequence
  Synthetic
caacttctaatccuttgagtgtttttcatuct

SEQ ID NO: 27876 - DNA, 31 bp, Artificial Sequence
  Synthetic
gtcattagggagauacatatggatacacuca

SEQ ID NO: 27877 - DNA, 24 bp, Artificial Sequence
  Synthetic
ctctgcatugaaagttccccaaut

SEQ ID NO: 27878 - DNA, 31 bp, Artificial Sequence
  Synthetic
ggttaaccagaauatctttatgtaggatuca

SEQ ID NO: 27879 - DNA, 25 bp, Artificial Sequence
  Synthetic
ccatcucaagaggagctcatuaagg

SEQ ID NO: 27880 - DNA, 29 bp, Artificial Sequence
  Synthetic
gtcagataccacagcauctttacatugat

SEQ ID NO: 27881 - DNA, 30 bp, Artificial Sequence
  Synthetic
aaccugaattatcactaucagaacaaagca

SEQ ID NO: 27882 - DNA, 27 bp, Artificial Sequence
  Synthetic
agatatcagtguttggccaacaauaca

SEQ ID NO: 27883 - DNA, 27 bp, Artificial Sequence
  Synthetic
tcttggtgccauttatcgttttugaag

SEQ ID NO: 27884 - DNA, 26 bp, Artificial Sequence
  Synthetic
gcaaacacaaaaaccuggttccaaua

SEQ ID NO: 27885 - DNA, 29 bp, Artificial Sequence
  Synthetic
aattggaagacutgactgcaaauacaaac

SEQ ID NO: 27886 - DNA, 25 bp, Artificial Sequence
  Synthetic
tccuctgtgttctuagacagacact

SEQ ID NO: 27887 - DNA, 22 bp, Artificial Sequence
  Synthetic
cctagcccuttcacccauacac

SEQ ID NO: 27888 - DNA, 24 bp, Artificial Sequence
  Synthetic
caucaggtgtcucagaacaaacct

SEQ ID NO: 27889 - DNA, 22 bp, Artificial Sequence
  Synthetic
cagagggccaaaautgaaugct

SEQ ID NO: 27890 - DNA, 30 bp, Artificial Sequence
  Synthetic
ttctctaatgttautacggctaattgugct

SEQ ID NO: 27891 - DNA, 28 bp, Artificial Sequence
  Synthetic
aacgaaactggacucattactccaaaua

SEQ ID NO: 27892 - DNA, 25 bp, Artificial Sequence
  Synthetic
gcctgcagugatattaactgtcugt

SEQ ID NO: 27893 - DNA, 28 bp, Artificial Sequence
  Synthetic
gctcagtattugcagaatacatucaagg

SEQ ID NO: 27894 - DNA, 22 bp, Artificial Sequence
  Synthetic
gggttutcaaatgcugcacact

SEQ ID NO: 27895 - DNA, 22 bp, Artificial Sequence
  Synthetic
gcugaagaccccaaagatcuca

SEQ ID NO: 27896 - DNA, 26 bp, Artificial Sequence
  Synthetic
tttgttaacutcagctcugggaaagt

SEQ ID NO: 27897 - DNA, 30 bp, Artificial Sequence
  Synthetic
gaaatctaagcccaccuaattgtacugaat

SEQ ID NO: 27898 - DNA, 28 bp, Artificial Sequence
  Synthetic
cttatactgctgcutataggttcagcut

SEQ ID NO: 27899 - DNA, 29 bp, Artificial Sequence
  Synthetic
aagactccugaaatgataaaucagggaac

SEQ ID NO: 27900 - DNA, 25 bp, Artificial Sequence
  Synthetic
gtggctcaguaacaaatgctccuat

SEQ ID NO: 27901 - DNA, 31 bp, Artificial Sequence
  Synthetic
cgttctaaatgagguagatgaatattcuggt

SEQ ID NO: 27902 - DNA, 28 bp, Artificial Sequence
  Synthetic
ttcatcacttcuggaaaaccactcatua

SEQ ID NO: 27903 - DNA, 22 bp, Artificial Sequence
  Synthetic
ccaacauaacagatgggcugga

SEQ ID NO: 27904 - DNA, 23 bp, Artificial Sequence
  Synthetic
gctccacaugcaagttugaaaca

SEQ ID NO: 27905 - DNA, 27 bp, Artificial Sequence
  Synthetic
ccacctccaaggugtatgaagtatgua

SEQ ID NO: 27906 - DNA, 28 bp, Artificial Sequence
  Synthetic
aggaaaauaccagcttcauagacaaagg

SEQ ID NO: 27907 - DNA, 32 bp, Artificial Sequence
  Synthetic
agttgaatatctgtutttcaacaagtacatut

SEQ ID NO: 27908 - DNA, 19 bp, Artificial Sequence
  Synthetic
gcutctagccugggccaca

SEQ ID NO: 27909 - DNA, 28 bp, Artificial Sequence
  Synthetic
ctatcatccaaaguatgggcuacagaaa

SEQ ID NO: 27910 - DNA, 27 bp, Artificial Sequence
  Synthetic
taaaaggtcttaucaccacgtcauaga

SEQ ID NO: 27911 - DNA, 30 bp, Artificial Sequence
  Synthetic
tgctgagtgtgtutctcaaacaatttaaut

SEQ ID NO: 27912 - DNA, 27 bp, Artificial Sequence
  Synthetic
aagttaggtgtutcctgggttaugaag

SEQ ID NO: 27913 - DNA, 32 bp, Artificial Sequence
  Synthetic
acagctcaaagutgaacttattcacuaagaat

SEQ ID NO: 27914 - DNA, 17 bp, Artificial Sequence
  Synthetic
gtcgcggcuccgctaua

SEQ ID NO: 27915 - DNA, 17 bp, Artificial Sequence
  Synthetic
cgggagcucaccugcac

SEQ ID NO: 27916 - DNA, 21 bp, Artificial Sequence
  Synthetic
actcucagcccaccttctcuc

SEQ ID NO: 27917 - DNA, 20 bp, Artificial Sequence
  Synthetic
ttggacaguccacgttugct

SEQ ID NO: 27918 - DNA, 21 bp, Artificial Sequence
  Synthetic
ggcaggagacaaugtcccauc

SEQ ID NO: 27919 - DNA, 23 bp, Artificial Sequence
  Synthetic
cutatatggcaagucggaccagt

SEQ ID NO: 27920 - DNA, 21 bp, Artificial Sequence
  Synthetic
gggtaguccaggcccttcaua

SEQ ID NO: 27921 - DNA, 28 bp, Artificial Sequence
  Synthetic
tctctgaatccuaagaagaagctcucag

SEQ ID NO: 27922 - DNA, 20 bp, Artificial Sequence
  Synthetic
ccttcucccaccctcacuga

SEQ ID NO: 27923 - DNA, 22 bp, Artificial Sequence
  Synthetic
acaguccagacgaccttcucat

SEQ ID NO: 27924 - DNA, 19 bp, Artificial Sequence
  Synthetic
ctgcugagccccatcacut

SEQ ID NO: 27925 - DNA, 20 bp, Artificial Sequence
  Synthetic
gtgagccaucaucgcaggaa

SEQ ID NO: 27926 - DNA, 17 bp, Artificial Sequence
  Synthetic
ccccgcgccutccuaag

SEQ ID NO: 27927 - DNA, 21 bp, Artificial Sequence
  Synthetic
tgctcgtcggucatcttcaug

SEQ ID NO: 27928 - DNA, 19 bp, Artificial Sequence
  Synthetic
caagttccccgugtgcauc

SEQ ID NO: 27929 - DNA, 18 bp, Artificial Sequence
  Synthetic
gtactgguccgcgagcut

SEQ ID NO: 27930 - DNA, 20 bp, Artificial Sequence
  Synthetic
gaccugacagttuggcggat

SEQ ID NO: 27931 - DNA, 20 bp, Artificial Sequence
  Synthetic
cccgttctucaccgactucc

SEQ ID NO: 27932 - DNA, 28 bp, Artificial Sequence
  Synthetic
ttttctcgtgcutgttcttttattgucc

SEQ ID NO: 27933 - DNA, 23 bp, Artificial Sequence
  Synthetic
aactcgttgacaucgaaggtcuc

SEQ ID NO: 27934 - DNA, 18 bp, Artificial Sequence
  Synthetic
gcuacggcaucagcagca

SEQ ID NO: 27935 - DNA, 17 bp, Artificial Sequence
  Synthetic
ctcagcguggucagcgt

SEQ ID NO: 27936 - DNA, 20 bp, Artificial Sequence
  Synthetic
tccagcucctacuacagcca

SEQ ID NO: 27937 - DNA, 18 bp, Artificial Sequence
  Synthetic
gccatctucgccctucgt

SEQ ID NO: 27938 - DNA, 21 bp, Artificial Sequence
  Synthetic
gtggaggccucatgtgucaat

SEQ ID NO: 27939 - DNA, 24 bp, Artificial Sequence
  Synthetic
gtttaggugagacaccgtgagauc

SEQ ID NO: 27940 - DNA, 19 bp, Artificial Sequence
  Synthetic
ccagugaccccctgtccut

SEQ ID NO: 27941 - DNA, 23 bp, Artificial Sequence
  Synthetic
ccataaauagccaggcugagcat

SEQ ID NO: 27942 - DNA, 22 bp, Artificial Sequence
  Synthetic
tggacctguacatcctcaugga

SEQ ID NO: 27943 - DNA, 18 bp, Artificial Sequence
  Synthetic
ggtgcagcugtccugagt

SEQ ID NO: 27944 - DNA, 20 bp, Artificial Sequence
  Synthetic
gacactcuctctcccuccca

SEQ ID NO: 27945 - DNA, 17 bp, Artificial Sequence
  Synthetic
gcuggcagcaccctucc

SEQ ID NO: 27946 - DNA, 22 bp, Artificial Sequence
  Synthetic
ccttccacuatgaggctgaugg

SEQ ID NO: 27947 - DNA, 24 bp, Artificial Sequence
  Synthetic
agtagttggugacagcaaagaugg

SEQ ID NO: 27948 - DNA, 22 bp, Artificial Sequence
  Synthetic
ccacagagcacugatcaaccuc

SEQ ID NO: 27949 - DNA, 25 bp, Artificial Sequence
  Synthetic
tgttttaaacgautccactcggugt

SEQ ID NO: 27950 - DNA, 23 bp, Artificial Sequence
  Synthetic
gaagggcaacauccatcugaaac

SEQ ID NO: 27951 - DNA, 22 bp, Artificial Sequence
  Synthetic
gcacaggagucctgcttcatuc

SEQ ID NO: 27952 - DNA, 22 bp, Artificial Sequence
  Synthetic
ggaatgaccagutcctcctuca

SEQ ID NO: 27953 - DNA, 23 bp, Artificial Sequence
  Synthetic
cactggaagutgtcatacucgca

SEQ ID NO: 27954 - DNA, 23 bp, Artificial Sequence
  Synthetic
cctggacuacaggcacagatgua

SEQ ID NO: 27955 - DNA, 23 bp, Artificial Sequence
  Synthetic
ccatagggutctctcuggagagg

SEQ ID NO: 27956 - DNA, 19 bp, Artificial Sequence
  Synthetic
cccaacacagugcctguct

SEQ ID NO: 27957 - DNA, 19 bp, Artificial Sequence
  Synthetic
ccuaggctcucagcaaccc

SEQ ID NO: 27958 - DNA, 19 bp, Artificial Sequence
  Synthetic
cccctcutgaccatuggca

SEQ ID NO: 27959 - DNA, 23 bp, Artificial Sequence
  Synthetic
gcucagagaaagagcagucagag

SEQ ID NO: 27960 - DNA, 17 bp, Artificial Sequence
  Synthetic
cucaagggccgugacgt

SEQ ID NO: 27961 - DNA, 22 bp, Artificial Sequence
  Synthetic
cagagaagaggcaugctgugat

SEQ ID NO: 27962 - DNA, 17 bp, Artificial Sequence
  Synthetic
ccuaggcccagccucac

SEQ ID NO: 27963 - DNA, 19 bp, Artificial Sequence
  Synthetic
cctgaaguggaggccugat

SEQ ID NO: 27964 - DNA, 19 bp, Artificial Sequence
  Synthetic
ctgaaccutccacccucga

SEQ ID NO: 27965 - DNA, 22 bp, Artificial Sequence
  Synthetic
ggtctgcagugagggtgtagua

SEQ ID NO: 27966 - DNA, 19 bp, Artificial Sequence
  Synthetic
acctcugaccaccuccgaa

SEQ ID NO: 27967 - DNA, 26 bp, Artificial Sequence
  Synthetic
tccttgatgauggtgatgttuaccag

SEQ ID NO: 27968 - DNA, 21 bp, Artificial Sequence
  Synthetic
cccagcacacuctgacaaaug

SEQ ID NO: 27969 - DNA, 17 bp, Artificial Sequence
  Synthetic
cacccucgaccctgugg

SEQ ID NO: 27970 - DNA, 21 bp, Artificial Sequence
  Synthetic
tggaaagagcugcaggugaag

SEQ ID NO: 27971 - DNA, 22 bp, Artificial Sequence
  Synthetic
gtcttccctcucctcctgctua

SEQ ID NO: 27972 - DNA, 23 bp, Artificial Sequence
  Synthetic
tctgugcaaagaggacaguaagg

SEQ ID NO: 27973 - DNA, 23 bp, Artificial Sequence
  Synthetic
caatacggguacaggttggugag

SEQ ID NO: 27974 - DNA, 22 bp, Artificial Sequence
  Synthetic
cactgacagcacucttcctgua

SEQ ID NO: 27975 - DNA, 23 bp, Artificial Sequence
  Synthetic
gcaggaaagaaggauctggtuct

SEQ ID NO: 27976 - DNA, 20 bp, Artificial Sequence
  Synthetic
gcccatguccagtgaguggt

SEQ ID NO: 27977 - DNA, 25 bp, Artificial Sequence
  Synthetic
gtacataaggaagcugtcgtagucc

SEQ ID NO: 27978 - DNA, 17 bp, Artificial Sequence
  Synthetic
ggctgcggcuggaagut

SEQ ID NO: 27979 - DNA, 17 bp, Artificial Sequence
  Synthetic
gcgggugagcctgucac

SEQ ID NO: 27980 - DNA, 19 bp, Artificial Sequence
  Synthetic
gaugaccacgaccagugct

SEQ ID NO: 27981 - DNA, 20 bp, Artificial Sequence
  Synthetic
ggttggcugaggtcacucac

SEQ ID NO: 27982 - DNA, 21 bp, Artificial Sequence
  Synthetic
tgactcccacugagacccuag

SEQ ID NO: 27983 - DNA, 22 bp, Artificial Sequence
  Synthetic
cagctggtacuccacactguag

SEQ ID NO: 27984 - DNA, 22 bp, Artificial Sequence
  Synthetic
actaggtcucgatggcagctua

SEQ ID NO: 27985 - DNA, 21 bp, Artificial Sequence
  Synthetic
cggaacacguaggagtggtug

SEQ ID NO: 27986 - DNA, 22 bp, Artificial Sequence
  Synthetic
acaggctgaugctcttcctcua

SEQ ID NO: 27987 - DNA, 22 bp, Artificial Sequence
  Synthetic
ccatctcacaggucaccaggua

SEQ ID NO: 27988 - DNA, 20 bp, Artificial Sequence
  Synthetic
gcagacgcugaaggcatcut

SEQ ID NO: 27989 - DNA, 21 bp, Artificial Sequence
  Synthetic
gggugaaggaaaggacaggug

SEQ ID NO: 27990 - DNA, 22 bp, Artificial Sequence
  Synthetic
caagccaggucatctaaugcct

SEQ ID NO: 27991 - DNA, 22 bp, Artificial Sequence
  Synthetic
tgcggucaagttuggaagaact

SEQ ID NO: 27992 - DNA, 21 bp, Artificial Sequence
  Synthetic
ccucctaatccauccccagca

SEQ ID NO: 27993 - DNA, 21 bp, Artificial Sequence
  Synthetic
atagcccggucagtttcucac

SEQ ID NO: 27994 - DNA, 23 bp, Artificial Sequence
  Synthetic
gagagucagaaacaugggaaggt

SEQ ID NO: 27995 - DNA, 20 bp, Artificial Sequence
  Synthetic
ggacttgccugttgctucct

SEQ ID NO: 27996 - DNA, 30 bp, Artificial Sequence
  Synthetic
agtaaataaacagaugtgcagaatucagga

SEQ ID NO: 27997 - DNA, 23 bp, Artificial Sequence
  Synthetic
cggaataacugcccauagggaat

SEQ ID NO: 27998 - DNA, 21 bp, Artificial Sequence
  Synthetic
cggaagcugcaatugaagagg

SEQ ID NO: 27999 - DNA, 19 bp, Artificial Sequence
  Synthetic
agccuccccgctaacacua

SEQ ID NO: 28000 - DNA, 22 bp, Artificial Sequence
  Synthetic
tcagtggcaautaagccctgut

SEQ ID NO: 28001 - DNA, 18 bp, Artificial Sequence
  Synthetic
tgtgcagguggctcaucg

SEQ ID NO: 28002 - DNA, 23 bp, Artificial Sequence
  Synthetic
gcaggaggguaaccagaaaggua

SEQ ID NO: 28003 - DNA, 21 bp, Artificial Sequence
  Synthetic
guagccacaaccuggaccaaa

SEQ ID NO: 28004 - DNA, 20 bp, Artificial Sequence
  Synthetic
cacctgguacaccugcagaa

SEQ ID NO: 28005 - DNA, 21 bp, Artificial Sequence
  Synthetic
ctggccauggtacauggagac

SEQ ID NO: 28006 - DNA, 21 bp, Artificial Sequence
  Synthetic
gggctgctuctcatcctgtut

SEQ ID NO: 28007 - DNA, 20 bp, Artificial Sequence
  Synthetic
gagggucgaacacugagagc

SEQ ID NO: 28008 - DNA, 20 bp, Artificial Sequence
  Synthetic
gccttagugagctcccucgt

SEQ ID NO: 28009 - DNA, 29 bp, Artificial Sequence
  Synthetic
cttttcttcctccutcatgatggattuct

SEQ ID NO: 28010 - DNA, 24 bp, Artificial Sequence
  Synthetic
gcagagccagutcaataccuacag

SEQ ID NO: 28011 - DNA, 26 bp, Artificial Sequence
  Synthetic
gagtaucatttgttccuggagacaag

SEQ ID NO: 28012 - DNA, 19 bp, Artificial Sequence
  Synthetic
gaagacggaugctgccauc

SEQ ID NO: 28013 - DNA, 19 bp, Artificial Sequence
  Synthetic
ggacggcutgccctcauat

SEQ ID NO: 28014 - DNA, 22 bp, Artificial Sequence
  Synthetic
agucaacgagctcaucaccaac

SEQ ID NO: 28015 - DNA, 23 bp, Artificial Sequence
  Synthetic
cttccaggagutcatgtcugacc

SEQ ID NO: 28016 - DNA, 19 bp, Artificial Sequence
  Synthetic
ctgaucgacgagcacgaug

SEQ ID NO: 28017 - DNA, 20 bp, Artificial Sequence
  Synthetic
gagctcguctcagcaucact

SEQ ID NO: 28018 - DNA, 24 bp, Artificial Sequence
  Synthetic
gatgaataaaaaccggugcagcuc

SEQ ID NO: 28019 - DNA, 23 bp, Artificial Sequence
  Synthetic
gggtgtggaaautacatccuggt

SEQ ID NO: 28020 - DNA, 24 bp, Artificial Sequence
  Synthetic
tttcttacacugcctctccuacct

SEQ ID NO: 28021 - DNA, 18 bp, Artificial Sequence
  Synthetic
ccttggtguggccagguc

SEQ ID NO: 28022 - DNA, 22 bp, Artificial Sequence
  Synthetic
ccagcatggucctgtgattcuc

SEQ ID NO: 28023 - DNA, 21 bp, Artificial Sequence
  Synthetic
gacctccugggacacgttuac

SEQ ID NO: 28024 - DNA, 20 bp, Artificial Sequence
  Synthetic
tccaagcaguccctagugct

SEQ ID NO: 28025 - DNA, 24 bp, Artificial Sequence
  Synthetic
aacacaattccggauctcttccug

SEQ ID NO: 28026 - DNA, 31 bp, Artificial Sequence
  Synthetic
tgtatgggttacutattctctctttgtugac

SEQ ID NO: 28027 - DNA, 21 bp, Artificial Sequence
  Synthetic
ggccagccucagacacaaaua

SEQ ID NO: 28028 - DNA, 30 bp, Artificial Sequence
  Synthetic
accacaaagaauaaatcctttcactcugat

SEQ ID NO: 28029 - DNA, 22 bp, Artificial Sequence
  Synthetic
ggagggttcuttggcaactuac

SEQ ID NO: 28030 - DNA, 23 bp, Artificial Sequence
  Synthetic
ggtggtcagucatgtgtgtcauc

SEQ ID NO: 28031 - DNA, 21 bp, Artificial Sequence
  Synthetic
aggtccacuggaggagaaguc

SEQ ID NO: 28032 - DNA, 20 bp, Artificial Sequence
  Synthetic
gccgguaccgagaggaacua

SEQ ID NO: 28033 - DNA, 18 bp, Artificial Sequence
  Synthetic
cacccuccacuccagcag

SEQ ID NO: 28034 - DNA, 19 bp, Artificial Sequence
  Synthetic
ggcctcucagtcccgtgua

SEQ ID NO: 28035 - DNA, 18 bp, Artificial Sequence
  Synthetic
gggtccuccaggauccct

SEQ ID NO: 28036 - DNA, 21 bp, Artificial Sequence
  Synthetic
actcagcugaaagcccugaac

SEQ ID NO: 28037 - DNA, 18 bp, Artificial Sequence
  Synthetic
ccacacguccgtgctuct

SEQ ID NO: 28038 - DNA, 22 bp, Artificial Sequence
  Synthetic
ccttttcucccgactgttgcua

SEQ ID NO: 28039 - DNA, 20 bp, Artificial Sequence
  Synthetic
actgtucacacggcctctuc

SEQ ID NO: 28040 - DNA, 26 bp, Artificial Sequence
  Synthetic
cttaaactgtuacgcttggcaagaug

SEQ ID NO: 28041 - DNA, 31 bp, Artificial Sequence
  Synthetic
ccctggaagtauacatatttcttcacagtua

SEQ ID NO: 28042 - DNA, 25 bp, Artificial Sequence
  Synthetic
attgcgguaacttttcctttugcat

SEQ ID NO: 28043 - DNA, 20 bp, Artificial Sequence
  Synthetic
gccagatguccctctcguct

SEQ ID NO: 28044 - DNA, 17 bp, Artificial Sequence
  Synthetic
gaucctgugcgcagggt

SEQ ID NO: 28045 - DNA, 18 bp, Artificial Sequence
  Synthetic
tctgccggccuctttucc

SEQ ID NO: 28046 - DNA, 17 bp, Artificial Sequence
  Synthetic
ccugcagcaccgaguct

SEQ ID NO: 28047 - DNA, 19 bp, Artificial Sequence
  Synthetic
tcctccucctcctccaugc

SEQ ID NO: 28048 - DNA, 28 bp, Artificial Sequence
  Synthetic
tgtacacactgacuactatgccaaguat

SEQ ID NO: 28049 - DNA, 19 bp, Artificial Sequence
  Synthetic
cccgcgucttctctaucgg

SEQ ID NO: 28050 - DNA, 19 bp, Artificial Sequence
  Synthetic
cacgtggucaacccugact

SEQ ID NO: 28051 - DNA, 21 bp, Artificial Sequence
  Synthetic
gtgcaugaaccaacagctguc

SEQ ID NO: 28052 - DNA, 19 bp, Artificial Sequence
  Synthetic
gatgccggutctucccaag

SEQ ID NO: 28053 - DNA, 22 bp, Artificial Sequence
  Synthetic
gcaagctugaagagccctcaut

SEQ ID NO: 28054 - DNA, 19 bp, Artificial Sequence
  Synthetic
ggtgaagagcugccugacg

SEQ ID NO: 28055 - DNA, 19 bp, Artificial Sequence
  Synthetic
aggugcacagcucagcaat

SEQ ID NO: 28056 - DNA, 21 bp, Artificial Sequence
  Synthetic
cgttugccacaagcatcucac

SEQ ID NO: 28057 - DNA, 19 bp, Artificial Sequence
  Synthetic
gtcggucaggcttcagucc

SEQ ID NO: 28058 - DNA, 17 bp, Artificial Sequence
  Synthetic
gtcgggugtcgccugag

SEQ ID NO: 28059 - DNA, 18 bp, Artificial Sequence
  Synthetic
tcttccaucccgcggtug

SEQ ID NO: 28060 - DNA, 24 bp, Artificial Sequence
  Synthetic
cccaaatugcaagacagagtugct

SEQ ID NO: 28061 - DNA, 21 bp, Artificial Sequence
  Synthetic
cacatccacutcctgcugaac

SEQ ID NO: 28062 - DNA, 21 bp, Artificial Sequence
  Synthetic
gcgcaggaacuttggtaguca

SEQ ID NO: 28063 - DNA, 23 bp, Artificial Sequence
  Synthetic
ctgcaggaucatgtccttgauct

SEQ ID NO: 28064 - DNA, 21 bp, Artificial Sequence
  Synthetic
cagctgaugctctttccuggt

SEQ ID NO: 28065 - DNA, 24 bp, Artificial Sequence
  Synthetic
gtaatgauaaggaccccacccauc

SEQ ID NO: 28066 - DNA, 20 bp, Artificial Sequence
  Synthetic
tgtctgccacuccctgguat

SEQ ID NO: 28067 - DNA, 23 bp, Artificial Sequence
  Synthetic
ggccgaaagutcttgtactccuc

SEQ ID NO: 28068 - DNA, 25 bp, Artificial Sequence
  Synthetic
ggtaaaagaacaguaaacccuggct

SEQ ID NO: 28069 - DNA, 22 bp, Artificial Sequence
  Synthetic
gtggaagaugcgattgatucgg

SEQ ID NO: 28070 - DNA, 21 bp, Artificial Sequence
  Synthetic
ggagagaacgutccccagaug

SEQ ID NO: 28071 - DNA, 22 bp, Artificial Sequence
  Synthetic
gtgactctccucgtggaactug

SEQ ID NO: 28072 - DNA, 21 bp, Artificial Sequence
  Synthetic
cactgtcccugggtgtcttuc

SEQ ID NO: 28073 - DNA, 25 bp, Artificial Sequence
  Synthetic
gcggagaugagaacaaaacctgtua

SEQ ID NO: 28074 - DNA, 22 bp, Artificial Sequence
  Synthetic
ttggccttguactcacagugac

SEQ ID NO: 28075 - DNA, 24 bp, Artificial Sequence
  Synthetic
tccttggatcugagagtgaggaut

SEQ ID NO: 28076 - DNA, 18 bp, Artificial Sequence
  Synthetic
ctaagcugcgcgcttucc

SEQ ID NO: 28077 - DNA, 21 bp, Artificial Sequence
  Synthetic
agtgacugagttcugcccaga

SEQ ID NO: 28078 - DNA, 18 bp, Artificial Sequence
  Synthetic
gacccauggcagggucaa

SEQ ID NO: 28079 - DNA, 19 bp, Artificial Sequence
  Synthetic
ctgcttccuctcccaggug

SEQ ID NO: 28080 - DNA, 21 bp, Artificial Sequence
  Synthetic
gggtgauacacaagccugacc

SEQ ID NO: 28081 - DNA, 21 bp, Artificial Sequence
  Synthetic
ggtgctgaugtcaccgaugat

SEQ ID NO: 28082 - DNA, 24 bp, Artificial Sequence
  Synthetic
ggctcctacuccatctgtatcugt

SEQ ID NO: 28083 - DNA, 20 bp, Artificial Sequence
  Synthetic
ggucactgtuggcaaacacg

SEQ ID NO: 28084 - DNA, 21 bp, Artificial Sequence
  Synthetic
ccccuccccacctgtcttuat

SEQ ID NO: 28085 - DNA, 19 bp, Artificial Sequence
  Synthetic
ccccagaccacugaagcuc

SEQ ID NO: 28086 - DNA, 24 bp, Artificial Sequence
  Synthetic
ccagaagcaugaaacactgtucaa

SEQ ID NO: 28087 - DNA, 24 bp, Artificial Sequence
  Synthetic
gagctgctgucgggaaaaatuaac

SEQ ID NO: 28088 - DNA, 26 bp, Artificial Sequence
  Synthetic
gatgtaggaagagutaatcacgugct

SEQ ID NO: 28089 - DNA, 28 bp, Artificial Sequence
  Synthetic
ctgagcutcatgtattuccaaaggaaaa

SEQ ID NO: 28090 - DNA, 26 bp, Artificial Sequence
  Synthetic
gcaccaatgutctcaaattcugagag

SEQ ID NO: 28091 - DNA, 23 bp, Artificial Sequence
  Synthetic
ggtgtguggcctctttgtaugat

SEQ ID NO: 28092 - DNA, 21 bp, Artificial Sequence
  Synthetic
ccatgcagcaautgtccagua

SEQ ID NO: 28093 - DNA, 27 bp, Artificial Sequence
  Synthetic
gcatagaguacgactggaactuaacat

SEQ ID NO: 28094 - DNA, 27 bp, Artificial Sequence
  Synthetic
catccctggcucagttaagtatttuat

SEQ ID NO: 28095 - DNA, 29 bp, Artificial Sequence
  Synthetic
ggaaagaaatugagagcagctaatcttut

SEQ ID NO: 28096 - DNA, 26 bp, Artificial Sequence
  Synthetic
gattttccatucaggttcttctgguc

SEQ ID NO: 28097 - DNA, 28 bp, Artificial Sequence
  Synthetic
cgtcattcctgauccttcatgagtauat

SEQ ID NO: 28098 - DNA, 18 bp, Artificial Sequence
  Synthetic
cutacaccuccgccacca

SEQ ID NO: 28099 - DNA, 24 bp, Artificial Sequence
  Synthetic
agttgtgacgggagutgtagttuc

SEQ ID NO: 28100 - DNA, 19 bp, Artificial Sequence
  Synthetic
ggcctguggtctgcaguat

SEQ ID NO: 28101 - DNA, 19 bp, Artificial Sequence
  Synthetic
cctcuccctccugcacaga

SEQ ID NO: 28102 - DNA, 23 bp, Artificial Sequence
  Synthetic
gggatctgugcttattctgtucc

SEQ ID NO: 28103 - DNA, 25 bp, Artificial Sequence
  Synthetic
gatactagggtugtagagggagguc

SEQ ID NO: 28104 - DNA, 20 bp, Artificial Sequence
  Synthetic
ccattccauccccacccaua

SEQ ID NO: 28105 - DNA, 22 bp, Artificial Sequence
  Synthetic
gcaaacccauggtgagaagaug

SEQ ID NO: 28106 - DNA, 21 bp, Artificial Sequence
  Synthetic
agcctcccautgaccaactuc

SEQ ID NO: 28107 - DNA, 24 bp, Artificial Sequence
  Synthetic
cctaatccuactcataggguccca

SEQ ID NO: 28108 - DNA, 19 bp, Artificial Sequence
  Synthetic
tctgacuccccttggcuct

SEQ ID NO: 28109 - DNA, 17 bp, Artificial Sequence
  Synthetic
gggcutcaggugaggga

SEQ ID NO: 28110 - DNA, 20 bp, Artificial Sequence
  Synthetic
cagaccuctgtcuccccact

SEQ ID NO: 28111 - DNA, 24 bp, Artificial Sequence
  Synthetic
tgaaagaggccaagugtatggaug

SEQ ID NO: 28112 - DNA, 18 bp, Artificial Sequence
  Synthetic
ggagccuggacagctuca

SEQ ID NO: 28113 - DNA, 17 bp, Artificial Sequence
  Synthetic
ccucgccacgtccucac

SEQ ID NO: 28114 - DNA, 21 bp, Artificial Sequence
  Synthetic
ccccagauccccagtcctaut

SEQ ID NO: 28115 - DNA, 21 bp, Artificial Sequence
  Synthetic
cccagaaugagaggugaagcg

SEQ ID NO: 28116 - DNA, 21 bp, Artificial Sequence
  Synthetic
ctggtgccuacacacccttua

SEQ ID NO: 28117 - DNA, 23 bp, Artificial Sequence
  Synthetic
gagggtugagaggttctgagtuc

SEQ ID NO: 28118 - DNA, 23 bp, Artificial Sequence
  Synthetic
gactccattuctgacagcucagg

SEQ ID NO: 28119 - DNA, 27 bp, Artificial Sequence
  Synthetic
tgtatggtcagagacutagaaatgcug

SEQ ID NO: 28120 - DNA, 20 bp, Artificial Sequence
  Synthetic
ccccugaagacgtgaucagc

SEQ ID NO: 28121 - DNA, 20 bp, Artificial Sequence
  Synthetic
ggaagcugtctcaggucagt

SEQ ID NO: 28122 - DNA, 21 bp, Artificial Sequence
  Synthetic
gctatgcuccatgccaugagg

SEQ ID NO: 28123 - DNA, 21 bp, Artificial Sequence
  Synthetic
cucgccagaaaaccttugcag

SEQ ID NO: 28124 - DNA, 20 bp, Artificial Sequence
  Synthetic
catggagtugaccctgggut

SEQ ID NO: 28125 - DNA, 24 bp, Artificial Sequence
  Synthetic
ctctctctcaguctctacctccug

SEQ ID NO: 28126 - DNA, 22 bp, Artificial Sequence
  Synthetic
tcagcagucagggatcccauat

SEQ ID NO: 28127 - DNA, 21 bp, Artificial Sequence
  Synthetic
acacgttgugcccattttcug

SEQ ID NO: 28128 - DNA, 19 bp, Artificial Sequence
  Synthetic
ctaccgccugctggaugaa

SEQ ID NO: 28129 - DNA, 21 bp, Artificial Sequence
  Synthetic
gggcugagtcaggucagagat

SEQ ID NO: 28130 - DNA, 24 bp, Artificial Sequence
  Synthetic
cgggcagagaaaucctatacagug

SEQ ID NO: 28131 - DNA, 22 bp, Artificial Sequence
  Synthetic
agaguagacaagctgugggaga

SEQ ID NO: 28132 - DNA, 21 bp, Artificial Sequence
  Synthetic
cgttggcugtatgaucgacct

SEQ ID NO: 28133 - DNA, 22 bp, Artificial Sequence
  Synthetic
ggaggtagggaugggagagtug

SEQ ID NO: 28134 - DNA, 23 bp, Artificial Sequence
  Synthetic
tctgaggttcuttgccatctgug

SEQ ID NO: 28135 - DNA, 27 bp, Artificial Sequence
  Synthetic
aaagagaaacucaaagaagagcacugt

SEQ ID NO: 28136 - DNA, 22 bp, Artificial Sequence
  Synthetic
cctggtggagaugcttttccug

SEQ ID NO: 28137 - DNA, 21 bp, Artificial Sequence
  Synthetic
cagtccctuctttgccgtuct

SEQ ID NO: 28138 - DNA, 21 bp, Artificial Sequence
  Synthetic
ggcatgaauattgcgguggga

SEQ ID NO: 28139 - DNA, 24 bp, Artificial Sequence
  Synthetic
aaaattgagggutactgguccaca

SEQ ID NO: 28140 - DNA, 20 bp, Artificial Sequence
  Synthetic
gcagtgaccgcutctgtcuc

SEQ ID NO: 28141 - DNA, 21 bp, Artificial Sequence
  Synthetic
ctaaattgcugtggccuggac

SEQ ID NO: 28142 - DNA, 20 bp, Artificial Sequence
  Synthetic
gggcaauccaagaggtcucc

SEQ ID NO: 28143 - DNA, 19 bp, Artificial Sequence
  Synthetic
ccaccugcaggaagtggut

SEQ ID NO: 28144 - DNA, 20 bp, Artificial Sequence
  Synthetic
tggaggaagagaugguggct

SEQ ID NO: 28145 - DNA, 18 bp, Artificial Sequence
  Synthetic
gtgcagcagcugagctug

SEQ ID NO: 28146 - DNA, 20 bp, Artificial Sequence
  Synthetic
catcacgcucttccctccug

SEQ ID NO: 28147 - DNA, 20 bp, Artificial Sequence
  Synthetic
cagcatccucagtgcctugt

SEQ ID NO: 28148 - DNA, 23 bp, Artificial Sequence
  Synthetic
acagugaagaaccgagacttugt

SEQ ID NO: 28149 - DNA, 24 bp, Artificial Sequence
  Synthetic
cctcatcttccutttcctgtgcug

SEQ ID NO: 28150 - DNA, 25 bp, Artificial Sequence
  Synthetic
gaagttucaaggaagtcctgauggt

SEQ ID NO: 28151 - DNA, 23 bp, Artificial Sequence
  Synthetic
gcttttaugaggaggccauagcg

SEQ ID NO: 28152 - DNA, 24 bp, Artificial Sequence
  Synthetic
tctctgatcucagagttcctgcut

SEQ ID NO: 28153 - DNA, 24 bp, Artificial Sequence
  Synthetic
gtctcgagagaaagutagcauggg

SEQ ID NO: 28154 - DNA, 23 bp, Artificial Sequence
  Synthetic
cctcaugagcctgtuggagaaag

SEQ ID NO: 28155 - DNA, 22 bp, Artificial Sequence
  Synthetic
atctgtcctcaugccctcttug

SEQ ID NO: 28156 - DNA, 21 bp, Artificial Sequence
  Synthetic
gtacaccatcucaccgtccuc

SEQ ID NO: 28157 - DNA, 27 bp, Artificial Sequence
  Synthetic
agggaatgttatugtatcctgagggua

SEQ ID NO: 28158 - DNA, 17 bp, Artificial Sequence
  Synthetic
ctgaccacccugccugt

SEQ ID NO: 28159 - DNA, 18 bp, Artificial Sequence
  Synthetic
gtgccaggagugggtuct

SEQ ID NO: 28160 - DNA, 21 bp, Artificial Sequence
  Synthetic
atgggtcuggtctctgacuga

SEQ ID NO: 28161 - DNA, 23 bp, Artificial Sequence
  Synthetic
gtgaccagugactccatactucc

SEQ ID NO: 28162 - DNA, 20 bp, Artificial Sequence
  Synthetic
aggagaacgccaaugtggug

SEQ ID NO: 28163 - DNA, 20 bp, Artificial Sequence
  Synthetic
cgggtugccctatugaggag

SEQ ID NO: 28164 - DNA, 20 bp, Artificial Sequence
  Synthetic
gcagagcagucactgagugg

SEQ ID NO: 28165 - DNA, 21 bp, Artificial Sequence
  Synthetic
gcatcactccutcgccaagut

SEQ ID NO: 28166 - DNA, 23 bp, Artificial Sequence
  Synthetic
ccaaagatgucagcatcctucgt

SEQ ID NO: 28167 - DNA, 20 bp, Artificial Sequence
  Synthetic
ctgctcuaccgtgacccauc

SEQ ID NO: 28168 - DNA, 17 bp, Artificial Sequence
  Synthetic
gtgugcgccgctcttug

SEQ ID NO: 28169 - DNA, 17 bp, Artificial Sequence
  Synthetic
ccugccccacccugaag

SEQ ID NO: 28170 - DNA, 22 bp, Artificial Sequence
  Synthetic
atttgtgtguccccctcttgut

SEQ ID NO: 28171 - DNA, 22 bp, Artificial Sequence
  Synthetic
cctccacauaggccatttuggg

SEQ ID NO: 28172 - DNA, 24 bp, Artificial Sequence
  Synthetic
cugggagauagagaggaagattuc

SEQ ID NO: 28173 - DNA, 24 bp, Artificial Sequence
  Synthetic
tgaggguttcttggauaggaggac

SEQ ID NO: 28174 - DNA, 22 bp, Artificial Sequence
  Synthetic
ctagccacauggtcagggttut

SEQ ID NO: 28175 - DNA, 23 bp, Artificial Sequence
  Synthetic
gccttctcuatcgtccatuccca

SEQ ID NO: 28176 - DNA, 20 bp, Artificial Sequence
  Synthetic
cctcccatcutccccttguc

SEQ ID NO: 28177 - DNA, 21 bp, Artificial Sequence
  Synthetic
ggctagautcagaggaugcca

SEQ ID NO: 28178 - DNA, 20 bp, Artificial Sequence
  Synthetic
ccagagcccugatttcuggt

SEQ ID NO: 28179 - DNA, 19 bp, Artificial Sequence
  Synthetic
ctttgccgggugtgttcug

SEQ ID NO: 28180 - DNA, 22 bp, Artificial Sequence
  Synthetic
cagcauccttcccaucagaaca

SEQ ID NO: 28181 - DNA, 23 bp, Artificial Sequence
  Synthetic
gggagauaaagggtccaaugagg

SEQ ID NO: 28182 - DNA, 23 bp, Artificial Sequence
  Synthetic
tctctgtcccugtctcctcuaat

SEQ ID NO: 28183 - DNA, 22 bp, Artificial Sequence
  Synthetic
ctgggagcuatttctucagggt

SEQ ID NO: 28184 - DNA, 23 bp, Artificial Sequence
  Synthetic
gtctcctagacuctccgatucca

SEQ ID NO: 28185 - DNA, 20 bp, Artificial Sequence
  Synthetic
gcagugccacagtggtguag

SEQ ID NO: 28186 - DNA, 22 bp, Artificial Sequence
  Synthetic
cactgcaugggcctattugaga

SEQ ID NO: 28187 - DNA, 20 bp, Artificial Sequence
  Synthetic
cgatggcuccctctcctuac

SEQ ID NO: 28188 - DNA, 21 bp, Artificial Sequence
  Synthetic
ggtgauggcttgacatuccct

SEQ ID NO: 28189 - DNA, 19 bp, Artificial Sequence
  Synthetic
gggcagcgugatctcgaug

SEQ ID NO: 28190 - DNA, 21 bp, Artificial Sequence
  Synthetic
cacctcugaccacctcaacuc

SEQ ID NO: 28191 - DNA, 21 bp, Artificial Sequence
  Synthetic
cccttucagaccatcugccaa

SEQ ID NO: 28192 - DNA, 19 bp, Artificial Sequence
  Synthetic
tgtucgcacagcccatugt

SEQ ID NO: 28193 - DNA, 20 bp, Artificial Sequence
  Synthetic
ggatacagggcguagagguc

SEQ ID NO: 28194 - DNA, 21 bp, Artificial Sequence
  Synthetic
ccccauctcctccuccaagat

SEQ ID NO: 28195 - DNA, 18 bp, Artificial Sequence
  Synthetic
cggctccuctggttgugg

SEQ ID NO: 28196 - DNA, 19 bp, Artificial Sequence
  Synthetic
gctgaggcaugggatuggg

SEQ ID NO: 28197 - DNA, 20 bp, Artificial Sequence
  Synthetic
tgggcgcacacauatucagg

SEQ ID NO: 28198 - DNA, 21 bp, Artificial Sequence
  Synthetic
gccuggaaggaaagggttgug

SEQ ID NO: 28199 - DNA, 22 bp, Artificial Sequence
  Synthetic
tgcutcttttgctugcagagga

SEQ ID NO: 28200 - DNA, 19 bp, Artificial Sequence
  Synthetic
gctggcagauggctctgua

SEQ ID NO: 28201 - DNA, 20 bp, Artificial Sequence
  Synthetic
ccacccacaucctugaagcc

SEQ ID NO: 28202 - DNA, 17 bp, Artificial Sequence
  Synthetic
gcaugggaggucgggaa

SEQ ID NO: 28203 - DNA, 18 bp, Artificial Sequence
  Synthetic
cccagcccuatccagcuc

SEQ ID NO: 28204 - DNA, 22 bp, Artificial Sequence
  Synthetic
acccugcccagaagctcttaua

SEQ ID NO: 28205 - DNA, 22 bp, Artificial Sequence
  Synthetic
ctttttguggacaagcacugca

SEQ ID NO: 28206 - DNA, 22 bp, Artificial Sequence
  Synthetic
gggcagaagugagaatgugagg

SEQ ID NO: 28207 - DNA, 22 bp, Artificial Sequence
  Synthetic
aagagtccagugcacatgugag

SEQ ID NO: 28208 - DNA, 23 bp, Artificial Sequence
  Synthetic
gguaacagagguaaagggactuc

SEQ ID NO: 28209 - DNA, 23 bp, Artificial Sequence
  Synthetic
agaagagguccactcgaaccuac

SEQ ID NO: 28210 - DNA, 22 bp, Artificial Sequence
  Synthetic
ctgtcccugactgtcattgugt

SEQ ID NO: 28211 - DNA, 20 bp, Artificial Sequence
  Synthetic
cccagatccucagccccuag

SEQ ID NO: 28212 - DNA, 23 bp, Artificial Sequence
  Synthetic
actgttcauctccccuagcacat

SEQ ID NO: 28213 - DNA, 20 bp, Artificial Sequence
  Synthetic
ccaagucacaccugaaccgt

SEQ ID NO: 28214 - DNA, 23 bp, Artificial Sequence
  Synthetic
gcaaggaugtcatugaagagcag

SEQ ID NO: 28215 - DNA, 21 bp, Artificial Sequence
  Synthetic
ggaauccccgagaagggauca

SEQ ID NO: 28216 - DNA, 17 bp, Artificial Sequence
  Synthetic
ggcgcacagucgccuat

SEQ ID NO: 28217 - DNA, 20 bp, Artificial Sequence
  Synthetic
ggagcacucgggugacaaac

SEQ ID NO: 28218 - DNA, 20 bp, Artificial Sequence
  Synthetic
cucctgggcuggaaagagag

SEQ ID NO: 28219 - DNA, 26 bp, Artificial Sequence
  Synthetic
ttgagttucaggaacatgucgaagaa

SEQ ID NO: 28220 - DNA, 22 bp, Artificial Sequence
  Synthetic
agagaatugaggctcuccaggt

SEQ ID NO: 28221 - DNA, 19 bp, Artificial Sequence
  Synthetic
cacatgcuccgacaggtug

SEQ ID NO: 28222 - DNA, 17 bp, Artificial Sequence
  Synthetic
cgcggugaccccttgua

SEQ ID NO: 28223 - DNA, 18 bp, Artificial Sequence
  Synthetic
ctcgggcuccgagatcug

SEQ ID NO: 28224 - DNA, 17 bp, Artificial Sequence
  Synthetic
ctgcgaggccucagcua

SEQ ID NO: 28225 - DNA, 17 bp, Artificial Sequence
  Synthetic
gagctcggucaccguca

SEQ ID NO: 28226 - DNA, 27 bp, Artificial Sequence
  Synthetic
gggaaauaagagagaaaggagaugaga

SEQ ID NO: 28227 - DNA, 21 bp, Artificial Sequence
  Synthetic
cuactcuaggagggaggcagt

SEQ ID NO: 28228 - DNA, 22 bp, Artificial Sequence
  Synthetic
ctgatctgugagcgctttcuct

SEQ ID NO: 28229 - DNA, 25 bp, Artificial Sequence
  Synthetic
ggaggaacccugaaattctgauagg

SEQ ID NO: 28230 - DNA, 24 bp, Artificial Sequence
  Synthetic
cgatgaggaugagaacatggtgua

SEQ ID NO: 28231 - DNA, 19 bp, Artificial Sequence
  Synthetic
ccagccaauaagccctugc

SEQ ID NO: 28232 - DNA, 24 bp, Artificial Sequence
  Synthetic
gaaaaacaguggagttucagccaa

SEQ ID NO: 28233 - DNA, 18 bp, Artificial Sequence
  Synthetic
gcctgtgauggcctggug

SEQ ID NO: 28234 - DNA, 22 bp, Artificial Sequence
  Synthetic
ggtgactggaguctgacacuca

SEQ ID NO: 28235 - DNA, 20 bp, Artificial Sequence
  Synthetic
gacgtugggaaccctccuaa

SEQ ID NO: 28236 - DNA, 27 bp, Artificial Sequence
  Synthetic
ggacacuacaacaacttcttcttugct

SEQ ID NO: 28237 - DNA, 22 bp, Artificial Sequence
  Synthetic
cttatccctucaccacccacug

SEQ ID NO: 28238 - DNA, 22 bp, Artificial Sequence
  Synthetic
catgtctucagccctgcctauc

SEQ ID NO: 28239 - DNA, 23 bp, Artificial Sequence
  Synthetic
ctgtagagcucgtattcgucacc

SEQ ID NO: 28240 - DNA, 21 bp, Artificial Sequence
  Synthetic
gtctgaaccaggucagagguc

SEQ ID NO: 28241 - DNA, 22 bp, Artificial Sequence
  Synthetic
ctgtgaguggcaagagacauca

SEQ ID NO: 28242 - DNA, 29 bp, Artificial Sequence
  Synthetic
gcaacatagcaagacutcctctctacuat

SEQ ID NO: 28243 - DNA, 22 bp, Artificial Sequence
  Synthetic
cccactgucctcccatuaacac

SEQ ID NO: 28244 - DNA, 21 bp, Artificial Sequence
  Synthetic
ccagcuggtgattgttuccgt

SEQ ID NO: 28245 - DNA, 23 bp, Artificial Sequence
  Synthetic
ccactccuccaaaattucagcag

SEQ ID NO: 28246 - DNA, 21 bp, Artificial Sequence
  Synthetic
ggtggtctccuctgctctcut

SEQ ID NO: 28247 - DNA, 20 bp, Artificial Sequence
  Synthetic
ggttgatgauctggcctugc

SEQ ID NO: 28248 - DNA, 21 bp, Artificial Sequence
  Synthetic
tctcctctcuggtcccaacug

SEQ ID NO: 28249 - DNA, 21 bp, Artificial Sequence
  Synthetic
ccttuggcccaaacacaggua

SEQ ID NO: 28250 - DNA, 20 bp, Artificial Sequence
  Synthetic
gtactgcccacucggcuaac

SEQ ID NO: 28251 - DNA, 20 bp, Artificial Sequence
  Synthetic
caagguacagggcatgcauc

SEQ ID NO: 28252 - DNA, 19 bp, Artificial Sequence
  Synthetic
ttcgcugccacactugagt

SEQ ID NO: 28253 - DNA, 20 bp, Artificial Sequence
  Synthetic
gcaggaagguggcaggatug

SEQ ID NO: 28254 - DNA, 23 bp, Artificial Sequence
  Synthetic
ccactccuccttccctagtucat

SEQ ID NO: 28255 - DNA, 28 bp, Artificial Sequence
  Synthetic
cctgtttatcccaguaattgacctcauc

SEQ ID NO: 28256 - DNA, 17 bp, Artificial Sequence
  Synthetic
gcccacugccccatguc

SEQ ID NO: 28257 - DNA, 18 bp, Artificial Sequence
  Synthetic
gtgggcugagcaggtcuc

SEQ ID NO: 28258 - DNA, 20 bp, Artificial Sequence
  Synthetic
gcuggagcgaaaggatuggg

SEQ ID NO: 28259 - DNA, 21 bp, Artificial Sequence
  Synthetic
ccacccgutttgaaccucagt

SEQ ID NO: 28260 - DNA, 27 bp, Artificial Sequence
  Synthetic
acagtgagaautagctgttuacacaca

SEQ ID NO: 28261 - DNA, 22 bp, Artificial Sequence
  Synthetic
gtttctctgacgucccccauag

SEQ ID NO: 28262 - DNA, 21 bp, Artificial Sequence
  Synthetic
cttctugagaagcctggcuca

SEQ ID NO: 28263 - DNA, 24 bp, Artificial Sequence
  Synthetic
tgacgaaguatgggcttuggaaat

SEQ ID NO: 28264 - DNA, 19 bp, Artificial Sequence
  Synthetic
ccggcuacaaggaccctuc

SEQ ID NO: 28265 - DNA, 17 bp, Artificial Sequence
  Synthetic
gcgctcccugaacccua

SEQ ID NO: 28266 - DNA, 19 bp, Artificial Sequence
  Synthetic
ccgcaaaugcgcagcuaag

SEQ ID NO: 28267 - DNA, 21 bp, Artificial Sequence
  Synthetic
acctgtcccutctctcuccag

SEQ ID NO: 28268 - DNA, 22 bp, Artificial Sequence
  Synthetic
cttccctccuccaggtgtcuat

SEQ ID NO: 28269 - DNA, 20 bp, Artificial Sequence
  Synthetic
cggacucaccgtcctuacct

SEQ ID NO: 28270 - DNA, 18 bp, Artificial Sequence
  Synthetic
tggttguccgtgcggaug

SEQ ID NO: 28271 - DNA, 21 bp, Artificial Sequence
  Synthetic
gautcctagccuggaaccagt

SEQ ID NO: 28272 - DNA, 24 bp, Artificial Sequence
  Synthetic
caagactgatccugcaactccaut

SEQ ID NO: 28273 - DNA, 21 bp, Artificial Sequence
  Synthetic
ctcacatcugtgtgtctugcg

SEQ ID NO: 28274 - DNA, 22 bp, Artificial Sequence
  Synthetic
caccaagucgaagttgcatgug

SEQ ID NO: 28275 - DNA, 21 bp, Artificial Sequence
  Synthetic
agacttcatucagcggtugct

SEQ ID NO: 28276 - DNA, 22 bp, Artificial Sequence
  Synthetic
ggcgtcugcccatagaacatut

SEQ ID NO: 28277 - DNA, 21 bp, Artificial Sequence
  Synthetic
gctctgcuccttttgguccag

SEQ ID NO: 28278 - DNA, 22 bp, Artificial Sequence
  Synthetic
ccagggaacaagcutgctaucc

SEQ ID NO: 28279 - DNA, 21 bp, Artificial Sequence
  Synthetic
cuaccaaccacccaugacgaa

SEQ ID NO: 28280 - DNA, 18 bp, Artificial Sequence
  Synthetic
tcaccucgcccctctuca

SEQ ID NO: 28281 - DNA, 17 bp, Artificial Sequence
  Synthetic
gugcagaagcgggugga

SEQ ID NO: 28282 - DNA, 22 bp, Artificial Sequence
  Synthetic
tcagaatcucgaagtcguccct

SEQ ID NO: 28283 - DNA, 25 bp, Artificial Sequence
  Synthetic
agaacctuacacggtgtttatgugg

SEQ ID NO: 28284 - DNA, 17 bp, Artificial Sequence
  Synthetic
cccgaggguaggcacuc

SEQ ID NO: 28285 - DNA, 17 bp, Artificial Sequence
  Synthetic
gccatggugctgccugt

SEQ ID NO: 28286 - DNA, 22 bp, Artificial Sequence
  Synthetic
atggcaaccaggauggaatuct

SEQ ID NO: 28287 - DNA, 20 bp, Artificial Sequence
  Synthetic
ctcacgggcauagacgtcug

SEQ ID NO: 28288 - DNA, 20 bp, Artificial Sequence
  Synthetic
acccccauctccgctctuat

SEQ ID NO: 28289 - DNA, 23 bp, Artificial Sequence
  Synthetic
gtaggaauctgagaugcccagag

SEQ ID NO: 28290 - DNA, 20 bp, Artificial Sequence
  Synthetic
cagagucccctttgccugag

SEQ ID NO: 28291 - DNA, 21 bp, Artificial Sequence
  Synthetic
gcaccaugggagaaagguagg

SEQ ID NO: 28292 - DNA, 25 bp, Artificial Sequence
  Synthetic
gtgcctggaaguttcagatcttgua

SEQ ID NO: 28293 - DNA, 19 bp, Artificial Sequence
  Synthetic
cugtgagctgucccaggag

SEQ ID NO: 28294 - DNA, 23 bp, Artificial Sequence
  Synthetic
gaggagacacagcuggatcttuc

SEQ ID NO: 28295 - DNA, 22 bp, Artificial Sequence
  Synthetic
gacagtcagaauccagcacuct

SEQ ID NO: 28296 - DNA, 25 bp, Artificial Sequence
  Synthetic
gggtagggauttagatacucacacc

SEQ ID NO: 28297 - DNA, 18 bp, Artificial Sequence
  Synthetic
gcgugagggacgucacac

SEQ ID NO: 28298 - DNA, 23 bp, Artificial Sequence
  Synthetic
cagtgtcccuaagaagagaccug

SEQ ID NO: 28299 - DNA, 20 bp, Artificial Sequence
  Synthetic
cctcccucgaagcggacaua

SEQ ID NO: 28300 - DNA, 18 bp, Artificial Sequence
  Synthetic
cttccuccctcccuccca

SEQ ID NO: 28301 - DNA, 18 bp, Artificial Sequence
  Synthetic
catgacgcagugggcuca

SEQ ID NO: 28302 - DNA, 17 bp, Artificial Sequence
  Synthetic
agcagcugcaggaccuc

SEQ ID NO: 28303 - DNA, 19 bp, Artificial Sequence
  Synthetic
gcttcucccctccaugacc

SEQ ID NO: 28304 - DNA, 17 bp, Artificial Sequence
  Synthetic
gggccuggtcgcugaac

SEQ ID NO: 28305 - DNA, 18 bp, Artificial Sequence
  Synthetic
cctggguctggcccauac

SEQ ID NO: 28306 - DNA, 24 bp, Artificial Sequence
  Synthetic
cttctcctcaccuaacccatcauc

SEQ ID NO: 28307 - DNA, 21 bp, Artificial Sequence
  Synthetic
cttggacacacgcagucatuc

SEQ ID NO: 28308 - DNA, 18 bp, Artificial Sequence
  Synthetic
gcugtgagaugcggcact

SEQ ID NO: 28309 - DNA, 22 bp, Artificial Sequence
  Synthetic
cccagagcutaaaccgaaugga

SEQ ID NO: 28310 - DNA, 23 bp, Artificial Sequence
  Synthetic
gggcttcucttctctgtcuacca

SEQ ID NO: 28311 - DNA, 23 bp, Artificial Sequence
  Synthetic
cagcugaaccagaucaaaaaccc

SEQ ID NO: 28312 - DNA, 28 bp, Artificial Sequence
  Synthetic
tctactatcaucacacaaactaguccca

SEQ ID NO: 28313 - DNA, 28 bp, Artificial Sequence
  Synthetic
ctctcaagtcugacaattgttttuccag

SEQ ID NO: 28314 - DNA, 25 bp, Artificial Sequence
  Synthetic
ctagggagaaguagatcctagcuca

SEQ ID NO: 28315 - DNA, 24 bp, Artificial Sequence
  Synthetic
caaagtgcaccuctgactcctaut

SEQ ID NO: 28316 - DNA, 24 bp, Artificial Sequence
  Synthetic
agaaaaacagaagcuggcagctua

SEQ ID NO: 28317 - DNA, 22 bp, Artificial Sequence
  Synthetic
aataaactgcucacccgtcucc

SEQ ID NO: 28318 - DNA, 24 bp, Artificial Sequence
  Synthetic
aagggaatgguggctttgttttua

SEQ ID NO: 28319 - DNA, 25 bp, Artificial Sequence
  Synthetic
accaaggtgguctttgctttctuag

SEQ ID NO: 28320 - DNA, 23 bp, Artificial Sequence
  Synthetic
ctgcttcuggtttccatugcaag

SEQ ID NO: 28321 - DNA, 26 bp, Artificial Sequence
  Synthetic
tggtcgtgtcugctcttcttttauag

SEQ ID NO: 28322 - DNA, 24 bp, Artificial Sequence
  Synthetic
gacacatgcacutaaaagcauccc

SEQ ID NO: 28323 - DNA, 22 bp, Artificial Sequence
  Synthetic
gtaagtgguagttggcctugga

SEQ ID NO: 28324 - DNA, 21 bp, Artificial Sequence
  Synthetic
gttgaagugggatcccuccaa

SEQ ID NO: 28325 - DNA, 25 bp, Artificial Sequence
  Synthetic
gcttcacaaguccttcagttcttut

SEQ ID NO: 28326 - DNA, 19 bp, Artificial Sequence
  Synthetic
gtcuggagacagccagguc

SEQ ID NO: 28327 - DNA, 25 bp, Artificial Sequence
  Synthetic
ccccttttcgcugttcctgatatut

SEQ ID NO: 28328 - DNA, 27 bp, Artificial Sequence
  Synthetic
auttttaaatcucacagggacagagct

SEQ ID NO: 28329 - DNA, 24 bp, Artificial Sequence
  Synthetic
cctgagcugagaaggctttucaat

SEQ ID NO: 28330 - DNA, 21 bp, Artificial Sequence
  Synthetic
ccacacgcucgtcttctguaa

SEQ ID NO: 28331 - DNA, 23 bp, Artificial Sequence
  Synthetic
cccctccutttcttgtugaccag

SEQ ID NO: 28332 - DNA, 29 bp, Artificial Sequence
  Synthetic
agctgaguacagaaaaatuagacaaaggg

SEQ ID NO: 28333 - DNA, 27 bp, Artificial Sequence
  Synthetic
ctcttagtgacuccaggatcttttugg

SEQ ID NO: 28334 - DNA, 29 bp, Artificial Sequence
  Synthetic
aaaagaggcauagtcacaataaagucagt

SEQ ID NO: 28335 - DNA, 22 bp, Artificial Sequence
  Synthetic
tgacacgcccutctctgtttut

SEQ ID NO: 28336 - DNA, 26 bp, Artificial Sequence
  Synthetic
gccaaagccauagtagtagtcaucac

SEQ ID NO: 28337 - DNA, 30 bp, Artificial Sequence
  Synthetic
aaggctgcaatgugaatattaacatgatuc

SEQ ID NO: 28338 - DNA, 21 bp, Artificial Sequence
  Synthetic
cctcctucccgagtagucact

SEQ ID NO: 28339 - DNA, 24 bp, Artificial Sequence
  Synthetic
cgacgagtgugacacatactucaa

SEQ ID NO: 28340 - DNA, 20 bp, Artificial Sequence
  Synthetic
ggagaagggcucctacctug

SEQ ID NO: 28341 - DNA, 25 bp, Artificial Sequence
  Synthetic
ctccaaucggcggagtatatuagag

SEQ ID NO: 28342 - DNA, 22 bp, Artificial Sequence
  Synthetic
gaaatuggacagccugacacac

SEQ ID NO: 28343 - DNA, 21 bp, Artificial Sequence
  Synthetic
agaacucccacugaggaacct

SEQ ID NO: 28344 - DNA, 19 bp, Artificial Sequence
  Synthetic
gauggtacccuggcccaac

SEQ ID NO: 28345 - DNA, 18 bp, Artificial Sequence
  Synthetic
cctgaggcuccctgcuca

SEQ ID NO: 28346 - DNA, 22 bp, Artificial Sequence
  Synthetic
gggttggautagctcugcagat

SEQ ID NO: 28347 - DNA, 24 bp, Artificial Sequence
  Synthetic
tgttctttccutcttctgcctugg

SEQ ID NO: 28348 - DNA, 22 bp, Artificial Sequence
  Synthetic
ggattgagtuccaggctgtucc

SEQ ID NO: 28349 - DNA, 25 bp, Artificial Sequence
  Synthetic
agttcagaccuccgaatagguagac

SEQ ID NO: 28350 - DNA, 22 bp, Artificial Sequence
  Synthetic
cccctcacutacagcctctuct

SEQ ID NO: 28351 - DNA, 19 bp, Artificial Sequence
  Synthetic
ggtgcccacuccaaggauc

SEQ ID NO: 28352 - DNA, 22 bp, Artificial Sequence
  Synthetic
ggagtagtgagugcccgaagua

SEQ ID NO: 28353 - DNA, 22 bp, Artificial Sequence
  Synthetic
cagauctgccugacaaacacca

SEQ ID NO: 28354 - DNA, 18 bp, Artificial Sequence
  Synthetic
gggagggugagctgguca

SEQ ID NO: 28355 - DNA, 19 bp, Artificial Sequence
  Synthetic
tgtccccugccaacucaga

SEQ ID NO: 28356 - DNA, 23 bp, Artificial Sequence
  Synthetic
ctgtcaccugaggtggtgaatua

SEQ ID NO: 28357 - DNA, 21 bp, Artificial Sequence
  Synthetic
gugggaccacctuaccaagac

SEQ ID NO: 28358 - DNA, 25 bp, Artificial Sequence
  Synthetic
ccctaaacaacgutctatcuggcaa

SEQ ID NO: 28359 - DNA, 21 bp, Artificial Sequence
  Synthetic
gccagcacucagacacacuaa

SEQ ID NO: 28360 - DNA, 21 bp, Artificial Sequence
  Synthetic
ttgactgggacuccctctcut

SEQ ID NO: 28361 - DNA, 20 bp, Artificial Sequence
  Synthetic
tgccttttcuggccttcugg

SEQ ID NO: 28362 - DNA, 18 bp, Artificial Sequence
  Synthetic
gggccttuagcccaaguc

SEQ ID NO: 28363 - DNA, 18 bp, Artificial Sequence
  Synthetic
gtcgtguggctgcaggua

SEQ ID NO: 28364 - DNA, 22 bp, Artificial Sequence
  Synthetic
cagtggaaagccucgtacucaa

SEQ ID NO: 28365 - DNA, 22 bp, Artificial Sequence
  Synthetic
aatgagatuaaggcccgctcug

SEQ ID NO: 28366 - DNA, 20 bp, Artificial Sequence
  Synthetic
cagcugggccgagttctuaa

SEQ ID NO: 28367 - DNA, 17 bp, Artificial Sequence
  Synthetic
gagcugcggatctugcg

SEQ ID NO: 28368 - DNA, 21 bp, Artificial Sequence
  Synthetic
gcttugaaagcccctccatuc

SEQ ID NO: 28369 - DNA, 20 bp, Artificial Sequence
  Synthetic
caucacaccccacgaguaca

SEQ ID NO: 28370 - DNA, 20 bp, Artificial Sequence
  Synthetic
cgggaagcugtcctttuggg

SEQ ID NO: 28371 - DNA, 18 bp, Artificial Sequence
  Synthetic
gggccaccaaugccaaug

SEQ ID NO: 28372 - DNA, 20 bp, Artificial Sequence
  Synthetic
cctctgcuttggccaaucct

SEQ ID NO: 28373 - DNA, 24 bp, Artificial Sequence
  Synthetic
cgctgttctcuttggtgtcatuca

SEQ ID NO: 28374 - DNA, 27 bp, Artificial Sequence
  Synthetic
tctagagatttcacugtgtctgcatug

SEQ ID NO: 28375 - DNA, 21 bp, Artificial Sequence
  Synthetic
ggccaccuccgttgtgaauaa

SEQ ID NO: 28376 - DNA, 24 bp, Artificial Sequence
  Synthetic
gccaggattuccttgggaaagaut

SEQ ID NO: 28377 - DNA, 26 bp, Artificial Sequence
  Synthetic
atccataugcagattgattctuggct

SEQ ID NO: 28378 - DNA, 20 bp, Artificial Sequence
  Synthetic
gtccgcucgtggatcugaag

SEQ ID NO: 28379 - DNA, 19 bp, Artificial Sequence
  Synthetic
ccgccgaccuatgucaagg

SEQ ID NO: 28380 - DNA, 22 bp, Artificial Sequence
  Synthetic
tgcttcaagucatactcuccgt

SEQ ID NO: 28381 - DNA, 25 bp, Artificial Sequence
  Synthetic
gatatccuggaaaccacatcctucc

SEQ ID NO: 28382 - DNA, 21 bp, Artificial Sequence
  Synthetic
tctccacggaaccgutttcuc

SEQ ID NO: 28383 - DNA, 24 bp, Artificial Sequence
  Synthetic
cgctatcugccatgatgatgucat

SEQ ID NO: 28384 - DNA, 24 bp, Artificial Sequence
  Synthetic
catgtgcauccgaatatgttgcug

SEQ ID NO: 28385 - DNA, 22 bp, Artificial Sequence
  Synthetic
tcttaagcugtcagagcuccct

SEQ ID NO: 28386 - DNA, 19 bp, Artificial Sequence
  Synthetic
cuccctuggaagccaccag

SEQ ID NO: 28387 - DNA, 28 bp, Artificial Sequence
  Synthetic
ccatagaugaaccgagtctttcttuaga

SEQ ID NO: 28388 - DNA, 19 bp, Artificial Sequence
  Synthetic
gttgcccutggtggugaag

SEQ ID NO: 28389 - DNA, 18 bp, Artificial Sequence
  Synthetic
ccactguggcgcuagaca

SEQ ID NO: 28390 - DNA, 18 bp, Artificial Sequence
  Synthetic
agggatgutggcgugagg

SEQ ID NO: 28391 - DNA, 18 bp, Artificial Sequence
  Synthetic
gcagauccagcucaccga

SEQ ID NO: 28392 - DNA, 24 bp, Artificial Sequence
  Synthetic
gtcacattagugttggccacttug

SEQ ID NO: 28393 - DNA, 19 bp, Artificial Sequence
  Synthetic
caccagucccggcaguaag

SEQ ID NO: 28394 - DNA, 25 bp, Artificial Sequence
  Synthetic
gaactcagagaugctgaagaacucc

SEQ ID NO: 28395 - DNA, 26 bp, Artificial Sequence
  Synthetic
catcttttactugggcagagtcctua

SEQ ID NO: 28396 - DNA, 21 bp, Artificial Sequence
  Synthetic
gtcctccuccgagttgatgug

SEQ ID NO: 28397 - DNA, 23 bp, Artificial Sequence
  Synthetic
tcagggcucatgataaaucgcaa

SEQ ID NO: 28398 - DNA, 17 bp, Artificial Sequence
  Synthetic
cgugcgaggcgatuggt

SEQ ID NO: 28399 - DNA, 23 bp, Artificial Sequence
  Synthetic
gaaattgatgaugccctgcacug

SEQ ID NO: 28400 - DNA, 24 bp, Artificial Sequence
  Synthetic
ggctgctttutacttcactgugag

SEQ ID NO: 28401 - DNA, 22 bp, Artificial Sequence
  Synthetic
gaacaaguatgggucaccagca

SEQ ID NO: 28402 - DNA, 27 bp, Artificial Sequence
  Synthetic
gccctaatccauctgatgcttttucat

SEQ ID NO: 28403 - DNA, 29 bp, Artificial Sequence
  Synthetic
gcgactaacaaucaaagtgaaaagauaca

SEQ ID NO: 28404 - DNA, 23 bp, Artificial Sequence
  Synthetic
cgtttggctugtggtgtaatugg

SEQ ID NO: 28405 - DNA, 29 bp, Artificial Sequence
  Synthetic
cagtttctcacuacaggtacttuaaagca

SEQ ID NO: 28406 - DNA, 21 bp, Artificial Sequence
  Synthetic
cccuccaagccaaagttgaug

SEQ ID NO: 28407 - DNA, 24 bp, Artificial Sequence
  Synthetic
ttttcctgccagucctctacaaug

SEQ ID NO: 28408 - DNA, 23 bp, Artificial Sequence
  Synthetic
gagaaagguaccaagcuaacauc

SEQ ID NO: 28409 - DNA, 26 bp, Artificial Sequence
  Synthetic
cttcagcacaaaauattgcuccaaca

SEQ ID NO: 28410 - DNA, 26 bp, Artificial Sequence
  Synthetic
ggaaccacugacagtctaucacaaaa

SEQ ID NO: 28411 - DNA, 21 bp, Artificial Sequence
  Synthetic
cttccugagacgaagcctucc

SEQ ID NO: 28412 - DNA, 22 bp, Artificial Sequence
  Synthetic
catcggacucgatgtagacgut

SEQ ID NO: 28413 - DNA, 20 bp, Artificial Sequence
  Synthetic
gccctttcugaccaagcugt

SEQ ID NO: 28414 - DNA, 19 bp, Artificial Sequence
  Synthetic
gagcggccuttgctcttug

SEQ ID NO: 28415 - DNA, 17 bp, Artificial Sequence
  Synthetic
ccucagaagccggcgua

SEQ ID NO: 28416 - DNA, 21 bp, Artificial Sequence
  Synthetic
ggagcuccaccctctagucat

SEQ ID NO: 28417 - DNA, 22 bp, Artificial Sequence
  Synthetic
catagcgcuccaggttgtaguc

SEQ ID NO: 28418 - DNA, 20 bp, Artificial Sequence
  Synthetic
ccacccuaccccuggagaaa

SEQ ID NO: 28419 - DNA, 20 bp, Artificial Sequence
  Synthetic
tctgaggccutcctctuggt

SEQ ID NO: 28420 - DNA, 17 bp, Artificial Sequence
  Synthetic
cccagcucccccatuca

SEQ ID NO: 28421 - DNA, 18 bp, Artificial Sequence
  Synthetic
tctgaccccugaccccut

SEQ ID NO: 28422 - DNA, 17 bp, Artificial Sequence
  Synthetic
ggaccagccggcaucuc

SEQ ID NO: 28423 - DNA, 21 bp, Artificial Sequence
  Synthetic
cagggaaggucaggtgctuac

SEQ ID NO: 28424 - DNA, 24 bp, Artificial Sequence
  Synthetic
aagtgaggtctuctcaggctctua

SEQ ID NO: 28425 - DNA, 21 bp, Artificial Sequence
  Synthetic
gtgccaaguggtcaagatcug

SEQ ID NO: 28426 - DNA, 18 bp, Artificial Sequence
  Synthetic
gaggtcautgccgugcag

SEQ ID NO: 28427 - DNA, 20 bp, Artificial Sequence
  Synthetic
ccggaacuguacaccaacca

SEQ ID NO: 28428 - DNA, 23 bp, Artificial Sequence
  Synthetic
tgtctgtuggagaccagauggat

SEQ ID NO: 28429 - DNA, 22 bp, Artificial Sequence
  Synthetic
cgtccucattcttcuggcacag

SEQ ID NO: 28430 - DNA, 19 bp, Artificial Sequence
  Synthetic
gatctgucacccgctguct

SEQ ID NO: 28431 - DNA, 18 bp, Artificial Sequence
  Synthetic
cguggccatguggacagg

SEQ ID NO: 28432 - DNA, 19 bp, Artificial Sequence
  Synthetic
cggcauggacacgactcut

SEQ ID NO: 28433 - DNA, 20 bp, Artificial Sequence
  Synthetic
tgaattcauccgccccguag

SEQ ID NO: 28434 - DNA, 17 bp, Artificial Sequence
  Synthetic
gcuggcagcccctcauc

SEQ ID NO: 28435 - DNA, 19 bp, Artificial Sequence
  Synthetic
agaugtgcucccccaacac

SEQ ID NO: 28436 - DNA, 23 bp, Artificial Sequence
  Synthetic
acttagagggaaggutggauggt

SEQ ID NO: 28437 - DNA, 21 bp, Artificial Sequence
  Synthetic
aggtgtccutctcagcacuct

SEQ ID NO: 28438 - DNA, 24 bp, Artificial Sequence
  Synthetic
gctgtaaacagcuctgtgtttcug

SEQ ID NO: 28439 - DNA, 24 bp, Artificial Sequence
  Synthetic
ctcccgagutcaagtgattcucat

SEQ ID NO: 28440 - DNA, 25 bp, Artificial Sequence
  Synthetic
cttttcagtucagtggcatucacat

SEQ ID NO: 28441 - DNA, 29 bp, Artificial Sequence
  Synthetic
ggagaagtcauagagacagaaaguagagt

SEQ ID NO: 28442 - DNA, 17 bp, Artificial Sequence
  Synthetic
gctuccccagccuccag

SEQ ID NO: 28443 - DNA, 22 bp, Artificial Sequence
  Synthetic
cagaggucgaagaatcgctcut

SEQ ID NO: 28444 - DNA, 19 bp, Artificial Sequence
  Synthetic
cguggaccttcuggaggag

SEQ ID NO: 28445 - DNA, 19 bp, Artificial Sequence
  Synthetic
ccttgugggcaatcuggga

SEQ ID NO: 28446 - DNA, 26 bp, Artificial Sequence
  Synthetic
gaaatgaaccaaucattgagcacuga

SEQ ID NO: 28447 - DNA, 20 bp, Artificial Sequence
  Synthetic
tcctcagccuccgauaagca

SEQ ID NO: 28448 - DNA, 20 bp, Artificial Sequence
  Synthetic
gtcagggaagcugatuccca

SEQ ID NO: 28449 - DNA, 21 bp, Artificial Sequence
  Synthetic
gggagagtcuccacctctuac

SEQ ID NO: 28450 - DNA, 18 bp, Artificial Sequence
  Synthetic
gctccgcauccgtgacug

SEQ ID NO: 28451 - DNA, 18 bp, Artificial Sequence
  Synthetic
cctgctggucctgcttug

SEQ ID NO: 28452 - DNA, 19 bp, Artificial Sequence
  Synthetic
gggcuaaagggcucagagt

SEQ ID NO: 28453 - DNA, 19 bp, Artificial Sequence
  Synthetic
cgagctuccacctcgacug

SEQ ID NO: 28454 - DNA, 21 bp, Artificial Sequence
  Synthetic
gcacaggaggaagugccaaua

SEQ ID NO: 28455 - DNA, 21 bp, Artificial Sequence
  Synthetic
tcctgggcaagutctcucaga

SEQ ID NO: 28456 - DNA, 25 bp, Artificial Sequence
  Synthetic
tttagaatctcaaucgcctgctcuc

SEQ ID NO: 28457 - DNA, 29 bp, Artificial Sequence
  Synthetic
agctttctttuagaccacatatctgcuat

SEQ ID NO: 28458 - DNA, 22 bp, Artificial Sequence
  Synthetic
cgctcuccacccatctcactua

SEQ ID NO: 28459 - DNA, 25 bp, Artificial Sequence
  Synthetic
gtctacuacacaaggagcucagaga

SEQ ID NO: 28460 - DNA, 22 bp, Artificial Sequence
  Synthetic
gctgtcggacugaaactgtgut

SEQ ID NO: 28461 - DNA, 32 bp, Artificial Sequence
  Synthetic
ttcaattctcagaaaagcuaccattatcagua

SEQ ID NO: 28462 - DNA, 24 bp, Artificial Sequence
  Synthetic
gccctgtgautcaatgactgttut

SEQ ID NO: 28463 - DNA, 21 bp, Artificial Sequence
  Synthetic
gccaaggaaguccccaaguag

SEQ ID NO: 28464 - DNA, 20 bp, Artificial Sequence
  Synthetic
cagaggcugagcaggaaaug

SEQ ID NO: 28465 - DNA, 17 bp, Artificial Sequence
  Synthetic
agcctccucgccaguct

SEQ ID NO: 28466 - DNA, 23 bp, Artificial Sequence
  Synthetic
gcttgtaugacccaagctccuaa

SEQ ID NO: 28467 - DNA, 24 bp, Artificial Sequence
  Synthetic
ccccaatcacucagtctagtucac

SEQ ID NO: 28468 - DNA, 25 bp, Artificial Sequence
  Synthetic
tggcattgttgauatcacaggguat

SEQ ID NO: 28469 - DNA, 22 bp, Artificial Sequence
  Synthetic
gcacgggutagtaucacagagg

SEQ ID NO: 28470 - DNA, 24 bp, Artificial Sequence
  Synthetic
ctctcagctucttctctgcttuct

SEQ ID NO: 28471 - DNA, 26 bp, Artificial Sequence
  Synthetic
ctccctatggauggctctcttgauat

SEQ ID NO: 28472 - DNA, 20 bp, Artificial Sequence
  Synthetic
ccagugaggagccaucacat

SEQ ID NO: 28473 - DNA, 18 bp, Artificial Sequence
  Synthetic
ccccagaggugcugcaag

SEQ ID NO: 28474 - DNA, 19 bp, Artificial Sequence
  Synthetic
gggtuaccctgggugaaga

SEQ ID NO: 28475 - DNA, 20 bp, Artificial Sequence
  Synthetic
aggtatgugcagtgctuggg

SEQ ID NO: 28476 - DNA, 18 bp, Artificial Sequence
  Synthetic
ttcgccaucaaggtuggg

SEQ ID NO: 28477 - DNA, 19 bp, Artificial Sequence
  Synthetic
ctgtggcuccatggcucat

SEQ ID NO: 28478 - DNA, 20 bp, Artificial Sequence
  Synthetic
gggtugggccaagatcacut

SEQ ID NO: 28479 - DNA, 19 bp, Artificial Sequence
  Synthetic
ggtccccaucccactgtug

SEQ ID NO: 28480 - DNA, 17 bp, Artificial Sequence
  Synthetic
tugggaggugggagggt

SEQ ID NO: 28481 - DNA, 21 bp, Artificial Sequence
  Synthetic
cgaggctaccucacaggaaug

SEQ ID NO: 28482 - DNA, 21 bp, Artificial Sequence
  Synthetic
tccatugggaggaaagggaug

SEQ ID NO: 28483 - DNA, 18 bp, Artificial Sequence
  Synthetic
ccgacgaccucggctaug

SEQ ID NO: 28484 - DNA, 20 bp, Artificial Sequence
  Synthetic
gggctcutccattcucacac

SEQ ID NO: 28485 - DNA, 22 bp, Artificial Sequence
  Synthetic
cccaacccauggagacctauga

SEQ ID NO: 28486 - DNA, 22 bp, Artificial Sequence
  Synthetic
cccgggacaaagaaucctcuaa

SEQ ID NO: 28487 - DNA, 21 bp, Artificial Sequence
  Synthetic
actgaugccccaugaaaaccc

SEQ ID NO: 28488 - DNA, 25 bp, Artificial Sequence
  Synthetic
gtgagaccutgtctcugaagcaaat

SEQ ID NO: 28489 - DNA, 25 bp, Artificial Sequence
  Synthetic
cctgctgccautttctttcuaacag

SEQ ID NO: 28490 - DNA, 24 bp, Artificial Sequence
  Synthetic
agaatuccaggacaacatgtguca

SEQ ID NO: 28491 - DNA, 27 bp, Artificial Sequence
  Synthetic
agaatgacttuggttttcctctcucag

SEQ ID NO: 28492 - DNA, 23 bp, Artificial Sequence
  Synthetic
tgtctgcaacacugcaaaauact

SEQ ID NO: 28493 - DNA, 23 bp, Artificial Sequence
  Synthetic
gacattttgaugcaggctctucc

SEQ ID NO: 28494 - DNA, 18 bp, Artificial Sequence
  Synthetic
gtggacucaccgcacucc

SEQ ID NO: 28495 - DNA, 26 bp, Artificial Sequence
  Synthetic
atttttccaaaguaagaagucagcut

SEQ ID NO: 28496 - DNA, 17 bp, Artificial Sequence
  Synthetic
cggcuggaagcucagca

SEQ ID NO: 28497 - DNA, 18 bp, Artificial Sequence
  Synthetic
accgagccuggctcuact

SEQ ID NO: 28498 - DNA, 20 bp, Artificial Sequence
  Synthetic
catcaggcacacutgcugac

SEQ ID NO: 28499 - DNA, 22 bp, Artificial Sequence
  Synthetic
gcuccagaaaggaauccttcut

SEQ ID NO: 28500 - DNA, 23 bp, Artificial Sequence
  Synthetic
gtcatccacucatcgatgucaca

SEQ ID NO: 28501 - DNA, 22 bp, Artificial Sequence
  Synthetic
gctttutgcagacaugcacagg

SEQ ID NO: 28502 - DNA, 23 bp, Artificial Sequence
  Synthetic
aagaauaccagcccacatacugc

SEQ ID NO: 28503 - DNA, 24 bp, Artificial Sequence
  Synthetic
tgttatttcagucacctggtgcut

SEQ ID NO: 28504 - DNA, 31 bp, Artificial Sequence
  Synthetic
aaagtgatagtccuctatgttattttuggct

SEQ ID NO: 28505 - DNA, 27 bp, Artificial Sequence
  Synthetic
gtgatgctgtuggatttctctttcaut

SEQ ID NO: 28506 - DNA, 29 bp, Artificial Sequence
  Synthetic
tttgtacaatugcatagacgtguaaaacc

SEQ ID NO: 28507 - DNA, 28 bp, Artificial Sequence
  Synthetic
catgacagaugaagaaggagcagaauaa

SEQ ID NO: 28508 - DNA, 22 bp, Artificial Sequence
  Synthetic
gcgugcacacacacaattctua

SEQ ID NO: 28509 - DNA, 25 bp, Artificial Sequence
  Synthetic
ttccctttctgauatctctgccuct

SEQ ID NO: 28510 - DNA, 24 bp, Artificial Sequence
  Synthetic
ccaagatgagucaaacactuacgg

SEQ ID NO: 28511 - DNA, 25 bp, Artificial Sequence
  Synthetic
tcctctcctuctacctctcuacaga

SEQ ID NO: 28512 - DNA, 27 bp, Artificial Sequence
  Synthetic
gaattgatgctugttgcacctauaaaa

SEQ ID NO: 28513 - DNA, 21 bp, Artificial Sequence
  Synthetic
caagcuactgcgucaacacaa

SEQ ID NO: 28514 - DNA, 30 bp, Artificial Sequence
  Synthetic
agacataaaatgacuctaagtgaagatucc

SEQ ID NO: 28515 - DNA, 22 bp, Artificial Sequence
  Synthetic
cctgcccagaucttgattucct

SEQ ID NO: 28516 - DNA, 28 bp, Artificial Sequence
  Synthetic
tgctaattcctauatcctgtgctaucct

SEQ ID NO: 28517 - DNA, 31 bp, Artificial Sequence
  Synthetic
cgtcacataagtttuaatgagcttttacgut

SEQ ID NO: 28518 - DNA, 23 bp, Artificial Sequence
  Synthetic
agaaattgucaagtgacguggga

SEQ ID NO: 28519 - DNA, 22 bp, Artificial Sequence
  Synthetic
gccagugcagactgtctuagag

SEQ ID NO: 28520 - DNA, 24 bp, Artificial Sequence
  Synthetic
caggtgaacuaactctcacgucag

SEQ ID NO: 28521 - DNA, 27 bp, Artificial Sequence
  Synthetic
gtgttcttugggaatttgatucgaaga

SEQ ID NO: 28522 - DNA, 23 bp, Artificial Sequence
  Synthetic
gttacattuggcctgatgctugg

SEQ ID NO: 28523 - DNA, 26 bp, Artificial Sequence
  Synthetic
gaactgatauacacctccttugccat

SEQ ID NO: 28524 - DNA, 22 bp, Artificial Sequence
  Synthetic
caaaggaugcaactucacccaa

SEQ ID NO: 28525 - DNA, 25 bp, Artificial Sequence
  Synthetic
ggaattgagtuggatgtcaggtuct

SEQ ID NO: 28526 - DNA, 23 bp, Artificial Sequence
  Synthetic
agggccctgutgtaatgctaaut

SEQ ID NO: 28527 - DNA, 23 bp, Artificial Sequence
  Synthetic
ctatttaugaccgccuggagcaa

SEQ ID NO: 28528 - DNA, 29 bp, Artificial Sequence
  Synthetic
ctgtttctccccuctctaagtaaaaaugt

SEQ ID NO: 28529 - DNA, 27 bp, Artificial Sequence
  Synthetic
tgggttgtcugttatttctgauggaat

SEQ ID NO: 28530 - DNA, 20 bp, Artificial Sequence
  Synthetic
gttttgaccgccucagctug

SEQ ID NO: 28531 - DNA, 21 bp, Artificial Sequence
  Synthetic
gtgctttcagcugtgagctug

SEQ ID NO: 28532 - DNA, 31 bp, Artificial Sequence
  Synthetic
agtgataaaagcugaaaatgacttacuggaa

SEQ ID NO: 28533 - DNA, 28 bp, Artificial Sequence
  Synthetic
gtcttggagacucaaagtatcttaucag

SEQ ID NO: 28534 - DNA, 21 bp, Artificial Sequence
  Synthetic
gggcccugaagcaaagaagua

SEQ ID NO: 28535 - DNA, 29 bp, Artificial Sequence
  Synthetic
gcagagaaaaauagatgagaccctugaaa

SEQ ID NO: 28536 - DNA, 21 bp, Artificial Sequence
  Synthetic
ctccgucaccactgatcctuc

SEQ ID NO: 28537 - DNA, 29 bp, Artificial Sequence
  Synthetic
gccaaataagcacutcttttcatctcaut

SEQ ID NO: 28538 - DNA, 24 bp, Artificial Sequence
  Synthetic
ggcctttttgcuccacatctttuc

SEQ ID NO: 28539 - DNA, 25 bp, Artificial Sequence
  Synthetic
catattcttctucctgctgtccugt

SEQ ID NO: 28540 - DNA, 23 bp, Artificial Sequence
  Synthetic
actattttgutttgtcccuggct

SEQ ID NO: 28541 - DNA, 21 bp, Artificial Sequence
  Synthetic
acaggaugctacccguaagga

SEQ ID NO: 28542 - DNA, 26 bp, Artificial Sequence
  Synthetic
caguttagctggatuggaaaaacaaa

SEQ ID NO: 28543 - DNA, 29 bp, Artificial Sequence
  Synthetic
cagatgataucagaaaaguccacatgaua

SEQ ID NO: 28544 - DNA, 30 bp, Artificial Sequence
  Synthetic
ggtatctttgatacuaaccttggtttcugt

SEQ ID NO: 28545 - DNA, 24 bp, Artificial Sequence
  Synthetic
cggaggcaacagutgaatgaaaug

SEQ ID NO: 28546 - DNA, 29 bp, Artificial Sequence
  Synthetic
ttttattgaaactugtcatgcatctugct

SEQ ID NO: 28547 - DNA, 27 bp, Artificial Sequence
  Synthetic
gctgaagaacccugatactaagggaua

SEQ ID NO: 28548 - DNA, 22 bp, Artificial Sequence
  Synthetic
aagccagucggtaagttctguc

SEQ ID NO: 28549 - DNA, 29 bp, Artificial Sequence
  Synthetic
gaaattggctctutagcttgtgtttcuaa

SEQ ID NO: 28550 - DNA, 28 bp, Artificial Sequence
  Synthetic
tgattataaataguccacgtcaauggca

SEQ ID NO: 28551 - DNA, 26 bp, Artificial Sequence
  Synthetic
atctgcactauatgggttctttuccc

SEQ ID NO: 28552 - DNA, 26 bp, Artificial Sequence
  Synthetic
cuaataggagauaaccacagcagcag

SEQ ID NO: 28553 - DNA, 29 bp, Artificial Sequence
  Synthetic
tggcttatgcctugagaattatttaccut

SEQ ID NO: 28554 - DNA, 26 bp, Artificial Sequence
  Synthetic
aauaacctaaugggcagaaaaccaat

SEQ ID NO: 28555 - DNA, 29 bp, Artificial Sequence
  Synthetic
agataacattgcuagtatcccactugaac

SEQ ID NO: 28556 - DNA, 24 bp, Artificial Sequence
  Synthetic
gcctttcacccugcttataatcuc

SEQ ID NO: 28557 - DNA, 28 bp, Artificial Sequence
  Synthetic
aaacagaugccagtattcuacaggaaaa

SEQ ID NO: 28558 - DNA, 30 bp, Artificial Sequence
  Synthetic
agtccagatgtgcugaagataaatacaaut

SEQ ID NO: 28559 - DNA, 21 bp, Artificial Sequence
  Synthetic
tgcttttaccugcaggcgaut

SEQ ID NO: 28560 - DNA, 22 bp, Artificial Sequence
  Synthetic
actttgcaaugctgctgtctuc

SEQ ID NO: 28561 - DNA, 23 bp, Artificial Sequence
  Synthetic
caccatttgcuacctttgggaut

SEQ ID NO: 28562 - DNA, 23 bp, Artificial Sequence
  Synthetic
gaggtcaggagcautgagaagut

SEQ ID NO: 28563 - DNA, 28 bp, Artificial Sequence
  Synthetic
ggaggtttcacugttaggaagcuaaaaa

SEQ ID NO: 28564 - DNA, 22 bp, Artificial Sequence
  Synthetic
cttgctgagcuggatctgagut

SEQ ID NO: 28565 - DNA, 26 bp, Artificial Sequence
  Synthetic
gacaacagccuttgaaatttugagag

SEQ ID NO: 28566 - DNA, 27 bp, Artificial Sequence
  Synthetic
aatatgtgctcugaaaattcagtugga

SEQ ID NO: 28567 - DNA, 30 bp, Artificial Sequence
  Synthetic
ggaattggagcaguttaactcagatauaca

SEQ ID NO: 28568 - DNA, 25 bp, Artificial Sequence
  Synthetic
tttccacctuggagtagatctucct

SEQ ID NO: 28569 - DNA, 26 bp, Artificial Sequence
  Synthetic
caagtcctauctcttgctcauggaat

SEQ ID NO: 28570 - DNA, 27 bp, Artificial Sequence
  Synthetic
tcaaacacagaautgttactggucact

SEQ ID NO: 28571 - DNA, 27 bp, Artificial Sequence
  Synthetic
gttggtggaagauaaactcagtctuct

SEQ ID NO: 28572 - DNA, 31 bp, Artificial Sequence
  Synthetic
gtgttttcacgtaugttcaaaataacctuca

SEQ ID NO: 28573 - DNA, 27 bp, Artificial Sequence
  Synthetic
gtaagaugcgaaaggaaatgaatguct

SEQ ID NO: 28574 - DNA, 27 bp, Artificial Sequence
  Synthetic
tgcccgtugctttacaatttauaagga

SEQ ID NO: 28575 - DNA, 31 bp, Artificial Sequence
  Synthetic
aacttgtataaaaguctgagtgaagugaagt

SEQ ID NO: 28576 - DNA, 27 bp, Artificial Sequence
  Synthetic
ccaatcttgccaauaatcaagttgucc

SEQ ID NO: 28577 - DNA, 27 bp, Artificial Sequence
  Synthetic
ctgactaauaatgctatccucccaaca

SEQ ID NO: 28578 - DNA, 25 bp, Artificial Sequence
  Synthetic
caatataagcugccaactgcttguc

SEQ ID NO: 28579 - DNA, 27 bp, Artificial Sequence
  Synthetic
ttgttcagcaggautacagaaaagcua

SEQ ID NO: 28580 - DNA, 28 bp, Artificial Sequence
  Synthetic
agcaaacaaaactauaggatcagggauc

SEQ ID NO: 28581 - DNA, 28 bp, Artificial Sequence
  Synthetic
tgaccctattcuaagcaaaccaaatcuc

SEQ ID NO: 28582 - DNA, 22 bp, Artificial Sequence
  Synthetic
ccatgacuccgccatctgtuag

SEQ ID NO: 28583 - DNA, 26 bp, Artificial Sequence
  Synthetic
tcagaagatacugagcatttgcugat

SEQ ID NO: 28584 - DNA, 26 bp, Artificial Sequence
  Synthetic
catgttctuaaccactatgccucaca

SEQ ID NO: 28585 - DNA, 31 bp, Artificial Sequence
  Synthetic
gaaagtgaaactccutactgagtctguaaat

SEQ ID NO: 28586 - DNA, 26 bp, Artificial Sequence
  Synthetic
aggaaagagcagacugtatacaacut

SEQ ID NO: 28587 - DNA, 31 bp, Artificial Sequence
  Synthetic
ctgaagaagagtaucttgagagagatttuga

SEQ ID NO: 28588 - DNA, 25 bp, Artificial Sequence
  Synthetic
aggaacaaagccutaaccaaaagua

SEQ ID NO: 28589 - DNA, 22 bp, Artificial Sequence
  Synthetic
gccagagttugcttcgagacut

SEQ ID NO: 28590 - DNA, 22 bp, Artificial Sequence
  Synthetic
caaaauccaccccagctguaaa

SEQ ID NO: 28591 - DNA, 23 bp, Artificial Sequence
  Synthetic
tgccttauaacgggtctcgttuc

SEQ ID NO: 28592 - DNA, 23 bp, Artificial Sequence
  Synthetic
ctuttgacaatgcucaaccagct

SEQ ID NO: 28593 - DNA, 25 bp, Artificial Sequence
  Synthetic
aggcttuacaaagttctcugcaaga

SEQ ID NO: 28594 - DNA, 26 bp, Artificial Sequence
  Synthetic
ggtatggagaguttggtttctgacug

SEQ ID NO: 28595 - DNA, 28 bp, Artificial Sequence
  Synthetic
agtttgctgacaauttaggaaaacaugg

SEQ ID NO: 28596 - DNA, 21 bp, Artificial Sequence
  Synthetic
ggaacatggguccttgtccut

SEQ ID NO: 28597 - DNA, 30 bp, Artificial Sequence
  Synthetic
cttgccttactgcuttttaataccttctut

SEQ ID NO: 28598 - DNA, 22 bp, Artificial Sequence
  Synthetic
gcagtagtugtcatctgcucca

SEQ ID NO: 28599 - DNA, 27 bp, Artificial Sequence
  Synthetic
agatcatttcttucagtctgtgggtuc

SEQ ID NO: 28600 - DNA, 27 bp, Artificial Sequence
  Synthetic
guagaatcacagauaacaaagcacgga

SEQ ID NO: 28601 - DNA, 25 bp, Artificial Sequence
  Synthetic
tttgctgtctuaggttggatgtuga

SEQ ID NO: 28602 - DNA, 22 bp, Artificial Sequence
  Synthetic
ggtggaagutcctctugagcat

SEQ ID NO: 28603 - DNA, 26 bp, Artificial Sequence
  Synthetic
tgaagtctttcuagcaatgtcugacc

SEQ ID NO: 28604 - DNA, 23 bp, Artificial Sequence
  Synthetic
gcaaagttauccagccatgctuc

SEQ ID NO: 28605 - DNA, 25 bp, Artificial Sequence
  Synthetic
caacccaggcutattctgtgatcut

SEQ ID NO: 28606 - DNA, 28 bp, Artificial Sequence
  Synthetic
tttaaagccagtugtgtgaatcttgtuc

SEQ ID NO: 28607 - DNA, 28 bp, Artificial Sequence
  Synthetic
catgtgugagaaactagctguaaaagac

SEQ ID NO: 28608 - DNA, 28 bp, Artificial Sequence
  Synthetic
tttctaguagaaagcacgcaacauaaga

SEQ ID NO: 28609 - DNA, 27 bp, Artificial Sequence
  Synthetic
tgctttcaaagaggucataataggcut

SEQ ID NO: 28610 - DNA, 23 bp, Artificial Sequence
  Synthetic
cctgaggcautcccatctugaat

SEQ ID NO: 28611 - DNA, 30 bp, Artificial Sequence
  Synthetic
cacaccgattuacctagagttctaatuaca

SEQ ID NO: 28612 - DNA, 22 bp, Artificial Sequence
  Synthetic
gcaaugtgtccucagcagaaag

SEQ ID NO: 28613 - DNA, 29 bp, Artificial Sequence
  Synthetic
gcaaagacautaattgtguaacacccaat

SEQ ID NO: 28614 - DNA, 30 bp, Artificial Sequence
  Synthetic
agaaaacatcttgaauagtagctgtcctut

SEQ ID NO: 28615 - DNA, 25 bp, Artificial Sequence
  Synthetic
ctcttccaagutttgccucaacaag

SEQ ID NO: 28616 - DNA, 25 bp, Artificial Sequence
  Synthetic
agcagtgguagtccagaaattuacc

SEQ ID NO: 28617 - DNA, 30 bp, Artificial Sequence
  Synthetic
gcatggaagtaaauctcatggaacattcua

SEQ ID NO: 28618 - DNA, 23 bp, Artificial Sequence
  Synthetic
agctggtggugaagttgatuaca

SEQ ID NO: 28619 - DNA, 29 bp, Artificial Sequence
  Synthetic
cttgctcaaggaaugcattttcttaugaa

SEQ ID NO: 28620 - DNA, 25 bp, Artificial Sequence
  Synthetic
tttactcaccagaugagaccucaga

SEQ ID NO: 28621 - DNA, 25 bp, Artificial Sequence
  Synthetic
aaacaggugcaaaaagattgtgugt

SEQ ID NO: 28622 - DNA, 23 bp, Artificial Sequence
  Synthetic
cuctacttctucccaccaaagca

SEQ ID NO: 28623 - DNA, 22 bp, Artificial Sequence
  Synthetic
ggatcactcacuttcccccuac

SEQ ID NO: 28624 - DNA, 17 bp, Artificial Sequence
  Synthetic
cacccugccctgcagua

SEQ ID NO: 28625 - DNA, 28 bp, Artificial Sequence
  Synthetic
tgcattgttuaacaggatcctcagatua

SEQ ID NO: 28626 - DNA, 27 bp, Artificial Sequence
  Synthetic
caatgaatcaccauagtacatggguct

SEQ ID NO: 28627 - DNA, 28 bp, Artificial Sequence
  Synthetic
tcagatctgctgauagccatagcataua

SEQ ID NO: 28628 - DNA, 26 bp, Artificial Sequence
  Synthetic
guatttgcctttatugcaagggaagt

SEQ ID NO: 28629 - DNA, 23 bp, Artificial Sequence
  Synthetic
gttgcuagaggcagacaaauccc

SEQ ID NO: 28630 - DNA, 30 bp, Artificial Sequence
  Synthetic
cttagattatcuttttcttggttugccaca

SEQ ID NO: 28631 - DNA, 22 bp, Artificial Sequence
  Synthetic
gtgaggtaaucagccaggauct

SEQ ID NO: 28632 - DNA, 22 bp, Artificial Sequence
  Synthetic
gcgaattuacgcctggattuca

SEQ ID NO: 28633 - DNA, 28 bp, Artificial Sequence
  Synthetic
attgcatcugaggatgattuaagagagg

SEQ ID NO: 28634 - DNA, 24 bp, Artificial Sequence
  Synthetic
ttgcctttuactgtcccaugaagt

SEQ ID NO: 28635 - DNA, 26 bp, Artificial Sequence
  Synthetic
aaccttcagagaggcaucaatttgua

SEQ ID NO: 28636 - DNA, 22 bp, Artificial Sequence
  Synthetic
aaccctgcaaagcugaaaccua

SEQ ID NO: 28637 - DNA, 31 bp, Artificial Sequence
  Synthetic
cttctttctugacaagtaacacaacaucaaa

SEQ ID NO: 28638 - DNA, 17 bp, Artificial Sequence
  Synthetic
gccuggcgggcaaacua

SEQ ID NO: 28639 - DNA, 22 bp, Artificial Sequence
  Synthetic
ccguctctuggagaagaagcag

SEQ ID NO: 28640 - DNA, 24 bp, Artificial Sequence
  Synthetic
atttcagcacuaagaactgugcct

SEQ ID NO: 28641 - DNA, 29 bp, Artificial Sequence
  Synthetic
agatgttacagttcucacagtcttgaaug

SEQ ID NO: 28642 - DNA, 22 bp, Artificial Sequence
  Synthetic
gcagcgtguttttccggaatug

SEQ ID NO: 28643 - DNA, 25 bp, Artificial Sequence
  Synthetic
ctgcatcttugaactggaaagcuaa

SEQ ID NO: 28644 - DNA, 24 bp, Artificial Sequence
  Synthetic
gatgctgtggutcaggactatgut

SEQ ID NO: 28645 - DNA, 31 bp, Artificial Sequence
  Synthetic
gtgtatgactatttcucttctctttctccut

SEQ ID NO: 28646 - DNA, 26 bp, Artificial Sequence
  Synthetic
tcagacaaaggaagugtccaugaaag

SEQ ID NO: 28647 - DNA, 28 bp, Artificial Sequence
  Synthetic
aggcaatguaaaacaaatgtuaaaggca

SEQ ID NO: 28648 - DNA, 26 bp, Artificial Sequence
  Synthetic
cctgttattgccutggagtttaaugg

SEQ ID NO: 28649 - DNA, 30 bp, Artificial Sequence
  Synthetic
aagcaacatuagggacaaaagtatuaaagt

SEQ ID NO: 28650 - DNA, 23 bp, Artificial Sequence
  Synthetic
gggcaaaaggguaattcucaagt

SEQ ID NO: 28651 - DNA, 24 bp, Artificial Sequence
  Synthetic
gttacacccuaaagccugaaacct

SEQ ID NO: 28652 - DNA, 22 bp, Artificial Sequence
  Synthetic
gaauctcacugacgaggcagag

SEQ ID NO: 28653 - DNA, 25 bp, Artificial Sequence
  Synthetic
gcagacatcaugagtactccttugg

SEQ ID NO: 28654 - DNA, 23 bp, Artificial Sequence
  Synthetic
actccuaaagacccugcaaaacc

SEQ ID NO: 28655 - DNA, 30 bp, Artificial Sequence
  Synthetic
acaacaaatataagguccactttgctttuc

SEQ ID NO: 28656 - DNA, 26 bp, Artificial Sequence
  Synthetic
ggttgaatcctutagccctacttuct

SEQ ID NO: 28657 - DNA, 25 bp, Artificial Sequence
  Synthetic
gaccacataugcacacatatcucca

SEQ ID NO: 28658 - DNA, 23 bp, Artificial Sequence
  Synthetic
ggucctggagcugaacaacaaat

SEQ ID NO: 28659 - DNA, 25 bp, Artificial Sequence
  Synthetic
ctggatatcugcagtacccagatug

SEQ ID NO: 28660 - DNA, 20 bp, Artificial Sequence
  Synthetic
gatctctguacggcccctuc

SEQ ID NO: 28661 - DNA, 24 bp, Artificial Sequence
  Synthetic
gttccugacacagacagacuacac

SEQ ID NO: 28662 - DNA, 18 bp, Artificial Sequence
  Synthetic
cuacgggcugggcaagat

SEQ ID NO: 28663 - DNA, 19 bp, Artificial Sequence
  Synthetic
ccatucccagccgtcagug

SEQ ID NO: 28664 - DNA, 21 bp, Artificial Sequence
  Synthetic
tcccacccugaggtacactut

SEQ ID NO: 28665 - DNA, 22 bp, Artificial Sequence
  Synthetic
tgttaatggcacuctgggaucg

SEQ ID NO: 28666 - DNA, 28 bp, Artificial Sequence
  Synthetic
aatagagaccucactatttgcaatgucc

SEQ ID NO: 28667 - DNA, 25 bp, Artificial Sequence
  Synthetic
agtacacctggugttaggagtuact

SEQ ID NO: 28668 - DNA, 20 bp, Artificial Sequence
  Synthetic
gctgtggutccacgauaggg

SEQ ID NO: 28669 - DNA, 23 bp, Artificial Sequence
  Synthetic
gcagattcugttctctacuggca

SEQ ID NO: 28670 - DNA, 27 bp, Artificial Sequence
  Synthetic
gggagtcuaagaagaattugaggaaga

SEQ ID NO: 28671 - DNA, 29 bp, Artificial Sequence
  Synthetic
gcttgttgacugagcagatataacaugag

SEQ ID NO: 28672 - DNA, 23 bp, Artificial Sequence
  Synthetic
gggtaaccauggtgaatgagtug

SEQ ID NO: 28673 - DNA, 24 bp, Artificial Sequence
  Synthetic
gtaccaggcuagtggtcagacaua

SEQ ID NO: 28674 - DNA, 26 bp, Artificial Sequence
  Synthetic
atgtagatcuaagagccagaaugcac

SEQ ID NO: 28675 - DNA, 25 bp, Artificial Sequence
  Synthetic
tccttctatuccccttttcgctuac

SEQ ID NO: 28676 - DNA, 23 bp, Artificial Sequence
  Synthetic
ggcctacacautgaggagugaag

SEQ ID NO: 28677 - DNA, 25 bp, Artificial Sequence
  Synthetic
cagaggtaacuagagagtgguaggg

SEQ ID NO: 28678 - DNA, 26 bp, Artificial Sequence
  Synthetic
acttagtactgcugttctgtgaacug

SEQ ID NO: 28679 - DNA, 27 bp, Artificial Sequence
  Synthetic
gaagaaacgauctagugcaaggaaaag

SEQ ID NO: 28680 - DNA, 23 bp, Artificial Sequence
  Synthetic
ccttggaucttcccattaugcct

SEQ ID NO: 28681 - DNA, 23 bp, Artificial Sequence
  Synthetic
tcccttcaaucttctcctugggt

SEQ ID NO: 28682 - DNA, 21 bp, Artificial Sequence
  Synthetic
agatcggugctggagtcugat

SEQ ID NO: 28683 - DNA, 23 bp, Artificial Sequence
  Synthetic
ctgttuaaggagccucaaaccca

SEQ ID NO: 28684 - DNA, 21 bp, Artificial Sequence
  Synthetic
actggtcccuttcaactgucc

SEQ ID NO: 28685 - DNA, 25 bp, Artificial Sequence
  Synthetic
cuagcagggagaagauagggaagaa

SEQ ID NO: 28686 - DNA, 22 bp, Artificial Sequence
  Synthetic
ttgcatttcucacccccgttua

SEQ ID NO: 28687 - DNA, 25 bp, Artificial Sequence
  Synthetic
tcagttatuccgaagctctgctuac

SEQ ID NO: 28688 - DNA, 24 bp, Artificial Sequence
  Synthetic
gcaggcctucttcaacactacuat

SEQ ID NO: 28689 - DNA, 21 bp, Artificial Sequence
  Synthetic
caaagctguagcggtuagcag

SEQ ID NO: 28690 - DNA, 23 bp, Artificial Sequence
  Synthetic
aggtttttccugagggcattugt

SEQ ID NO: 28691 - DNA, 20 bp, Artificial Sequence
  Synthetic
gtcacugccccacuagcaaa

SEQ ID NO: 28692 - DNA, 25 bp, Artificial Sequence
  Synthetic
gcacacacauaaacccacauacagt

SEQ ID NO: 28693 - DNA, 23 bp, Artificial Sequence
  Synthetic
ctggttcagaucagggtcactua

SEQ ID NO: 28694 - DNA, 20 bp, Artificial Sequence
  Synthetic
cctatcucccacccgugaac

SEQ ID NO: 28695 - DNA, 22 bp, Artificial Sequence
  Synthetic
gtgggaggaaggugaaacugac

SEQ ID NO: 28696 - DNA, 23 bp, Artificial Sequence
  Synthetic
cctcatgcagcucatttgctauc

SEQ ID NO: 28697 - DNA, 29 bp, Artificial Sequence
  Synthetic
tccttttctcaaggutcctattgtttcuc

SEQ ID NO: 28698 - DNA, 24 bp, Artificial Sequence
  Synthetic
ctcctaccauctgctttcctucac

SEQ ID NO: 28699 - DNA, 25 bp, Artificial Sequence
  Synthetic
tgggtccuaacatgtttctauccga

SEQ ID NO: 28700 - DNA, 30 bp, Artificial Sequence
  Synthetic
ctcttctcttctcutctcttctttctctug

SEQ ID NO: 28701 - DNA, 23 bp, Artificial Sequence
  Synthetic
agtaacccctuaggtgcatccut

SEQ ID NO: 28702 - DNA, 26 bp, Artificial Sequence
  Synthetic
ctcagattggaacuaagctttccuga

SEQ ID NO: 28703 - DNA, 22 bp, Artificial Sequence
  Synthetic
cttggguatgaaacugcaggga

SEQ ID NO: 28704 - DNA, 26 bp, Artificial Sequence
  Synthetic
tgtatctctgaacucttgtcccauct

SEQ ID NO: 28705 - DNA, 20 bp, Artificial Sequence
  Synthetic
gggcagacaauggaacaugc

SEQ ID NO: 28706 - DNA, 21 bp, Artificial Sequence
  Synthetic
gtttggaacaguccgagugga

SEQ ID NO: 28707 - DNA, 22 bp, Artificial Sequence
  Synthetic
gctcuggagcctttttcucagg

SEQ ID NO: 28708 - DNA, 22 bp, Artificial Sequence
  Synthetic
ctacaacccacucaccctctuc

SEQ ID NO: 28709 - DNA, 22 bp, Artificial Sequence
  Synthetic
gtaggtcccuccagcattccua

SEQ ID NO: 28710 - DNA, 24 bp, Artificial Sequence
  Synthetic
tcatgggttuagaaccctcctcut

SEQ ID NO: 28711 - DNA, 23 bp, Artificial Sequence
  Synthetic
gtgaagaucccaagtgtctccuc

SEQ ID NO: 28712 - DNA, 21 bp, Artificial Sequence
  Synthetic
aagctgctcugcatactcucg

SEQ ID NO: 28713 - DNA, 20 bp, Artificial Sequence
  Synthetic
caggtggcggguaggatcua

SEQ ID NO: 28714 - DNA, 22 bp, Artificial Sequence
  Synthetic
cctgcuaacgtttcttucaggt

SEQ ID NO: 28715 - DNA, 21 bp, Artificial Sequence
  Synthetic
gtaggauggctgtugaacgga

SEQ ID NO: 28716 - DNA, 22 bp, Artificial Sequence
  Synthetic
cagcccttuagttctgaggcut

SEQ ID NO: 28717 - DNA, 20 bp, Artificial Sequence
  Synthetic
ggctgtaguccagcagcuac

SEQ ID NO: 28718 - DNA, 22 bp, Artificial Sequence
  Synthetic
attccatccccutccctcgaua

SEQ ID NO: 28719 - DNA, 25 bp, Artificial Sequence
  Synthetic
ggautgggaatuaagaggaaagggt

SEQ ID NO: 28720 - DNA, 23 bp, Artificial Sequence
  Synthetic
cctttccccuctgttttgagcut

SEQ ID NO: 28721 - DNA, 20 bp, Artificial Sequence
  Synthetic
cctccagcggaaucttcguc

SEQ ID NO: 28722 - DNA, 23 bp, Artificial Sequence
  Synthetic
gtgggagucgtaggtttagtugt

SEQ ID NO: 28723 - DNA, 26 bp, Artificial Sequence
  Synthetic
gtacatacauagtaggtggcuagcct

SEQ ID NO: 28724 - DNA, 22 bp, Artificial Sequence
  Synthetic
tgaguggcaaggaagctuaagg

SEQ ID NO: 28725 - DNA, 27 bp, Artificial Sequence
  Synthetic
ctcctcagacaaaaguagacaatcuct

SEQ ID NO: 28726 - DNA, 23 bp, Artificial Sequence
  Synthetic
ttccuctttggccucagagaaag

SEQ ID NO: 28727 - DNA, 24 bp, Artificial Sequence
  Synthetic
gcaatcugagcattcuccacagaa

SEQ ID NO: 28728 - DNA, 24 bp, Artificial Sequence
  Synthetic
ctgauacaggaagagcagauccag

SEQ ID NO: 28729 - DNA, 26 bp, Artificial Sequence
  Synthetic
tgttcctctcauaggccttaatcuca

SEQ ID NO: 28730 - DNA, 27 bp, Artificial Sequence
  Synthetic
tccaaatttucccaatcaacuggagat

SEQ ID NO: 28731 - DNA, 26 bp, Artificial Sequence
  Synthetic
ctttcttacauaccagtgttgcucac

SEQ ID NO: 28732 - DNA, 25 bp, Artificial Sequence
  Synthetic
tgatgaaaacutcctgatggugaca

SEQ ID NO: 28733 - DNA, 25 bp, Artificial Sequence
  Synthetic
gagcccacttauggtgactaagaut

SEQ ID NO: 28734 - DNA, 25 bp, Artificial Sequence
  Synthetic
caaaccttgguactccattttuccc

SEQ ID NO: 28735 - DNA, 28 bp, Artificial Sequence
  Synthetic
ccgttgacatuaacagcaagtttucaaa

SEQ ID NO: 28736 - DNA, 22 bp, Artificial Sequence
  Synthetic
gggcutggtgttuagaagaaca

SEQ ID NO: 28737 - DNA, 27 bp, Artificial Sequence
  Synthetic
gutctcctctaucacagaaaagacact

SEQ ID NO: 28738 - DNA, 22 bp, Artificial Sequence
  Synthetic
ggaatuacggcagcccttctut

SEQ ID NO: 28739 - DNA, 30 bp, Artificial Sequence
  Synthetic
ctggtacatucccttaatttauaccccaat

SEQ ID NO: 28740 - DNA, 24 bp, Artificial Sequence
  Synthetic
ttcaggtgguggagagatgtttut

SEQ ID NO: 28741 - DNA, 28 bp, Artificial Sequence
  Synthetic
tggaagcauaagcagaattatgtauggg

SEQ ID NO: 28742 - DNA, 26 bp, Artificial Sequence
  Synthetic
ttaagauggagagcaataagctuggt

SEQ ID NO: 28743 - DNA, 27 bp, Artificial Sequence
  Synthetic
gaatgatcaagaaaucagtttcuggca

SEQ ID NO: 28744 - DNA, 29 bp, Artificial Sequence
  Synthetic
tgccaaataaaauacacttggtttgtugg

SEQ ID NO: 28745 - DNA, 27 bp, Artificial Sequence
  Synthetic
aggcagacaaauaactagucacaacag

SEQ ID NO: 28746 - DNA, 22 bp, Artificial Sequence
  Synthetic
cccactgcccugagaatcttut

SEQ ID NO: 28747 - DNA, 30 bp, Artificial Sequence
  Synthetic
gtttgtttggaatcutcacataggagaauc

SEQ ID NO: 28748 - DNA, 27 bp, Artificial Sequence
  Synthetic
ttaaggtagcagaaugacttagaugcc

SEQ ID NO: 28749 - DNA, 28 bp, Artificial Sequence
  Synthetic
actctaaatttuccacttccacacucac

SEQ ID NO: 28750 - DNA, 23 bp, Artificial Sequence
  Synthetic
ggatcaaggutttctgtggcuga

SEQ ID NO: 28751 - DNA, 29 bp, Artificial Sequence
  Synthetic
gtcaaacttttaggugacctcctcttuat

SEQ ID NO: 28752 - DNA, 25 bp, Artificial Sequence
  Synthetic
gctcagcugaagatagtgacttuga

SEQ ID NO: 28753 - DNA, 23 bp, Artificial Sequence
  Synthetic
tgcagttacguaggctcctttut

SEQ ID NO: 28754 - DNA, 21 bp, Artificial Sequence
  Synthetic
tgatgacacagcutccgugac

SEQ ID NO: 28755 - DNA, 24 bp, Artificial Sequence
  Synthetic
agagcaagacuctgtccucaaaga

SEQ ID NO: 28756 - DNA, 28 bp, Artificial Sequence
  Synthetic
ctgcatatacugagggatgactttatut

SEQ ID NO: 28757 - DNA, 23 bp, Artificial Sequence
  Synthetic
gaaggtggcgcauttgtttgaua

SEQ ID NO: 28758 - DNA, 23 bp, Artificial Sequence
  Synthetic
tcccccugggaactagaaauagg

SEQ ID NO: 28759 - DNA, 24 bp, Artificial Sequence
  Synthetic
agaaggaagcaaugcacatacuca

SEQ ID NO: 28760 - DNA, 24 bp, Artificial Sequence
  Synthetic
agtgttgauagccaggtagauagg

SEQ ID NO: 28761 - DNA, 26 bp, Artificial Sequence
  Synthetic
attggccgagugatgattttgtagua

SEQ ID NO: 28762 - DNA, 28 bp, Artificial Sequence
  Synthetic
tgcattaaaaggauaaagaagtgtuggc

SEQ ID NO: 28763 - DNA, 26 bp, Artificial Sequence
  Synthetic
ttccactgccuttctctcattcuaac

SEQ ID NO: 28764 - DNA, 27 bp, Artificial Sequence
  Synthetic
gaatatttguaacccaacaaagguggt

SEQ ID NO: 28765 - DNA, 28 bp, Artificial Sequence
  Synthetic
cacacacagucacttgatuacaaaaagg

SEQ ID NO: 28766 - DNA, 27 bp, Artificial Sequence
  Synthetic
ttttctagguctaggataaugggacac

SEQ ID NO: 28767 - DNA, 24 bp, Artificial Sequence
  Synthetic
aggacctccauctttaccaccuac

SEQ ID NO: 28768 - DNA, 24 bp, Artificial Sequence
  Synthetic
gtactgcuaaagaagcagcttugg

SEQ ID NO: 28769 - DNA, 28 bp, Artificial Sequence
  Synthetic
agagaagaauggtatctcaguaaacgga

SEQ ID NO: 28770 - DNA, 28 bp, Artificial Sequence
  Synthetic
cttatgtggtcagutgataggacttuga

SEQ ID NO: 28771 - DNA, 22 bp, Artificial Sequence
  Synthetic
agaagcaatggutgaggccuac

SEQ ID NO: 28772 - DNA, 23 bp, Artificial Sequence
  Synthetic
gctucaggagaacacaaggaugg

SEQ ID NO: 28773 - DNA, 21 bp, Artificial Sequence
  Synthetic
gttgggccccucaacatcaua

SEQ ID NO: 28774 - DNA, 22 bp, Artificial Sequence
  Synthetic
catcggtggguatgaggtauca

SEQ ID NO: 28775 - DNA, 22 bp, Artificial Sequence
  Synthetic
cccaaaggaagccucattcauc

SEQ ID NO: 28776 - DNA, 27 bp, Artificial Sequence
  Synthetic
agaaguagaaccaagaagcttatuggc

SEQ ID NO: 28777 - DNA, 26 bp, Artificial Sequence
  Synthetic
aacatttgctgcutactcattgcaut

SEQ ID NO: 28778 - DNA, 21 bp, Artificial Sequence
  Synthetic
ctgtagagacguaggcctugg

SEQ ID NO: 28779 - DNA, 22 bp, Artificial Sequence
  Synthetic
ggaagacuaggacccctgcuat

SEQ ID NO: 28780 - DNA, 30 bp, Artificial Sequence
  Synthetic
agaaaaggagaggautaaaactguaacacc

SEQ ID NO: 28781 - DNA, 23 bp, Artificial Sequence
  Synthetic
tcactggtcuctgtttgcacuac

SEQ ID NO: 28782 - DNA, 23 bp, Artificial Sequence
  Synthetic
atctcccucaggtagtucaggag

SEQ ID NO: 28783 - DNA, 23 bp, Artificial Sequence
  Synthetic
ccccagccccuttattgctatua

SEQ ID NO: 28784 - DNA, 25 bp, Artificial Sequence
  Synthetic
attcatcttcagacauggagcctuc

SEQ ID NO: 28785 - DNA, 28 bp, Artificial Sequence
  Synthetic
ccaaagaaucacaccaagactttatugt

SEQ ID NO: 28786 - DNA, 24 bp, Artificial Sequence
  Synthetic
cctcttatcaccutgtcctgcaut

SEQ ID NO: 28787 - DNA, 27 bp, Artificial Sequence
  Synthetic
gttactgacuaagcatccacttctuca

SEQ ID NO: 28788 - DNA, 21 bp, Artificial Sequence
  Synthetic
cagaacaggcccucagtucaa

SEQ ID NO: 28789 - DNA, 24 bp, Artificial Sequence
  Synthetic
ctccaauctgcttaugaccaggag

SEQ ID NO: 28790 - DNA, 22 bp, Artificial Sequence
  Synthetic
gaggatgcugatcacgggaaut

SEQ ID NO: 28791 - DNA, 23 bp, Artificial Sequence
  Synthetic
caaatgauctacagcugcggaag

SEQ ID NO: 28792 - DNA, 22 bp, Artificial Sequence
  Synthetic
actgccaagucccagggtaaut

SEQ ID NO: 28793 - DNA, 23 bp, Artificial Sequence
  Synthetic
atcactggcutcttgtttugcag

SEQ ID NO: 28794 - DNA, 28 bp, Artificial Sequence
  Synthetic
ctcgtttctctcutccttctttccttut

SEQ ID NO: 28795 - DNA, 23 bp, Artificial Sequence
  Synthetic
aagtcugtgttttcaucgaccca

SEQ ID NO: 28796 - DNA, 22 bp, Artificial Sequence
  Synthetic
gttgcacagcaucaccagtcua

SEQ ID NO: 28797 - DNA, 30 bp, Artificial Sequence
  Synthetic
ctccattttctucctcattctacttcucag

SEQ ID NO: 28798 - DNA, 21 bp, Artificial Sequence
  Synthetic
agagtttgugcacggucaaga

SEQ ID NO: 28799 - DNA, 28 bp, Artificial Sequence
  Synthetic
ggtccucaggaactttcattaucaacag

SEQ ID NO: 28800 - DNA, 22 bp, Artificial Sequence
  Synthetic
gcutcctttucacagggaggag

SEQ ID NO: 28801 - DNA, 23 bp, Artificial Sequence
  Synthetic
ctaagcaaccacacuttctuggt

SEQ ID NO: 28802 - DNA, 23 bp, Artificial Sequence
  Synthetic
gggtcctgautgatggcaatuac

SEQ ID NO: 28803 - DNA, 29 bp, Artificial Sequence
  Synthetic
agaatgtttcctccuctcttgtttgaaut

SEQ ID NO: 28804 - DNA, 25 bp, Artificial Sequence
  Synthetic
gtccagcaacaucaacaattctcuc

SEQ ID NO: 28805 - DNA, 28 bp, Artificial Sequence
  Synthetic
cctcctttaaacugttttcatcucacaa

SEQ ID NO: 28806 - DNA, 31 bp, Artificial Sequence
  Synthetic
tgacagggtattuaaaattctgaagatuggt

SEQ ID NO: 28807 - DNA, 22 bp, Artificial Sequence
  Synthetic
gacattgaugcccagaccttug

SEQ ID NO: 28808 - DNA, 22 bp, Artificial Sequence
  Synthetic
ggccaugagggctgtttcuaaa

SEQ ID NO: 28809 - DNA, 24 bp, Artificial Sequence
  Synthetic
gcaggttatgaguacctctgcaut

SEQ ID NO: 28810 - DNA, 24 bp, Artificial Sequence
  Synthetic
gggaagggaguacccaatatcuga

SEQ ID NO: 28811 - DNA, 21 bp, Artificial Sequence
  Synthetic
tgacaaugcagcugaggaacc

SEQ ID NO: 28812 - DNA, 18 bp, Artificial Sequence
  Synthetic
guggatcaguggcccaga

SEQ ID NO: 28813 - DNA, 23 bp, Artificial Sequence
  Synthetic
actcgcttggugattccatguaa

SEQ ID NO: 28814 - DNA, 27 bp, Artificial Sequence
  Synthetic
cttaatgtgcugttgagttagaaugga

SEQ ID NO: 28815 - DNA, 24 bp, Artificial Sequence
  Synthetic
tccttttctctugctttgggcuag

SEQ ID NO: 28816 - DNA, 25 bp, Artificial Sequence
  Synthetic
tcatgcauagatgtttuccacacca

SEQ ID NO: 28817 - DNA, 27 bp, Artificial Sequence
  Synthetic
caatcagtgttuctgctttctccauag

SEQ ID NO: 28818 - DNA, 27 bp, Artificial Sequence
  Synthetic
agtttgatggctuctgtgatatcagug

SEQ ID NO: 28819 - DNA, 24 bp, Artificial Sequence
  Synthetic
cccaactgguctgtcaacguaaaa

SEQ ID NO: 28820 - DNA, 27 bp, Artificial Sequence
  Synthetic
tcaaagcaaccgaagaaugtaaccaua

SEQ ID NO: 28821 - DNA, 25 bp, Artificial Sequence
  Synthetic
atctctgtcugacaacatcaaccug

SEQ ID NO: 28822 - DNA, 22 bp, Artificial Sequence
  Synthetic
cattacucagtgccugcaaggt

SEQ ID NO: 28823 - DNA, 25 bp, Artificial Sequence
  Synthetic
ccctttttgttuttgcctctctuca

SEQ ID NO: 28824 - DNA, 27 bp, Artificial Sequence
  Synthetic
acattaaaacuggcatctgtttccuca

SEQ ID NO: 28825 - DNA, 25 bp, Artificial Sequence
  Synthetic
gaaaacacucccccttcatagucat

SEQ ID NO: 28826 - DNA, 21 bp, Artificial Sequence
  Synthetic
gggtcagautctcagcuccca

SEQ ID NO: 28827 - DNA, 17 bp, Artificial Sequence
  Synthetic
ctcuccggcggauacgg

SEQ ID NO: 28828 - DNA, 22 bp, Artificial Sequence
  Synthetic
tccgaaggagacccutgacuag

SEQ ID NO: 28829 - DNA, 21 bp, Artificial Sequence
  Synthetic
tggcutcaguaggaggacagt

SEQ ID NO: 28830 - DNA, 29 bp, Artificial Sequence
  Synthetic
tgactgagagaagcagutatttagtuagg

SEQ ID NO: 28831 - DNA, 28 bp, Artificial Sequence
  Synthetic
cccaaaaggugtcttaaatgtagugagt

SEQ ID NO: 28832 - DNA, 20 bp, Artificial Sequence
  Synthetic
gagagcgccgcuttgaaauc

SEQ ID NO: 28833 - DNA, 22 bp, Artificial Sequence
  Synthetic
aggtautttgccaauggccact

SEQ ID NO: 28834 - DNA, 23 bp, Artificial Sequence
  Synthetic
tcaaagcccugttaccctggaua

SEQ ID NO: 28835 - DNA, 28 bp, Artificial Sequence
  Synthetic
ggcaaatatgtttucacatgggactuac

SEQ ID NO: 28836 - DNA, 27 bp, Artificial Sequence
  Synthetic
agctctttguaccaaatacccaatcug

SEQ ID NO: 28837 - DNA, 27 bp, Artificial Sequence
  Synthetic
atgtcttaaataucaacaggccacugt

SEQ ID NO: 28838 - DNA, 22 bp, Artificial Sequence
  Synthetic
ggacaggagguagccagagaua

SEQ ID NO: 28839 - DNA, 30 bp, Artificial Sequence
  Synthetic
ggtgagccctauttagtcatacactuaaaa

SEQ ID NO: 28840 - DNA, 25 bp, Artificial Sequence
  Synthetic
tggtgagtuactttggaaaugagct

SEQ ID NO: 28841 - DNA, 25 bp, Artificial Sequence
  Synthetic
agatgggaautgacaaugcaaaagg

SEQ ID NO: 28842 - DNA, 31 bp, Artificial Sequence
  Synthetic
ttttatgctaatcgcuacttctgttcauaca

SEQ ID NO: 28843 - DNA, 28 bp, Artificial Sequence
  Synthetic
cctcccataacuctaacaatctcatcuc

SEQ ID NO: 28844 - DNA, 25 bp, Artificial Sequence
  Synthetic
tgtaacaagagagccuaacccugat

SEQ ID NO: 28845 - DNA, 30 bp, Artificial Sequence
  Synthetic
catgtgactccgauaattaagctgatuaac

SEQ ID NO: 28846 - DNA, 24 bp, Artificial Sequence
  Synthetic
tctccaagggagaugagcuagaag

SEQ ID NO: 28847 - DNA, 28 bp, Artificial Sequence
  Synthetic
gcagtagauagggagaucatgtatttut

SEQ ID NO: 28848 - DNA, 28 bp, Artificial Sequence
  Synthetic
ttttagaggacacutttctgttggtuct

SEQ ID NO: 28849 - DNA, 28 bp, Artificial Sequence
  Synthetic
tcttcaatcttatcutctcccgagtuca

SEQ ID NO: 28850 - DNA, 26 bp, Artificial Sequence
  Synthetic
ccaaagtctttatuctgagaccccut

SEQ ID NO: 28851 - DNA, 27 bp, Artificial Sequence
  Synthetic
ttgtagggaagguctactctcactuac

SEQ ID NO: 28852 - DNA, 23 bp, Artificial Sequence
  Synthetic
tggagctccuttcccttgactua

SEQ ID NO: 28853 - DNA, 22 bp, Artificial Sequence
  Synthetic
cacauccccaggtcaguagaac

SEQ ID NO: 28854 - DNA, 23 bp, Artificial Sequence
  Synthetic
gccctgaggutttgcttaggtua

SEQ ID NO: 28855 - DNA, 31 bp, Artificial Sequence
  Synthetic
gtctgcttctagaauatcagagaacaguaaa

SEQ ID NO: 28856 - DNA, 27 bp, Artificial Sequence
  Synthetic
gctaccacuaaaatgtatcttccucca

SEQ ID NO: 28857 - DNA, 21 bp, Artificial Sequence
  Synthetic
gcttcttcutcctggugcact

SEQ ID NO: 28858 - DNA, 28 bp, Artificial Sequence
  Synthetic
ccatttttagautacatttgggucagca

SEQ ID NO: 28859 - DNA, 26 bp, Artificial Sequence
  Synthetic
atgcattccuggttgttttcttucag

SEQ ID NO: 28860 - DNA, 27 bp, Artificial Sequence
  Synthetic
tggtgcaautaatggagauagaagaca

SEQ ID NO: 28861 - DNA, 23 bp, Artificial Sequence
  Synthetic
ctatagtgctutgcctggcuaca

SEQ ID NO: 28862 - DNA, 28 bp, Artificial Sequence
  Synthetic
aagtttcactctaguggtttttgaccut

SEQ ID NO: 28863 - DNA, 29 bp, Artificial Sequence
  Synthetic
cgccaatatagauctgcttattatccuga

SEQ ID NO: 28864 - DNA, 22 bp, Artificial Sequence
  Synthetic
cucaccccaauaaggcccaaat

SEQ ID NO: 28865 - DNA, 27 bp, Artificial Sequence
  Synthetic
tggagatugacaagtacuggagagaat

SEQ ID NO: 28866 - DNA, 26 bp, Artificial Sequence
  Synthetic
aacttcaggugatcagttgtgtugat

SEQ ID NO: 28867 - DNA, 22 bp, Artificial Sequence
  Synthetic
gacagcctguttccagtcauct

SEQ ID NO: 28868 - DNA, 24 bp, Artificial Sequence
  Synthetic
caaactcaaaagcutgtggaguca

SEQ ID NO: 28869 - DNA, 28 bp, Artificial Sequence
  Synthetic
gtctcaaattcatuttcacactggatut

SEQ ID NO: 28870 - DNA, 17 bp, Artificial Sequence
  Synthetic
ctagcgcgcucagggua

SEQ ID NO: 28871 - DNA, 17 bp, Artificial Sequence
  Synthetic
ggtggcgaugctgcuca

SEQ ID NO: 28872 - DNA, 23 bp, Artificial Sequence
  Synthetic
ccgtttgctcucagttgccauat

SEQ ID NO: 28873 - DNA, 31 bp, Artificial Sequence
  Synthetic
gcaaggaaagagauagauaaatctgaaaaut

SEQ ID NO: 28874 - DNA, 24 bp, Artificial Sequence
  Synthetic
gtgccattugttgtgtatctuggt

SEQ ID NO: 28875 - DNA, 31 bp, Artificial Sequence
  Synthetic
ctttaacagttagggucatctttatggtcut

SEQ ID NO: 28876 - DNA, 31 bp, Artificial Sequence
  Synthetic
acaggattcttcuctaatacttgatgtucct

SEQ ID NO: 28877 - DNA, 24 bp, Artificial Sequence
  Synthetic
tcattcaacacuaacgtgcctugt

SEQ ID NO: 28878 - DNA, 29 bp, Artificial Sequence
  Synthetic
actataataguagactgttcctucacgct

SEQ ID NO: 28879 - DNA, 28 bp, Artificial Sequence
  Synthetic
gttcatcacauaccagacaatagcauct

SEQ ID NO: 28880 - DNA, 25 bp, Artificial Sequence
  Synthetic
acttcttgauaaccgtcagtgctut

SEQ ID NO: 28881 - DNA, 31 bp, Artificial Sequence
  Synthetic
cctgataacaucgagatatttctcatcauct

SEQ ID NO: 28882 - DNA, 33 bp, Artificial Sequence
  Synthetic
aagtttctgatgaaauagaaaactcaactgaut

SEQ ID NO: 28883 - DNA, 28 bp, Artificial Sequence
  Synthetic
aactggacaaccaaugagattcttcuac

SEQ ID NO: 28884 - DNA, 27 bp, Artificial Sequence
  Synthetic
actccctacugactcacgtattttuct

SEQ ID NO: 28885 - DNA, 29 bp, Artificial Sequence
  Synthetic
caatgctcctauagaagctatccaacauc

SEQ ID NO: 28886 - DNA, 25 bp, Artificial Sequence
  Synthetic
gaaggcacatugctgaattgtatug

SEQ ID NO: 28887 - DNA, 27 bp, Artificial Sequence
  Synthetic
tgagttgaatguattttcatcccucat

SEQ ID NO: 28888 - DNA, 26 bp, Artificial Sequence
  Synthetic
atttgatgcugaactgtattgcuaca

SEQ ID NO: 28889 - DNA, 25 bp, Artificial Sequence
  Synthetic
gacgcatacuggcaactggatauaa

SEQ ID NO: 28890 - DNA, 26 bp, Artificial Sequence
  Synthetic
agtgtaactcaaguctctggttcuct

SEQ ID NO: 28891 - DNA, 19 bp, Artificial Sequence
  Synthetic
gagctcuaatgcggugcca

SEQ ID NO: 28892 - DNA, 19 bp, Artificial Sequence
  Synthetic
gggagatcugcccaagcug

SEQ ID NO: 28893 - DNA, 17 bp, Artificial Sequence
  Synthetic
ctgccguggcccuagaa

SEQ ID NO: 28894 - DNA, 24 bp, Artificial Sequence
  Synthetic
aaccatccucgttgaacugaacat

SEQ ID NO: 28895 - DNA, 19 bp, Artificial Sequence
  Synthetic
ctcggcagugctctcacuc

SEQ ID NO: 28896 - DNA, 17 bp, Artificial Sequence
  Synthetic
gcgaggugctcctcuct

SEQ ID NO: 28897 - DNA, 18 bp, Artificial Sequence
  Synthetic
gctggtguctcacccuca

SEQ ID NO: 28898 - DNA, 18 bp, Artificial Sequence
  Synthetic
ggcccccuttcacgctua

SEQ ID NO: 28899 - DNA, 19 bp, Artificial Sequence
  Synthetic
ccacacuctcctcgtuccc

SEQ ID NO: 28900 - DNA, 18 bp, Artificial Sequence
  Synthetic
ccccuccacctccctucc

SEQ ID NO: 28901 - DNA, 18 bp, Artificial Sequence
  Synthetic
cctgccacucggttcugt

SEQ ID NO: 28902 - DNA, 22 bp, Artificial Sequence
  Synthetic
ccaggtgguaggagctauaggg

SEQ ID NO: 28903 - DNA, 22 bp, Artificial Sequence
  Synthetic
ttgagaggaggguccccatuaa

SEQ ID NO: 28904 - DNA, 21 bp, Artificial Sequence
  Synthetic
caatgcugagaggtguggaca

SEQ ID NO: 28905 - DNA, 19 bp, Artificial Sequence
  Synthetic
ccaacacguccacctucgt

SEQ ID NO: 28906 - DNA, 22 bp, Artificial Sequence
  Synthetic
catcagccccutcctttgcaua

SEQ ID NO: 28907 - DNA, 30 bp, Artificial Sequence
  Synthetic
gcattgatgtgutaatactttccttuccag

SEQ ID NO: 28908 - DNA, 26 bp, Artificial Sequence
  Synthetic
tgtttatggcaguaaccctaaaggug

SEQ ID NO: 28909 - DNA, 25 bp, Artificial Sequence
  Synthetic
tcactccattgucggttcatttcut

SEQ ID NO: 28910 - DNA, 19 bp, Artificial Sequence
  Synthetic
ccttctggaguggaggcut

SEQ ID NO: 28911 - DNA, 17 bp, Artificial Sequence
  Synthetic
gctccuccgcagguact

SEQ ID NO: 28912 - DNA, 22 bp, Artificial Sequence
  Synthetic
agtcactcugttgtccuccaga

SEQ ID NO: 28913 - DNA, 21 bp, Artificial Sequence
  Synthetic
acgaacgctucttcccctaug

SEQ ID NO: 28914 - DNA, 20 bp, Artificial Sequence
  Synthetic
ggacacgacacucaccacua

SEQ ID NO: 28915 - DNA, 20 bp, Artificial Sequence
  Synthetic
ctgtctccugaggctgtucc

SEQ ID NO: 28916 - DNA, 20 bp, Artificial Sequence
  Synthetic
cctcacccucctcttccuct

SEQ ID NO: 28917 - DNA, 18 bp, Artificial Sequence
  Synthetic
gctcuccccttccuccca

SEQ ID NO: 28918 - DNA, 18 bp, Artificial Sequence
  Synthetic
gcagcgguactcgccauc

SEQ ID NO: 28919 - DNA, 22 bp, Artificial Sequence
  Synthetic
ggtgattggccutgtccttuct

SEQ ID NO: 28920 - DNA, 20 bp, Artificial Sequence
  Synthetic
agagagugcagagcctcuga

SEQ ID NO: 28921 - DNA, 20 bp, Artificial Sequence
  Synthetic
gtcatgactucggcctccut

SEQ ID NO: 28922 - DNA, 21 bp, Artificial Sequence
  Synthetic
cccacaaucccacacgaacuc

SEQ ID NO: 28923 - DNA, 19 bp, Artificial Sequence
  Synthetic
cutcaccaucacgggcaac

SEQ ID NO: 28924 - DNA, 21 bp, Artificial Sequence
  Synthetic
gggcttcugggcttagaagut

SEQ ID NO: 28925 - DNA, 21 bp, Artificial Sequence
  Synthetic
gctctcuccaccctgtctuca

SEQ ID NO: 28926 - DNA, 19 bp, Artificial Sequence
  Synthetic
tgcaatccgcuccgtguaa

SEQ ID NO: 28927 - DNA, 20 bp, Artificial Sequence
  Synthetic
cagaggaggcucacuggaga

SEQ ID NO: 28928 - DNA, 17 bp, Artificial Sequence
  Synthetic
gggctcagguggaggug

SEQ ID NO: 28929 - DNA, 19 bp, Artificial Sequence
  Synthetic
tccacccucggugagaaga

SEQ ID NO: 28930 - DNA, 20 bp, Artificial Sequence
  Synthetic
gtctccugcacagaucggat

SEQ ID NO: 28931 - DNA, 22 bp, Artificial Sequence
  Synthetic
cacccaggucatggtgaucaaa

SEQ ID NO: 28932 - DNA, 21 bp, Artificial Sequence
  Synthetic
cccaggacutttcuccaggac

SEQ ID NO: 28933 - DNA, 25 bp, Artificial Sequence
  Synthetic
atccctggacccuaatgatttugac

SEQ ID NO: 28934 - DNA, 22 bp, Artificial Sequence
  Synthetic
cctgcccugtagagauaggagt

SEQ ID NO: 28935 - DNA, 22 bp, Artificial Sequence
  Synthetic
cagagacaucagaagggucagg

SEQ ID NO: 28936 - DNA, 29 bp, Artificial Sequence
  Synthetic
cttgccctcttuctcttctttcttatcut

SEQ ID NO: 28937 - DNA, 26 bp, Artificial Sequence
  Synthetic
ctggcatgtuctctgtgatactuaca

SEQ ID NO: 28938 - DNA, 17 bp, Artificial Sequence
  Synthetic
gcggucccacucacagt

SEQ ID NO: 28939 - DNA, 17 bp, Artificial Sequence
  Synthetic
cgctcccucctcucgga

SEQ ID NO: 28940 - DNA, 18 bp, Artificial Sequence
  Synthetic
ggtgggugggtccuagca

SEQ ID NO: 28941 - DNA, 17 bp, Artificial Sequence
  Synthetic
cgggccccgauaccauc

SEQ ID NO: 28942 - DNA, 27 bp, Artificial Sequence
  Synthetic
ccttgttttcugtttaaaaggcauaca

SEQ ID NO: 28943 - DNA, 28 bp, Artificial Sequence
  Synthetic
catctgatgcacgautttaaccacauac

SEQ ID NO: 28944 - DNA, 25 bp, Artificial Sequence
  Synthetic
tcagatttgutgtttcacuggagca

SEQ ID NO: 28945 - DNA, 20 bp, Artificial Sequence
  Synthetic
ggcucgttctaugcacacga

SEQ ID NO: 28946 - DNA, 22 bp, Artificial Sequence
  Synthetic
ctgtgcaaaaugggagtgacug

SEQ ID NO: 28947 - DNA, 24 bp, Artificial Sequence
  Synthetic
gtcctcccuacaattgcagactua

SEQ ID NO: 28948 - DNA, 26 bp, Artificial Sequence
  Synthetic
ggataactgcauttctcaaccaguga

SEQ ID NO: 28949 - DNA, 25 bp, Artificial Sequence
  Synthetic
aaacttcuagccccgtaacacauac

SEQ ID NO: 28950 - DNA, 22 bp, Artificial Sequence
  Synthetic
cccttacactuggtgccatcuc

SEQ ID NO: 28951 - DNA, 29 bp, Artificial Sequence
  Synthetic
atacacctagtaugtaaccacaaacatut

SEQ ID NO: 28952 - DNA, 24 bp, Artificial Sequence
  Synthetic
accagggaggaaccutgttctaut

SEQ ID NO: 28953 - DNA, 21 bp, Artificial Sequence
  Synthetic
tctgaaacaucctgcccucac

SEQ ID NO: 28954 - DNA, 25 bp, Artificial Sequence
  Synthetic
actcactgaaccuttcttgtccaut

SEQ ID NO: 28955 - DNA, 22 bp, Artificial Sequence
  Synthetic
ggaaccugaacgtgttuccaca

SEQ ID NO: 28956 - DNA, 27 bp, Artificial Sequence
  Synthetic
agcaaaagagguagaattggtttcuga

SEQ ID NO: 28957 - DNA, 25 bp, Artificial Sequence
  Synthetic
ccacccauatcctuaaaacaggaca

SEQ ID NO: 28958 - DNA, 26 bp, Artificial Sequence
  Synthetic
gattuagcacaaagguagaaggcaag

SEQ ID NO: 28959 - DNA, 22 bp, Artificial Sequence
  Synthetic
tgtggugaactctcuagaccca

SEQ ID NO: 28960 - DNA, 24 bp, Artificial Sequence
  Synthetic
ctttcttuccaaggagaccagcut

SEQ ID NO: 28961 - DNA, 24 bp, Artificial Sequence
  Synthetic
ctagtccaacuctattgcccucag

SEQ ID NO: 28962 - DNA, 21 bp, Artificial Sequence
  Synthetic
agtcacccuacccatggtuga

SEQ ID NO: 28963 - DNA, 30 bp, Artificial Sequence
  Synthetic
ccatgtatttgugctaatctctccauacag

SEQ ID NO: 28964 - DNA, 27 bp, Artificial Sequence
  Synthetic
aattaagtttguggaagctaagagugt

SEQ ID NO: 28965 - DNA, 29 bp, Artificial Sequence
  Synthetic
cctctacatctcucagtttatcatcaugt

SEQ ID NO: 28966 - DNA, 27 bp, Artificial Sequence
  Synthetic
ttcatagaaucctttgagctugcaaga

SEQ ID NO: 28967 - DNA, 29 bp, Artificial Sequence
  Synthetic
actaacccagcugaatttaatctctgtut

SEQ ID NO: 28968 - DNA, 22 bp, Artificial Sequence
  Synthetic
gctgagtagguagggaaccuct

SEQ ID NO: 28969 - DNA, 28 bp, Artificial Sequence
  Synthetic
gcataaaccaatguatctcatgctcaut

SEQ ID NO: 28970 - DNA, 24 bp, Artificial Sequence
  Synthetic
acagtgaacacaugtccacugaaa

SEQ ID NO: 28971 - DNA, 26 bp, Artificial Sequence
  Synthetic
ggtggaguggagagaaagaaactuat

SEQ ID NO: 28972 - DNA, 23 bp, Artificial Sequence
  Synthetic
gagccctgcaguttctttccaua

SEQ ID NO: 28973 - DNA, 24 bp, Artificial Sequence
  Synthetic
aggattgatgucttccctcccuag

SEQ ID NO: 28974 - DNA, 24 bp, Artificial Sequence
  Synthetic
tgccatatgaugttgcacttucca

SEQ ID NO: 28975 - DNA, 31 bp, Artificial Sequence
  Synthetic
gaccttaagatccuagaagattattctugct

SEQ ID NO: 28976 - DNA, 27 bp, Artificial Sequence
  Synthetic
gtcccaaatgutcatttagttcuccac

SEQ ID NO: 28977 - DNA, 24 bp, Artificial Sequence
  Synthetic
gatgtgaggcauttctacccacut

SEQ ID NO: 28978 - DNA, 31 bp, Artificial Sequence
  Synthetic
aatcttccttctucatttcaactgatauggt

SEQ ID NO: 28979 - DNA, 27 bp, Artificial Sequence
  Synthetic
gaaagcaatcaugcaatagcagcaaua

SEQ ID NO: 28980 - DNA, 23 bp, Artificial Sequence
  Synthetic
ccaatagctuggagggagtctut

SEQ ID NO: 28981 - DNA, 26 bp, Artificial Sequence
  Synthetic
ggcaaagutgaattgctuccaaaagt

SEQ ID NO: 28982 - DNA, 31 bp, Artificial Sequence
  Synthetic
caaggttagaatggcuaaagaaaggttatut

SEQ ID NO: 28983 - DNA, 22 bp, Artificial Sequence
  Synthetic
gagtcauagcatcccucaagca

SEQ ID NO: 28984 - DNA, 28 bp, Artificial Sequence
  Synthetic
tcaaatgtttcatguttttggaccacug

SEQ ID NO: 28985 - DNA, 24 bp, Artificial Sequence
  Synthetic
agaaaactuggaaggctugggaaa

SEQ ID NO: 28986 - DNA, 28 bp, Artificial Sequence
  Synthetic
cattttgccuagtgctcaguaagaaaag

SEQ ID NO: 28987 - DNA, 27 bp, Artificial Sequence
  Synthetic
gacgtaggacucaaagagatggtttut

SEQ ID NO: 28988 - DNA, 27 bp, Artificial Sequence
  Synthetic
agagttcagagagutctttccaugagt

SEQ ID NO: 28989 - DNA, 27 bp, Artificial Sequence
  Synthetic
tgattcaugacagaatgcttauggaca

SEQ ID NO: 28990 - DNA, 25 bp, Artificial Sequence
  Synthetic
gggccatcaaugtgagtctttcuat

SEQ ID NO: 28991 - DNA, 30 bp, Artificial Sequence
  Synthetic
tcaggtttaatgaauagccaagaaagtuca

SEQ ID NO: 28992 - DNA, 28 bp, Artificial Sequence
  Synthetic
actatcataaugaactggcatactuggg

SEQ ID NO: 28993 - DNA, 22 bp, Artificial Sequence
  Synthetic
gggacatgguatttaccccuga

SEQ ID NO: 28994 - DNA, 22 bp, Artificial Sequence
  Synthetic
cccatgtggaguaggactcugt

SEQ ID NO: 28995 - DNA, 29 bp, Artificial Sequence
  Synthetic
agtaaaaacaaugccatugaaccaagaag

SEQ ID NO: 28996 - DNA, 27 bp, Artificial Sequence
  Synthetic
atgctataaaugacagcatgtgagcua

SEQ ID NO: 28997 - DNA, 26 bp, Artificial Sequence
  Synthetic
ggtctaugaagacacautcacccuat

SEQ ID NO: 28998 - DNA, 22 bp, Artificial Sequence
  Synthetic
ccactggacutaagtgctgcut

SEQ ID NO: 28999 - DNA, 27 bp, Artificial Sequence
  Synthetic
aacatcagtagcauttctttaccccut

SEQ ID NO: 29000 - DNA, 26 bp, Artificial Sequence
  Synthetic
gattcuttgtagcagaugaggagagg

SEQ ID NO: 29001 - DNA, 27 bp, Artificial Sequence
  Synthetic
gctatttatggtuttgcttgtggguag

SEQ ID NO: 29002 - DNA, 24 bp, Artificial Sequence
  Synthetic
acaaaggacggacaucagtgatuc

SEQ ID NO: 29003 - DNA, 30 bp, Artificial Sequence
  Synthetic
gatagaggccacutttatttatctggagut

SEQ ID NO: 29004 - DNA, 27 bp, Artificial Sequence
  Synthetic
ccataaagtaaaggucccaagatucct

SEQ ID NO: 29005 - DNA, 30 bp, Artificial Sequence
  Synthetic
gaatttttctucccaacctutcatctttut

SEQ ID NO: 29006 - DNA, 28 bp, Artificial Sequence
  Synthetic
aatgtacccaagutttaggatgcttcut

SEQ ID NO: 29007 - DNA, 25 bp, Artificial Sequence
  Synthetic
acattgtttgguttgtctgacucca

SEQ ID NO: 29008 - DNA, 24 bp, Artificial Sequence
  Synthetic
cagtagaaacugtccaagguccat

SEQ ID NO: 29009 - DNA, 29 bp, Artificial Sequence
  Synthetic
gccataggtgucttattcctacttuacag

SEQ ID NO: 29010 - DNA, 31 bp, Artificial Sequence
  Synthetic
cttaataguagcagaggatttcttucaggaa

SEQ ID NO: 29011 - DNA, 26 bp, Artificial Sequence
  Synthetic
gatgaagaactguctcctcctaguga

SEQ ID NO: 29012 - DNA, 27 bp, Artificial Sequence
  Synthetic
ctgaattcaagucttttaccaggucca

SEQ ID NO: 29013 - DNA, 29 bp, Artificial Sequence
  Synthetic
tgagtguacagtggatauagaaaggacaa

SEQ ID NO: 29014 - DNA, 31 bp, Artificial Sequence
  Synthetic
aagatacccaatutcataaatagcatucaac

SEQ ID NO: 29015 - DNA, 24 bp, Artificial Sequence
  Synthetic
gtgtccaccaaaaugaacgactut

SEQ ID NO: 29016 - DNA, 21 bp, Artificial Sequence
  Synthetic
cagguggagagctctattugc

SEQ ID NO: 29017 - DNA, 25 bp, Artificial Sequence
  Synthetic
cccactgauaaaaaggaagcaaucc

SEQ ID NO: 29018 - DNA, 26 bp, Artificial Sequence
  Synthetic
agucctttaaactuagggacagagga

SEQ ID NO: 29019 - DNA, 27 bp, Artificial Sequence
  Synthetic
gaacatctcacagcauttccatcttut

SEQ ID NO: 29020 - DNA, 21 bp, Artificial Sequence
  Synthetic
caagcaatgtuccagggccua

SEQ ID NO: 29021 - DNA, 22 bp, Artificial Sequence
  Synthetic
gcaagttctccugtctccctut

SEQ ID NO: 29022 - DNA, 23 bp, Artificial Sequence
  Synthetic
cccatgucagaaaagcgcatcua

SEQ ID NO: 29023 - DNA, 25 bp, Artificial Sequence
  Synthetic
gctaatggctcuttttccctttgut

SEQ ID NO: 29024 - DNA, 22 bp, Artificial Sequence
  Synthetic
caggaaaugggcaagauggaac

SEQ ID NO: 29025 - DNA, 23 bp, Artificial Sequence
  Synthetic
gcuaagaacaaggctttcuggga

SEQ ID NO: 29026 - DNA, 25 bp, Artificial Sequence
  Synthetic
ccacatatccautttctcaguggga

SEQ ID NO: 29027 - DNA, 26 bp, Artificial Sequence
  Synthetic
ccttctcuaccccttttcttucacag

SEQ ID NO: 29028 - DNA, 21 bp, Artificial Sequence
  Synthetic
caagaaggcutggagggagug

SEQ ID NO: 29029 - DNA, 25 bp, Artificial Sequence
  Synthetic
cgtgatccctutcttcttgtcttug

SEQ ID NO: 29030 - DNA, 24 bp, Artificial Sequence
  Synthetic
acacaaatccutctcaagctcucg

SEQ ID NO: 29031 - DNA, 24 bp, Artificial Sequence
  Synthetic
ctggcacauagcttttctcaucat

SEQ ID NO: 29032 - DNA, 22 bp, Artificial Sequence
  Synthetic
ccctttgutgctctuggagcat

SEQ ID NO: 29033 - DNA, 25 bp, Artificial Sequence
  Synthetic
cccctaattcugtgttttgtgtuca

SEQ ID NO: 29034 - DNA, 24 bp, Artificial Sequence
  Synthetic
gggataagcuacttttgcuaccac

SEQ ID NO: 29035 - DNA, 29 bp, Artificial Sequence
  Synthetic
gtggagtttagagutgatgttttccatut

SEQ ID NO: 29036 - DNA, 27 bp, Artificial Sequence
  Synthetic
tgcccaaatgutttagacagatuacca

SEQ ID NO: 29037 - DNA, 24 bp, Artificial Sequence
  Synthetic
ctcccactaautgtcctccaucac

SEQ ID NO: 29038 - DNA, 28 bp, Artificial Sequence
  Synthetic
aataaaagtagagaaacaugagccccut

SEQ ID NO: 29039 - DNA, 26 bp, Artificial Sequence
  Synthetic
gaccttttagcuttgtgcatctugag

SEQ ID NO: 29040 - DNA, 20 bp, Artificial Sequence
  Synthetic
caagttgggauacgccucca

SEQ ID NO: 29041 - DNA, 28 bp, Artificial Sequence
  Synthetic
gattgttctttgutgtctgtcttuccag

SEQ ID NO: 29042 - DNA, 22 bp, Artificial Sequence
  Synthetic
ggaatuccagcacttugagagg

SEQ ID NO: 29043 - DNA, 24 bp, Artificial Sequence
  Synthetic
ggacaagaccutttgtttccctug

SEQ ID NO: 29044 - DNA, 21 bp, Artificial Sequence
  Synthetic
atcctuaccccagagcucgat

SEQ ID NO: 29045 - DNA, 28 bp, Artificial Sequence
  Synthetic
tttcctctgccutgcgttttaatttuag

SEQ ID NO: 29046 - DNA, 17 bp, Artificial Sequence
  Synthetic
ccuggcacaggacugca

SEQ ID NO: 29047 - DNA, 19 bp, Artificial Sequence
  Synthetic
cutggguggagccacaact

SEQ ID NO: 29048 - DNA, 26 bp, Artificial Sequence
  Synthetic
tctcaatgaaaugctttggcagttut

SEQ ID NO: 29049 - DNA, 26 bp, Artificial Sequence
  Synthetic
gatguaagagaagagaguaccttugt

SEQ ID NO: 29050 - DNA, 25 bp, Artificial Sequence
  Synthetic
gtgtggcaataucacattccttguc

SEQ ID NO: 29051 - DNA, 25 bp, Artificial Sequence
  Synthetic
cacgtuccccagttgtaatuaccat

SEQ ID NO: 29052 - DNA, 27 bp, Artificial Sequence
  Synthetic
ttctccttttgugttttgtctctcugt

SEQ ID NO: 29053 - DNA, 23 bp, Artificial Sequence
  Synthetic
ggtgagaaaugaaaagccuggag

SEQ ID NO: 29054 - DNA, 29 bp, Artificial Sequence
  Synthetic
gaaaaggacugaactctaaattcuggact

SEQ ID NO: 29055 - DNA, 27 bp, Artificial Sequence
  Synthetic
cgtagcagugatcatgguaaaagaaga

SEQ ID NO: 29056 - DNA, 23 bp, Artificial Sequence
  Synthetic
ccctgcttcuggatcgtttacut

SEQ ID NO: 29057 - DNA, 31 bp, Artificial Sequence
  Synthetic
aaaucaaagaaggaagagaaaugatcuacat

SEQ ID NO: 29058 - DNA, 27 bp, Artificial Sequence
  Synthetic
ttcttgtgtctucactgtctccattut

SEQ ID NO: 29059 - DNA, 26 bp, Artificial Sequence
  Synthetic
agttcagaugaagaacttgucacagg

SEQ ID NO: 29060 - DNA, 28 bp, Artificial Sequence
  Synthetic
cagcctcatcuggagatattgttaugac

SEQ ID NO: 29061 - DNA, 27 bp, Artificial Sequence
  Synthetic
gagtaatgttacucgctatgactugga

SEQ ID NO: 29062 - DNA, 23 bp, Artificial Sequence
  Synthetic
tcagctgaaauatccctguagcg

SEQ ID NO: 29063 - DNA, 26 bp, Artificial Sequence
  Synthetic
agtactgttugaagggttaggcatut

SEQ ID NO: 29064 - DNA, 28 bp, Artificial Sequence
  Synthetic
acaaaagaaccatuatacgaaggcctua

SEQ ID NO: 29065 - DNA, 31 bp, Artificial Sequence
  Synthetic
ctgattctaagtgucctatatgcttggauag

SEQ ID NO: 29066 - DNA, 17 bp, Artificial Sequence
  Synthetic
aacucccacggccctuc

SEQ ID NO: 29067 - DNA, 17 bp, Artificial Sequence
  Synthetic
tcccgctucggagggua

SEQ ID NO: 29068 - DNA, 17 bp, Artificial Sequence
  Synthetic
ctgcugccgcctcctua

SEQ ID NO: 29069 - DNA, 25 bp, Artificial Sequence
  Synthetic
ggaagaucgtatccuccaggaagag

SEQ ID NO: 29070 - DNA, 20 bp, Artificial Sequence
  Synthetic
gcaguggaaccgatccucag

SEQ ID NO: 29071 - DNA, 20 bp, Artificial Sequence
  Synthetic
gggatgagcgutccaaccut

SEQ ID NO: 29072 - DNA, 22 bp, Artificial Sequence
  Synthetic
ccttgtagccugtccagtctut

SEQ ID NO: 29073 - DNA, 21 bp, Artificial Sequence
  Synthetic
gtcccucaagaggtcuagcca

SEQ ID NO: 29074 - DNA, 25 bp, Artificial Sequence
  Synthetic
cctacctcucggttatcttttcucc

SEQ ID NO: 29075 - DNA, 22 bp, Artificial Sequence
  Synthetic
ccagaaccaaagcutcaucacc

SEQ ID NO: 29076 - DNA, 23 bp, Artificial Sequence
  Synthetic
ggtaaaggaccugcctgttctuc

SEQ ID NO: 29077 - DNA, 28 bp, Artificial Sequence
  Synthetic
tctcatgggauaagaaagttagggacuc

SEQ ID NO: 29078 - DNA, 21 bp, Artificial Sequence
  Synthetic
ctaggcacuggatggaggtug

SEQ ID NO: 29079 - DNA, 28 bp, Artificial Sequence
  Synthetic
gggctaaauataggtactugaaaagcct

SEQ ID NO: 29080 - DNA, 23 bp, Artificial Sequence
  Synthetic
aatgaagtccaugccaccatuct

SEQ ID NO: 29081 - DNA, 28 bp, Artificial Sequence
  Synthetic
gcttaatucagcaagactgtugaaaaca

SEQ ID NO: 29082 - DNA, 20 bp, Artificial Sequence
  Synthetic
aatgacutggtgguggcaga

SEQ ID NO: 29083 - DNA, 23 bp, Artificial Sequence
  Synthetic
tgccaaagtcutgtgacctguag

SEQ ID NO: 29084 - DNA, 24 bp, Artificial Sequence
  Synthetic
tttcagtgtucaccacccacaaua

SEQ ID NO: 29085 - DNA, 23 bp, Artificial Sequence
  Synthetic
gactcugaagaggctagaucgga

SEQ ID NO: 29086 - DNA, 23 bp, Artificial Sequence
  Synthetic
gccgacgucatgcaagtauacat

SEQ ID NO: 29087 - DNA, 23 bp, Artificial Sequence
  Synthetic
acttcttgactutgggagtgguc

SEQ ID NO: 29088 - DNA, 21 bp, Artificial Sequence
  Synthetic
ctcaccaacucaggucccaat

SEQ ID NO: 29089 - DNA, 23 bp, Artificial Sequence
  Synthetic
catctctgcuacccaagatgucc

SEQ ID NO: 29090 - DNA, 27 bp, Artificial Sequence
  Synthetic
aattgcagtcutgctgtattucaaagg

SEQ ID NO: 29091 - DNA, 28 bp, Artificial Sequence
  Synthetic
tgttagcuaagagagaacattcucagga

SEQ ID NO: 29092 - DNA, 23 bp, Artificial Sequence
  Synthetic
ttgctagtatgugcttggtcugg

SEQ ID NO: 29093 - DNA, 28 bp, Artificial Sequence
  Synthetic
aggaagtatggcucccaaagattauaga

SEQ ID NO: 29094 - DNA, 24 bp, Artificial Sequence
  Synthetic
acataatgcutgtggttuccccaa

SEQ ID NO: 29095 - DNA, 23 bp, Artificial Sequence
  Synthetic
ctctatagcccuctccaagcuca

SEQ ID NO: 29096 - DNA, 21 bp, Artificial Sequence
  Synthetic
gatgatgcuactgcagcugga

SEQ ID NO: 29097 - DNA, 20 bp, Artificial Sequence
  Synthetic
tgtgggacuctgtcctucgt

SEQ ID NO: 29098 - DNA, 23 bp, Artificial Sequence
  Synthetic
ctcccatcuccctgcaataacut

SEQ ID NO: 29099 - DNA, 24 bp, Artificial Sequence
  Synthetic
gtaagaccaacautgttgcuccag

SEQ ID NO: 29100 - DNA, 21 bp, Artificial Sequence
  Synthetic
cagggaucttgaggcugcaaa

SEQ ID NO: 29101 - DNA, 21 bp, Artificial Sequence
  Synthetic
ctaagtccgcutctggtcucc

SEQ ID NO: 29102 - DNA, 21 bp, Artificial Sequence
  Synthetic
gggaaaggugactcuggaaga

SEQ ID NO: 29103 - DNA, 23 bp, Artificial Sequence
  Synthetic
acuacacaacacguaggatcuac

SEQ ID NO: 29104 - DNA, 20 bp, Artificial Sequence
  Synthetic
tgctggcgaaugacgtctut

SEQ ID NO: 29105 - DNA, 29 bp, Artificial Sequence
  Synthetic
gattttggcttcuctcagaaactcattut

SEQ ID NO: 29106 - DNA, 25 bp, Artificial Sequence
  Synthetic
tcagtgttcagcugtctttggaaut

SEQ ID NO: 29107 - DNA, 21 bp, Artificial Sequence
  Synthetic
ctgautgttcctguggaagcc

SEQ ID NO: 29108 - DNA, 23 bp, Artificial Sequence
  Synthetic
ctaaggcagagutguaaccacct

SEQ ID NO: 29109 - DNA, 22 bp, Artificial Sequence
  Synthetic
acactttgcauctccctgtgug

SEQ ID NO: 29110 - DNA, 23 bp, Artificial Sequence
  Synthetic
ctcaggcaugcatcacaagtuag

SEQ ID NO: 29111 - DNA, 29 bp, Artificial Sequence
  Synthetic
gaacttgttgttutctcttttagggugaa

SEQ ID NO: 29112 - DNA, 28 bp, Artificial Sequence
  Synthetic
ttgtgtatgttuctagtcttacctucca

SEQ ID NO: 29113 - DNA, 28 bp, Artificial Sequence
  Synthetic
tcctgugaaggagaatatctcucaagat

SEQ ID NO: 29114 - DNA, 28 bp, Artificial Sequence
  Synthetic
aaagctctgtuaggatgattaaacagug

SEQ ID NO: 29115 - DNA, 26 bp, Artificial Sequence
  Synthetic
cccacttccaaauccttgtaatgugt

SEQ ID NO: 29116 - DNA, 22 bp, Artificial Sequence
  Synthetic
tcccaatcauacagccagcaug

SEQ ID NO: 29117 - DNA, 24 bp, Artificial Sequence
  Synthetic
tttacgugggctatactugccaat

SEQ ID NO: 29118 - DNA, 31 bp, Artificial Sequence
  Synthetic
cttgttaaatgagauaagtgcatccaatgut

SEQ ID NO: 29119 - DNA, 28 bp, Artificial Sequence
  Synthetic
acttagagtctugctttcagaattugct

SEQ ID NO: 29120 - DNA, 23 bp, Artificial Sequence
  Synthetic
ggtgcagcacacaugataaugag

SEQ ID NO: 29121 - DNA, 25 bp, Artificial Sequence
  Synthetic
gcctgaagccugatatcatgatugt

SEQ ID NO: 29122 - DNA, 22 bp, Artificial Sequence
  Synthetic
ggaatttgaagcugggcccaua

SEQ ID NO: 29123 - DNA, 24 bp, Artificial Sequence
  Synthetic
tgtttggcatuaaaaccgaaccug

SEQ ID NO: 29124 - DNA, 28 bp, Artificial Sequence
  Synthetic
gctttcctctucctctttgtaatttucc

SEQ ID NO: 29125 - DNA, 22 bp, Artificial Sequence
  Synthetic
aaccacacuaggguacagagct

SEQ ID NO: 29126 - DNA, 18 bp, Artificial Sequence
  Synthetic
gcagggcagcuctctgug

SEQ ID NO: 29127 - DNA, 19 bp, Artificial Sequence
  Synthetic
cacuctgcagguggacgag

SEQ ID NO: 29128 - DNA, 20 bp, Artificial Sequence
  Synthetic
gggcgttcugtgtgtcauca

SEQ ID NO: 29129 - DNA, 21 bp, Artificial Sequence
  Synthetic
ctaccugcccaacttcuaccc

SEQ ID NO: 29130 - DNA, 17 bp, Artificial Sequence
  Synthetic
gctugggccccacguag

SEQ ID NO: 29131 - DNA, 19 bp, Artificial Sequence
  Synthetic
cctgggugtatgcccucat

SEQ ID NO: 29132 - DNA, 23 bp, Artificial Sequence
  Synthetic
taggaccagaugtctgagucgat

SEQ ID NO: 29133 - DNA, 21 bp, Artificial Sequence
  Synthetic
ggaguacctauccagccacca

SEQ ID NO: 29134 - DNA, 17 bp, Artificial Sequence
  Synthetic
tcgccgugcgaacagua

SEQ ID NO: 29135 - DNA, 22 bp, Artificial Sequence
  Synthetic
tctacaaaggucacctgtucgg

SEQ ID NO: 29136 - DNA, 22 bp, Artificial Sequence
  Synthetic
gggaaacaaccccugaggatua

SEQ ID NO: 29137 - DNA, 24 bp, Artificial Sequence
  Synthetic
cttgcctttucttcttggttugca

SEQ ID NO: 29138 - DNA, 21 bp, Artificial Sequence
  Synthetic
gccctcaucacaaggtucact

SEQ ID NO: 29139 - DNA, 21 bp, Artificial Sequence
  Synthetic
gcacagactuccctgagctug

SEQ ID NO: 29140 - DNA, 22 bp, Artificial Sequence
  Synthetic
cacattucaagggcccuacact

SEQ ID NO: 29141 - DNA, 18 bp, Artificial Sequence
  Synthetic
gcuggagagcgacctgug

SEQ ID NO: 29142 - DNA, 22 bp, Artificial Sequence
  Synthetic
gatggctgugtgcatgcttauc

SEQ ID NO: 29143 - DNA, 29 bp, Artificial Sequence
  Synthetic
ctctaacagacuttgtgtgtttctuacca

SEQ ID NO: 29144 - DNA, 25 bp, Artificial Sequence
  Synthetic
agtttcaaauagcaactggaccuct

SEQ ID NO: 29145 - DNA, 23 bp, Artificial Sequence
  Synthetic
ggaucatcauccggaagacagaa

SEQ ID NO: 29146 - DNA, 22 bp, Artificial Sequence
  Synthetic
auttggaggacauggagagcac

SEQ ID NO: 29147 - DNA, 29 bp, Artificial Sequence
  Synthetic
ggctccugaaaggaaaacttgtttaauac

SEQ ID NO: 29148 - DNA, 20 bp, Artificial Sequence
  Synthetic
gaaguccgggacacugagag

SEQ ID NO: 29149 - DNA, 18 bp, Artificial Sequence
  Synthetic
cctcgaaguggacccgut

SEQ ID NO: 29150 - DNA, 19 bp, Artificial Sequence
  Synthetic
cucacaccggacguggaaa

SEQ ID NO: 29151 - DNA, 20 bp, Artificial Sequence
  Synthetic
ttcucacaacccucggaacc

SEQ ID NO: 29152 - DNA, 21 bp, Artificial Sequence
  Synthetic
cctggttcugcagagtcacut

SEQ ID NO: 29153 - DNA, 20 bp, Artificial Sequence
  Synthetic
cacagcggguctgattccuc

SEQ ID NO: 29154 - DNA, 21 bp, Artificial Sequence
  Synthetic
gggaggcaccuaagtaucgaa

SEQ ID NO: 29155 - DNA, 23 bp, Artificial Sequence
  Synthetic
tgttcccgttucctcttgatcuc

SEQ ID NO: 29156 - DNA, 22 bp, Artificial Sequence
  Synthetic
ggagaatgcaaggutcccacut

SEQ ID NO: 29157 - DNA, 23 bp, Artificial Sequence
  Synthetic
cctcatcggaaucaagctcagug

SEQ ID NO: 29158 - DNA, 26 bp, Artificial Sequence
  Synthetic
ccacaaagccccutataatacacuca

SEQ ID NO: 29159 - DNA, 27 bp, Artificial Sequence
  Synthetic
aggcaattgaaaaaguaaggaccauct

SEQ ID NO: 29160 - DNA, 22 bp, Artificial Sequence
  Synthetic
gctgtugctgagttuggagaac

SEQ ID NO: 29161 - DNA, 26 bp, Artificial Sequence
  Synthetic
tcattaatcccagcgcuttctacauc

SEQ ID NO: 29162 - DNA, 17 bp, Artificial Sequence
  Synthetic
cuggaagcgcccucagt

SEQ ID NO: 29163 - DNA, 27 bp, Artificial Sequence
  Synthetic
ggctgcgagtuataatgtgttacaauc

SEQ ID NO: 29164 - DNA, 25 bp, Artificial Sequence
  Synthetic
agtaagtgcuggatattcggguagt

SEQ ID NO: 29165 - DNA, 21 bp, Artificial Sequence
  Synthetic
ccttgtgccucttctgtucca

SEQ ID NO: 29166 - DNA, 24 bp, Artificial Sequence
  Synthetic
agcaaaagaugagagtgtccacut

SEQ ID NO: 29167 - DNA, 18 bp, Artificial Sequence
  Synthetic
cuccgcacggaguacgac

SEQ ID NO: 29168 - DNA, 23 bp, Artificial Sequence
  Synthetic
acaggcugaaagagttctcucac

SEQ ID NO: 29169 - DNA, 25 bp, Artificial Sequence
  Synthetic
gcatgttggugacctctgaatttut

SEQ ID NO: 29170 - DNA, 25 bp, Artificial Sequence
  Synthetic
atctttacugggtcagacugaggaa

SEQ ID NO: 29171 - DNA, 24 bp, Artificial Sequence
  Synthetic
caccatcctcugtttttgctguag

SEQ ID NO: 29172 - DNA, 26 bp, Artificial Sequence
  Synthetic
gacuaaaacaaccaaaccaaacucca

SEQ ID NO: 29173 - DNA, 23 bp, Artificial Sequence
  Synthetic
gcatttcgcautctgttgugacc

SEQ ID NO: 29174 - DNA, 25 bp, Artificial Sequence
  Synthetic
gaaaggaagaagacuacagggcaua

SEQ ID NO: 29175 - DNA, 27 bp, Artificial Sequence
  Synthetic
gtgacctgccuactaattcccataaut

SEQ ID NO: 29176 - DNA, 20 bp, Artificial Sequence
  Synthetic
gcggtccaugtaaccaugac

SEQ ID NO: 29177 - DNA, 28 bp, Artificial Sequence
  Synthetic
tcttttcatggtcucgtctcctaattuc

SEQ ID NO: 29178 - DNA, 26 bp, Artificial Sequence
  Synthetic
tgttccugagaaattttugccaacaa

SEQ ID NO: 29179 - DNA, 29 bp, Artificial Sequence
  Synthetic
acagtgagaaattuttgtctctgctttuc

SEQ ID NO: 29180 - DNA, 20 bp, Artificial Sequence
  Synthetic
cgcutctgtggucaggacat

SEQ ID NO: 29181 - DNA, 28 bp, Artificial Sequence
  Synthetic
catgagtttgcagugattttgctatuct

SEQ ID NO: 29182 - DNA, 20 bp, Artificial Sequence
  Synthetic
ccacgttgguctcgaggtuc

SEQ ID NO: 29183 - DNA, 20 bp, Artificial Sequence
  Synthetic
actcctcccutctgctucgt

SEQ ID NO: 29184 - DNA, 17 bp, Artificial Sequence
  Synthetic
ggacgcugggctuggat

SEQ ID NO: 29185 - DNA, 24 bp, Artificial Sequence
  Synthetic
ccutttguaaagauggaggaggag

SEQ ID NO: 29186 - DNA, 25 bp, Artificial Sequence
  Synthetic
ggactcacaatuacaagcctgttuc

SEQ ID NO: 29187 - DNA, 18 bp, Artificial Sequence
  Synthetic
gggagcgccugttuaccc

SEQ ID NO: 29188 - DNA, 22 bp, Artificial Sequence
  Synthetic
ctgcagucactcagtcuagcag

SEQ ID NO: 29189 - DNA, 23 bp, Artificial Sequence
  Synthetic
aaactccaccugcctagtttgut

SEQ ID NO: 29190 - DNA, 22 bp, Artificial Sequence
  Synthetic
aaatgcacaccguctcugagaa

SEQ ID NO: 29191 - DNA, 31 bp, Artificial Sequence
  Synthetic
gctgggaatauaacttaccactcttucaaat

SEQ ID NO: 29192 - DNA, 22 bp, Artificial Sequence
  Synthetic
caccgucccaguagaaaaccaa

SEQ ID NO: 29193 - DNA, 26 bp, Artificial Sequence
  Synthetic
atcggcttcuggttcttcttttcuag

SEQ ID NO: 29194 - DNA, 29 bp, Artificial Sequence
  Synthetic
agaaaacacagtaaauaggaggagacuct

SEQ ID NO: 29195 - DNA, 28 bp, Artificial Sequence
  Synthetic
ccagtgacuagaagttttccttccuaaa

SEQ ID NO: 29196 - DNA, 28 bp, Artificial Sequence
  Synthetic
caattatgcacagutcctttaacttuca

SEQ ID NO: 29197 - DNA, 26 bp, Artificial Sequence
  Synthetic
tcaactgcugcttattgtctcuacag

SEQ ID NO: 29198 - DNA, 21 bp, Artificial Sequence
  Synthetic
ggctgagagagcuttctcgug

SEQ ID NO: 29199 - DNA, 27 bp, Artificial Sequence
  Synthetic
aagtataggaacuaaggcagcuacact

SEQ ID NO: 29200 - DNA, 30 bp, Artificial Sequence
  Synthetic
caagaaccaaauggcataaaaguaagaact

SEQ ID NO: 29201 - DNA, 27 bp, Artificial Sequence
  Synthetic
ccccaaatgatugtgttctgttttgut

SEQ ID NO: 29202 - DNA, 22 bp, Artificial Sequence
  Synthetic
gcuggacaaggacaacuacaca

SEQ ID NO: 29203 - DNA, 26 bp, Artificial Sequence
  Synthetic
accattccauacacacctgttctuag

SEQ ID NO: 29204 - DNA, 26 bp, Artificial Sequence
  Synthetic
aggacaaaacaucttcgttcagauca

SEQ ID NO: 29205 - DNA, 29 bp, Artificial Sequence
  Synthetic
catggagctcaguttttgtgaatatctut

SEQ ID NO: 29206 - DNA, 26 bp, Artificial Sequence
  Synthetic
agaattatgctuggtacttggcugaa

SEQ ID NO: 29207 - DNA, 31 bp, Artificial Sequence
  Synthetic
tggcttgttgtgauaattaaggcttatuagt

SEQ ID NO: 29208 - DNA, 23 bp, Artificial Sequence
  Synthetic
gcatgggugaaagctagcuagat

SEQ ID NO: 29209 - DNA, 31 bp, Artificial Sequence
  Synthetic
tggtagaactatgugatagaaaaggtaggut

SEQ ID NO: 29210 - DNA, 30 bp, Artificial Sequence
  Synthetic
gcatctatgtaagucataacatgcttucct

SEQ ID NO: 29211 - DNA, 26 bp, Artificial Sequence
  Synthetic
gtctgtttacacucccttctccttut

SEQ ID NO: 29212 - DNA, 26 bp, Artificial Sequence
  Synthetic
ctcttcatccauctcagaagaagcug

SEQ ID NO: 29213 - DNA, 27 bp, Artificial Sequence
  Synthetic
aggaacgtcucagtggtttttaagtut

SEQ ID NO: 29214 - DNA, 24 bp, Artificial Sequence
  Synthetic
gaaacacuagacctauggcaacac

SEQ ID NO: 29215 - DNA, 27 bp, Artificial Sequence
  Synthetic
cttagcacacccucaaaagagtaauga

SEQ ID NO: 29216 - DNA, 27 bp, Artificial Sequence
  Synthetic
caaataaagatuccccactgtuccagt

SEQ ID NO: 29217 - DNA, 21 bp, Artificial Sequence
  Synthetic
gctggcatuacctcgcctaug

SEQ ID NO: 29218 - DNA, 25 bp, Artificial Sequence
  Synthetic
agggactaaguagaagggaugaagg

SEQ ID NO: 29219 - DNA, 28 bp, Artificial Sequence
  Synthetic
cataactgaaagccaaugacagatctut

SEQ ID NO: 29220 - DNA, 28 bp, Artificial Sequence
  Synthetic
tctgtatcatcugtatccatgtguacca

SEQ ID NO: 29221 - DNA, 24 bp, Artificial Sequence
  Synthetic
tgtatgtgtguttgactccacucc

SEQ ID NO: 29222 - DNA, 25 bp, Artificial Sequence
  Synthetic
gttcattacuggcatctaaguggac

SEQ ID NO: 29223 - DNA, 28 bp, Artificial Sequence
  Synthetic
gcttattagttgucttgccaattgtuct

SEQ ID NO: 29224 - DNA, 25 bp, Artificial Sequence
  Synthetic
gaaattcaagcagccuaaagcugat

SEQ ID NO: 29225 - DNA, 29 bp, Artificial Sequence
  Synthetic
agatgctagtgtutgaatctctctttuca

SEQ ID NO: 29226 - DNA, 26 bp, Artificial Sequence
  Synthetic
agaagagaaaucaagggtcauaccca

SEQ ID NO: 29227 - DNA, 23 bp, Artificial Sequence
  Synthetic
gaccctggagutcagggatatuc

SEQ ID NO: 29228 - DNA, 20 bp, Artificial Sequence
  Synthetic
caaggtgtuccaagccagug

SEQ ID NO: 29229 - DNA, 19 bp, Artificial Sequence
  Synthetic
caccagcagcauggcauag

SEQ ID NO: 29230 - DNA, 22 bp, Artificial Sequence
  Synthetic
tcaatcccucagaggctucact

SEQ ID NO: 29231 - DNA, 19 bp, Artificial Sequence
  Synthetic
cagaguggcagtgctgaug

SEQ ID NO: 29232 - DNA, 20 bp, Artificial Sequence
  Synthetic
gccatgucccttccugcaaa

SEQ ID NO: 29233 - DNA, 22 bp, Artificial Sequence
  Synthetic
cagcttccucctccacttcuac

SEQ ID NO: 29234 - DNA, 19 bp, Artificial Sequence
  Synthetic
gtgacaggcaugccaggua

SEQ ID NO: 29235 - DNA, 21 bp, Artificial Sequence
  Synthetic
cgccagatugaccaagtcucc

SEQ ID NO: 29236 - DNA, 20 bp, Artificial Sequence
  Synthetic
caaccaggcuggtcctgaua

SEQ ID NO: 29237 - DNA, 20 bp, Artificial Sequence
  Synthetic
ctgatggugcccctctctuc

SEQ ID NO: 29238 - DNA, 20 bp, Artificial Sequence
  Synthetic
aagcucacacagaggtgcut

SEQ ID NO: 29239 - DNA, 24 bp, Artificial Sequence
  Synthetic
gaaaaacatucgtggctucaagct

SEQ ID NO: 29240 - DNA, 21 bp, Artificial Sequence
  Synthetic
cagaggtugggagtttgggut

SEQ ID NO: 29241 - DNA, 21 bp, Artificial Sequence
  Synthetic
tgtccgctucagtgttccauc

SEQ ID NO: 29242 - DNA, 22 bp, Artificial Sequence
  Synthetic
tgagcaguatcaugagcccaga

SEQ ID NO: 29243 - DNA, 20 bp, Artificial Sequence
  Synthetic
ctgagccuccacatgtcucc

SEQ ID NO: 29244 - DNA, 20 bp, Artificial Sequence
  Synthetic
ccttggagcutcctcugagc

SEQ ID NO: 29245 - DNA, 22 bp, Artificial Sequence
  Synthetic
ggcctcttuccggatgtttcuc

SEQ ID NO: 29246 - DNA, 24 bp, Artificial Sequence
  Synthetic
ggactgagugttgtttctttucca

SEQ ID NO: 29247 - DNA, 25 bp, Artificial Sequence
  Synthetic
gtcccgaggcuatgaaattgaugaa

SEQ ID NO: 29248 - DNA, 24 bp, Artificial Sequence
  Synthetic
taacacttagggugcaggatuagg

SEQ ID NO: 29249 - DNA, 24 bp, Artificial Sequence
  Synthetic
tccttacccacugggattgtttug

SEQ ID NO: 29250 - DNA, 20 bp, Artificial Sequence
  Synthetic
ccccaaacccgaugacaucc

SEQ ID NO: 29251 - DNA, 27 bp, Artificial Sequence
  Synthetic
tcagcaagatcaucgcagagaatatut

SEQ ID NO: 29252 - DNA, 17 bp, Artificial Sequence
  Synthetic
gcctacccucccggcua

SEQ ID NO: 29253 - DNA, 17 bp, Artificial Sequence
  Synthetic
cggguccgggcaugaag

SEQ ID NO: 29254 - DNA, 23 bp, Artificial Sequence
  Synthetic
aacatuggccagaaggaagacut

SEQ ID NO: 29255 - DNA, 19 bp, Artificial Sequence
  Synthetic
accacugccctccacauca

SEQ ID NO: 29256 - DNA, 18 bp, Artificial Sequence
  Synthetic
cauccaguccagcgcact

SEQ ID NO: 29257 - DNA, 17 bp, Artificial Sequence
  Synthetic
ccctccgccuccatcuc

SEQ ID NO: 29258 - DNA, 21 bp, Artificial Sequence
  Synthetic
ggctcugaccccttgtccuat

SEQ ID NO: 29259 - DNA, 18 bp, Artificial Sequence
  Synthetic
gggagacucggccauacc

SEQ ID NO: 29260 - DNA, 20 bp, Artificial Sequence
  Synthetic
cccagcugaccctgtcttuc

SEQ ID NO: 29261 - DNA, 20 bp, Artificial Sequence
  Synthetic
gagcugcuaccaccaaaggt

SEQ ID NO: 29262 - DNA, 19 bp, Artificial Sequence
  Synthetic
gccctctcutcccacccua

SEQ ID NO: 29263 - DNA, 18 bp, Artificial Sequence
  Synthetic
cagggcugcagacacuca

SEQ ID NO: 29264 - DNA, 21 bp, Artificial Sequence
  Synthetic
ccctgccuggaaaaatggcua

SEQ ID NO: 29265 - DNA, 20 bp, Artificial Sequence
  Synthetic
cccttgugaggcggtuagag

SEQ ID NO: 29266 - DNA, 21 bp, Artificial Sequence
  Synthetic
ctcaagggccaggugtacauc

SEQ ID NO: 29267 - DNA, 23 bp, Artificial Sequence
  Synthetic
tccagtcaaaagauaggctcugt

SEQ ID NO: 29268 - DNA, 26 bp, Artificial Sequence
  Synthetic
acccagtgtgugttgttattgtuaat

SEQ ID NO: 29269 - DNA, 21 bp, Artificial Sequence
  Synthetic
ccccagcucctcattguacac

SEQ ID NO: 29270 - DNA, 28 bp, Artificial Sequence
  Synthetic
caagttaacacugattgaccatcatucc

SEQ ID NO: 29271 - DNA, 24 bp, Artificial Sequence
  Synthetic
ccagtagcctutctgagagccuaa

SEQ ID NO: 29272 - DNA, 21 bp, Artificial Sequence
  Synthetic
agacgctuctcccatagucgt

SEQ ID NO: 29273 - DNA, 22 bp, Artificial Sequence
  Synthetic
atgguagggcacaaugaagagg

SEQ ID NO: 29274 - DNA, 24 bp, Artificial Sequence
  Synthetic
gcttagucccaaggtcatgaauca

SEQ ID NO: 29275 - DNA, 29 bp, Artificial Sequence
  Synthetic
ctatattctggcuggtctgtatcttucag

SEQ ID NO: 29276 - DNA, 23 bp, Artificial Sequence
  Synthetic
ccaggugagattccagtuccaaa

SEQ ID NO: 29277 - DNA, 31 bp, Artificial Sequence
  Synthetic
tctcagtcctucttacattgtctttucaaaa

SEQ ID NO: 29278 - DNA, 25 bp, Artificial Sequence
  Synthetic
acctgtcugaaggaagaatgtuagc

SEQ ID NO: 29279 - DNA, 25 bp, Artificial Sequence
  Synthetic
tcaaacttcatguccacgtctctut

SEQ ID NO: 29280 - DNA, 20 bp, Artificial Sequence
  Synthetic
accatagtgucacgctgcuc

SEQ ID NO: 29281 - DNA, 27 bp, Artificial Sequence
  Synthetic
tgactatucagatgaaatgtucgcagt

SEQ ID NO: 29282 - DNA, 23 bp, Artificial Sequence
  Synthetic
gggctggatutggagctaaagua

SEQ ID NO: 29283 - DNA, 31 bp, Artificial Sequence
  Synthetic
ggaagtgatcuaactttgctgcaaauaaaag

SEQ ID NO: 29284 - DNA, 24 bp, Artificial Sequence
  Synthetic
caccatcttccuctgtgtttccut

SEQ ID NO: 29285 - DNA, 23 bp, Artificial Sequence
  Synthetic
gggaaugccagacttcttuggag

SEQ ID NO: 29286 - DNA, 21 bp, Artificial Sequence
  Synthetic
tgtaaaggcucagggtucacg

SEQ ID NO: 29287 - DNA, 24 bp, Artificial Sequence
  Synthetic
tggaataccgacugccatttctut

SEQ ID NO: 29288 - DNA, 25 bp, Artificial Sequence
  Synthetic
atcccagaattuccttgtttccaut

SEQ ID NO: 29289 - DNA, 28 bp, Artificial Sequence
  Synthetic
atgtgcaacattuttcgtcttgtgauat

SEQ ID NO: 29290 - DNA, 25 bp, Artificial Sequence
  Synthetic
tagatctaaaagagagcucctccug

SEQ ID NO: 29291 - DNA, 28 bp, Artificial Sequence
  Synthetic
tgccactgctgaugtactttattaacut

SEQ ID NO: 29292 - DNA, 28 bp, Artificial Sequence
  Synthetic
aatgtttuccagagacaaagtugcaaaa

SEQ ID NO: 29293 - DNA, 25 bp, Artificial Sequence
  Synthetic
ccacagaagccucatatgaagaugg

SEQ ID NO: 29294 - DNA, 27 bp, Artificial Sequence
  Synthetic
cccaaatataccucaacagggatuacc

SEQ ID NO: 29295 - DNA, 29 bp, Artificial Sequence
  Synthetic
gttccacaaacatucagccctttataaut

SEQ ID NO: 29296 - DNA, 25 bp, Artificial Sequence
  Synthetic
cccaacaggtauatgaggagatcug

SEQ ID NO: 29297 - DNA, 25 bp, Artificial Sequence
  Synthetic
agacgtttccugtttgacctttuct

SEQ ID NO: 29298 - DNA, 24 bp, Artificial Sequence
  Synthetic
gaataagcucaggacaagtugcac

SEQ ID NO: 29299 - DNA, 28 bp, Artificial Sequence
  Synthetic
gtatcatccatugcccttttcttgatut

SEQ ID NO: 29300 - DNA, 21 bp, Artificial Sequence
  Synthetic
ctccccgacauttgcttgtug

SEQ ID NO: 29301 - DNA, 24 bp, Artificial Sequence
  Synthetic
cattgcatugaacacgtgcatuag

SEQ ID NO: 29302 - DNA, 23 bp, Artificial Sequence
  Synthetic
ccttattcucaccatcccucact

SEQ ID NO: 29303 - DNA, 20 bp, Artificial Sequence
  Synthetic
cagutgttctcaugcagccg

SEQ ID NO: 29304 - DNA, 21 bp, Artificial Sequence
  Synthetic
ccccacagaccugacttcuct

SEQ ID NO: 29305 - DNA, 19 bp, Artificial Sequence
  Synthetic
ggttcucccgaaugcggaa

SEQ ID NO: 29306 - DNA, 18 bp, Artificial Sequence
  Synthetic
cccctguctgcttggugc

SEQ ID NO: 29307 - DNA, 19 bp, Artificial Sequence
  Synthetic
gagtcgucctcgtcguaca

SEQ ID NO: 29308 - DNA, 20 bp, Artificial Sequence
  Synthetic
tgggacgugcagcattcuaa

SEQ ID NO: 29309 - DNA, 19 bp, Artificial Sequence
  Synthetic
cttgtguaccgccucacca

SEQ ID NO: 29310 - DNA, 22 bp, Artificial Sequence
  Synthetic
gggaagaggugtgctacacaug

SEQ ID NO: 29311 - DNA, 22 bp, Artificial Sequence
  Synthetic
acacgutgaaguggagcaagag

SEQ ID NO: 29312 - DNA, 20 bp, Artificial Sequence
  Synthetic
ctggctaaggugttccccug

SEQ ID NO: 29313 - DNA, 23 bp, Artificial Sequence
  Synthetic
atgtagtgaagutcggcacacut

SEQ ID NO: 29314 - DNA, 19 bp, Artificial Sequence
  Synthetic
gctggtgcugttccctguc

SEQ ID NO: 29315 - DNA, 18 bp, Artificial Sequence
  Synthetic
ggcgttuccagggctuac

SEQ ID NO: 29316 - DNA, 19 bp, Artificial Sequence
  Synthetic
gctgagugggctacgtcug

SEQ ID NO: 29317 - DNA, 22 bp, Artificial Sequence
  Synthetic
ctcagaugtgctgtugagacct

SEQ ID NO: 29318 - DNA, 20 bp, Artificial Sequence
  Synthetic
caagccacccauctccucag

SEQ ID NO: 29319 - DNA, 18 bp, Artificial Sequence
  Synthetic
tggccuctgtcuccccag

SEQ ID NO: 29320 - DNA, 18 bp, Artificial Sequence
  Synthetic
caaggcgaugcaggucca

SEQ ID NO: 29321 - DNA, 17 bp, Artificial Sequence
  Synthetic
ccctgcagcuggcctua

SEQ ID NO: 29322 - DNA, 23 bp, Artificial Sequence
  Synthetic
ctcatcgtggaguacgccaaaua

SEQ ID NO: 29323 - DNA, 19 bp, Artificial Sequence
  Synthetic
gugcagagccataugcacg

SEQ ID NO: 29324 - DNA, 24 bp, Artificial Sequence
  Synthetic
ggttactgaaagcucagggauagg

SEQ ID NO: 29325 - DNA, 27 bp, Artificial Sequence
  Synthetic
tgtataagggugtttctgtaaccucca

SEQ ID NO: 29326 - DNA, 21 bp, Artificial Sequence
  Synthetic
ctggcccugcttggatcauat

SEQ ID NO: 29327 - DNA, 23 bp, Artificial Sequence
  Synthetic
ctttcagcutgtgggaatuggac

SEQ ID NO: 29328 - DNA, 24 bp, Artificial Sequence
  Synthetic
tccctuccacatggatugaaaaca

SEQ ID NO: 29329 - DNA, 32 bp, Artificial Sequence
  Synthetic
tccttttagaaaaacauagttgcaataaugcc

SEQ ID NO: 29330 - DNA, 29 bp, Artificial Sequence
  Synthetic
ggcaaaattaauggacacgtttgatagut

SEQ ID NO: 29331 - DNA, 23 bp, Artificial Sequence
  Synthetic
gtctgcuaggagggaaaaucacc

SEQ ID NO: 29332 - DNA, 19 bp, Artificial Sequence
  Synthetic
gaagcgcuccgggtagaut

SEQ ID NO: 29333 - DNA, 20 bp, Artificial Sequence
  Synthetic
cgacuggagaaagcaagcug

SEQ ID NO: 29334 - DNA, 17 bp, Artificial Sequence
  Synthetic
caccccutccggcucac

SEQ ID NO: 29335 - DNA, 17 bp, Artificial Sequence
  Synthetic
cggtgcugtcccuggat

SEQ ID NO: 29336 - DNA, 27 bp, Artificial Sequence
  Synthetic
cagaacaauacagatacuagggaccaa

SEQ ID NO: 29337 - DNA, 22 bp, Artificial Sequence
  Synthetic
ctcttccugaactgctccucag

SEQ ID NO: 29338 - DNA, 22 bp, Artificial Sequence
  Synthetic
gctgtcaggaugggactgttug

SEQ ID NO: 29339 - DNA, 23 bp, Artificial Sequence
  Synthetic
gutatgagcuaggagcaccaagg

SEQ ID NO: 29340 - DNA, 28 bp, Artificial Sequence
  Synthetic
ccattttgccugatcaagttacaauaaa

SEQ ID NO: 29341 - DNA, 22 bp, Artificial Sequence
  Synthetic
gguaggaggagaagaguccaua

SEQ ID NO: 29342 - DNA, 21 bp, Artificial Sequence
  Synthetic
ccaagcutacctgugaaggct

SEQ ID NO: 29343 - DNA, 26 bp, Artificial Sequence
  Synthetic
tcgttggaagccautttgactatcut

SEQ ID NO: 29344 - DNA, 18 bp, Artificial Sequence
  Synthetic
gacaggugctagggcugt

SEQ ID NO: 29345 - DNA, 17 bp, Artificial Sequence
  Synthetic
gccaccuggacggctua

SEQ ID NO: 29346 - DNA, 18 bp, Artificial Sequence
  Synthetic
cctcaggaggutgccuct

SEQ ID NO: 29347 - DNA, 24 bp, Artificial Sequence
  Synthetic
ctcaaaggagacutcggttaucct

SEQ ID NO: 29348 - DNA, 30 bp, Artificial Sequence
  Synthetic
cctcagaataguaaagaaccttgactucat

SEQ ID NO: 29349 - DNA, 22 bp, Artificial Sequence
  Synthetic
tccctccaggaugcttcuagac

SEQ ID NO: 29350 - DNA, 22 bp, Artificial Sequence
  Synthetic
cctcugaccaccagatgcttug

SEQ ID NO: 29351 - DNA, 21 bp, Artificial Sequence
  Synthetic
tcaagugcagtgttgugaggt

SEQ ID NO: 29352 - DNA, 21 bp, Artificial Sequence
  Synthetic
gcatuccagaacaagcagcuc

SEQ ID NO: 29353 - DNA, 24 bp, Artificial Sequence
  Synthetic
agaagtctcuttgcagctgugaaa

SEQ ID NO: 29354 - DNA, 22 bp, Artificial Sequence
  Synthetic
gcctacugagagcaagccatug

SEQ ID NO: 29355 - DNA, 21 bp, Artificial Sequence
  Synthetic
cctaacacuccggctctgugt

SEQ ID NO: 29356 - DNA, 30 bp, Artificial Sequence
  Synthetic
ttttctcagtgacaauaaaaagcacagtut

SEQ ID NO: 29357 - DNA, 23 bp, Artificial Sequence
  Synthetic
ggcugaaaagcacagtugaacag

SEQ ID NO: 29358 - DNA, 27 bp, Artificial Sequence
  Synthetic
agtagaaaauggcccctttgataaugt

SEQ ID NO: 29359 - DNA, 23 bp, Artificial Sequence
  Synthetic
gtcagagaaaccguctucaccat

SEQ ID NO: 29360 - DNA, 24 bp, Artificial Sequence
  Synthetic
tcctcccttucaagtgtcacttug

SEQ ID NO: 29361 - DNA, 24 bp, Artificial Sequence
  Synthetic
gtagtagcgaaagucagtcuggag

SEQ ID NO: 29362 - DNA, 25 bp, Artificial Sequence
  Synthetic
ctggtccacuttcttcttcttcuga

SEQ ID NO: 29363 - DNA, 21 bp, Artificial Sequence
  Synthetic
aggagagtuccaccccugaat

SEQ ID NO: 29364 - DNA, 26 bp, Artificial Sequence
  Synthetic
tgattctacagugctttctgttgcut

SEQ ID NO: 29365 - DNA, 23 bp, Artificial Sequence
  Synthetic
gcagcugagcctacauacacaac

SEQ ID NO: 29366 - DNA, 23 bp, Artificial Sequence
  Synthetic
gctgaaatgtuctacagccgcua

SEQ ID NO: 29367 - DNA, 21 bp, Artificial Sequence
  Synthetic
gccgucgattgtuaccaccag

SEQ ID NO: 29368 - DNA, 27 bp, Artificial Sequence
  Synthetic
aaaatctgaagaugtacccatgcucat

SEQ ID NO: 29369 - DNA, 28 bp, Artificial Sequence
  Synthetic
tgttttgagaatcauggaattctaggug

SEQ ID NO: 29370 - DNA, 26 bp, Artificial Sequence
  Synthetic
tccccttgtttugttcagatgtgaut

SEQ ID NO: 29371 - DNA, 24 bp, Artificial Sequence
  Synthetic
acagtgtguaaaacagacccucag

SEQ ID NO: 29372 - DNA, 23 bp, Artificial Sequence
  Synthetic
gaaatgaagcugaaggaggugga

SEQ ID NO: 29373 - DNA, 29 bp, Artificial Sequence
  Synthetic
ctcctgacatttcucctttttctctttut

SEQ ID NO: 29374 - DNA, 23 bp, Artificial Sequence
  Synthetic
ggcagaaggagagaugtttggug

SEQ ID NO: 29375 - DNA, 24 bp, Artificial Sequence
  Synthetic
ttgccaactguttcaagaactgug

SEQ ID NO: 29376 - DNA, 27 bp, Artificial Sequence
  Synthetic
aatttgcctctucagttgtaagcaaug

SEQ ID NO: 29377 - DNA, 24 bp, Artificial Sequence
  Synthetic
caagccaagaguaagtctcugagg

SEQ ID NO: 29378 - DNA, 29 bp, Artificial Sequence
  Synthetic
aaatgtgaattttcutgcagacttcagut

SEQ ID NO: 29379 - DNA, 28 bp, Artificial Sequence
  Synthetic
gtgtcacaactugtttccttacattuca

SEQ ID NO: 29380 - DNA, 24 bp, Artificial Sequence
  Synthetic
acccaactacutctcagagtucct

SEQ ID NO: 29381 - DNA, 30 bp, Artificial Sequence
  Synthetic
agttttacaagccauccttactttauccaa

SEQ ID NO: 29382 - DNA, 22 bp, Artificial Sequence
  Synthetic
aaggcccctuctgtgtatccua

SEQ ID NO: 29383 - DNA, 31 bp, Artificial Sequence
  Synthetic
gctctttctctgcuagcatcattaatttuac

SEQ ID NO: 29384 - DNA, 23 bp, Artificial Sequence
  Synthetic
gggtcaatugcatagacagucaa

SEQ ID NO: 29385 - DNA, 28 bp, Artificial Sequence
  Synthetic
ggactgtcatguttgtactttgttugat

SEQ ID NO: 29386 - DNA, 25 bp, Artificial Sequence
  Synthetic
ctgaaaacacugacctatggcuagt

SEQ ID NO: 29387 - DNA, 31 bp, Artificial Sequence
  Synthetic
gcttatcaaaacugctatgctcttccauaat

SEQ ID NO: 29388 - DNA, 23 bp, Artificial Sequence
  Synthetic
tgcaaacuacaggcttacagcut

SEQ ID NO: 29389 - DNA, 22 bp, Artificial Sequence
  Synthetic
tgcatcgtutcttgtccuccag

SEQ ID NO: 29390 - DNA, 25 bp, Artificial Sequence
  Synthetic
gactcgaaguacatagcttgtccug

SEQ ID NO: 29391 - DNA, 27 bp, Artificial Sequence
  Synthetic
agtgtttttgaaaucacagtgccttut

SEQ ID NO: 29392 - DNA, 28 bp, Artificial Sequence
  Synthetic
acatttcgugtatttcaaaaucggacag

SEQ ID NO: 29393 - DNA, 26 bp, Artificial Sequence
  Synthetic
tgtgctgtuacgctgttcttactuat

SEQ ID NO: 29394 - DNA, 30 bp, Artificial Sequence
  Synthetic
attgactcgtgttautactcttccagaauc

SEQ ID NO: 29395 - DNA, 28 bp, Artificial Sequence
  Synthetic
tcattgcactgugttttaacttgguaac

SEQ ID NO: 29396 - DNA, 22 bp, Artificial Sequence
  Synthetic
gcaggcaaccagaagucatcuc

SEQ ID NO: 29397 - DNA, 31 bp, Artificial Sequence
  Synthetic
ggagaactatcgcutttaaggagtttagaut

SEQ ID NO: 29398 - DNA, 31 bp, Artificial Sequence
  Synthetic
cttggtatgttgtautgttacttgctaatut

SEQ ID NO: 29399 - DNA, 26 bp, Artificial Sequence
  Synthetic
tcaccaattcaacauacactgtccut

SEQ ID NO: 29400 - DNA, 22 bp, Artificial Sequence
  Synthetic
ccauctgtugccacaacaacaa

SEQ ID NO: 29401 - DNA, 27 bp, Artificial Sequence
  Synthetic
catttacaguagcccgtcaaaactuac

SEQ ID NO: 29402 - DNA, 24 bp, Artificial Sequence
  Synthetic
ggcttcttctuccaccacagauaa

SEQ ID NO: 29403 - DNA, 31 bp, Artificial Sequence
  Synthetic
agacaaatgccagaaugactacttaaaugaa

SEQ ID NO: 29404 - DNA, 22 bp, Artificial Sequence
  Synthetic
acaaacagcugaaagcctcuga

SEQ ID NO: 29405 - DNA, 23 bp, Artificial Sequence
  Synthetic
tgagtgggcgccauatcaatuac

SEQ ID NO: 29406 - DNA, 24 bp, Artificial Sequence
  Synthetic
gataaaagaatacutgccgcgcut

SEQ ID NO: 29407 - DNA, 29 bp, Artificial Sequence
  Synthetic
gctcagggagacutcatcatcaauaaaac

SEQ ID NO: 29408 - DNA, 29 bp, Artificial Sequence
  Synthetic
ttcttcatgagcauatcgtataaugcaca

SEQ ID NO: 29409 - DNA, 28 bp, Artificial Sequence
  Synthetic
cgtcaatatucaagtgatggaugcaaat

SEQ ID NO: 29410 - DNA, 30 bp, Artificial Sequence
  Synthetic
tttcagtttuaaccagacatctcttucagt

SEQ ID NO: 29411 - DNA, 23 bp, Artificial Sequence
  Synthetic
aaagacccagagcutcaccttut

SEQ ID NO: 29412 - DNA, 28 bp, Artificial Sequence
  Synthetic
ctcttctctagcutatgtagccatauct

SEQ ID NO: 29413 - DNA, 28 bp, Artificial Sequence
  Synthetic
agttatcaaggcuatatcctggaatcug

SEQ ID NO: 29414 - DNA, 26 bp, Artificial Sequence
  Synthetic
cataaaactgccuacagtagcgtcua

SEQ ID NO: 29415 - DNA, 23 bp, Artificial Sequence
  Synthetic
ccauatgcatccuaggacagcag

SEQ ID NO: 29416 - DNA, 29 bp, Artificial Sequence
  Synthetic
tccttggaatugagagaatttgttacugt

SEQ ID NO: 29417 - DNA, 28 bp, Artificial Sequence
  Synthetic
gcggctgaaugaaactctcttaatttut

SEQ ID NO: 29418 - DNA, 20 bp, Artificial Sequence
  Synthetic
cggcaaucacgagtgttugg

SEQ ID NO: 29419 - DNA, 26 bp, Artificial Sequence
  Synthetic
ctcctggctatugtgcctaatttcua

SEQ ID NO: 29420 - DNA, 29 bp, Artificial Sequence
  Synthetic
tcttatcttcatagutgagcctcttccut

SEQ ID NO: 29421 - DNA, 28 bp, Artificial Sequence
  Synthetic
gcatgucatctctaactuccaagaggat

SEQ ID NO: 29422 - DNA, 31 bp, Artificial Sequence
  Synthetic
gaaaggauagagagagaguaaatagaaacug

SEQ ID NO: 29423 - DNA, 25 bp, Artificial Sequence
  Synthetic
accgatgaacauacactccattgug

SEQ ID NO: 29424 - DNA, 29 bp, Artificial Sequence
  Synthetic
tcactaacatctcuatccagaactctucc

SEQ ID NO: 29425 - DNA, 25 bp, Artificial Sequence
  Synthetic
caggtacaautctgguggacaacat

SEQ ID NO: 29426 - DNA, 21 bp, Artificial Sequence
  Synthetic
ctggctcgcuctaaaggucaa

SEQ ID NO: 29427 - DNA, 31 bp, Artificial Sequence
  Synthetic
tgtgacaattgtguttacctataacagatua

SEQ ID NO: 29428 - DNA, 23 bp, Artificial Sequence
  Synthetic
cctcacccugtgtcaccttauag

SEQ ID NO: 29429 - DNA, 23 bp, Artificial Sequence
  Synthetic
ccttcacttgugggaagggatug

SEQ ID NO: 29430 - DNA, 18 bp, Artificial Sequence
  Synthetic
accucagcaccgccuaac

SEQ ID NO: 29431 - DNA, 20 bp, Artificial Sequence
  Synthetic
ctctggccucttccacccua

SEQ ID NO: 29432 - DNA, 21 bp, Artificial Sequence
  Synthetic
ggctcacccutgtacttgcut

SEQ ID NO: 29433 - DNA, 21 bp, Artificial Sequence
  Synthetic
cggatcacugtgacgauaccg

SEQ ID NO: 29434 - DNA, 22 bp, Artificial Sequence
  Synthetic
cactcaaccuaaggctgtgugt

SEQ ID NO: 29435 - DNA, 22 bp, Artificial Sequence
  Synthetic
ccctcugagaagggacttcuga

SEQ ID NO: 29436 - DNA, 22 bp, Artificial Sequence
  Synthetic
ctggtcacaccugaatgctuct

SEQ ID NO: 29437 - DNA, 20 bp, Artificial Sequence
  Synthetic
gaggttggcauccgaguagg

SEQ ID NO: 29438 - DNA, 23 bp, Artificial Sequence
  Synthetic
gagttcaacagcuccgaguacag

SEQ ID NO: 29439 - DNA, 30 bp, Artificial Sequence
  Synthetic
gtttctattttauagctgaggaccugaaca

SEQ ID NO: 29440 - DNA, 23 bp, Artificial Sequence
  Synthetic
gcaaaggcauggagaggactuac

SEQ ID NO: 29441 - DNA, 23 bp, Artificial Sequence
  Synthetic
ggccggtugtcattttcatugat

SEQ ID NO: 29442 - DNA, 22 bp, Artificial Sequence
  Synthetic
acccagagggautttguccaag

SEQ ID NO: 29443 - DNA, 22 bp, Artificial Sequence
  Synthetic
ggcagaaaaccagugtccucag

SEQ ID NO: 29444 - DNA, 25 bp, Artificial Sequence
  Synthetic
cccaucaacaagcctgtttuaaacc

SEQ ID NO: 29445 - DNA, 20 bp, Artificial Sequence
  Synthetic
gcacgttgucgttgacaucc

SEQ ID NO: 29446 - DNA, 20 bp, Artificial Sequence
  Synthetic
gtgaacagggccaguctucc

SEQ ID NO: 29447 - DNA, 20 bp, Artificial Sequence
  Synthetic
gagttcugccccacaccuac

SEQ ID NO: 29448 - DNA, 20 bp, Artificial Sequence
  Synthetic
ctcctgcaaccugtctgugt

SEQ ID NO: 29449 - DNA, 21 bp, Artificial Sequence
  Synthetic
cccacaauttgtgugcagagc

SEQ ID NO: 29450 - DNA, 20 bp, Artificial Sequence
  Synthetic
acccactuctctctcuggca

SEQ ID NO: 29451 - DNA, 19 bp, Artificial Sequence
  Synthetic
ggguccagagguacaagca

SEQ ID NO: 29452 - DNA, 19 bp, Artificial Sequence
  Synthetic
ccuccccaggaccaacguc

SEQ ID NO: 29453 - DNA, 22 bp, Artificial Sequence
  Synthetic
ctgtagaacutgttggguggct

SEQ ID NO: 29454 - DNA, 22 bp, Artificial Sequence
  Synthetic
tctctugcacccatctuaccct

SEQ ID NO: 29455 - DNA, 28 bp, Artificial Sequence
  Synthetic
tggtaggaaugagatgatagagacucac

SEQ ID NO: 29456 - DNA, 21 bp, Artificial Sequence
  Synthetic
acutcctcaucaacagcagca

SEQ ID NO: 29457 - DNA, 19 bp, Artificial Sequence
  Synthetic
gacatgggcucccctcuac

SEQ ID NO: 29458 - DNA, 23 bp, Artificial Sequence
  Synthetic
gtgtacaaugtgtctgtguccga

SEQ ID NO: 29459 - DNA, 21 bp, Artificial Sequence
  Synthetic
acctagtcuggctgtccauct

SEQ ID NO: 29460 - DNA, 21 bp, Artificial Sequence
  Synthetic
ggagtgugcaaagucacagga

SEQ ID NO: 29461 - DNA, 24 bp, Artificial Sequence
  Synthetic
tcatagctgcuctgcagaaagaug

SEQ ID NO: 29462 - DNA, 28 bp, Artificial Sequence
  Synthetic
ggaaggaaaggaacuctaaaaacctcut

SEQ ID NO: 29463 - DNA, 21 bp, Artificial Sequence
  Synthetic
cttuggcagccuagagaagct

SEQ ID NO: 29464 - DNA, 17 bp, Artificial Sequence
  Synthetic
ggctucccagccuccac

SEQ ID NO: 29465 - DNA, 18 bp, Artificial Sequence
  Synthetic
aatgggauccccggctuc

SEQ ID NO: 29466 - DNA, 25 bp, Artificial Sequence
  Synthetic
gaautacctggacuacgagaccaag

SEQ ID NO: 29467 - DNA, 23 bp, Artificial Sequence
  Synthetic
gttgaggttgucgatggaguagg

SEQ ID NO: 29468 - DNA, 21 bp, Artificial Sequence
  Synthetic
cagggtuaacaagggugcgat

SEQ ID NO: 29469 - DNA, 23 bp, Artificial Sequence
  Synthetic
aggacatgggutaggaagtguca

SEQ ID NO: 29470 - DNA, 19 bp, Artificial Sequence
  Synthetic
cttgaccuggccacctcuc

SEQ ID NO: 29471 - DNA, 20 bp, Artificial Sequence
  Synthetic
ccagtgguctctcaguccaa

SEQ ID NO: 29472 - DNA, 21 bp, Artificial Sequence
  Synthetic
cagaatgacugctctccugct

SEQ ID NO: 29473 - DNA, 21 bp, Artificial Sequence
  Synthetic
caccagguggtagaagctcug

SEQ ID NO: 29474 - DNA, 22 bp, Artificial Sequence
  Synthetic
aaggacgugacccactctttuc

SEQ ID NO: 29475 - DNA, 20 bp, Artificial Sequence
  Synthetic
aggtgtugacgatgtugcct

SEQ ID NO: 29476 - DNA, 22 bp, Artificial Sequence
  Synthetic
ctaccaccccuagatccaucct

SEQ ID NO: 29477 - DNA, 21 bp, Artificial Sequence
  Synthetic
gctttctgggucccatcctuc

SEQ ID NO: 29478 - DNA, 19 bp, Artificial Sequence
  Synthetic
ctacctucccccgggacua

SEQ ID NO: 29479 - DNA, 22 bp, Artificial Sequence
  Synthetic
tcccttcttaucctccccugag

SEQ ID NO: 29480 - DNA, 23 bp, Artificial Sequence
  Synthetic
gagtttgtgauctctcctgugga

SEQ ID NO: 29481 - DNA, 22 bp, Artificial Sequence
  Synthetic
cctctctuggcacaaggguaac

SEQ ID NO: 29482 - DNA, 21 bp, Artificial Sequence
  Synthetic
gaaccugcccatgaacaucac

SEQ ID NO: 29483 - DNA, 24 bp, Artificial Sequence
  Synthetic
gtccuctttttcacuggaaaccct

SEQ ID NO: 29484 - DNA, 18 bp, Artificial Sequence
  Synthetic
gccuacaacgugccccat

SEQ ID NO: 29485 - DNA, 22 bp, Artificial Sequence
  Synthetic
ttaggcauaagggaggtccuca

SEQ ID NO: 29486 - DNA, 22 bp, Artificial Sequence
  Synthetic
gcacccctuttctgtgtgttuc

SEQ ID NO: 29487 - DNA, 19 bp, Artificial Sequence
  Synthetic
ctaaaggugggccggtugt

SEQ ID NO: 29488 - DNA, 23 bp, Artificial Sequence
  Synthetic
agauctttcuggaagaggccact

SEQ ID NO: 29489 - DNA, 21 bp, Artificial Sequence
  Synthetic
tgtaggacucctgctcctcuc

SEQ ID NO: 29490 - DNA, 20 bp, Artificial Sequence
  Synthetic
ctgagccaggcacugtcaut

SEQ ID NO: 29491 - DNA, 18 bp, Artificial Sequence
  Synthetic
gggugcaggcccttguac

SEQ ID NO: 29492 - DNA, 21 bp, Artificial Sequence
  Synthetic
gcttggcugaggcuaaggaag

SEQ ID NO: 29493 - DNA, 19 bp, Artificial Sequence
  Synthetic
cctccaggauccgcuccat

SEQ ID NO: 29494 - DNA, 19 bp, Artificial Sequence
  Synthetic
agtgggagccuctgtguct

SEQ ID NO: 29495 - DNA, 17 bp, Artificial Sequence
  Synthetic
cuggacccagcctgugg

SEQ ID NO: 29496 - DNA, 28 bp, Artificial Sequence
  Synthetic
cttttgaatgautgaaggaccuaaagcc

SEQ ID NO: 29497 - DNA, 21 bp, Artificial Sequence
  Synthetic
ctttgctugttgccuccacaa

SEQ ID NO: 29498 - DNA, 24 bp, Artificial Sequence
  Synthetic
ggaaggatgtcucaaccagagcua

SEQ ID NO: 29499 - DNA, 22 bp, Artificial Sequence
  Synthetic
tgtcattgacgucgatgaccuc

SEQ ID NO: 29500 - DNA, 23 bp, Artificial Sequence
  Synthetic
ctcaggaccuaggagctgagaut

(The sequence listing continues in the following parts.)

We claim:

1. A method for amplifying a plurality of different target sequences within a sample, comprising:
   a) producing at least one hundred different amplified target sequences by amplifying at least one hundred different target sequences within a single amplification reaction mixture, wherein the producing includes contacting the at least one hundred different target sequences with a plurality of target-specific primers and a polymerase under amplification conditions and forming a plurality of double stranded amplified target sequences containing a primer-derived sequence, and wherein at least one of the plurality of target-specific primers and at least one of the primer-derived sequences includes a cleavable group;
   b) cleaving the cleavable group of at least one primer-derived sequence of at least one double stranded amplified target sequence, thereby forming a cleaved amplified target sequence;
   c) producing one or more double-stranded adapter-ligated amplified target sequences by ligating at least one double-stranded adapter containing an adapter sequence to the cleaved double-stranded amplified target sequence in a blunt-ended ligation reaction; and
   d) reamplifying at least one of the double-stranded adapter-ligated amplified target sequences using primers that bind to at least some portion of the adapter sequence;
   wherein the method includes use of no more than two target-specific primers to produce any one of the double stranded adapter-ligated amplified target sequences.

2. The method of claim 1, wherein one or more of the at least one double-stranded adapter cannot hybridize under high stringency to the 20 contiguous nucleotides at the 3' end or the 5' end of at least one amplified target sequence in the sample.

3. The method of claim 1, wherein the reamplifying includes contacting the at least one double-stranded adapter-ligated amplified target sequence with one or more primers including a nucleic acid sequence that is complementary to at least one of the double-stranded adapters, and a polymerase under amplification conditions, thereby producing at least one double-stranded reamplified adapter-ligated amplified target sequence.

4. The method of claim 1, wherein at least one target-specific primer is at least 70% complementary to at least a portion of a corresponding target sequence in the sample.

5. The method of claim 1, wherein at least one double-stranded adapter that is ligated to the cleaved end of the at least one of the double-stranded amplified target sequences is susceptible to exonuclease digestion.

6. The method of claim 1, wherein at least one double-stranded adapter that is ligated to the cleaved end of the at least one of the double-stranded amplified target sequences does not include a protecting group.

7. The method of claim 1, wherein the ligating includes contacting at least one double-stranded amplified target sequence having a 3' end and a 5' end with a ligation reaction mixture including one or more double-stranded adapters and a ligase under ligation conditions, wherein none of the double-stranded adapters in the ligation reaction mixture includes, prior to the ligating, a target-specific sequence.

8. The method of claim 7, wherein the ligating includes contacting at least one double-stranded amplified target sequence with a ligation reaction mixture including one or more double-stranded adapters and a ligase under ligation conditions, wherein the ligation reaction mixture does not include one or more additional oligonucleotide adapters prior to ligating the one or more double-stranded adapters to at least one double-stranded amplified target sequence.

9. The method of claim 1, wherein the amplifying further includes a digestion step prior to the ligating, thereby producing a plurality of double-stranded blunt-end amplified target sequences possessing a 5' phosphate group.

* * * * *